United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 31

SEQ ID NO: 129985 - protein, 707 aa, Glycine max
  Coding DNA Sequence Number=SeqID_13207
  Gene Ontology: Mol. function=nucleoside-triphosphatase activity; Cellular component=membrane; Biological process=transport
  Homolog annotation: Hit_ID=Q6K4D1; Match level="QueryCoverage=71%, HitCoverage=69%, E-value=1e-172, Identity=60%"; Hit description =Putative ABC transporter
  Pfam annotation: Domain name=ABC2_membrane; Domain location=275-487; Score=159.5; E_value=8.5e-45; Accession=PF01061.14; Description=ABC -2 type transporter
  Pfam annotation: Domain name=ABC_tran; Domain location=6-173; Score =53.5; E_value=7.1e-13; Accession=PF00005.17; Description=ABC transporter
  Pfam annotation: Domain name=RRM_1; Domain location=508-564; Score =19.6; E_value=0.0022; Accession=PF00076.12; Description=RNA recognition motif. (a.k.a. RRM, R
  Pfam annotation: Domain name=RRM_1; Domain location=612-673; Score =19.0; E_value=0.0025; Accession=PF00076.12; Description=RNA recognition motif. (a.k.a. RRM, R
  Pfam module annotation: Pfam domain module=ABC2_membrane::ABC _tran::RRM_1::RRM_1; Domain location=275-487::6-173::508-564::612-673
MHGRLGSNTRQTGEILINGHKQALSYGTSAYVTQDDTLLTTLTVREAVHYSAQLQLPDTMSKEEKKERADFTIREMGLQDAINTRIGGWGCKGISGGQERRVSICIEILTRPKLLFLDEPTSGLDSAASYYVMRRIATLAQNDHIQRTVIVSIHQPSSEVFQLFNSLCLLSLGKTVYFGPASAATEFFASNGFPCPPLMNPSDHLLKTINKDFDQDIEVGLAGTKSMPTEEVIHILLNSYKSSERNQEVQNEVAVLSKKDTSSLDMKRGNAGFLNQCLVLTKRSFINMYRDLGYYWLRLVIYIALAITLATVFYDLGTSYDSIKDRGSLVAFINGFITFMTIGGFPSFVEVMKVYQRERQNGHYGVTAFVIGNTLSSIPYLLLVTFIPGAISYYLPGLQKGCEHFLYFICVLFSSLMLVESLMMIVASVVPNYLMGIITGSGIQGIMLLLCGFFKLPNHIPKPVWKYPLHYVAFHTYANQGMFKNEYEGLRFASNEVGGGYISGEENLYCLSISPSVRDAKVVTDPNTARSKGYGFVKFSDENERNRAMTEMNGVYCSTRPMRISAATPKKTTGAYGAPAAPVPKPVYPVPAYTSPVVQVQPPDYDVNNTTIFVGNLDLNVSEEELKQNSLQFGEIVSVKIQPGKGFGFVQFGTSFLLMALARQNNYVRPLLTEENLLDIKNGRHVLQEMTIDTFIPNDTKILHDGI

SEQ ID NO: 129986 - protein, 115 aa, Glycine max
  Coding DNA Sequence Number=SeqID_13208
  Gene Ontology: Mol. function=catalytic activity; Biological process =alkaloid metabolic process
  Homolog annotation: Hit_ID=Q94G63; Match level="QueryCoverage=77%, HitCoverage=32%, E-value=5e-19, Identity=60%"; Hit description =Ethylene-induced esterase
TTNEARGSGGAGGGGGGRGGEAEEDLKLAKTLARPASLFIEDLSKQKNFSKEGYGSVPRAYIVCTEDLTIPLEYQLWMIQNAGFNDVLEIKGSVRSYGYALQATRTIRFPPADSD

SEQ ID NO: 129987 - protein, 47 aa, Glycine max
  Coding DNA Sequence Number=SeqID_13209
MWCTTPNRILKGLDSLEGGYKSRNPFSWIKEAETVWENVVPYFVWAS

SEQ ID NO: 129988 - protein, 397 aa, Glycine max
  Coding DNA Sequence Number=SeqID_13210
  Gene Ontology: Mol. function=transaldolase activity; Cellular component=cytoplasm; Biological process=carbohydrate metabolic process
  Homolog annotation: Hit_ID=Q5JK10; Match level="QueryCoverage=69%, HitCoverage=68%, E-value=3e-98, Identity=60%"; Hit description =Putative transaldolase
  Pfam annotation: Domain name=STAS; Domain location=1-63; Score=-0.7; E_value=0.047; Accession=PF01740.11; Description=STAS domain
  Pfam annotation: Domain name=Transaldolase; Domain location=93-383; Score=31.5; E_value=6.1e-11; Accession=PF00923.9; Description =Transaldolase
  Pfam module annotation: Pfam domain module=STAS::Transaldolase; Domain location=1-63::93-383
MAPVTYIDSSVVQALKDLYQEYKLRDIQIAISNPSPEVLLTLSRSGLVELIGKEWYFVRVHDVVQVCLQHVQSLKGASNSPQAPFSSVENKPSLFARLSKERVEKLSITDLESGAGKDIESAYWELVVKDIQDTCKLLEPIYNETDGEDGHVSLAVSPKLANDTNGTIEAAKWLHNMVGSPCVYMKIPATDESISSMKEVISLGISVNATSCGMTDLSKVSSVTTFYISRVDVTLDKKLEQIGTTEALDLKGKGVVAQAVLAYQLYQKKFSGPRWERLENRGAKKQRLMWASTNVKNPSYPDTFYVNSVIGRDTISTFSVQALQAFMDHGILSRTLDAKVSEAQDIYNAIEKLGIDWSSVGLELEHEVLDSFTKSFDNVLECMQKKAMNIYSFQKHV

SEQ ID NO: 129989 - protein, 424 aa, Glycine max
  Coding DNA Sequence Number=SeqID_13211
  Gene Ontology: Mol. function=nucleic acid binding; Cellular component= chromatin; Biological process=DNA integration
MASNNVPLLAPPVFIGKNDEMWVVKMRRQLKAFDLWKAMETTEPPALEENPTVAQIKFHSKQVAKRAKALTILHSVVDDDVLNLKREFEALKMNEAKNIKDFMTRLMKPKDLNLMSNEKASEFEQWNHSMKEMTTIEDNNTWQLVDKLEDKNSIGVKWVYTLNLNGSIDYVETFSPVTKMNTIRILVALAAEMKWKIWHLDVKSAFLNRNLTEEIYKQAPRAWYNNIDAYFSSQGFRSENDATLYVKRLLDGGSLIVSVYVDDFLMSSNNQQEVQQLIYAYEILKKFRMKSCKFVPTPSVQNLKLSKDDGAEKMGDSLYRNVIGSLLYLTSSRPDLTYAASLLSTFMKSLSVLHFVVAKRALKYLKLNLESGLNPMKMEDIVTQSTAEAEYAAAAAATNQAIWLKKIMFDLGVEKMDATEIYCD

SEQ ID NO: 129990 - protein, 157 aa, Glycine max
  Coding DNA Sequence Number=SeqID_13212
  Gene Ontology: Mol. function=catalytic activity; Biological process =alkaloid metabolic process
  Homolog annotation: Hit_ID=Q8LCI0; Match level="QueryCoverage=77%, HitCoverage=47%, E-value=4e-40, Identity=60%"; Hit description =Putative acetone-cyanohydrin lyase
MSSKNSIDRKPKHYVLVHGACYGAWLWYKLKPRLESAGHKVTVLDLAASGTNMKKIEDVDTFSQYTEPLLQLMATIPPNKKVVLVGHSLGGLNIALAMEKFPEKVAVGVFVTAIIPDIEHKPSYVLEKPPKLRPPVTFPPSIVAPTGGGLLHQAGGA

SEQ ID NO: 129991 - protein, 151 aa, Glycine max
  Coding DNA Sequence Number=SeqID_13213
  Gene Ontology: Mol. function=calmodulin binding; Cellular component =integral to membrane; Biological process=response to biotic stimulus
  Homolog annotation: Hit_ID=Q94KB7; Match level="QueryCoverage=94%, HitCoverage=25%, E-value=2e-24, Identity=46%"; Hit description=MLO -like protein 6
  Pfam annotation: Domain name=Mlo; Domain location=7-151; Score= -249.9; E_value=3.1e-07; Accession=PF03094.6; Description=Mlo family
MAEKTQVYERTLEETPTWAVAVVCFVLLAVSIVIEHIIHGIGKWFKKKHKNALFEALEKVKGELLLLGFLSLLLTVLQDEISKICVSKNVASTWHPCANPKAPKTSQSEDESEDFQINSRKLLQFYDLVPRRVLATKGYDKCDEKASRASS

SEQ ID NO: 129992 - protein, 281 aa, Glycine max
  Coding DNA Sequence Number=SeqID_13214
  Gene Ontology: Cellular component=integral to membrane; Biological process=autophagy
  Homolog annotation: Hit_ID=Q9C7C1; Match level="QueryCoverage=99%, HitCoverage=95%, E-value=1e-107, Identity=64%"; Hit description =Senescence-assocated protein, putative; 28418-29806
  Pfam annotation: Domain name=Tetraspannin; Domain location=4-242; Score=207.6; E_value=2.9e-59; Accession=PF00335.10; Description =Tetraspanin family
MQRFSNTVIGFLNFFTLLASIPIIGAGLWMARSTTTCENFFQTPLLVIGFVVLVISLAGFIGACFHVAWALWVYLVIMVFIIAALLGFAVFGFVVTEQGGGVEVPGRAYKEYRLDRYSPWLRNRIKDPQYWSTIRSCILGSNTCAKLAFWTPLDYVQRDMSPIQNMHVFNCVCQSGCCKPPTGCSYNEETVVVTQDPDCYRWNNAPTLLCYDCDSCKAGVLENIRRGWHNISVLNVVVLVFLIGIYSIAFCAFRNARRAQTDYPHGVNRMTKVKPRWDYYW

SEQ ID NO: 129993 - protein, 195 aa, Glycine max
  Coding DNA Sequence Number=SeqID_13215
  Gene Ontology: Mol. function=calmodulin binding; Cellular component =integral to membrane; Biological process=cell death
  Homolog annotation: Hit_ID=Q56BA4; Match level="QueryCoverage=97%, HitCoverage=43%, E-value=3e-44, Identity=44%"; Hit description=MLO1
  Pfam annotation: Domain name=Mlo; Domain location=1-124; Score= -322.1; E_value=0.00048; Accession=PF03094.6; Description=Mlo family
MGLRIQDRGEVFKGAPVVEPGDDLFWFNRPRFLLFIIHLVLFQNAFQLAHFAWSTMASTMKPTIFNDRVAAALKKWHHTSKKHVKHRKHSEGNNATPFSSRSSTPTFGMSPIHLLHRHLAGRSESAQTSPRISNYENEQCDVDGEASTSYHPGTDDTQMQVLGPHSTTELRISTKHDINFSSSEFSFEKRNTRGD

SEQ ID NO: 129994 - protein, 121 aa, Glycine max
  Coding DNA Sequence Number=SeqID_13216
  Gene Ontology: Mol. function=serine carboxypeptidase activity; Cellular component=cellulose and pectin-containing cell wall; Biological process=proteolysis
  Homolog annotation: Hit_ID=Q9SFB5; Match level="QueryCoverage=67%, HitCoverage=17%, E-value=1e-26, Identity=68%"; Hit description =Putative serine carboxypeptidase II
MSGDTDSVVPVTASWYSIRALNLSTIINWILSFMYEEVGGWSQVYEGLTLVTVRGAGHEVPLHKPRQGFTLFKSFLENKNMPLPIDSKLSGPTQSLNKNIRLARPIRKITMPSSVQGFFTY

SEQ ID NO: 129995 - protein, 119 aa, Glycine max
  Coding DNA Sequence Number=SeqID_13217
  Gene Ontology: Mol. function=catalytic activity; Biological process =alkaloid metabolic process
  Homolog annotation: Hit_ID=Q6RYA0; Match level="QueryCoverage=87%, HitCoverage=52%, E-value=3e-17, Identity=41%"; Hit description =Salicylic acid-binding protein 2
MGQCFSGGVWVLLESTLATNLLDSEFSKSGNKTIVVFGPKFLSNKLNQASTIEGYGSVPLAFIVSTEDQEIPLNFQHWMIQNAGINVEVLEIKGADHMLMISKPQELCDSLLQIATKYA

SEQ ID NO: 129996 - protein, 66 aa, Glycine max
  Coding DNA Sequence Number=SeqID_13218
  Gene Ontology: Mol. function=nucleoside-triphosphatase activity
  Homolog annotation: Hit_ID=Q6K4D2; Match level="QueryCoverage=77%, HitCoverage=7%, E-value=4e-13, Identity=61%"; Hit description =Putative ABC transporter
MEAFRCPRKINREEGICLTWKDVWVAASNRKSGSISILKGLTGYAKSGQLLAIMGPSGCGKSTLRT

SEQ ID NO: 129997 - protein, 163 aa, Glycine max
  Coding DNA Sequence Number=SeqID_13219
  Gene Ontology: Cellular component=nucleus; Biological process=cell division
  Homolog annotation: Hit_ID=Q9LME2; Match level="QueryCoverage=60%, HitCoverage=11%, E-value=7e-19, Identity=42%"; Hit description =Synaptonemal complex protein 1
VTQMKQEHHKRQASLIAEHNEQLKRTQLQAENEYREKTMFMRNDHEAQIKALRCELEDECRKLEEELHLQKSKEDRQRALLQLQWKVMSDKPKEDQEVNSKHVDLCFNLFVCDCLQMDAIFANFHVGIPLSIKGGGHPHPSNIGDLFLEGSLNPYAEDPYAFD

SEQ ID NO: 129998 - protein, 357 aa, Glycine max
  Coding DNA Sequence Number=SeqID_13220
  Gene Ontology: Mol. function=nucleoside-triphosphatase activity; Cellular component=membrane; Biological process=transport
  Homolog annotation: Hit_ID=Q6K4D2; Match level="QueryCoverage=94%, HitCoverage=47%, E-value=1e-100, Identity=53%"; Hit description =Putative ABC transporter
  Pfam annotation: Domain name=ABC2_membrane; Domain location=57-269; Score=174.1; E_value=3.5e-49; Accession=PF01061.14; Description=ABC -2 type transporter
DPEKGLAGGLSTEEAIHVLAKSYDSSKICHQVQKEIAQTKKRDSDTMDEKCHADFFTQCLILTRRSFVNMYREVGYYWLRLLIYGALALSLGTMFFDIGSSSESIQARGSLLVFVVTFLTFITVGGFPSFVEEMKVFERERLNGHYGVTAFTIGNTLSSVPFLLLMSLIPGALVYYLVGLHQGHEHFVYFIFMLFTSVFLVEGLMMIVASMVPNFLMGIIVGSGILGIMMLDGGFYRLPSDIPKPFWRYPLHYISFHKYAYQGLFKNEFQGLTFPSNQVGAHMTIHGEHILRHIWQMEVNYSKWVDVGILVGMAVLYRILFLVIIKSFEKVKPISSALNCPQTNFGLTKVTRSSEID

SEQ ID NO: 129999 - protein, 313 aa, Glycine max
  Coding DNA Sequence Number=SeqID_13221
  Gene Ontology: Mol. function=nucleoside-triphosphatase activity; Cellular component=integral to membrane; Biological process=transport
  Homolog annotation: Hit_ID=Q6K4D2; Match level="QueryCoverage=99%, HitCoverage=68%, E-value=2e-52, Identity=41%"; Hit description =Putative ABC transporter
  Pfam annotation: Domain name=ABC2_membrane; Domain location=87-274; Score=-32.6; E_value=0.055; Accession=PF01061.14; Description=ABC-2 type transporter
MGLQDAINTRIGGRGSKGASGVQLPTRRIATLAQNDHIQRTVIASIHQLSSEVFQLLNNLCLLSSGKTVYFGPASAANERGHAGFFNQCLVLTERSFANMYRDLGYYWLQFAIFVALAIALATIFCDLGTSYGSVQDPGSLIAFINGFLTFMTIGGFPSFVEVMKVFQRERQNGHYVDSLMMIVASVVPNFLMGIMTGAGIQGIMLLLDGFFKLPRMFKNEFEGLRFASNEVGGGYISGEDILRNTWQVDTSYSKWVDLAILIGMIVVYRVLFLVIIKIKEKMKPVVVSLSCMSASSKRTIQVMENPNATPLH

SEQ ID NO: 130000 - protein, 161 aa, Glycine max
  Coding DNA Sequence Number=SeqID_13222
  Gene Ontology: Mol. function=calmodulin binding; Cellular component =integral to membrane; Biological process=cell death
  Homolog annotation: Hit_ID=Q56BA4; Match level="QueryCoverage=97%, HitCoverage=29%, E-value=2e-39, Identity=57%"; Hit description=MLO1
MGVVIQFLCSYVTLPLYALVTQMGSTMKPTIFNQRVASALKNWHNTAKKHVKNSKHTTPFSSRPSTPQYGMSPIHLLHRHLAGRSESAQTSPRTSNYENEQWDVEGSPSPSHHAVAAEETQMQVFEPGSSSAPELPISSQLDIRVSSSEFSFEKRHTAESD

SEQ ID NO: 130001 - protein, 309 aa, Glycine max
  Coding DNA Sequence Number=SeqID_13223
  Gene Ontology: Mol. function=nucleoside-triphosphatase activity; Cellular component=membrane; Biological process=transport
  Homolog annotation: Hit_ID=Q6K4D2; Match level="QueryCoverage=84%, HitCoverage=35%, E-value=7e-94, Identity=64%"; Hit description =Putative ABC transporter
  Pfam annotation: Domain name=ABC_tran; Domain location=85-277; Score =112.5; E_value=1.2e-30; Accession=PF00005.17; Description=ABC transporter
MSCLLQPNASDCEPNNSSKILPPLSEFETSFEVEKIKSVETGKDGEEDQEEGVFLTWEDLWVTVSNGKNGRKPILQGLKGYAKPGKLLAIMGPSGCGKSTLLDALAGRLGSKTKQTGKILINGRKQALAYGASAYVTEDDTILTTLTVKEAVYYSAYLQLPDSMSKSEKQERADFTIREMGLHDAINTRIGGWGSKGASGGQKRRVSICIEILTHPRLLFLDEPTSGLDSAASYHVMSRISNLNKKDGIQRTIIASIHQPSNEIFQLFHNLCLLSSGKTVYFGPTSAANKFFSSNGFPCPSLHSPSDHF

SEQ ID NO: 130002 - protein, 110 aa, Glycine max
  Coding DNA Sequence Number=SeqID_13224
MEVLKKLFVADLFTNNKLFRNYSDQGFTNMDEMMCWTLFVDDYALLHVLEHAKLHDPGSMNVKVEQLILVIQDVVLLENQLSFLLLKLLWRDTDEWMLIRTMEEFLSCHH

SEQ ID NO: 130003 - protein, 469 aa, Glycine max
  Coding DNA Sequence Number=SeqID_13225
MCEECGGGHQTSKCTKVPTEEGDNKPQQRPNLWDHTAKLEEALTKLIEVVITNYKNTEVAIKSMETQIGPLAKQLQNSSIGFSVAIKENPKVKKKKMSKLSIHKQEDCERMAKFEKYMEMLQGKKEEPPIEKLTWDVLHQPYQRTAHLEHHVLVVQGGGEAAMARPGELGCFHQKAPPSFGTFRKAENVVKLYGLRNNACFVGSEGSKQDDEGKTCKDFQNNQHRTTNIIPILPDMFALVDEGVDNHEVRITIRYLHMSSDLPSLDDKGADDDVRITIRYFRMSSDLPSLDDKGANDDVQITIRYLRVSSDLPSLDDKGADEDSRPEDADISRKGAYDNVQITIRYLRISSDMLSQDDKGADDDLKKGADNNKVSPHVIRLVVSDDKSADDDMTTLVTACYQTLESQLQKSQPEDSDISRKGADDHIGVCLSIGLGDGVVDKSGAFAPTYPQFEMRNSDYVVVAFVRLK

SEQ ID NO: 130004 - protein, 64 aa, Glycine max
  Coding DNA Sequence Number=SeqID_13226
DSGAFGKKKKTHAAFITQCLILIRRASLQTYRETNNYRARLIVFIVISLSVGSIFYHPDLRSIM

SEQ ID NO: 130005 - protein, 127 aa, Glycine max
  Coding DNA Sequence Number=SeqID_13227
MGCAKISLIMISKCLLHPKASSVITERHPKKLGMRFVEHEWIMARVPPAVNMGQMKEEAEDEAHQEPVYQWGPSESLMIQKMDAMFHHHQEHSADVHSTLENITTRLESIGTRLTLSNLFNPNEDEA

SEQ ID NO: 130006 - protein, 245 aa, Glycine max
  Coding DNA Sequence Number=SeqID_13228
MVHEFSKLGAYFSFSGFLMSLKASKAKKMLKMVPPDRILLETDAPDALPMSNIDSLYFVEGDTSLTEELLAQTTTSSTSGSSLGNSSHVLADASMLPKETLNHPANIHNVLDYVASMLEITKEELAELSYQNAVRLLSYEGGEESTSALRLVASKALKVSTYGTIHDFRLTGFPSDTLWRTQRRMPLRWAISTKNLEATLVVVNVVGNAMRVPILSEDNTNSHSKCIYFDLKGQFKVRQHEHWSS

SEQ ID NO: 130007 - protein, 122 aa, Glycine max
  Coding DNA Sequence Number=SeqID_13229
GPGVSSSGYGPLSVLQGACPPSKESHPQRHPVDPEKSNRALGFPALVTGLCSPTGCPFPPARSRHHDIARSSGPPTNRAFIKKYCVPRQAQGETPQQPGDGRQQATDAPPSPLEFTSDHPKK

SEQ ID NO: 130008 - protein, 322 aa, Glycine max
  Coding DNA Sequence Number=SeqID_13230
  Gene Ontology: Mol. function=protein transporter activity; Cellular component=membrane; Biological process=intracellular protein transport
  Homolog annotation: Hit_ID=Q9SML5; Match level="QueryCoverage=99%, HitCoverage=100%, E-value=1e-118, Identity=70%"; Hit description =Knolle
  Pfam annotation: Domain name=DUF827; Domain location=21-216; Score= -110.4; E_value=0.033; Accession=PF05701.2; Description=Plant protein of unknown function (DUF827)
  Pfam annotation: Domain name=SNARE; Domain location=229-291; Score =87.0; E_value=5.9e-23; Accession=PF05739.9; Description=SNARE domain
  Pfam annotation: Domain name=Syntaxin; Domain location=52-160; Score =80.0; E_value=7.6e-21; Accession=PF00804.15; Description=Syntaxin
  Pfam module annotation: Pfam domain module=DUF827::SNARE::Syntaxin; Domain location=21-216::229-291::52-160
MNDLMTKSFTSYVDLKKAAMKEDVDLEAGVVVSSATPRNVELTSSTTHLDTDMGLFLEEAEKVKAEMGSLRDILGRLQQANEESKSLHKPEALKVLRARINADIVAVLKKARAIRAQLEEMDRANAANRRLSGLKEGTPAIYRTRIAVTNGLRKKLKELMMEFQGLRQRMMSEYKDTVGRRYFTVTGEHPDEEVIEKIIANGNEEEVLGKAIQEHGRGKVLETVVEIQDRHDAAKEVEKSLLELHQVFLDMAVMVEAQGEKMDDIEHHVLHASHYVKDGTKNLQSAKEYQKKSRKWMCIGIILLLILILFIVIPVVTSLSSS

SEQ ID NO: 130009 - protein, 72 aa, Glycine max
  Coding DNA Sequence Number=SeqID_13231
MAFVDNWAVGKEETHIDPFTGKDQIRKALKVPLELPGSPPLGVFFERFVPPFCTLFVVASYPEPYQNCTDAA

SEQ ID NO: 130010 - protein, 110 aa, Glycine max
  Coding DNA Sequence Number=SeqID_13232
MACIADKIKTIDGSKETLKLAVRITDLWFVGTPGRSEQAEKIIVDSDGDQIHVVCKQDQLKAWKMDLKEDIIAGQLQFDLLVDIIGVVDEVVFRHISPRSKRVVFKLMNL

SEQ ID NO: 130011 - protein, 67 aa, Glycine max
  Coding DNA Sequence Number=SeqID_13233
MSSPSHLNAQPLVWGHGPRTFEVFLEPTCPFSVRAFNKLDELLDEVGAENVTIKIRLQSQPWHLFPG

SEQ ID NO: 130012 - protein, 123 aa, Glycine max
  Coding DNA Sequence Number=SeqID_13234
  Homolog annotation: Hit_ID=Q2QWE5; Match level="QueryCoverage=97%, HitCoverage=71%, E-value=1e-15, Identity=39%"; Hit description =Expressed protein
MTNWFAIETTTTLGALEEILDTKISGSDSNREVNIVPLTRDLDDVEPKEQDFDGDTFEIIKPALGDDTRDGGFVLEHVGLYVEASRFLEIRCELAVVSVKRIPYGSLGKKTHREPILHQNIIG

SEQ ID NO: 130013 - protein, 176 aa, Glycine max
  Coding DNA Sequence Number=SeqID_13235
  Homolog annotation: Hit_ID=P93653; Match level="QueryCoverage=22%, HitCoverage=4%, E-value=4e-09, Identity=71%"; Hit description =Trehalose-6-phosphate synthase
MKRVANITLMADTYGFRAPTYQRGKYEALKLKKLQDQHGESLSWTDYLSLPFSQTNIKEYDIWLAAENEMFLNPSKGEWMTTMPEQLNMEMVDNFLVARLTHITLKREAWVTSSALIPVVAGVVIASGRYVNVASCSLCHSRSGVVVDRLGGGGRARLSLIWIHYVPKIASFASNK

SEQ ID NO: 130014 - protein, 84 aa, Glycine max
  Coding DNA Sequence Number=SeqID_13236
MSKTIMLPPFSIIFSSPTYIHKETCFRCRSLKEIKNYEKYGSPPRRHKVKTQAKEESNDKTKNETEYWLKFTDNYKLMSRTESD

SEQ ID NO: 130015 - protein, 48 aa, Glycine max
  Coding DNA Sequence Number=SeqID_13237
MSARAVREKWWRERWSSAARQALETTRMEREERSEKSTVKDVTEAGRE

SEQ ID NO: 130016 - protein, 194 aa, Glycine max
  Coding DNA Sequence Number=SeqID_13238
MGGEQIGEVRDHSSLFSAIKTRFVGYSVDRNSWISIRPITRWESHKLAKMHGNCLQESPKSNKICINKNEILENTILGQTARPNTLKNLRKRDVARRRPLSSWNMEMQEILWVKAHEPPLLWVVQFDDEVEDMSTLMEEDRRCSLISASFQHVGQFFTLRARAIQGGGNAAALSGKDSLDLVVIKRKLKDNFII

SEQ ID NO: 130017 - protein, 236 aa, Glycine max
  Coding DNA Sequence Number=SeqID_13239
  Homolog annotation: Hit_ID=Q00M79; Match level="QueryCoverage=17%, HitCoverage=5%, E-value=4e-10, Identity=76%"; Hit description =Expressed protein-like protein
MDIINISFKYERLCNFWYGCESLDHQLKVCHMQDESYDEEDVDNLPFGCGDTTKKVGSRIKEEYRARLSQRTESMEYGEIEEESLEPHKSKESPYEMLCNNKNSVENIVTDMLSIKKDCKPKKLLRDLELNGFAEQNNDSGGPTVSRMAHALWPPLRIASSFPQGNVIAVFGEMRVKLFSIVFDSISQSPELTLIHLLPKFGHSVLDVCFLKDVATIQFTFGIFLTLIWFLRFNLQ

SEQ ID NO: 130018 - protein, 349 aa, Glycine max
  Coding DNA Sequence Number=SeqID_13240
  Gene Ontology: Mol. function=3'-5'-exoribonuclease activity; Cellular component=exosome (RNase complex); Biological process=RNA processing
  Homolog annotation: Hit_ID=Q2QT85; Match level="QueryCoverage=78%, HitCoverage=96%, E-value=1e-120, Identity=80%"; Hit description=3' exoribonuclease family, domain 1 containing protein, expressed
  Pfam annotation: Domain name=RNase_PH; Domain location=92-232; Score =101.1; E_value=3.3e-27; Accession=PF01138.11; Description=3' exoribonuclease family, domain 1
  Pfam annotation: Domain name=RNase_PH_C; Domain location=262-328; Score=13.8; E_value=0.083; Accession=PF03725.5; Description=3' exoribonuclease family, domain 2
  Pfam module annotation: Pfam domain module=RNase_PH::RNase_PH_C; Domain location=92-232::262-328
MVANGGKHATKMNIVLRMPIENGFNVINKTIFLSYSNNLDNRIVHNTYYFRIYEISQNSCFAGMVGLSLGETHFIQGGIAQDLRCDGRKRLTYRPISVETGVIPQTNGSARVRMGATDVIASVKAELGKPSLLQPDKGKVSIYVDCSSTAEPAFEGRGGDELAAELSNALQRCLLGGKSGAGAGIDLSSLIVVEGKICWDLYIDGLVVSSDGNLLDALGAAIKAALSNTGIPRVQVAAGTSNDEHPEVDVSDEEFLQFDTSRVPVIVTLTKVGRHYIVDATSEEESQMSSAVSISVNRQGHICGITKRGGVGLDPSIILDMISVAKHVSEQLINKLDSEIASAEAEEES

SEQ ID NO: 130019 - protein, 319 aa, Glycine max
  Coding DNA Sequence Number=SeqID_13241
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94EN5; Match level="QueryCoverage=94%, HitCoverage=60%, E-value=1e-139, Identity=76%"; Hit description=Beta- 1,3-glucanase
  Pfam annotation: Domain name=Glyco_hydro_17; Domain location=1-167; Score=-28.1; E_value=2.3e-09; Accession=PF00332.9; Description =Glycosyl hydrolases family 17
  Pfam annotation: Domain name=X8; Domain location=182-267; Score =178.9; E_value=1.2e-50; Accession=PF07983.3; Description=X8 domain
  Pfam module annotation: Pfam domain module=Glyco_hydro_17::X8; Domain location=1-167::182-267
MVPLLNFLQSTGSYLMLNVYPYYDYMQSNGVVPLDYALFRPLPPNKEAIDSNTLLHYTNVFDAIVDAAYFAMSYLKFTNIPILVTESGWPSKGDSSEPDATVDNANTYNSNLIRHVLNNSGTPKQPGIAVSTYIYELYNEDLKSGPVSENNWGLFYASGAQVYTLHLTNSGTVFANDTTNQTFCVAKSNADSKMLQAALDWACGPGKVDCSPLLQGQSCYEPNSVASHATYAINSYYQQMAKSAGTCDFKGVASITTTNPSHGSCIFSGSGGKNVTSVNGTALAPSTNSTNSGCLSQYYNGGFFTSTVILTLILSVVVL

SEQ ID NO: 130020 - protein, 273 aa, Glycine max
  Coding DNA Sequence Number=SeqID_13242
MLQVQEAKNKLDVPKDAEEKLCDETKGHKLDITSDRDVQILDDTKSNRRSGTSTMGDEAIKLSGSNRRPHSEITKNSKRGNAKANMETDNLDSVQEPKSETQLNTVPRKRGRNKTWEISQSRKACNCSSPYPSSEKPTSRKDKLHRMPKTVSETLVCMQKSENIAKAVQSRRTQNIGTDFLANDTSKVHEALASKPKADENTNAASVNNNYPDAGAISIRATSSQYTSSLSCRDVKRLGSSWVGQARCKGRTMKNKARVRVGLAVKVQRKKEE

SEQ ID NO: 130021 - protein, 70 aa, Glycine max
  Coding DNA Sequence Number=SeqID_13243
MTLSLKSTYIHKETHFRCRSLEEIKNYKKYGSPPRCHKVKIQDKEESNDKTRSETKFTDNYKLMNRTESD

SEQ ID NO: 130022 - protein, 54 aa, Glycine max
  Coding DNA Sequence Number=SeqID_13244
MFDSVLCFRKQALEQEQGQNLIGMGGTRQAKKSKWKHITKLAVRVGQNTYIEQV

SEQ ID NO: 130023 - protein, 166 aa, Glycine max
  Coding DNA Sequence Number=SeqID_13245
  Gene Ontology: Mol. function=beta-galactosidase activity; Cellular component=beta-galactosidase complex; Biological process =carbohydrate metabolic process
  Homolog annotation: Hit_ID=Q1RTL3; Match level="QueryCoverage=87%, HitCoverage=22%, E-value=4e-27, Identity=38%"; Hit description=D -galactoside/L-rhamnose binding SUEL lectin; Galactose-binding like
MVLRKPRISPQTVWSHKVGLHGENMKFYSPGITEGWFANGLPTDKIFMWYKTTFRTPIGTDPVVLDLKGSGKGQAWVNGNNIGRYWTSYLAGTMSQTHFFVMVRITHWFCLKNPFEVKIASVTIAKACAKAYEGHALELACKENQVISEIKFASFGVPKLCLGKQK

SEQ ID NO: 130024 - protein, 181 aa, Glycine max
  Coding DNA Sequence Number=SeqID_13246
  Gene Ontology: Mol. function=RNA-directed DNA polymerase activity; Biological process=RNA-dependent DNA replication
MENKSIYGPWLLVKKNFRKKPMVGGSTRVGAISIPRKVDPESKGATKSKELWGMFKELTSDINSPWALLGEFNSTLHVHEMCGGVVNPSLRGILGFQGVLNGCELIDAGFQGYPFTRKRGNLEQRLDKMLINLQWRLLFQDAIVLHLSPFKSDHRPLLVKFCANYSKNSHRRGLFTFWPLG

SEQ ID NO: 130025 - protein, 99 aa, Glycine max
  Coding DNA Sequence Number=SeqID_13247
MNLVGRRISEEGGSLVQEGRRRLRKMIVSEVLVDHEGHKSRADFVHSERLCRVGFDCLRRRFGISSNEKEKKECDDRSMRVAHFRKESCDAFTLSFIIL

SEQ ID NO: 130026 - protein, 259 aa, Glycine max
  Coding DNA Sequence Number=SeqID_13248
  Gene Ontology: Cellular component=chloroplast
  Homolog annotation: Hit_ID=Q8W4A5; Match level="QueryCoverage=78%, HitCoverage=62%, E-value=2e-25, Identity=53%"; Hit description=APO protein 2, chloroplast precursor
  Pfam annotation: Domain name=DUF794; Domain location=38-259; Score =36.3; E_value=3.1e-17; Accession=PF05634.2; Description=Arabidopsis thaliana protein of unknown function (DUF794)
  Subcellular localization annotation: CTP_CleavageSite=51; ConfidenceScore=5.02e-01
MTKGITPRDYSLLLKPSPLSSLGLLHSLQHGNSRIRVPVTIRIQPERFCHRAPTVTNEVPQNADFPQHYSRKEKKPFPVPIVELRRAARERMKKMKDEPRKSMSAPKNGLLVKSLVLTAYNVYNTRITLINNLKKLLKVVPVHALVVELCIQAGVEIPEFPTKRRRKPIIRIGRKEFIDADESDLPDKISEGPLKPLPAETPDSEIVAPLDNEVVPLAVETILAWERTRKGAKRLMRLYNVSVCGYCPEIHVGSQDHKA

SEQ ID NO: 130027 - protein, 88 aa, Glycine max
  Coding DNA Sequence Number=SeqID_13249
  Subcellular localization annotation: CTP_CleavageSite=64; ConfidenceScore=5.36e-01
MSFGVSLSNESNIKKLSNHLQNIMSHNSKIRGVLLGAPSIFASAFVPPVSVVVVFFVGISLCDRAAMGVDYPSQVDGGSAASARRHCR

SEQ ID NO: 130028 - protein, 131 aa, Glycine max
  Coding DNA Sequence Number=SeqID_13250
  Gene Ontology: Mol. function=nucleic acid binding
  Homolog annotation: Hit_ID=Q8S8M1; Match level="QueryCoverage=77%, HitCoverage=8%, E-value=1e-16, Identity=42%"; Hit description =Putative retroelement integrase
MKQFMRKTFLPPSYKRYAYDRLQSLTQGSKNIDGYHKEMTMTMRRANVQEPKTAMARFLRGLNRDIQCIVKFQHYESLESMVHQAKKVKRQLKRKHSYKKTYHYDSFSGKDKSKKEGSSPSRQQGSKRMHW

SEQ ID NO: 130029 - protein, 180 aa, Glycine max
  Coding DNA Sequence Number=SeqID_13251
  Gene Ontology: Mol. function=nucleic acid binding; Biological process= DNA integration
  Homolog annotation: Hit_ID=Q47522; Match level="QueryCoverage=23%, HitCoverage=53%, E-value=3e-19, Identity=100%"; Hit description=LacZ protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDMFDQDSITDYFNRVQMLVNGMKTCKEELIDQQLVDKVLRTLTPRFDHVVVVIEESKDLDSMKVEELQNSLEAHE

SEQ ID NO: 130030 - protein, 171 aa, Glycine max
  Coding DNA Sequence Number=SeqID_13252
MMDYIAIKITTCPSNFTAQNYPCHVMKLLPEDHRDYPCLFNDEYESWDVQGNTQYQYSLMRAQIQGYQWFFSESDKHEFDLIKETHDTKLFLPLYNGKFFIPFPVDHNNKLVQFFQKEKKDKEIYEANGCHGQQTPPFPSTDLSMKDSSDIFCYGNIQDKEDVTVTKSTKN

SEQ ID NO: 130031 - protein, 107 aa, Glycine max
  Coding DNA Sequence Number=SeqID_13253
  Gene Ontology: Mol. function=carboxypeptidase activity; Biological process=proteolysis
MTMVLELLKDAFENAKIPTSFYEAKKVIYKLGLNYTKIDVCPKSCMLYWEEDENLQICKHCRKSRWKAKEPRNVRLGLASDGFSTCRTMNNKHTIWSVLLIPYNRPP

SEQ ID NO: 130032 - protein, 48 aa, Glycine max
  Coding DNA Sequence Number=SeqID_13254
MRQALNTFLPWPIHLVKRLSEQGVVGLAKPADRPDDEVVVGCYLVWPV

SEQ ID NO: 130033 - protein, 255 aa, Glycine max
  Coding DNA Sequence Number=SeqID_13255
  Gene Ontology: Mol. function=hydrolase activity
  Homolog annotation: Hit_ID=Q21WZ9; Match level="QueryCoverage=94%, HitCoverage=54%, E-value=3e-32, Identity=31%"; Hit description=Metal dependent phosphohydrolase
  Pfam annotation: Domain name=HD; Domain location=179-250; Score=2.0; E_value=0.027; Accession=PF01966.12; Description=HD domain
MPNHASDTYYIDIEQIQIGLYIHLDLGWMDHPFSVSNFKITDESQIETIRSLGLQQLRYDPRRSSSTPLRSSRGGGNYNVVDFPFKKDFSSRLGIIDDTPALSPAQKKQLALKHAITESEQKFLQTSAEVRNLQKLSVEHPDQAFGLASNLVQDLVTSTLTEGDIAIHAMNGHRIGDQYYQHELNILVLSMLLAKNLNISDEDAVILGMAAILHDIGKRQISDKILLKKEPLTARETAIYQTHVILGMNMLKDVP

SEQ ID NO: 130034 - protein, 86 aa, Glycine max
  Coding DNA Sequence Number=SeqID_13256
MGAKYLEVVERGSHPNNGWSPDEIRTQNDHNLSLRVVGHNRAWAARHRITIICLCVPLDTIASAWRKGARNEHNLSSPTSRLIVLE

SEQ ID NO: 130035 - protein, 58 aa, Glycine max
  Coding DNA Sequence Number=SeqID_13257
  Subcellular localization annotation: CTP_CleavageSite=49; ConfidenceScore=5.08e-01
MASLLCESHVAWKPPVVMAIQAQVQVASSSGEFGHRFPVSLFRGRHVVVAFPEGTFFR

SEQ ID NO: 130036 - protein, 239 aa, Glycine max
  Coding DNA Sequence Number=SeqID_13258
  Gene Ontology: Mol. function=RNA-directed DNA polymerase activity; Cellular component=intracellular; Biological process=RNA-dependent DNA replication
MRPHQEETELVDLGAGSERKEVKVGIGMTPPPPIREEFVALPRDYHDAFAWLYQDMPSLSHDIVKHRLPLNSGYSLVKQKLRRMKPRMLLKIKEEVKKQFDAGFLAVARYPEWVANIVPVPKKDGKVRMCVDYRDLNRASPKDKFPVPHINVHVDNTTNFALFFFMDGFSGYNQIKMVPEDMEKTTFVTLWGTFCYKVMSFGLKNTGALFHDMMHREIEIYVDNMIAKFKTEEEYLVNL

SEQ ID NO: 130037 - protein, 77 aa, Glycine max
  Coding DNA Sequence Number=SeqID_13259
MTSQQAANHRGQSQDLSPFPWPTPEQFEATVAWPGDKTDFKTQAGPTGALGMTKELRRITTWLTCWTSSLDKAELHD

SEQ ID NO: 130038 - protein, 113 aa, Glycine max
  Coding DNA Sequence Number=SeqID_13260
MAPKKLSTKRSRKDATGEGSSVAPQADMDFDRHRFWSTEHQQWFEAIKGWSFLRERRVQLRDKEYVEFQEEIARRQWAQLVSPMAKFDPEIVIAYRRRSQRHALLGEGPVDSL

SEQ ID NO: 130039 - protein, 145 aa, Glycine max
  Coding DNA Sequence Number=SeqID_13261
MIPPLEAAVAHLLQLLLVFLWLLGCLTRHLPGHTVLLNESPVNRRLNELGGGDLHSIELTEACDESKKPFGSTGYLRGVIPANWGRFELWLLGKMLLSSNVIHICVMVVMLVRMIRTRSRRPDSSFGRTHSAGLPPKPANAPETD

SEQ ID NO: 130040 - protein, 103 aa, Glycine max
  Coding DNA Sequence Number=SeqID_13262
MVWRLLSSLLLLHSAAINLQEAKDSIDEEDLWPTSSTWSYISEGSQGVFKDCKGITRIVENLKWFTWTWTREVVELVILARALEAKNQQKVLEGEIVEIEDKS

SEQ ID NO: 130041 - protein, 118 aa, Glycine max
  Coding DNA Sequence Number=SeqID_13263
  Gene Ontology: Mol. function=unspecific monooxygenase activity
  Homolog annotation: Hit_ID=O04892; Match level="QueryCoverage=98%, HitCoverage=27%, E-value=3e-32, Identity=61%"; Hit description =Cytochrome P450 like_TBP
  Subcellular localization annotation: CTP_CleavageSite=50; ConfidenceScore=5.50e-01
SPRLTASGRWNNVGKGSRQNGSVTSGKGLALRAGHGGPSPEPVGCRWTARAASAARAGRRVPVGGRIGNGPFGASSPGVEQSTQNCALNVKVKKFNQARVVLAGSNYDSLKVAKCLVI

SEQ ID NO: 130042 - protein, 239 aa, Glycine max
  Coding DNA Sequence Number=SeqID_13264
  Gene Ontology: Mol. function=transporter activity; Cellular component= integral to membrane; Biological process=transport
  Homolog annotation: Hit_ID=Q1XPK4; Match level="QueryCoverage=99%, HitCoverage=34%, E-value=1e-37, Identity=47%"; Hit description =Hydrophobe/amphiphile efflux-1 HAE1 precursor
GPAGVFYRQFAFTLVIAILISAVNALTLSPALCALFLKDPQDGEHVNTPPGSSLDRTQRATKQIDKIVNGEKATNHLWVADGVNFISNANASPYSAGFIKLKDIDKRGDVKDPDQIAAGLTGKVSQVKDASAFFFNFPTIQGFGNLGANTQAFIGELMKRKEIAFAFTTYAAGNPQYTIEVDADKANQLGVSVTDLMQTMQIYFGSSFVSDFNRFGRNGSYQNISNLEKDFRAGNRNKK

SEQ ID NO: 130043 - protein, 150 aa, Glycine max
  Coding DNA Sequence Number=SeqID_13265
MVDQEETQEQMKADMSALKEQMASMMEAIPNWVAYPYGLPPNYTPPIMHDDAGHVSSPILEGETPRQPDEVHKDHRELWYYPFTDMMILCLIPDVVIPPKFKVPDFDKYKGTTCPKNHLKMYCRKMGAHSRDENLLMHFFQDSLAGAAII

SEQ ID NO: 130044 - protein, 235 aa, Glycine max
  Coding DNA Sequence Number=SeqID_13266
  Gene Ontology: Mol. function=nucleoside-triphosphatase activity; Cellular component=membrane; Biological process=cobalt ion transport
  Homolog annotation: Hit_ID=UPI00006BA0D6; Match level="QueryCoverage =84%, HitCoverage=62%, E-value=2e-61, Identity=59%"; Hit description =ABC-type transport protein
RQQSVRNRTGGERGDAPGGSGPRHRARRSERCRQDDAAAHARLTPRARHRDDQHRGCRPRRGPPGRPPSSGMDAGCSGRLAVADRPRDDRHDGSPLRHRADRSGSQVRTPARARRARHPRRLSGKGALARPEAEAGPRAGARARPRRAAPRRAGVRSRPRGAGATARLAAAVRSRGADRADLEPHPLRAGGGRRRRRVPRGGSRGRCRSRRGDGANLAGASGRSVGRPYERGHLA

SEQ ID NO: 130045 - protein, 64 aa, Glycine max
  Coding DNA Sequence Number=SeqID_13267
  Gene Ontology: Mol. function=structural constituent of ribosome; Cellular component=ribonucleoprotein complex; Biological process =response to antibiotic
  Homolog annotation: Hit_ID=Q9XQE1; Match level="QueryCoverage=62%, HitCoverage=48%, E-value=4e-09, Identity=78%"; Hit description =Chloroplast 30S ribosomal protein S12
LSKRGRVKDLPSVRYHIVRGTLDAVGVKDPQQGRSSALDKKLREEASMEGENERERESGMEIEG

SEQ ID NO: 130046 - protein, 93 aa, Glycine max
  Coding DNA Sequence Number=SeqID_13268
  Subcellular localization annotation: CTP_CleavageSite=71; ConfidenceScore=5.34e-01
MEKNPAVKVARTGISSRKDKGISQSQERSKGLGVTTITTKGPKNLSRLSWRTFPGSSSTIDLDRLRISGTRGQSIEKKSLQSQDLLLNQQNYG

SEQ ID NO: 130047 - protein, 35 aa, Glycine max
  Coding DNA Sequence Number=SeqID_13269
MAVYEANEGGKMPLTWGQTRNMPITHRVWKRNEIC

SEQ ID NO: 130048 - protein, 110 aa, Glycine max
  Coding DNA Sequence Number=SeqID_13270
  Gene Ontology: Cellular component=integral to membrane; Biological process=photosynthesis
  Homolog annotation: Hit_ID=P49179; Match level="QueryCoverage=99%, HitCoverage=62%, E-value=2e-52, Identity=84%"; Hit description =Photosystem I assembly protein ycf4
  Pfam annotation: Domain name=Ycf4; Domain location=1-110; Score=81.9; E_value=2e-21; Accession=PF02392.7; Description=Ycf4
MAFYGIAGAAFDIFNKKGKKVRFVPWGFPGKNRRIILEIPMNELHSIRIITEVKEEGIFTRTSTFESIVYLETIEQGFIPLTRIEDNLNGTQIAHKAGELSVFLGVPLFY

SEQ ID NO: 130049 - protein, 282 aa, Glycine max
  Coding DNA Sequence Number=SeqID_13271
  Homolog annotation: Hit_ID=Q51613; Match level="QueryCoverage=18%, HitCoverage=62%, E-value=1e-16, Identity=61%"; Hit description=, complete genome
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPGVWETLEGNERCRFRGTVRLTATSLVHPKQPACTLQQPVEWILPTPTPSRLVESVQLIKVSSSEEDLEEDPEELSPEPAMDAPDLPEDDEDPLPDVDSLEDIMPASEVDSTEESGPGGTTNSDDSSS

SEQ ID NO: 130050 - protein, 176 aa, Glycine max
  Coding DNA Sequence Number=SeqID_13272
  Subcellular localization annotation: CTP_CleavageSite=51; ConfidenceScore=5.13e-01
ARLTGASSKGGKCAESPPTFICGKRRKNRRKPVMKNIPDSGVVFTFEEGISTSHVDKSGALAPTYPPSKRKSDLLEDRRPSKNARRTTNDEERLKIFAKSPTETLRKREELANQLAQASRVASFRSNRLLEEHPATGPYGSPCHGTSRIVQQRVPSTSKRSNKGCMPSNNGPRMKL

SEQ ID NO: 130051 - protein, 79 aa, Glycine max
  Coding DNA Sequence Number=SeqID_13273
MGAKHLTRTKEWSHVIEQRSPDEIRVTIKSPHANDLLFPKFHKLPNDGCQAPHKDQRMVRLSSSKGSPKSVYDTNFVPL

SEQ ID NO: 130052 - protein, 150 aa, Glycine max
  Coding DNA Sequence Number=SeqID_13274
  Gene Ontology: Cellular component=mitochondrion
  Homolog annotation: Hit_ID=P93308; Match level="QueryCoverage=58%, HitCoverage=93%, E-value=2e-10, Identity=44%"; Hit description =Hypothetical mitochondrial protein AtMg00530
MKRGERGQLTTAKSQTTSTLCMIENCRCVLPGACSELRLENNKQGIELSKALSPYSNKANALYLTKAFSDRGSLAVVWVELKPPLIPINRSSGGLPSTHLSIYKNPSPEESRSSRMRMNPGHTHPDPPWNFRNLQKHSRRGLVMIFSKIT

SEQ ID NO: 130053 - protein, 117 aa, Glycine max
  Coding DNA Sequence Number=SeqID_13275
  Subcellular localization annotation: CTP_CleavageSite=86; ConfidenceScore=5.11e-01
PDAPATWSISPYSRTIGPPPKRACWRACGAGPERRGARSLWFHHGRHSSSRDSRPLTQYRGTGSAPPRPSQVRYGSFSPLPARVARAQSPQHLHLHQKATGQPIGRVAGHRHAVGRL

SEQ ID NO: 130054 - protein, 119 aa, Glycine max
  Coding DNA Sequence Number=SeqID_13276
  Subcellular localization annotation: CTP_CleavageSite=22; ConfidenceScore=5.09e-01
MATTPPVLLKNGIPGLPGHPWVASRGSNPARLGELRSPGRAGRQPPPLFSYKKAEGGCSKDPSAPWLCISAVLGEKNCFREENPSRGASVTLPRCFRKQIREGFRPFFIVLHPFFVLQR

SEQ ID NO: 130055 - protein, 72 aa, Glycine max
  Coding DNA Sequence Number=SeqID_13277
MHETQCGPLRVHRMNRKAWFEQNRGGGCRPARPGELSSPRRAGLLPPEATAFWRNIPEGPSGPGCYLHPHFY

SEQ ID NO: 130056 - protein, 115 aa, Glycine max
  Coding DNA Sequence Number=SeqID_13278
MVNKDEWVRAAMADDTVVVELLLCLKQGTVSHKSHQQLIPFSWGVKQSRSRSRLRAVVSRSDTVVSTTCSPTTPLSWSAGTDNYEDSSRRHHHHHHHAAISKVSSLSLCCLWRVW

SEQ ID NO: 130057 - protein, 216 aa, Glycine max
  Coding DNA Sequence Number=SeqID_13279
MVIDQSLFHDLNQLSSDGVPFEGTLNDDWKFDFSAHDARQLVCTNHADMTGRLLAGSLAFESRILHYLIVRILLPRSSNLAQVSKEDLVIMWAFHTGCQLDWAHLVRYRMHKALRLNAPLPYPHLVTLFFRHFQIPLDSEPYVPIKRSFLIGAAVIASLGYRKKHDGSWVKKAAQPADDEGNLPTEDSSSLQKIFSIVTSFHLVLEWLSKAYIYVT

SEQ ID NO: 130058 - protein, 158 aa, Glycine max
  Coding DNA Sequence Number=SeqID_13280
  Homolog annotation: Hit_ID=P0A6W0; Match level="QueryCoverage=36%, HitCoverage=18%, E-value=2e-12, Identity=61%"; Hit description =Glutaminase 2
MRPKCNAIAAQGLIKVRLGATKFAPFEKVESDGKNCHCSEFVVAINGDPTRYLHYLHRAVARFTHDGALIRTVVIREASQYEPGLKISIAPAAPAGDQTAILISPGITATIPPPTPDLAGMPTRQANSPAPSYMPLVIISAFTCRAWRAEITAHSSSS

SEQ ID NO: 130059 - protein, 419 aa, Glycine max
  Coding DNA Sequence Number=SeqID_13281
  Gene Ontology: Mol. function=metallopeptidase activity; Cellular component=extracellular region; Biological process=proteolysis
  Homolog annotation: Hit_ID=Q6D6B0; Match level="QueryCoverage=60%, HitCoverage=51%, E-value=2e-53, Identity=47%"; Hit description =Putative iron-regulated membrane protein
  Pfam annotation: Domain name=PepSY_TM; Domain location=146-172; Score= 20.8; E_value=0.0049; Accession=PF03929.6; Description=PepSY -associated TM helix
  Pfam annotation: Domain name=PepSY_TM; Domain location=281-307; Score= 20.3; E_value=0.0068; Accession=PF03929.6; Description=PepSY -associated TM helix
  Pfam annotation: Domain name=PepSY_TM; Domain location=326-352; Score= 13.5; E_value=0.78; Accession=PF03929.6; Description=PepSY-associated TM helix
  Pfam module annotation: Pfam domain module=PepSY_TM::PepSY_TM::PepSY _TM; Domain location=146-172::281-307::326-352
MTFSYHFRQRLTACVAIVAVLLLFVAPIVSKTLLERQTRIDPVASHSPSSAMPMHHHDMPMEMAMPGMMHHNMDDGEFACGYCDLLVHVPMMMWVFIPFIWLMLVISRAPPLPPLVAPRPRRFSGRKTALSAVHSAAPRGAVLNLLRRLHFYIGLFVAPFIFVAALSGTLYVLTPQLENLIYADALTAQPQGNAQSLSAQIAAARAYAGENQHIYAVRPAPAARDTTRVQFSDATLGPSQSRAVFIDPYSLKVTGDMTVYGTSGVLPLRTTLDLLHSSLLLGDFGRNYSELAASWLWVAALGGVLLWLGTRPKRRLKTVRKGFAFTRHWHITLGLTLMLGLLFFSVTGLTWSQWAGGNIDKMRTELNWLTPQVNTALSGDAPAAPAAPADPHADHRSMPDMDMTSMPMSSMAKPAAQPA

SEQ ID NO: 130060 - protein, 158 aa, Glycine max
  Coding DNA Sequence Number=SeqID_13282
MFPLTKIQGTNRLRILCLNTLECTSFVVQVEGTSTWLFKENKGGYIPCGSFLVKDFTRLLEISRTGGCLGTGRRHELWPNHGLSAHPQLSAASARLAQQKNLVEHQYDGCTLSVRSVRQAQQLSSARLSARLALSSNPFTRAKREGGAKCNVANSEPI

SEQ ID NO: 130061 - protein, 90 aa, Glycine max
  Coding DNA Sequence Number=SeqID_13283
MSSFTIYYGTQSDIRVKSYCRFEFLTSFRFNYERLDILRDTIRHPRAYVFNFEHLDILRDLIRHPRYKLLSFEFAFERLDILEHSIGHLS

SEQ ID NO: 130062 - protein, 189 aa, Glycine max
  Coding DNA Sequence Number=SeqID_13284
MQTASPIGGFAVAVTRGEDATTTGGGLASQIGELQARAVSFSGFFRWQPFQVAGAGTGYIMNSVIKVLYLNGRVYEENDGVIFEGSKKAIQIKRGISFNALKKKLEKRFLVSGKYVALQICDDEDVETMLESFQQQDQMLVPELYIEKDVDGGSMFHSANSLTSCGNNLSNNGAQPPRNVSIYMVMTMM

SEQ ID NO: 130063 - protein, 101 aa, Glycine max
  Coding DNA Sequence Number=SeqID_13285
YQLAKASWLLKAEGATSSSNDPLHGIGGLMTRSKTKRIKQSLQGLILMIKEKENQCELRVAPNWVTFLQIDEDSLKPTSRITKKHPWVELINFGGLLTLVD

SEQ ID NO: 130064 - protein, 55 aa, Glycine max
  Coding DNA Sequence Number=SeqID_13286
MIPMPNRLWRILRSDAILRRKGPFTRAISKRLQEDWARAAEEGPRDLTNLTGSIL

SEQ ID NO: 130065 - protein, 377 aa, Glycine max
  Coding DNA Sequence Number=SeqID_13287
  Gene Ontology: Mol. function=nucleoside-triphosphatase activity; Cellular component=membrane; Biological process=transport
  Homolog annotation: Hit_ID=Q6K4D2; Match level="QueryCoverage=99%, HitCoverage=51%, E-value=1e-111, Identity=50%"; Hit description =Putative ABC transporter
  Pfam annotation: Domain name=ABC2_membrane; Domain location=97-310; Score=134.3; E_value=3.4e-37; Accession=PF01061.14; Description=ABC -2 type transporter
YFGPASDANQFFASNGFPCPTLHNPSDHYLRIINKDFEQDAEQGFGKGVISEKAIDNLVKSYKSSQIRKQVKKEVNKIGESDSDAIRKQRIHAAFPTQCLVLIRRASLQLFRDISNYWLRLIVFIVIAISIGSIFYDIGTSNGSIQGRGSLFIFFVSVLTFMTLVGGFSPLLEEIKVFERERLNGHYGVTAFLIGNIFSAVPYMLLISLIPGGIAYYLCGMHKGPERFFYFTSLLFAIVMWVESLMLVVGSICPNYVIGMFLAGGVEGLMILTGGFYRLPNDLPKPLWKYPLYYVSFLKYAFQGSFKNDFEGLTFSVDQDGGVTRTVSGREVLSDTWHLEMGYSKWVDLAIMFGMILLYRVLFLVITKCKEKLKPFH

SEQ ID NO: 130066 - protein, 105 aa, Glycine max
  Coding DNA Sequence Number=SeqID_13288
MILTNNIKEVIPKTKNAKEFIGLMKEYSQIVDKFLTETLLNMLTTMKLDDSRTMHEHVIKMTNIAARLKTLGMIVNENFLVQFILDSLSSEHGPFQMNYNIIKDK

SEQ ID NO: 130067 - protein, 146 aa, Glycine max
  Coding DNA Sequence Number=SeqID_13289
  Gene Ontology: Mol. function=nucleoside-triphosphatase activity; Cellular component=membrane; Biological process=transport
  Homolog annotation: Hit_ID=Q6K4D2; Match level="QueryCoverage=56%, HitCoverage=11%, E-value=8e-24, Identity=61%"; Hit description =Putative ABC transporter
MTTFPSAQPEVLQTNPQVLTTFEGDAIKLTEINGSVQREKDITVTWENLWVTVSSGKKKKPILQDLTGYARPGRILAIMGPSGCGKSTLLDALAGRLSTNIKHTGKILINGQKQALAYGTSVRDNSQKLQDHKRKSSNIFVGKIIV

SEQ ID NO: 130068 - protein, 71 aa, Glycine max
  Coding DNA Sequence Number=SeqID_13290
MAASLGKELKSKMLLSLVINLVTILSLHAKSFSFVNSSSSDSDEEVKIVVKVMKQGVLLCRTWAQLIVPAR

SEQ ID NO: 130069 - protein, 267 aa, Glycine max
  Coding DNA Sequence Number=SeqID_13291
  Homolog annotation: Hit_ID=Q6Z7V1; Match level="QueryCoverage=99%, HitCoverage=41%, E-value=1e-36, Identity=35%"; Hit description=LMBR1 integral membrane protein-like
MGMMMFYSLTPKTNKLSKLAYDMLDDCKICNMQHPFHTTFSTSLILVGVEKPFLKNLDAIILEMLRADIKDTKVEKIYWKMGKINDAVPFFGKGFNKIYPLIMVIYTSLIASNIFNRVIKYCGNWKIFKFSDEAEDMDGFDLSGVIILRRECSLLQQGHKVGELVFPLARSFSVSTDVESTSKAMERVSSSLTSDVNDSPNTSAAPSSVLASKWESMMHGFKILRSNIDSKGFLPLSNAQGSTLNSKSSSESLDDIFERLKRPPSEI

SEQ ID NO: 130070 - protein, 156 aa, Glycine max
  Coding DNA Sequence Number=SeqID_13292
  Homolog annotation: Hit_ID=Q1SDK5; Match level="QueryCoverage=94%, HitCoverage=19%, E-value=6e-56, Identity=72%"; Hit description=LMBR1- like conserved region
MACSNTFGLVTGAFLLGFGLSEIPNGIWLNSDWNTEQKVLSHKVAKMAVKLDDAHHDFSNAIVITQATSKQMSKRDSLRPYMNIIDKMLLQIVKSCKCIYMQLKEDPSFKPQGGTLGESGMDYDTDDKSMAALRRRLTKAREQYYRYRRYTLICLV

SEQ ID NO: 130071 - protein, 86 aa, Glycine max
  Coding DNA Sequence Number=SeqID_13293
MQLGSNTSSDWEWHFNWRRPLFDSEIIMADDFLGEIASQQIHPVRADSWVWKPEPSGHYSSKSAYDLLWGELMGNNRMLFLRNYGN

SEQ ID NO: 130072 - protein, 377 aa, Glycine max
  Coding DNA Sequence Number=SeqID_13294
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=95%, HitCoverage=66%, E-value=1e-110, Identity=60%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=DHBP_synthase; Domain location=126-323; Score=437.2; E_value=2.3e-128; Accession=PF00926.10; Description=3,4- dihydroxy-2-butanone 4-phosphate synthase
  Subcellular localization annotation: CTP_CleavageSite=56; ConfidenceScore=5.23e-01
MASSLSLSTPPLCHPRVCKHFKLYNGLHKFSFNGHGSDFAVVRHNSKVPNAAGRIRATLTSGGGGDLGSYLKSSGFVTNHFRTGAQLDVIAFGTLRADTAVPAGSGFSDDEDDHDFDSPTEGFASIPEAIEDIRNGKMVVVVDDEDRENEGDLIMAAQLATPEAMAFIVKHGTGIVCISMKEEDLERLDLPLMVNSQYNDEKLRTAFTVTVDAKHGTTTGVSAHDRATTVLALASKDSQPSDFNRPGHIFPLKYREGGVLKRAGHTEASVDLAILAGLNPVAVLCEIVDDDGSMARLPKLRQFAERENLKIVSIADLIRYRRKRDKLVERAGDALIPTMWGPFVANCYRSLLDGIEHIAMVKETKYENGKHTDMVET

SEQ ID NO: 130073 - protein, 117 aa, Glycine max
  Coding DNA Sequence Number=SeqID_13295
MGDVREIFISKHRNKGGRRYGFVRFKVVSDERSLERKLDNIIVGGLKMYINVPKYRRKKERYMERSVKHSTQAVGASNERKLPGQTAVQHRTDPKSYAKVVSTVNMDAGQRRNPLPT

SEQ ID NO: 130074 - protein, 345 aa, Glycine max
  Coding DNA Sequence Number=SeqID_13296
  Gene Ontology: Mol. function=zinc ion binding; Cellular component =integral to membrane; Biological process=ubiquitin cycle
  Homolog annotation: Hit_ID=Q1SGA9; Match level="QueryCoverage=87%, HitCoverage=87%, E-value=7e-68, Identity=47%"; Hit description=Zinc finger, RING-type; RINGv
  Pfam annotation: Domain name=PHD; Domain location=148-193; Score=1.2; E_value=0.043; Accession=PF00628.19; Description=PHD-finger
  Pfam annotation: Domain name=zf-C3HC4; Domain location=149-190; Score= 36.5; E_value=9.3e-08; Accession=PF00097.15; Description=Zinc finger, C3HC4 type (RING finger)
  Pfam module annotation: Pfam domain module=PHD::zf-C3HC4; Domain location=148-193::149-190
MVLHHRKLLLFPPPPPPLCRSACPEKFNDPLPPPNSPDDYLTQSPTKNIKISKYLIISFSIVATAFIVLSFYAIYAKFFSPRNRSIRRTLSRPETEQDFLDEEEQQQHGPVVDHPIWYIRTTGLQQAVITAITVCKYRKDEGLIEGTDCSVCLSEFQEDESLRLLPKCNHAFHLPCIDTWLRSHTNCPMCRAPIVTDPTRVPSMDPTAFEASSFVEEVLENSVEDAQSSSDDLVRNEEEERVQEGEVCENENLAVTVQPRRSVSLDSSSAAKISLALATVVSGDSHGNHSKRVVGNVNGNLSTKGGSSSSSSSSSVKRSRSFNAKHLLSWYSRSQRKPNAPLRSF

SEQ ID NO: 130075 - protein, 175 aa, Glycine max
  Coding DNA Sequence Number=SeqID_13297
  Gene Ontology: Mol. function=oxidoreductase activity
  Homolog annotation: Hit_ID=Q1SGA8; Match level="QueryCoverage=98%, HitCoverage=48%, E-value=5e-46, Identity=54%"; Hit description=2OG -Fe(II) oxygenase
  Subcellular localization annotation: CTP_CleavageSite=24; ConfidenceScore=5.12e-01
MASTASEVSQQVQSNNRTSFTSVKALTKSPELTSLPPSYTTTNSDDEIVADPDEDDPIPIIDYSLLVTGTLDQRAKTIHDLRKACEEWRFFMLINHFVSKTILEKMVDEIFAFFNLREEEKQEYVGKDVMDPVRYGTSSNVSMDKVLFWRDFLKIVVHSEFHSLDKPPGFRNLSW

SEQ ID NO: 130076 - protein, 78 aa, Glycine max
  Coding DNA Sequence Number=SeqID_13298
MYPNFINIQRHNIEILNGENARNWVANVVLKLHDDPTVNESEIVVFLRQVRWPAGKREGFGRREKKQHCEAEEAEESV

SEQ ID NO: 130077 - protein, 97 aa, Glycine max
  Coding DNA Sequence Number=SeqID_13299
MSRNVKDIGVGHIEMMCSKRRDIREEDANKRNRRLSVLVSCFVINAFGVNLNLNLIAQNDVVLVEVGMNEMQQETRESKQPESVNEMRVVGGMGRKK

SEQ ID NO: 130078 - protein, 174 aa, Glycine max
  Coding DNA Sequence Number=SeqID_13300
  Homolog annotation: Hit_ID=O04892; Match level="QueryCoverage=48%, HitCoverage=15%, E-value=1e-21, Identity=76%"; Hit description =Cytochrome P450 like_TBP
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKALRWSLRMWTQCDFCPVL

SEQ ID NO: 130079 - protein, 91 aa, Glycine max
  Coding DNA Sequence Number=SeqID_13301
QPVEWILPTPTPYRLVEPVHVIEVSSSEEHLEEDPEELPPEPAMDALDLPEDDEDPLPDVDSLEDIMSASEADSTEESGPGGAANSDDSSS

SEQ ID NO: 130080 - protein, 98 aa, Glycine max
  Coding DNA Sequence Number=SeqID_13302
MRGAPSVESLTPFVTRGFSDPNARMLQGVHKAWEKVQRKDRELRGSGNGIIGDYRKWLRANTQGLDWLLKLRAAKEEEAEAPEESEEVQALKVELEKA

SEQ ID NO: 130081 - protein, 116 aa, Glycine max
  Coding DNA Sequence Number=SeqID_13303
MVNHKGEQTKFLIWDRECAQLIGQLADDVNRLKIEDGDVDLNASPQALDRLLGCFLAFKVKVQPRFRNSVVLKYSDESDLINAMLDMIPDSEQSLSITAEHDRSMLGSSEPTKFES

SEQ ID NO: 130082 - protein, 80 aa, Glycine max
  Coding DNA Sequence Number=SeqID_13304
  Gene Ontology: Mol. function=serine O-acetyltransferase activity; Cellular component=cytoplasm; Biological process=cysteine biosynthetic process from serine
  Homolog annotation: Hit_ID=Q8L5G2; Match level="QueryCoverage=64%, HitCoverage=21%, E-value=2e-17, Identity=75%"; Hit description =Serine acetyltransferase
MQNFFQLAFFTWTSIRFDIRSCFHQETENIIIRDVPPRTTVVGNPAKLVGGKNSSVKLDKISIFTMDHTSHIADFYDYCV

SEQ ID NO: 130083 - protein, 64 aa, Glycine max
  Coding DNA Sequence Number=SeqID_13305
  Homolog annotation: Hit_ID=O22633; Match level="QueryCoverage=98%, HitCoverage=81%, E-value=4e-19, Identity=73%"; Hit description=NOI protein
  Pfam annotation: Domain name=NOI; Domain location=1-62; Score=89.8; E_ value=8.4e-24; Accession=PF05627.2; Description=Nitrate-induced NOI protein
MSDTGRPLPKFGEWDVNDPASAEGYTVIFNKARNEKKTGGKPDSPAKVNNPRTRPPLDPSKTQS

SEQ ID NO: 130084 - protein, 99 aa, Glycine max
  Coding DNA Sequence Number=SeqID_13306
MSSRVVFRGPEKISYKKITKIASAWVLGICVLIVLFDVQDAVSLARTEEEPEAAARKLTEAAFSRGSADNITCIVVRFHHEKAEVANPDKAESTSTQHE

SEQ ID NO: 130085 - protein, 68 aa, Glycine max
  Coding DNA Sequence Number=SeqID_13307
  Subcellular localization annotation: CTP_CleavageSite=59; ConfidenceScore=5.28e-01
MQQHHRQHPRRRRRTKHAIGRSQRRPAKVTKKTQLSFFERRRRIGRSRRSRNGEEEVEEAEMAKKQKW

SEQ ID NO: 130086 - protein, 83 aa, Glycine max
  Coding DNA Sequence Number=SeqID_13308
DFRSAVSLVTVFQRNEHGFEAFSPHGQDHLGLPSGVKTKHEWQKPVKVLKDERKRGWGHDRPIAALLCAKQTGNVAARQLRIL

SEQ ID NO: 130087 - protein, 144 aa, Glycine max
  Coding DNA Sequence Number=SeqID_13309
MGTNQTGKRFYQVKVKGLDTPSIKELGRLMEPLQMQAFRKNYGKILKLSIAEISIEAIASLTQYYDQPLRCFTFGDFQLKCNCGQGFSKRFGPHKTDSERHSGPTTEVPRRQGEGYGQSRRLGPQSTLFLAYHHSKESPVVAVL

SEQ ID NO: 130088 - protein, 83 aa, Glycine max
  Coding DNA Sequence Number=SeqID_13310
MAPKKLFAKRSRRDAAAEGSSAAPERVQLMDNEYTDFQEEIARRRWTSLVTPMAMFDPDIVLEFYANAWPTEEGVRDMRSWVR

SEQ ID NO: 130089 - protein, 96 aa, Glycine max
  Coding DNA Sequence Number=SeqID_13311
MAVTMMVVLVVATTKVVLVVAVTMTLMVVLMVMSISSSYGTDNDGGIGGIEKCGSRCFPRMLQPYGISIGLKEHSNPVTPKAYTPKSPSGPLPPDS

SEQ ID NO: 130090 - protein, 378 aa, Glycine max
  Coding DNA Sequence Number=SeqID_13312
  Gene Ontology: Mol. function=cellulose synthase (UDP-forming) activity; Cellular component=membrane; Biological process=cellulose biosynthetic process
  Homolog annotation: Hit_ID=Q8VZK9; Match level="QueryCoverage=97%, HitCoverage=49%, E-value=1e-103, Identity=51%"; Hit description =Putative cellulose synthase catalytic subunit
MKVELHGADGYGGPLFIGTCCFHRRDALCGKKFNCQYKNEWNDENEKEVVKANLHELEVESKALASCSYEENTLWGKEIGAIYGCLVEDVITGLWIHSQGWKSIYYNPPRKAFFGIAPTNLLHTLVQQKRWGEGDFQILFTEYSPTWYGEGKINLGLLMGYWRFNYSATTCLPILYYSFIPSLYLLKAIPLFPKMSSPWFIPFAYVILGESSSTLIEGLISGGTIKGWWNDLRMWLYIRTSSYLFALIDIVWKFFGRSYSSFAVTTKIVEDDDVSQRYKNEVMEFGTSSPFFTVLATLALLHLFCLLATIKELVLCKVALTGEKMALQVLLCGFLVLINFPIYQGLFLRKDKGRLPSSHTIKSTTLALSACIFFKIWN

SEQ ID NO: 130091 - protein, 305 aa, Glycine max
  Coding DNA Sequence Number=SeqID_13313
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=91%, HitCoverage=37%, E-value=6e-89, Identity=55%"; Hit description =Cellulose synthase-like protein CslE
MESGEDYSLFETRKDKGRHIRRIYAISLFVAICFIWAYRLSHIPAYGKWAWLGLFAAELWSGFYWLFGQALRWNMLFRKTFINRLSERYENSLPRVDMFVFTADPIIEPPMMVINTVLSVMAYDYPAEKLSVYLSDDAGSDITFYALLEASTFAKHWVPFCKRFKVEPRSPAAYFNTLVSTNSHDHNHAKDLDAIKKLYVDMKRRIEDAVKLGGVPSEARSKHNGFSQWDSYYSRHDHDTILQILLHERNPHNSKDVDGFVLPTLVYMAREKRPQYHHNYKAGAINSLVVYIIKTRLYFLLKNLG

SEQ ID NO: 130092 - protein, 277 aa, Glycine max
  Coding DNA Sequence Number=SeqID_13314
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=97%, HitCoverage=36%, E-value=8e-98, Identity=61%"; Hit description =Cellulose synthase-like protein CslE
GWKSIYYNPERKAFVGIAPTTLDVACLQHMRWSEGMFQVFFSKYCPFIYGHGKIHFGVQMGYCNYLLWAPMSLPTLCYVFVSPICLLRGIPLFPQLSSIWVLPFAYAFLATYGFSLCEYLICGSTAKGWWNLQRIKFIHRTTSYLFGFIDTMKKQLGLSQTKFVITDKVVTKDVQKRYEQEVIEFGGSSIMLTILATVALLNLFGLLWGMKRIMMDLEFSSSQLMMQITLSSLVVMISLPVYEALFIRSDKGCIPSSVMLKSIVLASLACFLAPFIC

SEQ ID NO: 130093 - protein, 106 aa, Glycine max
  Coding DNA Sequence Number=SeqID_13315
MGETHEIPHHNLADFEPWLGYATEGQAVGGIPFENTLESPQFRPQPQPLHFAVGRAPPAMAEKGKVDHLKERLKAIEGGEDYAFANLEELFLIPKHGHSQVQGAGL

SEQ ID NO: 130094 - protein, 327 aa, Glycine max
  Coding DNA Sequence Number=SeqID_13316
  Gene Ontology: Mol. function=serine O-acetyltransferase activity; Cellular component=cytoplasm; Biological process=cysteine biosynthetic process from serine
  Homolog annotation: Hit_ID=Q5MYA1; Match level="QueryCoverage=77%, HitCoverage=71%, E-value=2e-98, Identity=69%"; Hit description =Serine O-acetyltransferase 1
  Pfam annotation: Domain name=Hexapep; Domain location=243-260; Score =13.5; E_value=0.78; Accession=PF00132.14; Description=Bacterial transferase hexapeptide (three rep
  Pfam annotation: Domain name=Hexapep; Domain location=269-286; Score =11.5; E_value=3; Accession=PF00132.14; Description=Bacterial transferase hexapeptide (three rep
  Pfam annotation: Domain name=Hexapep; Domain location=287-304; Score =12.7; E_value=1.3; Accession=PF00132.14; Description=Bacterial transferase hexapeptide (three rep
  Pfam annotation: Domain name=SATase_N; Domain location=85-189; Score =155.7; E_value=1.2e-43; Accession=PF06426.4; Description=Serine acetyltransferase, N-terminal
  Pfam module annotation: Pfam domain module=Hexapep::Hexapep::Hexapep:: SATase_N; Domain location=243-260::269-286::287-304::85-189
  Subcellular localization annotation: CTP_CleavageSite=75; ConfidenceScore=5.12e-01
MMRRRSLVTASPKQGSVFFVGHDNNPTIHPHTHTLLTPSPKQVTENHNHSKTFKPSSNHNRVNTLHTGSTVQHVEADEAVELDVLWTKMQEEAKLDVTVEPFLSDYYNTSILSHNSLQTALANHLAMKLSNSSLPSSILSDLFVTVLETDKSIMDAVKSDLRVVKELDPACISHVHCFLNFKGFLACQAHRVAHKLWLQGRKILAVTIQNRVSQVFAVDVHPGARIGSGILLDHATGIVVGETAVIGNNVPILHGVTLGGTGKVSGDRHPKIGDGVLIGAGTCILGNIKVGDGAKIGAGSVVIKDVPPRTTVVGNPAKLVGGKNSSV

SEQ ID NO: 130095 - protein, 165 aa, Glycine max
  Coding DNA Sequence Number=SeqID_13317
  Gene Ontology: Mol. function=pectinesterase activity; Cellular component=cell wall; Biological process=cell wall modification
  Homolog annotation: Hit_ID=Q9FM79; Match level="QueryCoverage=92%, HitCoverage=40%, E-value=2e-32, Identity=47%"; Hit description =Similarity to pectin methylesterase
  Pfam annotation: Domain name=Pectinesterase; Domain location=38-164; Score=-221.7; E_value=7.7e-05; Accession=PF01095.10; Description =Pectinesterase
CVQVQGDTDSDHARNFITWEDFMVDEQGITSNVGGRIIVVDQSGKGDSTTVQGAVDMVPQNNTERVKIYIYPGIYRERVHVPKSKPFISFIGKPNITMNEREANITANAQNITEIANAIPIITNSTKASDKGNDGQEMGTVSTATVWVESDFFCATALTIEVIED

SEQ ID NO: 130096 - protein, 200 aa, Glycine max
  Coding DNA Sequence Number=SeqID_13318
  Gene Ontology: Mol. function=pectinesterase activity; Cellular component=cell wall; Biological process=cell wall modification
  Homolog annotation: Hit_ID=Q9FM79; Match level="QueryCoverage=97%, HitCoverage=51%, E-value=4e-68, Identity=61%"; Hit description =Similarity to pectin methylesterase
  Pfam annotation: Domain name=Pectinesterase; Domain location=3-195; Score=18.4; E_value=4.5e-23; Accession=PF01095.10; Description =Pectinesterase
MCIFVFQNLVDKDADKRQAVALRVDGDKAVFYRVRLVGEQDTLLDNTGIHYFYRSYIQGSVDFICGNAKSLFHECVLDSVAEFWGAIAAHHRDSADEDTGFSFVNCTIKGSGSVFLGRAWGKYAATTYSFCDMDHVILPLGWSDWGDPSRQGTAMFGEYECSGKGSNRTERVEWSKALSSEEAMPFLSRDYIYGDGWLRL

SEQ ID NO: 130097 - protein, 271 aa, Glycine max
  Coding DNA Sequence Number=SeqID_13319
  Gene Ontology: Mol. function=protein serine/threonine phosphatase activity; Cellular component=integral to membrane; Biological process=protein transport
  Homolog annotation: Hit_ID=Q8VYE2; Match level="QueryCoverage=83%, HitCoverage=59%, E-value=4e-79, Identity=62%"; Hit description =Import inner membrane translocase subunit TIM50, mitochondrial precursor
  Pfam annotation: Domain name=NIF; Domain location=77-239; Score=76.9; E_value=6.6e-20; Accession=PF03031.8; Description=NLI interacting factor-like phosphatase
MWDIACLLPPPLEDVEEDHCRQINIVCTSWGVGHADSFACDTSVPAKAVELYLDARRLIEEQVRSYTEPYTDKLLPDLLPQEQHVFTLVLDLNETLIHYIWTRDTGWQTFKRPGVDAFLEHLAQFYEIVVYTDEQNMFVDPVIERLDTKHCIRYRLSRPATKYQDGKHFRDLSKLNRNPGKVLYLSGHALESCLQPENCLPIKAWQQQDIDDTALLDFIPFLEFVARSSPPDIRPVLASYQGCDIPSEFIRRSKEHQRRMQEQKNRGRFWK

SEQ ID NO: 130098 - protein, 249 aa, Glycine max
  Coding DNA Sequence Number=SeqID_13320
  Subcellular localization annotation: CTP_CleavageSite=24; ConfidenceScore=5.01e-01
MTHNLKPLYYLVKLTQLFVSVSVCSFIFSPSSLLVFLYYFKFYLSAFPFQLYTHNIDKNSMFLLCNGILVFVGITKSLSRSSCCDDYRPSAYIKDDGSQSRFWVIEANELMSEIVETEEQTSEPDEQNTAVEQVIEIENCAEEEVQENIEKIVLVDEGQEKGSSLVLKEEEKEELDEETELLDVGDEEEDKGSETDYILIEESIEEEEEDVEEESCMLSTEELNKKFEDFIRKMKEDLRIEAQRQLVMV

SEQ ID NO: 130099 - protein, 344 aa, Glycine max
  Coding DNA Sequence Number=SeqID_13321
  Gene Ontology: Mol. function=pectinesterase activity; Cellular component=cell wall; Biological process=cell wall modification
  Homolog annotation: Hit_ID=Q9FM79; Match level="QueryCoverage=94%, HitCoverage=93%, E-value=9e-87, Identity=48%"; Hit description =Similarity to pectin methylesterase
  Pfam annotation: Domain name=Pectinesterase; Domain location=52-339; Score=61.0; E_value=2.6e-26; Accession=PF01095.10; Description =Pectinesterase
VVFLFVVSIFVIWAQVVDLAEGGAVRNYISWEDLQVNEQRLAVKSSHNQVRVITVNQNGGGHSKTVQGAVNMVPDNNRQRVKIFIFPGIYREKVRVPVTKPYVSFIGKRNRTASPIITWNSKSSDKGPNGTALGTYASATVGVDSDYFCATGITFENSVIASAGGKGMQGVALRVSSPKAMFYRVRIKGTQDTLLDSTGNHYFLKCRIIGKVDFICGSAKSLYEKCRLQSIAENYGAIAAHHRDSPTDDTEHGGTTQELYTPNVIWMALLILKGGQTGIIHIGRMQNMSKHIWYFRTAVFAEYQCKGRGADRRHRVPWSKSFSYPEASPFLYKSFIDGDQWLRL

SEQ ID NO: 130100 - protein, 405 aa, Glycine max
  Coding DNA Sequence Number=SeqID_13322
  Gene Ontology: Mol. function=potassium channel activity; Cellular component=integral to membrane; Biological process=potassium ion transport
  Homolog annotation: Hit_ID=Q9LLM5; Match level="QueryCoverage=85%, HitCoverage=100%, E-value=1e-124, Identity=66%"; Hit description =Outward-rectifying potassium channel KCO1
  Pfam annotation: Domain name=Ion_trans_2; Domain location=128-210; Score=80.0; E_value=7.6e-21; Accession=PF07885.6; Description=Ion channel
  Pfam annotation: Domain name=Ion_trans_2; Domain location=249-324; Score=68.6; E_value=2.1e-17; Accession=PF07885.6; Description=Ion channel
  Pfam annotation: Domain name=TrkH; Domain location=8-320; Score= -129.2; E_value=0.047; Accession=PF02386.7; Description=Cation transport protein
  Pfam module annotation: Pfam domain module=Ion_trans_2::Ion_trans _2::TrkH; Domain location=128-210::249-324::8-320
MDAFSAFSLNEGTQLRRSIWLVSVVSDDPNDFILHLWWSYIADPCFLNSSAVGKGAYMANNGVKEPLLWVSLDATQKTEQQLNKRSLLRFRSAPHAEIVPTETNGNESIPHSASIFQNLHPSFKRVAIYLAVYLGVGALIFYLVRNQIKGQKTDGILDALYFTIVTMTTVGYGDLVPNSHLTKLLACAFVFSGMALIGLIVSKAADYLVEKQEILLVKAMRMHQKVGSTEILREVETNKTRYKLFLVFFLLLILIIAGTIFLVTVEKLDVIDAFYCVCSTITTLGYGDQSFSTQAGRIFAVFWILTGTITLAQLFLYIAELNTEIRQKELVKWVLTRKVTNSDLEAADLDVDGTVRAAEFVIYKLKEMGKISQEDISLVMQEFEQLDVDDSGTLSTSDITLAQSS

SEQ ID NO: 130101 - protein, 149 aa, Glycine max
  Coding DNA Sequence Number=SeqID_13323
MFGAKFVAVVVVTLWLSKSNFNFEAYGDAVGDVIPTPTSCENCQVTPPPSGYPSYEAPPPPSQPPPPSSGYSIYGAPPPPSPHKSGQSKCPPAAGVQCCTPPAPYTYGYGYGPPNPYTYVPYGEGQGPASMVLPILVPLIMLFSSIFLV

SEQ ID NO: 130102 - protein, 261 aa, Glycine max
  Coding DNA Sequence Number=SeqID_13324
  Subcellular localization annotation: CTP_CleavageSite=62; ConfidenceScore=5.02e-01
MVKVTKQQICHNLCCYFASFLPIILVLVLLFSISFFFSVSESFPSLLTLLIALLSTLFLVTLAKKKGSLHENLVQDNQQNLELQPSLGDVTVQQNETSERQAEAHSESSFPLDCESSNIMDTSFELSARKYEQQADPQSDSSLPSDSESTASSTMDEESIEIHRNRNQNLDISDSLVFDYDVDGEEDGLIEIKLPNNHFPEFLPESIFKQQGLTELLAEINEMNEDENLIEIDISKGSTKHQDLRLEKELVCRVDHWVLSD

SEQ ID NO: 130103 - protein, 210 aa, Glycine max
  Coding DNA Sequence Number=SeqID_13325
  Gene Ontology: Mol. function=hydrolase activity; Cellular component =cytosol; Biological process=carbohydrate biosynthetic process
  Homolog annotation: Hit_ID=Q67V42; Match level="QueryCoverage=72%, HitCoverage=50%, E-value=6e-40, Identity=55%"; Hit description=MutT domain protein-like
  Pfam annotation: Domain name=NUDIX; Domain location=55-175; Score =63.1; E_value=9.1e-16; Accession=PF00293.18; Description=NUDIX domain
AKCGVWIKLPTALVNFVETAVKEGFRYHHAEPNYLMLVYWIIPETSCTNPPNASHRVRVGGLVLNDKKEVLVVQEKRGIFHEIGLWKIPTGIVEAGEELLAAAVREVKEETGIDTEFVELAFRHADNSLFRKSELFFLCMLRPLSTDDIKKQDLEIDRCCQDKGMYSEAIDVNQDIATTGVSTAKKGANQAEKEVQAAVNTKRKISNPEE

SEQ ID NO: 130104 - protein, 216 aa, Glycine max
  Coding DNA Sequence Number=SeqID_13326
  Gene Ontology: Mol. function=two-component response regulator activity; Cellular component=intracellular; Biological process=two -component signal transduction system (phosphorelay)
  Homolog annotation: Hit_ID=UPI00005F84CD; Match level="QueryCoverage =54%, HitCoverage=57%, E-value=1e-19, Identity=45%"; Hit description =COG4566: Response regulator
MAALLAAGAAPGRTGPGVGYGTGVGAGDGRIRHCDDFRLVSPRNAGAAVQQSAKRRRGCGVCAVVAVTAVYPAGAAAVRAGFPARAFRQHGAALEAGALLTLTHRQPDRLQQRFNLQRPGEKGKGALSKQAPAGLQRVVPGHDDHRQQRMACALPGQPAQAATLWLSHIKQQTAAYGLLTGGGGFERCQVGKVGDFVVHGSQQKSQRLTHGYIIIH

SEQ ID NO: 130105 - protein, 205 aa, Glycine max
  Coding DNA Sequence Number=SeqID_13327
  Gene Ontology: Mol. function=chromatin binding; Cellular component =chromatin; Biological process=chromatin assembly or disassembly
  Homolog annotation: Hit_ID=Q1SAV4; Match level="QueryCoverage=94%, HitCoverage=49%, E-value=4e-55, Identity=52%"; Hit description =Integrase, catalytic region
  Pfam annotation: Domain name=rve; Domain location=1-117; Score=15.0; E_value=0.00033; Accession=PF00665.16; Description=Integrase core domain
MLPTTHTAHVVASLFLELVVKIHGVPQSLVSDRDPLFVSKFWQELFHHSGTQLKMSSAYHPHSDDQTEVLNRAIEQYLRSFVHHQLSSWGRFLAWAEYSHNTSWNAATGATPYEVTFGRKPFNFLAYIASTSNLKAVDTFMTNRDEVFQFIRKKLLKAQATMKDHADTHRREVTYNPGDWVLLKLRPHCQSTAKGSQAFSGKLAK

SEQ ID NO: 130106 - protein, 60 aa, Glycine max
  Coding DNA Sequence Number=SeqID_13328
MADKICFCSFPHSIGVKGKVSDPFNQAIEAEALLQSPTLGRSCCLVTIARGEFHHEAGYK

SEQ ID NO: 130107 - protein, 71 aa, Glycine max
  Coding DNA Sequence Number=SeqID_13329
MEVTSLQKLGQKMDQIDADMEAMKEQMTIMMEAMMSMRRMMEVNAATIVAASTATEVDLVMTHLVATISPL

SEQ ID NO: 130108 - protein, 78 aa, Glycine max
  Coding DNA Sequence Number=SeqID_13330
MNVHQESSTRPGKLCCFHQKAPPSVGTPWKVQVGLFTDYATIPSLTSGMLRNFTDCATMLPFDFRHVAKLHGLPNDGC

SEQ ID NO: 130109 - protein, 60 aa, Glycine max
  Coding DNA Sequence Number=SeqID_13331
MNLSKDMLKDLVFAGKRIEVGLRRGKFDYASTVSSSNRRPGMSGGNNNEEETHVVTIVPT

SEQ ID NO: 130110 - protein, 90 aa, Glycine max
  Coding DNA Sequence Number=SeqID_13332
MLSLMKNKGEEIKSYRNINVRKLSPMKDKGEDVESYGNIKRMLSPMKNKGEVIESYGNIKVRTLSPMKDKGENIESYGNIKARTLSPMKA

SEQ ID NO: 130111 - protein, 121 aa, Glycine max
  Coding DNA Sequence Number=SeqID_13333
MKGTYYPDLVKIFYATAHIDGDTSFLCAKGSNHAQLTKEDLLLICLMQKKMKLNWVNIIVDNVLRTKRIGSFKCPYAMIISKILDYFGLDTQDEVFDFMEEEFAVKTKVLKQMAYIKADEE

SEQ ID NO: 130112 - protein, 205 aa, Glycine max
  Coding DNA Sequence Number=SeqID_13334
MHGPQRKGLGISAPGCEANGSPLMKMPLISSWHIRWSWKRGNIANSVRGGARPRGITPPRHPVDPEKSNRALGFLALIIGLCQFYGVSVTPTKLIQPPINRAFIEKYCMPRQAQQQGQAQQQPAADAPLPPLRQPPSLESISAHMRRIELQMHAYMQHVIDQQAANHRGQIQLNESFYQYTLHQQCQDPSPYPWPTPEHFGAMVA

SEQ ID NO: 130113 - protein, 152 aa, Glycine max
  Coding DNA Sequence Number=SeqID_13335
  Subcellular localization annotation: CTP_CleavageSite=55; ConfidenceScore=5.10e-01
MSPRFYLWHEGLLKIHLYAYSCKLSSRMNTGISTTGQGENAFKPSPLYFTFLFVRSSSSSRSRILTSLAIKGHSHQQFIHIGEISRYVSFNVCLYDPLPHPLKLNIIPHQHLNTRAPRAAARHEPVLRRHLRLFLGVQWINHQIRQIGAEGF

SEQ ID NO: 130114 - protein, 113 aa, Glycine max
  Coding DNA Sequence Number=SeqID_13336
  Gene Ontology: Mol. function=ribonuclease H activity; Biological process=DNA integration
MEVVLPFEVEVPSLRILAKSGLLAAMSHGRLYQSRVKNAFDKKVCLCKFSEGDLVLKKVSQAQKDYRGKWAPNYEGPFVVKKAFSGEAFLLASMDDEEFPSPINFNIVKRYYA

SEQ ID NO: 130115 - protein, 83 aa, Glycine max
  Coding DNA Sequence Number=SeqID_13337
  Homolog annotation: Hit_ID=UPI000034F3FA; Match level="QueryCoverage =63%, HitCoverage=6%, E-value=2e-16, Identity=67%"; Hit description =oxidoreductase
MGASEEEGALDENGETWEAEGLYVCDGNVLPSAVGVNPMVTIQSTSYCIATRVGTTEVRERQCAGGHDEVNGKEIEWDEFTTR

SEQ ID NO: 130116 - protein, 96 aa, Glycine max
  Coding DNA Sequence Number=SeqID_13338
MAISRKQSIVRLFRAPILGTYWEGLKVCYLVTSPKVGTTSDNISSKRKTLDEASLSSSESETQHDHRSTSTSYVSMDPGIRPNNSPMCKGVSAMCA

SEQ ID NO: 130117 - protein, 351 aa, Glycine max
  Coding DNA Sequence Number=SeqID_13339
  Gene Ontology: Mol. function=nucleotidyltransferase activity; Cellular component=nucleus; Biological process=NAD biosynthetic process
  Homolog annotation: Hit_ID=UPI00004A471F; Match level="QueryCoverage =61%, HitCoverage=90%, E-value=1e-48, Identity=44%"; Hit description =PREDICTED: similar to nicotinamide nucleotide adenylyltransferase 1
  Pfam annotation: Domain name=CTP_transf_2; Domain location=140-324; Score=116.7; E_value=6.5e-32; Accession=PF01467.16; Description =Cytidylyltransferase
MKKKKKVKSMAMNDVAPRINKKMNEVAVVCTACGGVHEGTYVKGSVNSKSLKFLAMLGHLIEETLSMLGEVFKYSFHFIHRLIGHAPILGFSFLEHSHSVTQHIQVMDVPLPRDKLALDLINNEPSPANTSNSKIYVILVATGSFNPPTFMHLRMFELARDALNSDGYCVIGGYLSPVNDAYKKKGLISAEHRIQLCHLACKSSDFIMVDPWEASQSTYQRTLTVLSRVHNSVCETGLVSQESLKVMLLCGSDLLHSFSIPGFWIPDQVKTICKDYGVVCIPREGQDVEKTIFKDDILNENKDNIKVVNELVPNQISSTRVRDCIARGLSIKYLTADEVIDYIREQQLYLN

SEQ ID NO: 130118 - protein, 334 aa, Glycine max
  Coding DNA Sequence Number=SeqID_13340
  Gene Ontology: Mol. function=protein serine/threonine kinase activity; Cellular component=cell surface; Biological process =protein amino acid phosphorylation
  Homolog annotation: Hit_ID=Q9FHG4; Match level="QueryCoverage=95%, HitCoverage=47%, E-value=1e-131, Identity=72%"; Hit description =Serine/threonine-specific kinase like protein
  Pfam annotation: Domain name=Pkinase; Domain location=18-288; Score =167.1; E_value=4.6e-47; Accession=PF00069.15; Description=Protein kinase domain
  Pfam annotation: Domain name=Pkinase_Tyr; Domain location=18-288; Score=101.8; E_value=2.1e-27; Accession=PF07714.7; Description =Protein tyrosine kinase
  Pfam module annotation: Pfam domain module=Pkinase::Pkinase_Tyr; Domain location=18-288::18-288
MEDWEFHYKELKSATREFHPSRIVGHGSFGTVYKAFFISSGTIAAVKRSRHSHEGKTEFLAELNTIAGLRHKNLVQLQGWCVEKGELLLVYDFMPNGSLDKMLYKEPERGKLLSWSHRQNIALGLASVLVYLHQECEQRVIHRDIKAGNILLDGNFNPRLGDFGLAKLMDHDKSPVSTLTAGTMGYLAPEYLQYGKATDKTDVFSYGVVVLEVACGRRPIEREGSKMLNLIDWVWGLHSEGKVIEAADKRLNGEFEEEEMRKLLILGLSCANPDSAERPSMRRVLQILNNEAAPLAVPKVKPTLTFSSDLPLPLTIEDIVSEADQESMCEIKID

SEQ ID NO: 130119 - protein, 65 aa, Glycine max
  Coding DNA Sequence Number=SeqID_13341
MVVDEVAGVNAEIMVVDKVARVNAEIMVVNEVAGVVGVNAEIMVVDEVKTKRCNGLHTKDMQVID

SEQ ID NO: 130120 - protein, 75 aa, Glycine max
  Coding DNA Sequence Number=SeqID_13342
MTPLSSKKESLDSPLLRELRRSDFLFDGGCKDFDFDVLMMPYDHDVLMPCEHVLLKLRSRQKSKRFKKHHQEDLQ

SEQ ID NO: 130121 - protein, 125 aa, Glycine max
  Coding DNA Sequence Number=SeqID_13343
LGRVEEETKRLATIREAKLTGASSMGGKCAESPPTFIERKMLEKPKETDHEEYSRFGSYLYVDKSRALAPTYPPSKRKSDLRSSRKRGESSDSFLLERGVDKSGAFAPTYPPSKRKSDLRSSREC

SEQ ID NO: 130122 - protein, 240 aa, Glycine max
  Coding DNA Sequence Number=SeqID_13344
GFVRARVLSTIMDRLAYISEFWLSACLSRLADGLKRVALSGCSLSQQIGLARSHIKSKCSIFLKKKQGGENKVNVHNNKKKAYIAWEENASSTSSDSTNKEEYLYLMAIGEVESFVGSSDSKIELDENYDKLLHAFNEMHEEAKKLSQANNYLKGKRYGIPNGRYRWVPKRTTKVTDGSLLVGASMEAGSLSFNEEEGASPPRIALDKKLEEDALMDEKKERRGEHEIEGIKEGDKWNFE

SEQ ID NO: 130123 - protein, 216 aa, Glycine max
  Coding DNA Sequence Number=SeqID_13345
  Subcellular localization annotation: CTP_CleavageSite=31; ConfidenceScore=5.15e-01
MVVPSLCLPCVMSPSCNAIVIQFTHLSLMLRLPHNSSPSRTLLCQFHSRCTETIIADGVLLMPFSIVVVHDSSCLVVFDNVLVGFDSVFDIVLVVHGSEEMFNTVHVIDQPYGEVSRSFVVRWKDELEPTWHLLHSSGNMHFVTYSQDLVSSTLLVGWTELREFYGLTGNHQFLTQPLKVLLTEYKVTCNRCAEYHVLIDESYKIHPSEVGRDYRV

SEQ ID NO: 130124 - protein, 121 aa, Glycine max
  Coding DNA Sequence Number=SeqID_13346
MRPRPIAWSELEKWREEEKNLLPWNPAEEPSSVDTRRRSSFAVFNERRFFRSSCAVCLTKEVLPRDSTKEGSSAVDIITAEEVLLRKKVLPWNPAEELLPRVSPEEVCFTEQKRSRAFLGF

SEQ ID NO: 130125 - protein, 103 aa, Glycine max
  Coding DNA Sequence Number=SeqID_13347
MARMVDAATICVISEESRRPSIGNEEAWLVVTFGSAGNEYVGVVSSMGKLQWLRGKRSLFGFAKFRLNIYTVQSAKFSLKHALLMLLDTAKKRMQQMKQHYNN

SEQ ID NO: 130126 - protein, 40 aa, Glycine max
  Coding DNA Sequence Number=SeqID_13348
MTLPMMKIRRVVNGYKSTIYDRVENVGVKVMTGSQETFSQ

SEQ ID NO: 130127 - protein, 277 aa, Glycine max
  Coding DNA Sequence Number=SeqID_13349
  Gene Ontology: Mol. function=transferase activity, transferring glycosyl groups; Cellular component=integral to membrane; Biological process=metabolic process
  Homolog annotation: Hit_ID=Q8S9A8; Match level="QueryCoverage=92%, HitCoverage=65%, E-value=9e-97, Identity=70%"; Hit description =Glucosyltransferase-1
MRDSDGVIVNTCDPIEGRVIKALSEGLCLPEGMTSPHVFCIGPVISATCGEKDLNGCLSWLDSQPSQSVVLLSFGSLGRFSRAQVKEMAVGLEKSEQRFLWVLRSELVGVDSVEPSLDELLPEGFVERTKGRGMVVRNWAPQVRILSHDSVGGFVTHCGWNSVLEAVCEGVPMVAWPLYAEQRLNRVIMVQDMKVALAVNEDKDGFVSGTELRDRVRELMDSMKGKEIRQRVFEMKIGAKKAKAEEGSSLVAFQRLVSYPLPKAEYRIMESFVDYSC

SEQ ID NO: 130128 - protein, 159 aa, Glycine max
  Coding DNA Sequence Number=SeqID_13350
MSSSCWRWKVALKWKESKRVEKSQDFERRLQNLPGKGNPIQFPSHIIKWHDNNKRTRRWGGLQLMEGTISIRARGIVRTNSVSAYERNHQVSQPTLRREGEAKSKRSLPRKENAWESPPTFILGKTLEKPKRGLRIFKMRVRELYTHREGLLLLRTKVV

SEQ ID NO: 130129 - protein, 94 aa, Glycine max
  Coding DNA Sequence Number=SeqID_13351
  Gene Ontology: Mol. function=transferase activity, transferring glycosyl groups; Biological process=metabolic process
  Homolog annotation: Hit_ID=Q8S9A6; Match level="QueryCoverage=82%, HitCoverage=17%, E-value=1e-09, Identity=45%"; Hit description =Glucosyltransferase-3
MTGSWRKVARDEAPECFGEGGDDVGEVVVAGAGEFEGEDVGWENGGDLSGREVVEGDGGCRGGDGSDILGGGVTTLGCRRGVGGWSEDEYCDGK

SEQ ID NO: 130130 - protein, 137 aa, Glycine max
  Coding DNA Sequence Number=SeqID_13352
MEVKYRFETEYDCNMARTVWDKMRKDRYFDFLAKARLKEKATTKKEKEKSIVATTNKALKLDCKVHTRSSRNFEQHLKSMEVRENNKGKVHDIGHSLEIVISGSYGSSVRINVLCERHAQEEMKETLKDKMSVALKE

SEQ ID NO: 130131 - protein, 51 aa, Glycine max
  Coding DNA Sequence Number=SeqID_13353
  Subcellular localization annotation: CTP_CleavageSite=13; ConfidenceScore=5.00e-01
MASNPSKAQKKAKSSKRKQEECSQLSSPALSSSKETVHLSMLKFLTAHTNG

SEQ ID NO: 130132 - protein, 71 aa, Glycine max
  Coding DNA Sequence Number=SeqID_13354
MEKQAFETMAACPSDLMLSPEETSSPRRAGSFSPKQFEGPDELEASLGEPGSKKMLEMIPFAPPLVYFSHP

SEQ ID NO: 130133 - protein, 102 aa, Glycine max
  Coding DNA Sequence Number=SeqID_13355
MMKMTILAPNKRHMFGLWSCVLCLSICARFCSAAKLDEVTRERFYGNMPNGLLPESNNTLDKMFNRVLEKEFFYNDQTEGVVWMMPFSHVRGRWCLSFFNHM

SEQ ID NO: 130134 - protein, 78 aa, Glycine max
  Coding DNA Sequence Number=SeqID_13356
  Gene Ontology: Mol. function=serine carboxypeptidase activity; Biological process=proteolysis
  Homolog annotation: Hit_ID=O04084; Match level="QueryCoverage=55%, HitCoverage=11%, E-value=8e-11, Identity=61%"; Hit description =Serine carboxypeptidase isolog; 30227-33069
MTKPQDNPLVLWLNGGLGCSSVGYGATQDIGRGLKFNNFSWNKETFELDISITKKLLEGERGKIIHERGILVCGFSFV

SEQ ID NO: 130135 - protein, 58 aa, Glycine max
  Coding DNA Sequence Number=SeqID_13357
MDDKVVELRELSVKGVTIYLGVMLGRPTRTLQLGSCEKIMALIVEGVLDLELLMEGGK

SEQ ID NO: 130136 - protein, 64 aa, Glycine max
  Coding DNA Sequence Number=SeqID_13358
MGLVDSGPQTLDPFMYGPYVLNFLKLECHKLRNREENCLKSYETHLTSFNTWLGAPFPGFTCMK

SEQ ID NO: 130137 - protein, 73 aa, Glycine max
  Coding DNA Sequence Number=SeqID_13359
MANGEEFFKDEQNVGIIVALGGGGGSSYMGATSGIKAVESWGNEEMEWRGLKVHHERDQGHRQFSQRSKKWEN

SEQ ID NO: 130138 - protein, 147 aa, Glycine max
  Coding DNA Sequence Number=SeqID_13360
  Gene Ontology: Mol. function=ribonuclease H activity; Biological process=RNA-dependent DNA replication
  Homolog annotation: Hit_ID=Q1S4N4; Match level="QueryCoverage=65%, HitCoverage=26%, E-value=3e-18, Identity=43%"; Hit description =Ribonuclease H
MAMLKYSIMCPVREINVHWNPLASNSVKLNTDGRSLWNPNIDGFGGLLRDSLGQWISCYSGSCGIATCLFTELIVLYHGVNLAWNKGIRSLACESDSKVSLELIKGIRRNALASQGSNHRCPSRRGGACQCGGPGSCLTPLIEYCGQ

SEQ ID NO: 130139 - protein, 251 aa, Glycine max
  Coding DNA Sequence Number=SeqID_13361
  Subcellular localization annotation: CTP_CleavageSite=40; ConfidenceScore=5.46e-01
MTVKNPSQSSTSNSETSSSPSPINYRDKVKCKAGRALYVVAVMDSSNFTLKATLKGAKILIRTLFDRSFGEKDNEFKSKSLASFGKIVHWINMHSVLAHASTFQEENDHDILVTIATKPIKSTSSVPYGMLMTLVFKHFGVPLEDEDKDEDLLTWGEKNVSVLRMLRSLKKGCLKTILREEARAQNEDIHPFEGVGAVDASNIVSSTQAQEEPNVEIIVDVLAKLGTTDSTLEKEETEKEEEKKEKPFEKA

SEQ ID NO: 130140 - protein, 184 aa, Glycine max
  Coding DNA Sequence Number=SeqID_13362
  Gene Ontology: Mol. function=DNA binding; Biological process=DNA integration
  Homolog annotation: Hit_ID=Q1T035; Match level="QueryCoverage=89%, HitCoverage=31%, E-value=6e-40, Identity=39%"; Hit description =Integrase, catalytic region
MEEELSLFTKNKVWNHEHTLKNQLVIGTKWVFKNKLNDKGEATIILMAYVAHKDIKLYQMNAKSAFLNQFINEEVYMKQPPDFKDKEKPQHVYKLFKALKSGKGDLLIVQIYVDDIIFGATIEMMCKGFSKLKKEKYTKHILKRFRMDEARHMATPMHPSIVIDKEISILPKGYCDVDFVGDKV

SEQ ID NO: 130141 - protein, 154 aa, Glycine max
  Coding DNA Sequence Number=SeqID_13363
MEGPTLGWFQWMMRNYQLITWPSFLQAIETRFAHSPYKDPTGLLCKLTRKGSVKDYLHQFEALANRIVGLSPSFLMSCFISGLDPEILQEVQAMQPFLLCMSPGLCAFRSKRRRRAQKVKKGNYRIHKSYVPLGAVSMLAQCPNSSKAYNAKIC

SEQ ID NO: 130142 - protein, 225 aa, Glycine max
  Coding DNA Sequence Number=SeqID_13364
  Homolog annotation: Hit_ID=Q9FKY8; Match level="QueryCoverage=94%, HitCoverage=70%, E-value=3e-70, Identity=64%"; Hit description =Arabidopsis thaliana genomic DNA, chromosome 5, P1 clone:MUD21
  Pfam annotation: Domain name=DUF1649; Domain location=9-148; Score =205.0; E_value=1.8e-58; Accession=PF07855.3; Description=Protein of unknown function (DUF1649)
MNCEVCQLKELELEHFEIREVLRCILHTIVFHRALGLVRPKDVDLELFDVTYVQCGEAELEKKIDEKIEQFVCWVEKHPNKKSQICLSFYEVKNKQASWFSNKIERLYWEQWYINLNVAQHPKAHSSKYHHSKVVDPGGALIALFVKLNLFSCFTPTVNLPVFLCFLQVEGALEDRNARSAALEASLREVLFQIIKFVNEKKDHVPPIPNLEGAVSFPYEITIPR

SEQ ID NO: 130143 - protein, 166 aa, Glycine max
  Coding DNA Sequence Number=SeqID_13365
MMTKVMTKNSKINQRTTQLIKIESRTIQEFKIESRRIQNSRGKLRVKNQDSRFKISRIKIKIQDSRFKNQEKGAVKVKVSVLSIAVVVGGIRVSYGSNVFQDYFVDAKDSSQESRVKQVSRIKESFNQSKFQESKSRSIKTSFKNQRVVQSRFKVKVKIQEKTQLR

SEQ ID NO: 130144 - protein, 226 aa, Glycine max
  Coding DNA Sequence Number=SeqID_13366
  Gene Ontology: Mol. function=DNA binding
  Homolog annotation: Hit_ID=Q1RUD8; Match level="QueryCoverage=91%, HitCoverage=40%, E-value=4e-27, Identity=37%"; Hit description=IMP dehydrogenase/GMP reductase
MASQEKWGPFADILALLIFGVVLFPNVDGLVNLPAIDAFLAYHHSKESPVVAILADLFDTFDRRCEKNSARIVCCLPALCVWLISHLFQQDTRHPCPLQSYRSCAEKGRVDWDQHLAGIGGSAINWFPRWKEGNEGVLFSCGDYPNIPLMGTRGCINYNPVLAIRQLGYPMRGAPTEESLSPFLVRNLGAQSLEAIQRVHKAWRSPLRKDKELRGIRNGVIGGYHG

SEQ ID NO: 130145 - protein, 381 aa, Glycine max
  Coding DNA Sequence Number=SeqID_13367
  Homolog annotation: Hit_ID=Q4KDK9; Match level="QueryCoverage=36%, HitCoverage=78%, E-value=3e-22, Identity=40%"; Hit description =Acetyltransferase, GNAT family , putative
FIKFACAHVLAHHFQPQIAFLLIARGVDNAFEHAPAIVFTGFLRIEVELIQLGTAHAGVRYRRIPGHFGKADGFVGFGNQPAFVGGYQAAAQFGQAVLFVDEFIQLGFGDPHMFEVGAVGHAPQLMQQFGIIRLRVAYGEFHASLPSVFMFYPALRQSGGVSGHPARTGDPSLCANQTGCHPFCVADGLIAEVQRMPDLSHAARTRQPAQQRELALGQHIGVAVRCGDGGNVFRRQHRTDQRRQRAFFTQDQRFLQVAGDVIQHGFIADVGENHQLDARCFELHQQQATQRLFQVFIGKMQFADHHVTPASGGDRVIRRGERQAAYHLPGKVEAQTFRNPAVAIHSEDVQHCFLLCSRLIHLNGNRAEPISDGLRQVVGKG

SEQ ID NO: 130146 - protein, 119 aa, Glycine max
  Coding DNA Sequence Number=SeqID_13368
  Gene Ontology: Mol. function=protein binding
  Pfam annotation: Domain name=Arm; Domain location=36-76; Score=18.3; E_value=0.027; Accession=PF00514.13; Description=Armadillobeta -catenin-like repeat
VHIIQRGVIPQLVDMLKFSYRHGEMSVFALGSLAPESHNQAIIAHNGGIEPLLTMLDSNKAALQHRAVLSLYGLADNELSDFIEAGGFQKLKDGHFKYQSTKQCIETTLKRLEEKMQGQ

SEQ ID NO: 130147 - protein, 478 aa, Glycine max
  Coding DNA Sequence Number=SeqID_13369
  Gene Ontology: Mol. function=oxidoreductase activity; Cellular component=chloroplast; Biological process=metabolic process
  Homolog annotation: Hit_ID=Q1LM49; Match level="QueryCoverage=98%, HitCoverage=99%, E-value=1e-154, Identity=57%"; Hit description =Aldehyde dehydrogenase
  Pfam annotation: Domain name=Aldedh; Domain location=19-475; Score =594.9; E_value=7.4e-176; Accession=PF00171.12; Description=Aldehyde dehydrogenase family
MQRSIAMHMIEHIYINGQFVTPDGDEWLDIIKPADGSVIGKARLADAQDAERAIAAAAAAFPALAATTVAQRITLLEQMYHAVNRAESELRAAILEEYGAPTARSEWMSRYPADVILQVIEELKRYPFVQQAGRAQVQMLPLGVAGLITPWNSNAGFICHKLATAIAAGCTAVIKPSEFSLLQTQVITRALHTAGLPAGVFNIVTGRGASVGEALSRSPQVAKISFTGSTATGKAILRSAADTFKRVTLELGGKSPTLILPDADAAQAAGLAVQAGFINSGQACIAGTRILVPEQRKAEFEQALTAAVAAEVSGDPADARTTIGPMVNEKQWQRVQHYIALGEQQGARLLTGGSGRPDGLHHGWYIRPTLFSDVTNEMPLAREEIFGPVLSILTYRDEAEAIAMANDSDYGLSALVIGTDEQHARQVGEQLIAGRVMINTLAHEPRAPFGGFRHSGIGREMGQAGISAFLEPRALIAG

SEQ ID NO: 130148 - protein, 84 aa, Glycine max
  Coding DNA Sequence Number=SeqID_13370
MVLKAKYNEHPWESIWWKDIKKICGGLSDNKWFDEGVTWKGSQILEDSWWWQLENSGIYTTKSTNAYLVDSVEESQISPLFKVL

SEQ ID NO: 130149 - protein, 65 aa, Glycine max
  Coding DNA Sequence Number=SeqID_13371
  Homolog annotation: Hit_ID=Q8S4W7; Match level="QueryCoverage=54%, HitCoverage=6%, E-value=1e-11, Identity=88%"; Hit description=DELLA protein GAI1
MWWHASMLLALFGGGDGYRVEEHNECLMLGWHTKPLIATSVSTHCKTGDGCSLSRLADSLINFLT

SEQ ID NO: 130150 - protein, 193 aa, Glycine max
  Coding DNA Sequence Number=SeqID_13372
  Gene Ontology: Mol. function=hydrolase activity, acting on ester bonds; Cellular component=nucleus; Biological process=lipid metabolic process
  Homolog annotation: Hit_ID=Q1SYS9; Match level="QueryCoverage=71%, HitCoverage=40%, E-value=1e-29, Identity=49%"; Hit description=GDSL -like Lipase/Acylhydrolase
MQGATISFRLQLANHIVIVSQIVSKLGSPDLALQYLEKCLYYVNIGSNDYKNNYFHPQLYPTSCIYSLEQENGLCIDNALHNLGVRKYVLAGLGRIGCTPTVMHSHGTNGSCVEEQNAAISDYNNKLKALVDQFNDRLMNSTRKDYGQPGNFPEEEVQIMAYLAEGVFPARSRHSTNHERSRLDSFEYFPRKM

SEQ ID NO: 130151 - protein, 54 aa, Glycine max
  Coding DNA Sequence Number=SeqID_13373
MKEVEGMKGVVEEDGKEDSVEESNDSRLTGETVGEVKAVADMHQRKVEMAKQAL

SEQ ID NO: 130152 - protein, 138 aa, Glycine max
  Coding DNA Sequence Number=SeqID_13374
MGIKHFEVVKQRSHADKQWSPDEIRGVSACYPTSHSSGWQNCVWAQITLGCLYLPPDAQDQQMLSLYGQSLGYIHLPPDAWVRISRCCLCTNNHWGISACRLTQGSGSTDVVRPKEVQITVRRLRMLPDSRVTLAGWG

SEQ ID NO: 130153 - protein, 162 aa, Glycine max
  Coding DNA Sequence Number=SeqID_13375
  Gene Ontology: Mol. function=succinate-CoA ligase (GDP-forming) activity; Cellular component=mitochondrion; Biological process =tricarboxylic acid cycle
  Homolog annotation: Hit_ID=O82662; Match level="QueryCoverage=63%, HitCoverage=23%, E-value=2e-22, Identity=58%"; Hit description =Succinyl-CoA ligase [GDP-forming] beta-chain, mitochondrial precursor
  Pfam annotation: Domain name=ATP-grasp_2; Domain location=2-149; Score=-102.8; E_value=0.00041; Accession=PF08442.1; Description=ATP -grasp domain
MDVASINPGEQLVVKSQILARGRGLGTFKSGLKGGVHIVKIDQVEDIVDNKLVLPIVTSHLLFFIDPVCRTAKVATKVYLCEKLSLVNEMYIAITLDRTSVGPLLSVSVVKDNILEAVKVLIGRCLRKHRLRKLAFKDGAYVGTILESLCLRKHRLRKLAIF

SEQ ID NO: 130154 - protein, 375 aa, Glycine max
  Coding DNA Sequence Number=SeqID_13376
  Homolog annotation: Hit_ID=Q9C519; Match level="QueryCoverage=45%, HitCoverage=33%, E-value=6e-37, Identity=47%"; Hit description=WRKY transcription factor 6
  Pfam annotation: Domain name=WRKY; Domain location=256-298; Score =45.5; E_value=1.8e-10; Accession=PF03106.6; Description=WRKY DNA -binding domain
MHSYGAVKALVVALEKETMMAKEAKENAVFLKGGGLRGKKNAVTVQYLLCSAVKENKVKAVSAGVMRTLVELMVDLGSSMEDLGLSIVYLVSVVVAVAVVEGIYDFKGALHHRATPPSNPVELQRMNAENKKLKEMLSHVTGNYTVLQMHLVTLMQQNQQRTETMENGGKVEDKNHGVGGGKVPRKFLDIGPSDRAKVDDQVFDSSFDERTRSSMPQNNNVKLEQEMEQEITMKVNPSNPMDQSTAEATMRKAPTISDGCQWRKYGQKMAKGNPCPQAYYRCIMAVGCPFRKQTSSLPVALWTQAIKVGVWRTRAKDHMGNVVRFAMVVLHKFQFDAILPRKGPVTRAMSKRLQEDWARADKEGLRVLMNLRVDF

SEQ ID NO: 130155 - protein, 53 aa, Glycine max
  Coding DNA Sequence Number=SeqID_13377
MIGAFSQNTVTLTGLPMILPSESDLTYYCVMNRWMTMKNLMLEDTGTPRSDRM

SEQ ID NO: 130156 - protein, 88 aa, Glycine max
  Coding DNA Sequence Number=SeqID_13378
  Subcellular localization annotation: CTP_CleavageSite=37; ConfidenceScore=5.31e-01
MFRSFRRFPQINVGGDSARLPPLEDAPVSLASPSRRRVMAPKKLSTKRSRKDTSGEGSSAAQDFDSHRFRSVSRPSKDGRSSGRGGSS

SEQ ID NO: 130157 - protein, 123 aa, Glycine max
  Coding DNA Sequence Number=SeqID_13379
MDRSTAVRKEKQMGNNKLDLKERKNKKSKLDVQGLFIRLGFGMDLLPGRKPDLGKRTAEDSGFLSLASHSDFLLVELSTRVANQRSNALKWINRIPCWKRKSRESSQSALLQITDRRSREELN

SEQ ID NO: 130158 - protein, 261 aa, Glycine max
  Coding DNA Sequence Number=SeqID_13380
  Gene Ontology: Mol. function=binding; Cellular component=nucleus; Biological process=mRNA editing
  Homolog annotation: Hit_ID=Q6K2P5; Match level="QueryCoverage=82%, HitCoverage=57%, E-value=2e-32, Identity=32%"; Hit description =Putative pentatricopeptide (PPR) repeat-containing protein
  Pfam annotation: Domain name=PPR; Domain location=188-222; Score =27.3; E_value=5.5e-05; Accession=PF01535.11; Description=PPR repeat
  Pfam annotation: Domain name=PPR; Domain location=226-260; Score =18.6; E_value=0.023; Accession=PF01535.11; Description=PPR repeat
  Pfam annotation: Domain name=PPR; Domain location=98-132; Score=32.4; E_value=1.6e-06; Accession=PF01535.11; Description=PPR repeat
  Pfam module annotation: Pfam domain module=PPR::PPR::PPR; Domain location=188-222::226-260::98-132
MSSSPCFASDAILPRMGPVPRAMSKRLQEDWARAAEEGPRVLMNLREGKINNTRMMFDKMPEWDIGLWTTMITGYLKYGMIREATKLFDRRDAKKNVVTWTTMVNGYIKFNQVKEAGRLFYEMPLRDISTIVTTLVQCGSIEDEWRIFYQMNERDVVSWTTMVAGLSKNGRVEDGRAFFDWMTVWNVVSWNAMIMDHAQNRRLDEALELFQRILERDMHSWNTMITTWTARMTEYVQHGLSEEALNVFNKMLATDWVKTQH

SEQ ID NO: 130159 - protein, 58 aa, Glycine max
  Coding DNA Sequence Number=SeqID_13381
MAHKKNKTAKNPGINNEDDVKKNEWVLEWDHKEKLILHRKCFHTFTSFTNQVKSFLNL

SEQ ID NO: 130160 - protein, 48 aa, Glycine max
  Coding DNA Sequence Number=SeqID_13382
MAKNKVHNKDGAAKEPTSGISEMGLKHFVVASYAPAAPFVVSNVQNQG

SEQ ID NO: 130161 - protein, 84 aa, Glycine max
  Coding DNA Sequence Number=SeqID_13383
MTSYSNMYKDNWTQPWPMGLEIYPEVHENPRAFFSNSSPILLEPLAHGSSDWSLPREDCIITKKRLSCEGYFSHQIYYFIDPSG

SEQ ID NO: 130162 - protein, 65 aa, Glycine max
  Coding DNA Sequence Number=SeqID_13384
MSRPPNFKGREGFLLESGMAGLIDVTSLHQQESAKTRKTKAFDASLGLELREHRGYRTKPLLRQD

SEQ ID NO: 130163 - protein, 157 aa, Glycine max
  Coding DNA Sequence Number=SeqID_13385
  Subcellular localization annotation: CTP_CleavageSite=67; ConfidenceScore=5.68e-01
MDPPPPKKLNKSAMSSSSWALSSTPGAPASPAPAQWPSRSGLPRWRRCVCCLRLGFSVLYLSGSTILLNEGPSDRRSDDLAGYNGHSVELAEARDQSRKPQGPVGLLRVQGGKVRVVVAREDVVEQQRHPHLGQGGHAGAHDPHPPPCGSPGKIMPW

SEQ ID NO: 130164 - protein, 237 aa, Glycine max
  Coding DNA Sequence Number=SeqID_13386
MTLSVIHPKSNMIKVLQEHNKSLGDDNASETLRLLAIGPKLNVLTWKGCDMKKISFYTKSQANKSRVQNSRINGNTDVRHDEIGFALVDLDKVAYKDEPFIMAEQAKSLTTRQLDEPKVVVHVNHATKRVSRLHEEKFHQYLGMVVGYKIHTLYPNWKVVPKALKNLIWDDIVGSFVPHGHQDILTTTIRRPKHSSHVHVVGVGVTISQYFGHASHGSNSSTSITPQQLVEIIEPLK

SEQ ID NO: 130165 - protein, 80 aa, Glycine max
  Coding DNA Sequence Number=SeqID_13387
MRKSPGHAQREVNMKRVIYWEMVHLWTPITILLPMHPPDIKLSDEDDSSLGKLHKYEGRDCEPSSKLELIVSWEAIDRNS

SEQ ID NO: 130166 - protein, 263 aa, Glycine max
  Coding DNA Sequence Number=SeqID_13388
MAFIFITPSMFNMSDTKEMKTLMHPTTHLGPDEESMKVDGTQYRAMIGSLLYLTMSRPDIMFNPIRTFWQYAEFVNKKTITSKVLGVKVVLSCDTLAKAGRRTTTPTSPELSTLRMQTSIYYAALINKLLWDQGVYHVFNKTGSIVVKQQKFSKSNLKAMKVALEQTLKEAPEVDVDTINKRKQKRLAKSIANEDLSLESFGITRIIKKIMSQRDEEEEEILVKEHWTKKRHEYVVSTPTCPPTVNLVAQQLKELSEIDDDEE

SEQ ID NO: 130167 - protein, 80 aa, Glycine max
  Coding DNA Sequence Number=SeqID_13389
MAIYLLEDSSPWQHRVYADPIDNSSKGCQRFTLELSTGTPNKSARSCSEIRISVPFSVAFSVKLLLSTSVATKKVLTSRG

SEQ ID NO: 130168 - protein, 195 aa, Glycine max
  Coding DNA Sequence Number=SeqID_13390
MVKAQKIAHVTKIHEAQQKRKVDVVVVAEIGAKKAAEKETAATVQAEAFAKAMDDTVVHGVLIDLTNTGVMDEIGEMSNAAMADEVEPLISDLASKQTSNSNEATSQDKDDHDAVIVSSTSSSPTPLNYAQHAIVTRDQNVQQAQLSMLGVVAAPALVSQSVSLEPPPQPLASIPQPPSSSQPPFEPLPPPLSQD

SEQ ID NO: 130169 - protein, 120 aa, Glycine max
  Coding DNA Sequence Number=SeqID_13391
MCICSLFIHSPMSHNKGYQGQSKDWAVSFTGNKENLASSSTEDESTDDFPLMPLCKFVPTPQPCPALSPLDLDRFKRAAPREKLTDEQFFPLAFIYGNPTLIILFSEAIFSEAVYAKAPT

SEQ ID NO: 130170 - protein, 201 aa, Glycine max
  Coding DNA Sequence Number=SeqID_13392
  Gene Ontology: Mol. function=structural molecule activity; Cellular component=extracellular region; Biological process=keratinization
  Homolog annotation: Hit_ID=Q28658; Match level="QueryCoverage=63%, HitCoverage=67%, E-value=2e-11, Identity=33%"; Hit description=Small proline-rich protein 3
  Subcellular localization annotation: CTP_CleavageSite=57; ConfidenceScore=5.09e-01
MSSPSEDYTSSTSKGYTPTPLEGYTSSPSKGYRSLPSDGYTPSPPEGCTSSPLEDCMSSPSEGFTSLTSEGYMPSPLEGCTSSPSKGYTPSPSEGYSSSPSHDYMPSPSEGYTPSPLEGSTLAPLENLRIAPLRHSVDPEKSNRVLGVSNFDYDSLAFIEKYCAPRRAQGKAPQQPGDGRQRATDAPPPPPESTSSHLQRL

SEQ ID NO: 130171 - protein, 143 aa, Glycine max
  Coding DNA Sequence Number=SeqID_13393
MPFSFSHSRNLTYSRKSLETMDEHQQNWKEMTNTMMKINKKVKEMFNIIHVIDQTCGEVSRSFIVRWKDELEPIWHLLHSSGNMHSVTYNSNLVSPALLAGWTELREFDGLTGNHQVTLIYYRQSVFLLIIFKSTSEPRAYSK

SEQ ID NO: 130172 - protein, 311 aa, Glycine max
  Coding DNA Sequence Number=SeqID_13394
  Gene Ontology: Mol. function=DNA binding; Biological process=DNA integration
MEDAPLGSSERPFCTLAGGQAVTPLTMSQASLLLASSLPWHGYYYASYSPSSNHSSFFSSSPKAQKPKKEYPPKILPGYSWVYGEVKTYASSFRTYESITYFLEGAKFFHDDRLDVMIISLVLPTRIDTLGPFPRAPGQVKYLVVAIGYFTKWVIAETLATITTENIENFVFRKIICRIEEKSKRGQMNLCSITATHPMGISNNPYSAKGETPFKMTYKTKAVIHVEIGEPTFRIVNLNLNQNEGNPITEHDLIKQRRERVTWSYGKLVLEEKNNHQGKKLMFWKCSLEKEFLALGTPPTCGNTSARIGKW

SEQ ID NO: 130173 - protein, 65 aa, Glycine max
  Coding DNA Sequence Number=SeqID_13395
MKRYKSFWEGPSRANVKIAKIELEIVALKGQVAQVDALKAQVAEVDVLKQQLVFLMQTIKGNQVK

SEQ ID NO: 130174 - protein, 144 aa, Glycine max
  Coding DNA Sequence Number=SeqID_13396
MDLVLTEFGKIFSQCCSSMSSYTTVVECTCEDILTLKLALRGILGGLGRGRMLFPKVHPIGESSNDEHSHHHDGSNVAICHTLISSRDDHLQTFGFLPAELSCLTPIVVQSIRFFYVSEGNVQNTQKEGKRALLGHFSAPEPPR

SEQ ID NO: 130175 - protein, 113 aa, Glycine max
  Coding DNA Sequence Number=SeqID_13397
MAGVDEVQEQMKVDMEAMKEQMARMMEAMMSMKKIIEVNTATVATVSTVYRVDPTPPSGLNLINRLTSDMGDPHFVLVQNKYVFPPYGLPPNYTPPNDNVNNSTLILIENQQP

SEQ ID NO: 130176 - protein, 353 aa, Glycine max
  Coding DNA Sequence Number=SeqID_13398
  Gene Ontology: Mol. function=RNA-directed DNA polymerase activity; Cellular component=nucleus; Biological process=RNA-dependent DNA replication
  Homolog annotation: Hit_ID=Q1S226; Match level="QueryCoverage=66%, HitCoverage=76%, E-value=2e-33, Identity=35%"; Hit description =Cyclic nucleotide-binding
MEPTSSVSSRLAKTACSTISAAEKTREAGEVATVVLVGEKFRPAEDCLGKVGDSLSPKGERWFGCAGFGKIQQCLTWKMAVEPLPPSGGIVGESIGFQIWKLENGIKWKIGCGSKVKFWEDGWLAGGIPLNEKYPHLYSTTAYLNNNSILSSSWGGVYTVGSSYKVLNRHFSGENNYEVFKELWKLKLPSKVSHFDWRLILDRLPTKVNLRRRNVDLNDVSCTFGTSCEEDVSHLFYSCDKIWPLWWEALSWLNIAVASPKSPREHFLQHSHGYLKGIRVQRWQTIVFSNERFNGQKQMDDAIFFCWIWLKNMENGFGIPFHSWATNIRVGVVYFNLDLWMLNSCNTACIRTP

SEQ ID NO: 130177 - protein, 552 aa, Glycine max
  Coding DNA Sequence Number=SeqID_13399
  Gene Ontology: Mol. function=metal ion binding; Cellular component =nucleus; Biological process=regulation of transcription, DNA -dependent
  Homolog annotation: Hit_ID=Q94JW8; Match level="QueryCoverage=54%, HitCoverage=65%, E-value=2e-28, Identity=32%"; Hit description =Squamosa promoter-binding-like protein 6
  Pfam annotation: Domain name=SBP; Domain location=183-290; Score =93.8; E_value=5e-25; Accession=PF03110.5; Description=SBP domain
MESWSYVAEEKGYVSSEALSPPNTLERSKGSCFGWELKTPCSFSNDMLGLGQQNVEDQGFGELGFPGMLGKQLCGDDPNPIGAVQSRKVDDVVVDCRITSPSPVVAAPNGFSSREDFNSKLSNALVDSNGGNSLIDLKLGWFADHGDAMVPTFSKGAPILSSSELSTPPKRVRASGAHSQTAYCLVYGCNKDLSGCKDYHKRHKVCEVHSKTSKVIVNGIEQRFCQQCSRFDPLKGLPPFSHKMENNLEIRGCMVMVYSAAVMFSLLSRFHLLAEFDDGHNERRRKPQVGIHSGKAGRLLQPYADSRFQETMLTSSFICQEILPSGVLSSEKYGASDMWRPIKAEDSTGFTFRPLSSIPITNGHPQSRSLFPSYSGKQLPFLHENGATSATGNIFSENNNQYNPPSLGGQSSGSQSLFQDSSLGREDFNVFDTESAVQGLSGISDSGCALSLLSSQSQNSSGQSSGIPIAHPMVIPSSHSHYNMSRVSEKMIGISSQASSGVSDRFPPEFNPVDGSHLSPILISDNNEIINFEMANGIFQGSDFVTVKDRLS

SEQ ID NO: 130178 - protein, 63 aa, Glycine max
  Coding DNA Sequence Number=SeqID_13400
MVTNWNPTILANTSLKLVNGYLSFLACKISKPYHGKSLRDCYQWWIVEWKAKFTSYKEPHCAF

SEQ ID NO: 130179 - protein, 181 aa, Glycine max
  Coding DNA Sequence Number=SeqID_13401
  Gene Ontology: Mol. function=4 iron, 4 sulfur cluster binding
  Subcellular localization annotation: CTP_CleavageSite=53; ConfidenceScore=5.84e-01
MAVGAVSNSTLFLPSSLLSSSKPNPLTIPFSFYLTKTSPFSISVLTRQRRFLSVSSLTADHHNLSDFGDGDSVAISNEGLKMLLKGMTYPELEKWVQSHGYRPGQAMMLWKRMYGNNIWAHHIDELEGLNKDFKKMLNENAEFKALTQKEIRTASDGTRKDIADFIHIGRWAGHRNSCHTL

SEQ ID NO: 130180 - protein, 49 aa, Glycine max
  Coding DNA Sequence Number=SeqID_13402
MSEPPRDMNPETRWGTAQARGLNGGKNTIQINEWEKKPFSIQELGKGKH

SEQ ID NO: 130181 - protein, 104 aa, Glycine max
  Coding DNA Sequence Number=SeqID_13403
  Gene Ontology: Mol. function=RNA-directed DNA polymerase activity; Cellular component=chromatin; Biological process=RNA-dependent DNA replication
MGEKQEHAFTALKGKLTHVPILVLPNFTKSFEIECDASNVGIRAVLMQEGHLIAYFSEKLNEGVLNYSTYDKEFYALKSKSKVKPHGLYSSLLIPDCPWIGFQR

SEQ ID NO: 130182 - protein, 117 aa, Glycine max
  Coding DNA Sequence Number=SeqID_13404
  Homolog annotation: Hit_ID=Q2PS26; Match level="QueryCoverage=40%, HitCoverage=8%, E-value=3e-07, Identity=52%"; Hit description=SUMO isopeptidase
MTAPFSAYAEDGGRYSLHGRKDAFQAIQLDGSRSRKGLPIVLDVDDDDGGDNNDEYDDDEAHIVEKTENKFPEYLKEAKIYFPSRDDPECVEICFTDTNCLAPEGYLTSTIMNFYIQ

SEQ ID NO: 130183 - protein, 397 aa, Glycine max
  Coding DNA Sequence Number=SeqID_13405
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=Q0PW29; Match level="QueryCoverage=96%, HitCoverage=98%, E-value=0.0, Identity=80%"; Hit description=GRP -like protein 2
  Pfam annotation: Domain name=RGP; Domain location=10-386; Score =850.3; E_value=9.5e-253; Accession=PF03214.4; Description=Reversibly glycosylated polypeptide
MSSSSGSTAAATPILKEEVDIVIPTIRNLDFLGMWRPFFEGYHLIIVQDGDPSKVIKVPEGFDYELYNRNDINRVLGPRAHCISFKDSACRCFGFLLSKKKYIFTIDDDCFVSTTLCLFIGKFTVRFLCYIYEIYGHGAGFISQVAKDPSGKEINALEQHLKNLLSPSTPFFFNTLYDPYREGTDFVRGYPFSLREGVPTAASHGLWLNIPDYDAPTQLVKPLERNNRYVDAVMTIPKGTLFPMCGMNLAFNRELIGPAMYFGLMGEGQPIGRYDDMWAGWCVKVISDHLGLGVKTGLPYIWHSKASNPFVNLKKEYKGIYWQEELIPFFQSVSFPKECTTAQKCYIELSKQVKAKLGKVDEYFNKLADAMVTWIEAWDELNLSGVKSEALSNGPAK

SEQ ID NO: 130184 - protein, 377 aa, Glycine max
  Coding DNA Sequence Number=SeqID_13406
  Gene Ontology: Mol. function=RNA-directed DNA polymerase activity; Biological process=RNA-dependent DNA replication
  Homolog annotation: Hit_ID=Q1T493; Match level="QueryCoverage=81%, HitCoverage=57%, E-value=5e-26, Identity=27%"; Hit description =Nucleic acid-binding, OB-fold, subgroup
  Pfam annotation: Domain name=Rep_fac-A_C; Domain location=152-293; Score=-65.0; E_value=0.039; Accession=PF08646.1; Description =Replication factor-A C terminal domain
MTRKVNSIMDVTAQKETWKVCVCVINMRVIQRAARINIEMILMDENADKIVAQIKNVDPGKWNDVVKVGAYAVSIQNSMYGSRLFINEDLEDIEDYKNGLDPSQLSVVTCSQRLGQVSYSSQPTSEDRFLYNAQVKSLSELCELKKECVCVTVATITKFLVDNGWIYESCPKCNKKVECEKFPYTCQCCGNESATTVARFRLEVRVGQPNETANFTLWDRECNVLIKESASKIKQQMIDEEGEFDPMDISEAIDRILGKKLAFRFKAIPNNTRYSMSQTSKDEYLIMLLLKRLPTCELVGDDIVYTISYGNICCIYILPQQQSLSVSGDFDSESSKSVTPAKRGFMISKSQLKSVPFEDLSSIQLSYSKLSKHIKSE

SEQ ID NO: 130185 - protein, 45 aa, Glycine max
  Coding DNA Sequence Number=SeqID_13407
MPLIQFLNNVGHNEEKLKMSWSTKVNLVGKNQTGISRGCGFECRY

SEQ ID NO: 130186 - protein, 274 aa, Glycine max
  Coding DNA Sequence Number=SeqID_13408
  Gene Ontology: Mol. function=RNA-directed DNA polymerase activity; Cellular component=extracellular region; Biological process=RNA -dependent DNA replication
MLGEEDNFLSVEVNMVILIPSEFWAYAKQSNKLDGDVFVEDVECASLIIDPNQQGKAMIFEKPIEEMGRHLKPLYIRAHINDKTLSRVIVDGGVVLNVIPINTMKKIGKGVEDLTTNMKMIKFTCGGTYAWRVLVVDITVGTKTKKIVLFVVDAKPAYTLLLGRDWIHRNQVEKVHANKRPFKVEPWWACCPNNALAGQLIRRKIPPFEAQDLLIEVNLDTSKEPRMTKVNGLLNEEQRKKLVEHIKNIKILSHRNLNWVLNLPNNHQGGLTHS

SEQ ID NO: 130187 - protein, 124 aa, Glycine max
  Coding DNA Sequence Number=SeqID_13409
  Homolog annotation: Hit_ID=P24465; Match level="QueryCoverage=48%, HitCoverage=19%, E-value=5e-07, Identity=54%"; Hit description =Cytochrome P450 71A1
  Subcellular localization annotation: CTP_CleavageSite=38; ConfidenceScore=5.38e-01
MVVVCQCVSPLWGRAGAGSSLLRAGSSPLVVAGCGVVRVGRVVVLCVVRPPAALLHFNFGMKSDEESLNGVGNCGGYEEEGGGIRLEQVGVFGYGYKRKHEAPSNAIVRDPSAWDEAEQFWPKI

SEQ ID NO: 130188 - protein, 85 aa, Glycine max
  Coding DNA Sequence Number=SeqID_13410
MVEKRGGNLKKCHRIEVAWRVGMVADPTQPYPKLKCKSAAGGRTTHNTTTRPTRTTPHPATTSGDDPARSSDEPAPARPHKGDTH

SEQ ID NO: 130189 - protein, 76 aa, Glycine max
  Coding DNA Sequence Number=SeqID_13411
MLLPVLGLAWLRRGYGVEEGVAHNVTRRGEHLCFVHSLQNLSTSDVLTFSLCLCDQGTLLDFGVVKGTMRENEILW

SEQ ID NO: 130190 - protein, 813 aa, Glycine max
  Coding DNA Sequence Number=SeqID_13412
  Gene Ontology: Mol. function=helicase activity; Biological process =viral genome replication
  Homolog annotation: Hit_ID=Q94LS3; Match level="QueryCoverage=71%, HitCoverage=67%, E-value=1e-83, Identity=36%"; Hit description =Putative helicase
MEDAPVSPRVALPPKVYDYFGTAWFKLPNADVAKLLNEDCHDVILSTEHADPRLYPPQVMLLIGKHLLFLIDRESAEGRCVQDAVNYLNGYMVHQICHDKQVLRMSHAKEFLTVAQELGAKIIAQRSSIENAKMIIAQPAPSVVLIEWIKKQKEDPKISSDLVAASLASFGLLNNEILDCSFGAQHANDSLHHTNESSSHKNAEDAETDDVVPDYENELLDCVDDTAEDISIGDPSQICPYCQAAMCYQEKTRKNRKQANPKYSLCCSMGKIQLPFLKNPPMLLQQLLCDDESRKSRNYQQYIRAYSMMFAFSSLGAKIDTNGKKDERIYNLPTVLEVAAVIVGDASQPINRDIILEKQRGRLQRINELHPDIDTIEFQKRGLPHARILLFLDAGSKYPSPVDIDRIISAEIPYSIEQPQLYECVKKHMMHGPCGHTNKQSPCMKDGKCSRYFPKNGKLKLLLTKTAVMFIKGIMMAHLNIEWCNQSISINYLFKYINKGYDHITTALMPVENEDGKTEQTIHKRSPIVERLYFHLPGENSVIFEDGDDIDALLSKPTIKESIGYTIGRLNWVPPSTGEFYYLRMMLVVVKGPTTYEQIRTVNGQLYSTFREACFAMGFLVDDEEYIEALREAYHWGSSQFLRRFFVTMLLTNNIERPNHVWSKTWECLINGILHQQRRIRDIPGAGGMFFLYGYRGTGKTFMWKTLAFALCSKSDIVLTIASSGIALLLLPNGKTAHSKFSIPVSTLQNSTCNIHQGIKQAELLKETKLIIWDEAPMAHRYCFEALDKTLNDIMCMCNSDNVPFGGKIVVFR

SEQ ID NO: 130191 - protein, 196 aa, Glycine max
  Coding DNA Sequence Number=SeqID_13413
MTETSTVMVALVGAFAAMTGKLLHSVLVANEVVEEAKRIVWDDERSDKKKKLFESYVVGEKKIQVDLLQYVDDTIFMGEATGYWVGEEVLERYSHMLNCKELLHEETLIWSEVLVCKYRGQRGLSSAVVSRNSSIWRRHLSLVRGGTNVGRWFDALVGRKVGNDRGGGGGFDGKESYLNGKIGHGGFMRRLRVFSE

SEQ ID NO: 130192 - protein, 101 aa, Glycine max
  Coding DNA Sequence Number=SeqID_13414
  Homolog annotation: Hit_ID=Q1T0D6; Match level="QueryCoverage=27%, HitCoverage=4%, E-value=2e-08, Identity=100%"; Hit description =Pyridine nucleotide-disulphide oxidoreductase, class I
MKSIAQTVHIQEKTPSFEFECVVQSGTIYPLPTIAIQSGTDSSLSAWSLVITVLPEERGWIRRFRSFLELLIAEEIMTVSVYFITYVDCKNKAVGLHESLN

SEQ ID NO: 130193 - protein, 235 aa, Glycine max
  Coding DNA Sequence Number=SeqID_13415
  Gene Ontology: Mol. function=protein kinase binding; Biological process=regulation of cyclin-dependent protein kinase activity
  Homolog annotation: Hit_ID=Q2QQS5; Match level="QueryCoverage=24%, HitCoverage=9%, E-value=3e-16, Identity=79%"; Hit description=Cyclin family protein, putative, expressed
TIATVYMFLAGKVEETPRPLKDVILVSYEIIHKKDPAAAQRIKQKVCNQMLELYEQNRLAPAQGSEVEGSAGGTRAASKAPSANEEQASKQISSQAPQHESVDRIAIPQTGTENQSNDGSALRTERDQDRIVGTKQGSEVGRRDESALNNSGSNVGQNLERREVPLGHSPNEAIKIDKDKLKALAAMGDNKKEQRGKMALKKHVMDEDDLIEKELEDGIELAVEDDKIQIGFGVI

SEQ ID NO: 130194 - protein, 69 aa, Glycine max
  Coding DNA Sequence Number=SeqID_13416
MCKKCDILVEARGEGVSVAAIEGLGHKDEEEPLGFNRAGGKVVDMVVMHESTGPCQMLHAYNSKVRSFI

SEQ ID NO: 130195 - protein, 178 aa, Glycine max
  Coding DNA Sequence Number=SeqID_13417
  Gene Ontology: Mol. function=RNA-directed DNA polymerase activity; Cellular component=chromatin; Biological process=RNA-dependent DNA replication
MAEATRSRVSADRLEDAIAKLLASQLAMNAKIDDLLQRITHIETTHQQPQASPSSSAGQTPIATGSTHRLKLDVPRFDGSDPTGWTFKITQFFEYHNTSDHERMTIASFYMEGAALAWFQWMHRNAQLSSWSAFLHALHTRFASSTYEDPMGLLCKLQQRSSVNSYLTEFESLANQIV

SEQ ID NO: 130196 - protein, 65 aa, Glycine max
  Coding DNA Sequence Number=SeqID_13418
MILEDKLKACQRSKRSLTEQLSRAEENMWTIIDQSQELPRLLAKAKAMADVYSTPEEVHGLFDYC

SEQ ID NO: 130197 - protein, 67 aa, Glycine max
  Coding DNA Sequence Number=SeqID_13419
MHGVSTNVYLRKMSEKPERCGLRTLGVKGLGVVFTHEEGIEPLNDLSILLKGEKTLRHWTINDLLIF

SEQ ID NO: 130198 - protein, 99 aa, Glycine max
  Coding DNA Sequence Number=SeqID_13420
MEVRDKVKLLSYRDLDDLVQLYIRVEQRSVLQNLRAFTLIQRKIKVNALKKRHIPSYYERELMDKLQRLRQGSMSVEEYRQQIETFMEVGSLSFYKVLQ

SEQ ID NO: 130199 - protein, 107 aa, Glycine max
  Coding DNA Sequence Number=SeqID_13421
  Homolog annotation: Hit_ID=P61430; Match level="QueryCoverage=57%, HitCoverage=7%, E-value=4e-09, Identity=50%"; Hit description =Synaptonemal complex protein 2
MLDASPEDVVDHGSCGDFLMSWMTVVNSSYFYSSIPQYYDKELEEMLTSSRLATENLNSKLEEVHLQLKVKEDEIMHHLTNQEKMEKEKNDLQLCNVGLAEKLDMSL

SEQ ID NO: 130200 - protein, 95 aa, Glycine max
  Coding DNA Sequence Number=SeqID_13422
MVDAGDGNPPLGGDYMLLIDSITTQMETMMREHTEELYGRIEQLENQENNGRIEQLENQENNDDDGRRRRRRRDNDDGDAREDNIEGVKLNILPL

SEQ ID NO: 130201 - protein, 108 aa, Glycine max
  Coding DNA Sequence Number=SeqID_13423
MSNSSSNYVPSSDEEEHKKEKGPQRDLFMVRRLLGSQAKDLDESQRENNFHTRCLIHGKLASCITVNDQGVNHSWQAAPRRDVEGFIKEEEEGICYFDHADDTSHIML

SEQ ID NO: 130202 - protein, 270 aa, Glycine max
  Coding DNA Sequence Number=SeqID_13424
  Gene Ontology: Mol. function=nucleoside-triphosphatase activity; Cellular component=membrane; Biological process=cell division
  Homolog annotation: Hit_ID=Q1SK92; Match level="QueryCoverage=95%, HitCoverage=31%, E-value=6e-77, Identity=54%"; Hit description=AAA ATPase, central region; DEAD/DEAH box helicase, N-terminal
  Subcellular localization annotation: CTP_CleavageSite=58; ConfidenceScore=5.81e-01
MSGLFGSFSMISSTGETRGILRQQSSAFVSSNPPKLRRNASASSDISSTSSQCGPTFPAPLKRTSSLCFDEKLFVQSLYKLLVFITETSSIILYIRDVEKLVLQSPRLYNLLQKMIKKLSGSVLILGSQILDSEDDCKEVDERFSALFPYNIEIKAPEDETHLGSWKGQLEKDMKDIQFQDNRNHIAEVLAANDIDCDDLNSICHGDTILLSNYIEEIVVSALSYHLMNTKDPEYRNGKLVISANSLSHGLSLFQEGKSSGNLKTNESNK

SEQ ID NO: 130203 - protein, 1133 aa, Glycine max
  Coding DNA Sequence Number=SeqID_13425
  Gene Ontology: Mol. function=RNA-directed DNA polymerase activity; Cellular component=chromatin; Biological process=chromatin assembly or disassembly
  Pfam annotation: Domain name=RVP_2; Domain location=30-145; Score= -35.8; E_value=0.00062; Accession=PF08284.2; Description=Retroviral aspartyl protease
  Pfam annotation: Domain name=RnaseH; Domain location=536-655; Score= -33.7; E_value=0.079; Accession=PF00075.14; Description=RNase H
  Pfam annotation: Domain name=rve; Domain location=792-948; Score =105.9; E_value=1.2e-28; Accession=PF00665.16; Description=Integrase core domain
  Pfam module annotation: Pfam domain module=RVP_2::RVT_1::RnaseH::rve; Domain location=30-145::276-445::536-655::792-948
MIPDAGSNLEVPPEPPELVLESTPAQLSLHALSGHSAPETLRMKGIIKDFHVNILIDGGSTHNFLHHQVVTALKLSTQDIVPLRVTVGNGDEIRCQQRCEGVTVQIQRHSFTIDFHILPLGGADVVLGVQWLKTLGPILTDYTSLNMKFIMEGKLVELKGDREKDIEQVTPSQLRRLLHMNPASSLFHIRLENQTPTQATTHIIPEIAALITKYSSLFQPPTTLPPSRTTDHTITLLPNTTPVNVKPYRYPYFQKQEIEEQVNAMLEKGFIRPSSSPFSSPVLLVKKKDGGWRFCVDYRALNAVTVRDRFPIPTVDELLDELGGARWFSKLDLMHGYHQILMRETDISKTAFRTHQGHYEFRVMPFGLCNAPSSFQSTMNELFRPHLRKYIIVFFDDILIYSRTISDHLLHLESAFRILVAGQFSLKFSKCMFAQEKLEYLGHIVAGEGVRPVPEKLQTIQEWPVPRTPKALRGFLGLAGFYRRFIKGYSTLAAPLTKLLCHTQFQWTTAAANAFQKLKEALMAALVLALPNFQIPFIVETDASGSGMGVVLVQEGHPISFFSKQFCSKLMNASTYVRELAAITAAVKKWRQYLLGHKFIIVTNHRSLRELMNQTVQTPEQHRYLARLLGYDFTIQYRSGRTNIVADALSRIHEESPSSASLSLISMPQFDFLEDLRQDIATNPAFMELFRKIRNNPEAHPDYTITNGLILHKGRIWIPSDSSFTKLLLEEFHKTPTGGHMGVQKTLHRLHENFTWDSMRTDTRAFIAGCLTCQYTKYDNKKSAGLLNPLPIPVQPWDDLSMDFIVGLPTYKGHTCIFVVVDRFSKGLRLGMLPTQHNARTVANLFMDIVGRLHGMPRSIVSDRDPLFISRFWKELFSLSGTKLRLSSAYHPQSDGQTEVANRIIEQYLRAFVHQNPSRWGHYLLWAEWSYNTSCHSATGVTPFEVTFGKKPPNFPHYITGTAKVDAVDDMLSQREKVFALLRRKLTKAQARMKEVADKRRRELEFAVGDWVLVKLRPRRQISVTETTYSKLTKMYYGPFQITARMGKVAYQLQLPPHSRIHNVFHVSLLKPYVPGESSHVSTELPPAAVDNDPVVAPLAIIASKLIPAESGPTRMVLVQWKDLPLEEASWEE

SEQ ID NO: 130204 - protein, 78 aa, Glycine max
  Coding DNA Sequence Number=SeqID_13426
  Gene Ontology: Mol. function=nucleoside-triphosphatase activity
  Homolog annotation: Hit_ID=Q1SK92; Match level="QueryCoverage=98%, HitCoverage=9%, E-value=5e-23, Identity=70%"; Hit description=AAA ATPase, central region; DEAD/DEAH box helicase, N-terminal
MSFLLWKNERTQALLTSAAYVHLKSLHFSKHTRNLPPASRAILLSGPAEPYQQMLAKALAHYFESKLLLLDITDFSVK

SEQ ID NO: 130205 - protein, 110 aa, Glycine max
  Coding DNA Sequence Number=SeqID_13427
  Gene Ontology: Mol. function=hydrolase activity, hydrolyzing O -glycosyl compounds; Cellular component=cell wall; Biological process= carbohydrate metabolic process
  Homolog annotation: Hit_ID=Q8LC45; Match level="QueryCoverage=85%, HitCoverage=30%, E-value=6e-26, Identity=60%"; Hit description =Probable xyloglucan endotransglucosylase/hydrolase protein 33 precursor
  Subcellular localization annotation: CTP_CleavageSite=43; ConfidenceScore=5.60e-01
MALLQQKLSFSCLLILCLATVVSSHSRPYTTPSVTRLTDSFPRVQVDSAFSKTFGAKNIQFLSNGSTATLALDKITGSGLVSQSRYSYGFFSAAIKLPSGLSPGVVVAFY

SEQ ID NO: 130206 - protein, 50 aa, Glycine max
  Coding DNA Sequence Number=SeqID_13428
MTKTIHHITTYTFPAAGMQRNLMRQKNNTGHIRCTLLLFVTSKRPVPMHD

SEQ ID NO: 130207 - protein, 222 aa, Glycine max
  Coding DNA Sequence Number=SeqID_13429
  Gene Ontology: Mol. function=DNA binding; Biological process=DNA integration
  Subcellular localization annotation: CTP_CleavageSite=18; ConfidenceScore=5.03e-01
MLGSRPTSIPMDYSTRLSASMGTPLSETSASSYRRLIRRLIYLTNTRPDIAHVVQQLNQYMANPTSTHSQATFRVLRYLKGTPATPIGQDVATHDAPSPASQSIWSAIQIASNPVFHERTKHIEIDCHIVQDKVNKGLLKLLPVSSSMQLVNIFTKPLSHALSQGLYSKLGMMNIHSQLAGALSRSLCLINTIVSLEHISEARAGGTHRAEYGSDTILNFIV

SEQ ID NO: 130208 - protein, 90 aa, Glycine max
  Coding DNA Sequence Number=SeqID_13430
MEQKHVLLSALSVGVGLGVGLGLSSGQKWIGGNRDSDELSVELIVQELKNLVVEGRSSNVTFEDFPYYLSILIKLGVKGVLDMDPSQSDL

SEQ ID NO: 130209 - protein, 102 aa, Glycine max
  Coding DNA Sequence Number=SeqID_13431
  Subcellular localization annotation: CTP_CleavageSite=72; ConfidenceScore=5.30e-01
MSSSQSISINTQALCNIYTKTQSYMQCGTMSVKNHVRHLGFISSPLKGLSINSSPLKGLSINSSPLKGLSINSSPLKGLSINSSPLKGLSINLSPLKVLIVV

SEQ ID NO: 130210 - protein, 192 aa, Glycine max
  Coding DNA Sequence Number=SeqID_13432
  Gene Ontology: Mol. function=RNA-directed DNA polymerase activity; Biological process=RNA-dependent DNA replication
  Pfam annotation: Domain name=rve; Domain location=7-137; Score=-0.3; E_value=0.0063; Accession=PF00665.16; Description=Integrase core domain
MPLQNIIEVEVFDCWGIEFVGLLPSSYGNEYILLVVDYVSKWVEVVATPKNDAKTVVKFLKKDIFSRFGVPKVLISDSSSHFCNVQLQKGIKEDIGEDCGVYKEGLGRQRKLQLLELEEMRLNAYDKKLYKQKSKWSRPLTIKEVKPYGAVELMDPQLDHLERSWVVNGQRLKLYHGGNIERLTIILHLQDP

SEQ ID NO: 130211 - protein, 119 aa, Glycine max
  Coding DNA Sequence Number=SeqID_13433
MFFGESIACGGDKGELCPLKGVMNRKLMKKDLMLEGEGVQEVHLGNVYGGTVDQDNDSIWVAKVNGGGAHDVVVSVVLGIVVVGCTLVVGDNGVCGVVISWGGACQVVTKVALAVQSRK

SEQ ID NO: 130212 - protein, 524 aa, Glycine max
  Coding DNA Sequence Number=SeqID_13434
  Gene Ontology: Mol. function=GPI anchor binding; Cellular component =membrane; Biological process=root hair cell differentiation
  Homolog annotation: Hit_ID=Q9LFW3; Match level="QueryCoverage=76%, HitCoverage=91%, E-value=0.0, Identity=73%"; Hit description=COBRA -like protein 4 precursor
  Pfam annotation: Domain name=Phytochel_synth; Domain location=76-240; Score=313.1; E_value=5.1e-91; Accession=PF04833.5; Description =Phytochelatin synthetase-like conserv
MLGATLGLVILFTSSSGMEFVNGKQQPKSTFTCLKLVALIALYLVLISPAESFDPLDPTGNVTIRWDIMSWTSDGYLATVTLFNFQLYRNIMNPGWTLGWTWAKKEIIWAMMGAQATEQGDCAKFKLKIPHSCKRNPQVVDLLPGAPFNTQFTNCCKGGVLTSWGQNPSGAVSAFQIGVGLSGTSNKTVKLPKNFKLLGPGPGYSCGPAKIVPSTAILTEDRRRKMQALMSWNVTCTYSQFLASKNPSCCVSLSSFYSDKVTGCPPCACGCQNNDTCVTKDSKILQQNVTSPHQKSDITLTPKPLLQCTHHLCHVRVHWHLKDNYKDYWRVKIAIINFNYRLNFTDWSLVVQHPNLNNVTQVYSFEYMPLLPYESTNDTGMFYGLKYYNDLLMEAGPKGNVQSEVLMKKDKNTFTLKQGWAFPRRVYFNGDECMLPPPDSYPMLPNSAHKLPTTITLMAAYVKNKEGDSVRNFHIVCLSSWGAAYISVGKLHLVPIGFKMKSNMASVEGGIRKSHIACLSSWGA

SEQ ID NO: 130213 - protein, 300 aa, Glycine max
  Coding DNA Sequence Number=SeqID_13435
MASKKKRASSSQPQEPYDTSIFVSEIAWERYETNIDVALVKEFYSNLYDPEDLSPKQCKVRGKTIKFDAATLNTFLETPVVLEPGERYPAYSRYCYTYPNHQVIAAKLCLPGRGFVLNAERAPWKLLRKDLTTLAQTWSVLSYSNLAPTSHASDLNMDRARLVYGLVMKMDMDLGSMISGQISQNPDDPSITFLGFRKAKAKAPSDAPIPPPLAPAPTLAGLSGPGGLARSPTFLSWGGEAPEAQDAQAQDAEDTPETQDPAQEVEEDTGAAKAGMDTNYVVDVTATQGTWDPWPTPAQD

SEQ ID NO: 130214 - protein, 62 aa, Glycine max
  Coding DNA Sequence Number=SeqID_13436
METMRQPIPVEEKVEKENSNRSKTAAKAPRGTTDPMAGNMLKFKICTKKGERANRGLGLSAL

SEQ ID NO: 130215 - protein, 140 aa, Glycine max
  Coding DNA Sequence Number=SeqID_13437
MVCENKYANVLVPPTGLTRQHYSYNIPKNQVTALRVQIYDKLALSNQFPTEDLAFHCEEAPFYKFKEEKLKKYKVVGMSPPPLKTSQSLKNSFKALQDASFGLLSRLWVRILQKLPSNFVFSGFIWKSYWWPLAERQSRA

SEQ ID NO: 130216 - protein, 124 aa, Glycine max
  Coding DNA Sequence Number=SeqID_13438
MVVVGTCGANVMAASLRRSHAKVPGWGVVATLVGSVVLGAVNVKGCLEQMTAWACGAHKRGRWRCCLVGSDGDAIGVDGGSCAVWLQAWKEGGDDYGILIFESGCLCLGNEKGLGKKVKIRVHI

SEQ ID NO: 130217 - protein, 103 aa, Glycine max
  Coding DNA Sequence Number=SeqID_13439
MWTRIVVPFWRWCGCPWGWGRECLSGIVGESSFEELVEIGVQVWVVGDNIGCFIAEEVKFGCVGVEPFVERFELWDYNWGSGGIGVNNCGGDWDSGRWGKDFG

SEQ ID NO: 130218 - protein, 90 aa, Glycine max
  Coding DNA Sequence Number=SeqID_13440
MKKTIALKDKDDAEKKNIYVKTIASDVTKNEEEKNDDFMQNLPHVDFEASGKSTPSLHIPISTAPISQVPPQPSATMTPSYSTIPDTFDE

SEQ ID NO: 130219 - protein, 66 aa, Glycine max
  Coding DNA Sequence Number=SeqID_13441
MMYRCCSALVTLDLAKEANSICLSKGFDGSEAEGHEQCLPEACENIALKDLSAISHTNPLRYNRKL

SEQ ID NO: 130220 - protein, 71 aa, Glycine max
  Coding DNA Sequence Number=SeqID_13442
MVEKGWKKGIENDRRKNSLYESSQALVAGVDLSLRTRRLAQVSVFAISAPFSRLVRVPIFALSAPYTLSAS

SEQ ID NO: 130221 - protein, 84 aa, Glycine max
  Coding DNA Sequence Number=SeqID_13443
MYLLFFSFRRSYENSRIAKKTPPFDFRHITEFSRIVFGVPKAIVSDQGTHFCNRTDMRYIFVSVHYMDRNEDLKFDNFDIKIEI

SEQ ID NO: 130222 - protein, 123 aa, Glycine max
  Coding DNA Sequence Number=SeqID_13444
MAKTKDNNNRVHAKREIEAYATATAFRFRGQPCPCQQQQQQQQQQQGAASPAPPQGPHAAAAVVIHQLGGATSSAAINKACGGRERRSEPTSGAAAVFPSMDVAALTSGCSPPSASVAAVIFY

SEQ ID NO: 130223 - protein, 224 aa, Glycine max
  Coding DNA Sequence Number=SeqID_13445
  Homolog annotation: Hit_ID=Q1T493; Match level="QueryCoverage=85%, HitCoverage=46%, E-value=2e-17, Identity=25%"; Hit description =Nucleic acid-binding, OB-fold, subgroup
  Pfam annotation: Domain name=DUF223; Domain location=40-135; Score= -9.7; E_value=0.023; Accession=PF02721.5; Description=Domain of unknown function DUF223
MARVADKIKLIDGSREALKLSVRITDLWFIGILGKTEQAEMVVVDSDGDEIHVVCKQDLLKSRKADLKENLSYVMHNFKVIKNDEKFRVCDHEYKLCFTGVNVVRQCDMKQLPFRKFRFVVFSSVIAGHFKIGLLVDERSIVILLTHARIKEAHGSYPASVNNSFKASKLMINDLVLEIQEFRESLLDLGIEVRSILTPIGQGSSQVSGSSQLSSKDVFLSKTK

SEQ ID NO: 130224 - protein, 115 aa, Glycine max
  Coding DNA Sequence Number=SeqID_13446
MAHTKKTGQMTSEAAKEIVDKIDVLTAAIGQPKHPGHVHAVGVGVTIKQYFRLAPRTSRTSSSMAPEDLEHQMQSQFQSQMQSQGLELPPEPEVGPSAARVSTKETCVDPSGNDP

SEQ ID NO: 130225 - protein, 127 aa, Glycine max
  Coding DNA Sequence Number=SeqID_13447
MAPPDSIPTVEQFNEMVVWTGTQSSLHKEDKGPTAQVPQHMEDESSEATIPKPFDIGEEVEETQVRQVATTIPERSLEATSEPFSPVVNLPSPQPGVEPSTPLLQMLEDPTTPVLAVDTSPSTTLVL

SEQ ID NO: 130226 - protein, 168 aa, Glycine max
  Coding DNA Sequence Number=SeqID_13448
MSHVYHGGRSLGRKSKVRFNVRKEKESLECLLMRKHCYKHIDICFSIAKMLTPLKKNALIILRDKIIDYHHMKLTKFTVKHFLIGFMNRLHAWKSKKTSNRNKRSRPEYEDLHCIGTKNLSRFIHELFYRTKNMIETSLLILGEKIKECNPHELKFILILGLDETEAL

SEQ ID NO: 130227 - protein, 147 aa, Glycine max
  Coding DNA Sequence Number=SeqID_13449
MKADMEAMKDQMAAMMEAMLSIKKIMESNAATVATTSIATEVDPTHPSSLNQVNPSILDMVGQRGEALGKCQNSTPILIESQQPQSDHVHVSQPMGETHELPHHNLVDFEPRLRYAIEGQEVGGGVPLPNTLEGPQFRPQPQPLHFT

SEQ ID NO: 130228 - protein, 196 aa, Glycine max
  Coding DNA Sequence Number=SeqID_13450
MEFIRFGVVRPTTIGAIVDLLALPLIENLGLLALPQIFEDTESLSYFTSVFKLQNIKTPKWPNPQHNWLVLQKRSHLAVSSSLSLTLAMNVTEGDKPRSERRMRWLGNSARIQWMAVKQRLEKDTWGLLFSGRWAAAMVSGADKGAECCCMSAGRGGGVGMDDGVHMSVCVRSVLAKEEDGGVGEWCWLVSNTVMR

SEQ ID NO: 130229 - protein, 116 aa, Glycine max
  Coding DNA Sequence Number=SeqID_13451
MGAIKCRNNTANNKGMAREYRNREGRRTKAKKGNSQTILPQGLRKKRDGFGDRFGAGIENPIPDPEPEPEFGYRGKPDADPHPDPGQLEFSSSKSGRVRGGPRCHAYSNARYPCGS

SEQ ID NO: 130230 - protein, 244 aa, Glycine max
  Coding DNA Sequence Number=SeqID_13452
  Gene Ontology: Mol. function=amino acid transporter activity; Cellular component=integral to membrane; Biological process=auxin mediated signaling pathway
  Homolog annotation: Hit_ID=Q8L884; Match level="QueryCoverage=70%, HitCoverage=40%, E-value=4e-74, Identity=76%"; Hit description=Auxin transporter-like protein 4
MLSQKQGEDAIVTNLNQTEHEGGSTSTREEKEQDHSICASNQVAQVLLTLPYSFAQLGMVSGILLQIFYGLIGSWTAYLVSVLYIEYRTRKEKENVSFKNHVIQWFEVLNGLLGRYWKAVGLAFNCTFLLFGSVIQLIACASNIYYINGHGHTFLEHAVQPWCSYLPSTITKSAHTRTQHRGTAIRQGGDKHYPQSSKENKQEDFVTNSAPMHRAGGFSSDREDILSARIFILLSILLLHLRTC

SEQ ID NO: 130231 - protein, 197 aa, Glycine max
  Coding DNA Sequence Number=SeqID_13453
  Subcellular localization annotation: CTP_CleavageSite=52; ConfidenceScore=5.32e-01
MRRYPSGYPFKLSFAISKTQSLIARRDQHRLLHPLSIATNKPVDTRRFTSSSAQTISVILTLESRDMRRYPSETNFAPFIIQEQQAEWVNAQRQILRPLSFGNKLSGFRWQGGSLAEWCFARTKLVSYLYFPFISNKRQVKRGNCHTLISSGEHPLLGCDPHLTTSRYLTPIVRQFVKFCDMPEVKRKNCSTIREVP

SEQ ID NO: 130232 - protein, 56 aa, Glycine max
  Coding DNA Sequence Number=SeqID_13454
  Subcellular localization annotation: CTP_CleavageSite=41; ConfidenceScore=5.08e-01
MWAQRASTAKRSFSALSVTRESGRTQESRLSASPNPLTSAKCEGGAKCDVAISEPI

SEQ ID NO: 130233 - protein, 172 aa, Glycine max
  Coding DNA Sequence Number=SeqID_13455
VDVLLECHVTCHMYFVGPGLYISPPISEPACGQKRLSNVNGGYLVSRAVALTSRRGHEFIEPLSVDKCCSMSRVVTLTDPRFAGGRTTALVNEDLGHHEIGDHNGDNHGVFLVDRVDALEVFINGNVDVDVLDDMEVHARVFAGDAFVSLYLMLDPSFCRHVDSCASPHVVL

SEQ ID NO: 130234 - protein, 148 aa, Glycine max
  Coding DNA Sequence Number=SeqID_13456
MPWGGIQKADHDQLEARVSRPQGDEHFTHTMHERTQGKSYPKHTISTQDDPSLSHVHRHEERMICRHPFVDCIMEVDIPLGWKPLNLERYDGTIDSDEHLDSFLTQANLYTNNDAVLCCVFPMSLKGAVLTWYDGLPPRSTNNFDTFV

SEQ ID NO: 130235 - protein, 89 aa, Glycine max
  Coding DNA Sequence Number=SeqID_13457
MDTPVSCRVQCPTRHRHRHRHDTEARVRVEFDVFDRWSRVHVRVMLPGAEIGDGGTKGGGGENGGDPGQGCPMTGPHRSKLLLKLQGNC

SEQ ID NO: 130236 - protein, 166 aa, Glycine max
  Coding DNA Sequence Number=SeqID_13458
  Homolog annotation: Hit_ID=Q700L7; Match level="QueryCoverage=38%, HitCoverage=44%, E-value=1e-13, Identity=80%"; Hit description =Receptor-like-kinase
MAQFTVLEKFTDIFIGWPPMYGLMKLVLFVYLWYPKTKVQSLFLLQQLYNYFICSWKPQDKRSTIVSTFLCLIVEGNSATGAIAGVVVGVALLFVAPAIVFAWWRQRKPQEFFFDVPDELSHPIQLNTRKRILKYTLGSLRGFHYENCKLQQILSAIRTFLKGRIW

SEQ ID NO: 130237 - protein, 40 aa, Glycine max
  Coding DNA Sequence Number=SeqID_13459
MALQAEKLLLLVQPYACYFIHIRIIVQSLINNTHNISMEK

SEQ ID NO: 130238 - protein, 213 aa, Glycine max
  Coding DNA Sequence Number=SeqID_13460
MVSKLFVVERQFFEDKENSKTGSIDRSVIKLRSNVEGRPKHLQYVKACVSICPLTGARSETRWVRLPRKENARSCHQRLFEENVGKTKMEKVEGLRILKMRVQEFFMHGEGISTPRVRHKESITDAIRKRFSLVFSSFFFLSLLSSSFLFFLDLWTSRNSGALYFSLPTPIYSKMRGRGCTAARPGELVASALSLLVGPRAEKCPKSDPFAAL

SEQ ID NO: 130239 - protein, 182 aa, Glycine max
  Coding DNA Sequence Number=SeqID_13461
MTLTPPRDKGIVIDSPRKRCSINLEMLEKKRKKLEYEVLTLFFDKELKEKFDRSWAGKKWFIGDTLISLRSNLFNILHFIKNKRLYDDWFKDKGLRKKKIDSGSFDDNKDDDKKLKSQDHFMITKMMTFKIEFKIESRTLQGSKENLISRIKNQDSGFKNNQDQDPRLKDSRIKRRLNQDKY

SEQ ID NO: 130240 - protein, 116 aa, Glycine max
  Coding DNA Sequence Number=SeqID_13462
MVKYLVKLQTKFREDPSLHEGWEAFLPRQLHVVFSRSFRCYRVLSLPYPTLHVTNFKSPTTKSDNQPMKLTLTPTTIIAMTWLRVGVRKKSPDMERKTYASDTRAAPETKMCYRRD

SEQ ID NO: 130241 - protein, 72 aa, Glycine max
  Coding DNA Sequence Number=SeqID_13463
MVDDANSVVLEGEALGLLQALNLAIELDMSHVVFETECKGLVDKVYSSTHATEAGSIINAWLQSYLSIVPNF

SEQ ID NO: 130242 - protein, 85 aa, Glycine max
  Coding DNA Sequence Number=SeqID_13464
MTMIFKSFTIFGRQFLFVYLFYHQHMIKATKPIKSTFNVPYEMLMTLIFRNFGVSMEDEPRDDEVFSWGDKNVDDLRLNPQARIC

SEQ ID NO: 130243 - protein, 484 aa, Glycine max
  Coding DNA Sequence Number=SeqID_13465
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=99%, HitCoverage=98%, E-value=1e-139, Identity=55%"; Hit description=GTP cyclohydrolase I
  Pfam annotation: Domain name=GTP_cyclohydroI; Domain location=140 -238; Score=54.6; E_value=3.4e-13; Accession=PF01227.12; Description =GTP cyclohydrolase I
  Pfam annotation: Domain name=GTP_cyclohydroI; Domain location=362 -466; Score=71.4; E_value=2.9e-18; Accession=PF01227.12; Description =GTP cyclohydrolase I
  Pfam module annotation: Pfam domain module=GTP_cyclohydroI::GTP _cyclohydroI; Domain location=140-238::362-466
MGHLGQNILNYELENGVNMCCDEDCSKNEINTTLIQYAVKDLLTGLGEDINREGIIKTPLRVAKALCDGTRGDYPFLHILLTDNYCIKDLKGFLSSTNLDKKGLIIPGYSQSAKEIVEGALFPEAGVDNTKVGHAGGVGGLVIVRDLEFYSYCESCMLPFYFKCHVGYVPSGQRVLGLSKLSRVTNVFAKRLQEPQRLADEVCFALHQGIEPAGVAVVLQCTHINIPDTVFDTNHKGLVETLVSSGSGVFENKDADMWGDVFGLLKFRGIDKDKVHVKGSLDQYWCPSLSSKIGEINPIMVTAVSSILKSLGEDPTRKELVGTPSRYVKWLMNFQYCSDIDGKLKLNGSPWSGEVNFDEKEVHSELNLPFWSQCEHHLLPFHGVVHIGYFISKGCHPIEKSLLQSIVLFYGFKLQVQERLTKQIAETISPLIGGNVIVVVEASHTCMVSRGIEKFGSNTATIAVLGRFSIDLAAKTAFLESIPK

SEQ ID NO: 130244 - protein, 80 aa, Glycine max
  Coding DNA Sequence Number=SeqID_13466
  Subcellular localization annotation: CTP_CleavageSite=50; ConfidenceScore=5.46e-01
MSVTNLVERLGVHDKTNHTLASQVTLTSFNSSPFKGLSINSSPLKGLSINSSPLKGLSINSSPLKGLSINSSPLKDLIVV

SEQ ID NO: 130245 - protein, 178 aa, Glycine max
  Coding DNA Sequence Number=SeqID_13467
  Gene Ontology: Mol. function=RNA-directed DNA polymerase activity; Biological process=RNA-dependent DNA replication
  Homolog annotation: Hit_ID=Q1SYN8; Match level="QueryCoverage=61%, HitCoverage=65%, E-value=2e-11, Identity=31%"; Hit description=RNA -directed DNA polymerase (EC 2.7.7.49) (Clone AmLi2)-garden snapdragon-related
MPDYLGIANLDSIPFQSLSMDQNQSLIANFDEKEVKEVKKAIWECKGSKALRPDDHLKAFGPAHKVATKVVDEARRERKKHILFKVDNEKAYDLVSWEFLWYMLQRLGFCEKWVSWIKGEAKLRGEFKGFEMGEDKVVVDLVFQLVPEIRKIAWVSGKGIASYWFRGTSSSKKKIEER

SEQ ID NO: 130246 - protein, 136 aa, Glycine max
  Coding DNA Sequence Number=SeqID_13468
MPALRDEGIGIEGEPALEGLELADAEGGGERDVGGEQSGERGKKEAESWESEAETERHLSSMAESLTNPPSQNPPQAVVIAIAGKTPNPFSLSSSSLITPQPVVSSSPYPKTSSSCDCRKPATTLLHEFVFVTSSI

SEQ ID NO: 130247 - protein, 319 aa, Glycine max
  Coding DNA Sequence Number=SeqID_13469
  Gene Ontology: Mol. function=helicase activity; Biological process =viral genome replication
  Homolog annotation: Hit_ID=Q9LTU4; Match level="QueryCoverage=74%, HitCoverage=16%, E-value=1e-62, Identity=48%"; Hit description =Helicase-like protein
MKKLCCVKYNTLKNSQHPVENQHASYGKRIILPSSFIGSRRYMDQLFFDGMAICSMVGFLDFFLTFTCNPYWPEIQWSISALKLTAEDWPDIVTRDSKLNLEQLMSDLKDRKVLGNVLAYIYMIEFQKRGFPYAYILLFLDVASKYPSPADIDGVISVEMPDSIEQPQLYEYVKKHMMYGPCGHANRKLPCMKDGKCSRYFPKKRQAETVVDQEGYPIYRRCNDGKYIDNNDIALDNIYVIHKRSPAVERLYFHLPSDNSVIFEDGDDIDALLSKPTIKESMFTSWLQANNISQQAKDLTYLQFITIYIHQQNKMLEAT

SEQ ID NO: 130248 - protein, 229 aa, Glycine max
  Coding DNA Sequence Number=SeqID_13470
  Homolog annotation: Hit_ID=Q1T493; Match level="QueryCoverage=52%, HitCoverage=22%, E-value=3e-09, Identity=29%"; Hit description =Nucleic acid-binding, OB-fold, subgroup
MERKLNSIMDITAQNETWKISVRVINLWVIQRAVRINIEMILMDEKANKIVAQIKNVDHGKWNDVVKVGKTYMIRSESAKPYDLQSKECVCLIVATITKFLVGNGCIYESCPKCNKKVECEKFPYTCQGCGNENATTMVRFWLEVRVGQLNEIANFTLWDRECNALINESASEIKQQMIAQEGEFDPKDIPKAIDRILGKKLAFRFKVMPNNTRVPKQYEKGNSKSLAI

SEQ ID NO: 130249 - protein, 1079 aa, Glycine max
  Coding DNA Sequence Number=SeqID_13471
  Gene Ontology: Mol. function=RNA-directed DNA polymerase activity; Cellular component=chromatin; Biological process=chromatin assembly or disassembly
  Pfam annotation: Domain name=rve; Domain location=814-934; Score= -9.9; E_value=0.04; Accession=PF00665.16; Description=Integrase core domain
  Pfam annotation: Domain name=zf-H2C2; Domain location=755-796; Score =6.6; E_value=0.049; Accession=PF09337.1; Description=His(2)-Cys(2) zinc finger
  Pfam module annotation: Pfam domain module=RVT_1::rve::zf-H2C2; Domain location=384-615::814-934::755-796
MGSSVKLEDAILWLTNHQVSLRESMQSMTQKFDELLLRMPPMLSSPSSMIPSTSTLPPVPATHHHMKLDIPRFNVTDPFGWALQTHFAPSHYDDPTGTLFKLTQKGTVAQYLSEFEDLANRIVGLPPQFLLSCFILGLMPEIHREVQALQSLTLVQTTGLARLQEEKLLDTCQAFCSTLLPSPPRPLPTLKHLSSEEIASHRERNLCFNCDEKYHRGHRCASWVFLLVADEDDTVGDNMEGIDSAPDPPDIHDPFLAQISFNSLAGYLAPETLRLLGMLAGHQVVILVDVMVGNDHTWHAPDGARQSLLTFRQLPSSWTCIARANIVLGVQWLKSLRPVLTDYNTMCMKFFHGGQLVELKGDTEPTLNLLTQPQFRWLLRKQGTSCHYHIVVLSDEAHSALSTTPHPPRLQALISHFGALFQPPSSLPPVNSGKCVSVSKGLIRPSTSPFSSPVLLVRKQDGSWRFFVDYMALNAITGYHQIRMHSEDIVKIVFRTHHGHYEFKVAPFGLCNAPSFFQATMNVIFWPYLRRFIIVFFDDILIYNVTFDDHVEYLGHFVSQKGVKLVASTVYKRIYYDYGPIGQGNHRGTISVDSYSPNSFRLPFTIETDALGVGLGVVLLQQGHPIAYYSKPFPPKLQRSSTYVLELFAVTMAVKKWRQYLLGHCFTIITNHHSLKELLTQVIQTPEQHMYLARLMGSCTPNWPKTQSINTNVRPSRTFWPHTRTSRSPITLSSGKAAFGFHEISLIPTLLTEYHATPTGGHLGTTKTIARLSKNFYSDGLREDVTKFVASCLDCQHSKYKTKKVSGLLCPLPIPHQPWEDLSLDFIIGLPPYHGNTVVLVVVDYFSKGIHLGMLPPSHMAHLSGTQLHMSSAYHPQSDGQTKVLNLVIEQYLRASVHHRPSSWGKLLLWVEWSHNTSWNAEYITGISKVDVVDDMLVNHEETFRAIRKKLLKAQTLMKQYANTKRREVEYQPRDWVMLKFSNELARLPIAYNFPREHAFTRCSTGLSPNETSWEDWSQLRQDYHLEDKVISQRPQNDRETKVQGVASSGPSEVMNTGVQLEEKPKRIITKPAYLKDYV

SEQ ID NO: 130250 - protein, 87 aa, Glycine max
  Coding DNA Sequence Number=SeqID_13472
MKNESSKTTTPKPLVRRKKADETQEAVATSKKSLEATSKPSEPVADTTSPQQAADPSTAEDHTTPVLSPNTSPTATLVLHLTDEEDV

SEQ ID NO: 130251 - protein, 120 aa, Glycine max
  Coding DNA Sequence Number=SeqID_13473
  Gene Ontology: Mol. function=binding; Cellular component=ubiquitin ligase complex; Biological process=protein ubiquitination
  Homolog annotation: Hit_ID=Q1S238; Match level="QueryCoverage=63%, HitCoverage=16%, E-value=3e-25, Identity=79%"; Hit description=IMP dehydrogenase/GMP reductase
  Pfam annotation: Domain name=Arm; Domain location=43-83; Score=18.4; E_value=0.026; Accession=PF00514.13; Description=Armadillobeta -catenin-like repeat
MTPKVKGMEILKRCFRVLPLLQKRLFTSWYLHRLSKTDLAKKRADNLALIDESGAVAALIPLLWCSDSWTQEHAVKALLNLSLLEENKALITNAGAVKSLIYVLKRGTKTSKQNAVLVSC

SEQ ID NO: 130252 - protein, 388 aa, Glycine max
  Coding DNA Sequence Number=SeqID_13474
  Gene Ontology: Mol. function=nucleic acid binding
  Homolog annotation: Hit_ID=Q1SP02; Match level="QueryCoverage=71%, HitCoverage=70%, E-value=1e-26, Identity=30%"; Hit description=IMP dehydrogenase/GMP reductase
  Pfam annotation: Domain name=DUF1723; Domain location=22-71; Score =44.3; E_value=4.3e-10; Accession=PF08330.1; Description=Protein of unknown function (DUF1723)
PEIEGMIAATRLSSLIRCSVITTDPGLISAFVERWHCETSTFYLPVGKLTITLDGVASLLHVPITGTLPKFEPLVTSDVIGLLTELLKVSHEEATAETQQAGGPHVRLGWLWDLYESQCRARRWVVAARTDLAQAGGFAWGATALVHMYEHLNDASQASTRWLTGKAHMTRIKGAPYQRRMDALTMTDVCWMPYAEHRGVRGFDLISSYTGQLRWGQIVMYVRPEQVLRQFGYLQTIPLPPVCGSLAGGNIDDRWLHFSDHLVPAGELCVVPGQVAPNYMEWFFRISHPFVTRTEETAEPRHPPPPHDEEFIEPPIPEVSVTSDLPTHSVVDCKGCQGMAEDLGAIAKDLEWVINLRMVTEDNDLYDIMTCCLRRARGDAADGSLRPR

SEQ ID NO: 130253 - protein, 61 aa, Glycine max
  Coding DNA Sequence Number=SeqID_13475
MIWKTTRNLISQIIEAQKTIMVRTHGLGRVLGAGRGRGISEDAHQADVPRRRRPTTSARRQ

SEQ ID NO: 130254 - protein, 379 aa, Glycine max
  Coding DNA Sequence Number=SeqID_13476
MGSPVKGGHEAVHQPHMQCPAAQRTRRRQQLGCAVLPRQTHYYRTLGAWPCGCLQMSSSDCSPIQTSCKQIIAFLALGPCTPCEAQDPTMKRRIVPEAVSAPERLTCQSVNDLRPLQIQGTRSEGGAVPAGSKCAGLERREDGNSEGDSGEEKEASPSACRNCCCALCFALCAGNDNMTAQPLHECWLIKSRRHGSEHYIAVTVARDLFSDGAPGDSLEERLDALECFYDEEHFWLESHMDTLAAKVEPFGLLIPCAHLFGCLSTDGSPVVLLCTVPDALSINAIFDTPDMVSLLAYEIFQLKGKIKEKQKGMSLWRPKPLWGCTAKIVWWPWSGFDHSASGHSVVPPPAGVDDLKTAIAHLGGPKFPDYELFPSLHDD

SEQ ID NO: 130255 - protein, 771 aa, Glycine max
  Coding DNA Sequence Number=SeqID_13477
  Subcellular localization annotation: CTP_CleavageSite=53; ConfidenceScore=5.16e-01
MSETLGCLPAALLLFASHASPLQLVSHLPGVGTVIAHLACKAGVRTPGNVVVRGSDVARTLNAQVDERLVQGFSMSIAGEALEGGGLGPCRCPIAARDLQQEGSQAQQSNAALSTMHSLPQLLGGWKFAQECFMYITDQGCHSGGTSIKLKLVLSNSNAGIFALLGKHLRIPVSDADDDGILPSDQNTREKLVSDVLKCTDEPKSSEAHLIIKRKMDNEKHFGFAIPQLHGSMQLRGRDEIFSSRPWKPSQSEHGMQTRQERSIKLPGAGLWQATKNALPVGHLRTLCQKHPFEPKMGPQNSTACELCCCTVCDFEASICTKWGQPDAQGCLNWTTVMPTHTGGNITQRSTGLLIPVLHSAFISDVSGMHIMLVAHLWTGAHCKDGQSAPMPAAHFPAINRPQAGTPQQPAGAALEPRAAPGGKEPAALGGTKDGARQKPAPTQLDTCYASSLTILEADARTAAQVGYTIGHPRGLKKICLEDQPQPLRSGKKLLFANPPLEKMSARKIYCKTATRQGHDGETLQSMPEGIKPLVGATSSNDGRVSPVLSTRAGSPLAHADAPKKKPEDPVRGREVDHSVVVPEDEPAHGPLRAWVSFNQQGGPAPAEPLAAGLALVARTSPANQSSATMALPGAGERPGTFGWPWPSIHFTKPEGLYTLDTFLGTCQLVYTSCQAIYMYFGAASGYGKQFNETDECKFVVKAFSTAILKPMEGFLALKINKIVNGIVQALTVAAFLAFAFGGYTTWGKAIFYVLGSIACINAAMGKNGAY

SEQ ID NO: 130256 - protein, 386 aa, Glycine max
  Coding DNA Sequence Number=SeqID_13478
  Gene Ontology: Mol. function=hydrolase activity, hydrolyzing O -glycosyl compounds; Biological process=carbohydrate metabolic process
  Homolog annotation: Hit_ID=Q9AQG4; Match level="QueryCoverage=35%, HitCoverage=5%, E-value=1e-10, Identity=37%"; Hit description=CelE
MGPSPGTQRDLVMLCMMHPRVAHEAYSHDRRQSLPAVSHCKTWRSCTLIDLCVCSGVALLMAEIMPNELLYSEAIQKFCNWYIPPLRSVPHTANGLAFPYKLMTRGYCAPGSGDSLELVERQITRGCMQGWGALRYASNAAAMTLFYAEMLMAQPSPSKNVTAYAAQLFNYPLVREHASSCHASRGQCVHVQGKSQIDFALGSTGQSYLVGFGKNSPKSPFQKNAWNSWLNYKPGTATEGQIRNDFLASPQPNRWHMGRWWVAPWTSKGQPIRTPGTKPSGMFCPEFFYTQTCPHKKITACVVWCASNRYTEPAIDYSSGLILALSALVNYHTGLGPYNECGLDFGYAFPGAPAPPNALVAACGLNSIAAGHRTVLNVSAVLPVGG

SEQ ID NO: 130257 - protein, 49 aa, Glycine max
  Coding DNA Sequence Number=SeqID_13479
MERVPSTKDQRNCEWDCSGFDSCGLAGIRFWWLHDMGKGAVLCARPALR

SEQ ID NO: 130258 - protein, 70 aa, Glycine max
  Coding DNA Sequence Number=SeqID_13480
FDSCGLAGIRFWWLHDMGKGAVLCARQLCVNLCCYGQERARGLTGRCHQKPLGAQRGTPKAGGGKAEAAQ

SEQ ID NO: 130259 - protein, 67 aa, Glycine max
  Coding DNA Sequence Number=SeqID_13481
MPKSSPNMHVKQEVSTRVKPRLLCKQSMGQNTPNKIDDCHTLISSGDHCLVACNLRLTASRYLTPIV

SEQ ID NO: 130260 - protein, 66 aa, Glycine max
  Coding DNA Sequence Number=SeqID_13482
ATSEPPALVVDLPSPQHTADPSTPMLEIPTTPVLAMDTSPPATPVLHLKDEEDVQTKNTQDQSQEF

SEQ ID NO: 130261 - protein, 82 aa, Glycine max
  Coding DNA Sequence Number=SeqID_13483
  Subcellular localization annotation: CTP_CleavageSite=33; ConfidenceScore=5.52e-01
MAFMTPPSSSCSFTRLFPVRTTSTTLSQPTLLRASEARLTDASSIGGKCAESPPTFIERKTLEKPKETGHEEYSRSRSYLYV

SEQ ID NO: 130262 - protein, 490 aa, Glycine max
  Coding DNA Sequence Number=SeqID_13484
  Pfam annotation: Domain name=Transposase_23; Domain location=199-258; Score=-3.5; E_value=0.0027; Accession=PF03017.5; Description =TNP1ENSPM transposase
MQIWSSTLHSPIARHEKWKKARTNKFGQMTSTAAQEIADKIDELQEQAKQGALVPHGRQDILNTAIGRPEHPGRVRVGGHGVTITSYFGHASCASHSSSPAITAERLVEIIQTIKQEVKKEVEDENKDCMDKMKMELDAIKTELSQIHTQQSAPPRPSNPDIFVARVSTKESCAEAANNVVGNERSTFDTCSMGLYIVCGDSTQLVAGGKVFGVGGTIHTVAYGDDVLRVCVDTVYDGEAIVPLPTSEIQYVRDVVNSFIGWPRHLVKPLSYDSDLNVRKPDEHSSDAKLAGESDPLGELMKILFYVYQNPVEVSWEASQFGLPDIGAKFYITHVDLAEIISANQSLYGFLEPQSMQNAKERRQQCQQYIETWFKESQRQLYLGAYLHQKKPDIYIKGAINSAIKTITNSFQGMSNQGAPRWVEPKSNVQSGGFECGYYVMHWMWCIVTASLKDDWHKWFFDGSPLDVEAITTVRQKWATYFLTFRKSSC

SEQ ID NO: 130263 - protein, 128 aa, Glycine max
  Coding DNA Sequence Number=SeqID_13485
MVGERKKTQKQGHENENEEAGAWKNQQPQRRTTNTNQNIIQYTIAKEKDSLTSKAIKKAKAPQQQEQKPPAATRTKATSSNHGSSSYEILTLSLTLLGAPNNTLSFTVYIIHALAQMLTYRDASARQN

SEQ ID NO: 130264 - protein, 120 aa, Glycine max
  Coding DNA Sequence Number=SeqID_13486
  Subcellular localization annotation: CTP_CleavageSite=40; ConfidenceScore=5.09e-01
MDPEKSNRALGKILHAKASTTAVGGVPAAADSGCTATTSTAATTSGFHLFSPVEDRAPDAHVQLNETFYRYTLHQQSQDPSPFLWPTPEQFGATVAWPGDEPDFQTGVGPIGAPGDKDGA

SEQ ID NO: 130265 - protein, 67 aa, Glycine max
  Coding DNA Sequence Number=SeqID_13487
MVEASPLEPTLRNKLSSSSSNEASSLDCSSDNSLAFRAFGAIICGLHSVEPSYDTVKVSHISLMLLI

SEQ ID NO: 130266 - protein, 203 aa, Glycine max
  Coding DNA Sequence Number=SeqID_13488
  Homolog annotation: Hit_ID=Q5W7C9; Match level="QueryCoverage=25%, HitCoverage=20%, E-value=7e-19, Identity=90%"; Hit description =Unknow protein
MLIPRIPSLLLLREKKFMTRRPFYLHAALLRQAFAHCGKFPTAASRRSLGRVSVPVWLIILSDQLLIIALTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 130267 - protein, 58 aa, Glycine max
  Coding DNA Sequence Number=SeqID_13489
MAGEVKTKGNATYSFDNYVTTILHLPWLWPLSHVRILADGGGIVVVGEIFTLIMIEID

SEQ ID NO: 130268 - protein, 165 aa, Glycine max
  Coding DNA Sequence Number=SeqID_13490
MGEIEEVQEQMMADMEAMKEQMATMMEAMMSMKKILEVNAAAVSATSTVAEVYLTPSSGLNQINHPTSNMVGQAGKELGSMGGPHFVQVQNKHAFPPYGLPPNYTPPNVAHTPDENVNNSTPILIESQQPQSDHAHVSQPMREAHEIPHHNLADFESCLGYATEG

SEQ ID NO: 130269 - protein, 106 aa, Glycine max
  Coding DNA Sequence Number=SeqID_13491
MGQGCNERNWTIFRGHYNITKSTQIGTLAVVTLGIISEESANENKEKKKLLVKRGKVSTGCRGRGGEREKKKGKGKEDSKGQGERGQRKRPHDLHTCPKSSPLLHF

SEQ ID NO: 130270 - protein, 215 aa, Glycine max
  Coding DNA Sequence Number=SeqID_13492
  Gene Ontology: Mol. function=transporter activity; Cellular component= integral to membrane; Biological process=transport
  Homolog annotation: Hit_ID=Q66AL0; Match level="QueryCoverage=99%, HitCoverage=44%, E-value=3e-92, Identity=81%"; Hit description =Sulfate permease family protein
MVIPALNLAVVSFVSMMLTARSFAAKNGYEVNADAEFRALGLVNIVSALSQVYSGGGIGRGADVCGLVAAGHPWHLDLAPPQRAGVPPGAVYLSQRAAGRGDQRHRAGGVTGADAVSAHCLPADGTAAGRQRRRHDPFHGQQQWGEGGARRHDVSFQFAADLFQRGVLQTPYSQFGRRHAVPAALGGGGRGGQFYPCRYQRAGGHRRTETRSVTA

SEQ ID NO: 130271 - protein, 201 aa, Glycine max
  Coding DNA Sequence Number=SeqID_13493
  Gene Ontology: Mol. function=pyruvate kinase activity; Cellular component=chloroplast; Biological process=glycolysis
  Homolog annotation: Hit_ID=Q1RYJ8; Match level="QueryCoverage=87%, HitCoverage=29%, E-value=1e-58, Identity=68%"; Hit description =Pyruvate kinase
  Pfam annotation: Domain name=PK; Domain location=107-201; Score= -250.4; E_value=0.017; Accession=PF00224.11; Description=Pyruvate kinase, barrel domain
  Subcellular localization annotation: CTP_CleavageSite=62; ConfidenceScore=5.78e-01
MAQVAASRSIQSTPLCPTSGSARDRAQNLLKPPSFASKVFPFVGNNNKRSKLSLRGLQISARKSAPSEVIPVSPEDDPKIEEHLQHLRGVQPFGENSVGMWSKPTFRRKTKIVCTIGPSTNTREMIWKLAEAGMNVARLNMSHGDHASHQKVIDLVKEYNASHGDNVIAIMLDTKGCVALVYLLCNNFVLDIRSIVSSTMV

SEQ ID NO: 130272 - protein, 355 aa, Glycine max
  Coding DNA Sequence Number=SeqID_13494
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=31%, E-value=2e-75, Identity=47%"; Hit description=Chromo
WEEEDDPALQLDPPDEVETAGDPSLQDHHLSYNALKGSSGLGIMKFQGSINGLGVQILLDSGSSDNFLQPRLAQCLKLPVEPIPNLQVLVVNGNALTAEGLIQDLEVKIQGHTLKLPVYLLPVSGADLVLGAAWLATIGPDLSDYSTLTLKFYLGINLSPYMARDPPYHNRLNLITREECSIRVPLQNCLLYNTQVFDVPSADMLKEGIIAPSRSPFSPPIILVKKKDGTWRFCTDYRALNAITIKDSFPIPTVDELIDELHGAVYFSKLDLRFAFRTHQGHYEWLVMPFGLTNAPATFQSLMNEINYLGHTVSGKGVTMDQEKVQAVLNWPYPINLKQLRGFLRLTGYYSKLIK

SEQ ID NO: 130273 - protein, 94 aa, Glycine max
  Coding DNA Sequence Number=SeqID_13495
  Gene Ontology: Mol. function=pyruvate kinase activity; Cellular component=chloroplast; Biological process=glycolysis
  Homolog annotation: Hit_ID=Q1RYJ8; Match level="QueryCoverage=58%, HitCoverage=9%, E-value=2e-22, Identity=91%"; Hit description =Pyruvate kinase
MLTSLLIPEPPKLISRKYYTVKGSRAVLSSRAYNGPEVRSGDLPQPITLMPGQEFTFTIQRGVGTADCVSVNYDDFVNDVEVGDMLLVDGMVIN

SEQ ID NO: 130274 - protein, 80 aa, Glycine max
  Coding DNA Sequence Number=SeqID_13496
MAFGNMAARPGELMLTPEVTGSPRRAGSLSLKQFGDPGEPEASLGELGSRKLIEKTLLPLPFVTGVEQHRSASENQNINE

SEQ ID NO: 130275 - protein, 55 aa, Glycine max
  Coding DNA Sequence Number=SeqID_13497
MGLKIERLMHIIVSPEQAVVDEVEKKVVNFPWFFLKSCTWANTGHDIMPKCSEIE

SEQ ID NO: 130276 - protein, 1395 aa, Glycine max
  Coding DNA Sequence Number=SeqID_13498
  Gene Ontology: Mol. function=RNA-directed DNA polymerase activity; Cellular component=chromatin; Biological process=chromatin assembly or disassembly
  Pfam annotation: Domain name=RVP_2; Domain location=286-416; Score= -30.7; E_value=0.00025; Accession=PF08284.2; Description=Retroviral aspartyl protease
  Pfam annotation: Domain name=rve; Domain location=1054-1201; Score =105.0; E_value=2.2e-28; Accession=PF00665.16; Description=Integrase core domain
  Pfam module annotation: Pfam domain module=RVP_2::RVT_1::Retrotrans _gag::rve; Domain location=286-416::553-722::89-179::1054-1201
  Subcellular localization annotation: CTP_CleavageSite=41; ConfidenceScore=5.16e-01
MAHPPPNTPDPVAELTRQVALLSTQVEQMRKQMNDPASTVSSSSTVDSANRPRMKLDVPRFDGSNAHGWIFKISQFFTYHQTLEEDRITIASFYLDGPALAWYQWMHRNQQIVSWTQFLTALKTRFALTAYDDPRGKLFKLTQSTTVAAYLTEFEALANRLEGLSPADLLSCFISGLKTEIRREIPAFRPFCLSQAADPSAPPKITAGLLPTPPGKPRFRHLSGPEMDERKEKGLCFNCDQRWSRNHKCGARIFLMLTNDDNDVVTGDLDSAVAQLDSGNVEVVSEAAQLSLHALSSDQAGDTFRVQGIIGSHSVSVLVEGGSTHNFIRGSVVDKLGLSLDPITSFRVMVGSGQVLLCSHACREVTVLIQGHKFCLDLFVLDLRGTDLVLGVQWLKHIGLVLMNYSTMSLTFLYNNSTIELHGDTTPHSMSLHSFNKLTRIEPEAQLFSFHISNPDTNLIHPPPNTGPEPIPTLPDLATLEPQVQTIITQYSHLFSEPSALPPPRITDHTIPLAPHASPVKVQPYRYPHSQKHEIEKQVAKLISTGWIQPNTSPFSSPVLLLKKKDGSWRMCVDYRSLNAITVRDRFPLPTIDELLDELGKARVFSKLDLTSGFHQIRVAPEDLHKTMFCTHDGHYEYRVMPFGLCNAPSTFQAIMNDIFRSLLRKTVIVFFDDILVFSSSMDEHAGHLSQVFSILNTHQFHLRPSKCSFGQRQIAYLGHIVADGTVAPDPSKIQGVIDWPTPKSTKSLHVFLGLSGFYRRFVKGYASIAHPLTSLLKKNSFEWSVGAQDAFEALKLALTSAPILSLPDFNIPFVIQSDASGYAMGAVLLQNNHPIAYFSKLFCPRMARASTYLRELHAITCAVKRWRQYLLGNFFIIQTDHRSLKELLTQVIQTPEQQLYLSKLLGYHYEIHYRSGKSNVVADALSRGPEIPTAELQLLSTPQFLFIEELRQELAADVPYQDLCRKVLAEPLSFPEYTLQNGLLLRKGRIWVPSNSRFKLLLMKEFHETLIGGHVGVVKNLKRLSANFYWDSMRKDIKAFIANCLVCQQTKYVPAKPGGLPLSGGYSVLFVVVDRFSKYVHLGALPAHYTAYKVAELFVQLVCKHHGLPRSIVSDRDPVFISKFWTDLFKFSGTLLRMSSAYLPQSDGQTEVTNRTIEQYLRAFVHHKPSLWHRYLPWAEYHYNTSFHSSAGMPPYEIVYGKPPPTFPCYVQGSSAIAATDELLATREEMLALLRRNLAKDQARMKTFTDSKRREVSFEPNAWRVGVVAYKLELPSYSKIHNVFHCSLLKPYHGPLPPPVELLPPDAVDNCPLLSPLTVIDSRSVQVNGQERTQVLDKVVLDGVSIDTAVDTRGADSNIDAANPDTSSPLEQPTTRPKRTIQLPNKYQDYITYK

SEQ ID NO: 130277 - protein, 41 aa, Glycine max
  Coding DNA Sequence Number=SeqID_13499
MEHPVNHQNMEICIEDQTDLSSIVRSTESKLRLSSKGIVQG

SEQ ID NO: 130278 - protein, 134 aa, Glycine max
  Coding DNA Sequence Number=SeqID_13500
  Gene Ontology: Mol. function=metal ion binding; Cellular component =intracellular; Biological process=thiamin biosynthetic process
  Homolog annotation: Hit_ID=Q10PA0; Match level="QueryCoverage=94%, HitCoverage=22%, E-value=6e-35, Identity=45%"; Hit description =Pentatricopeptide, putative, expressed
MEPNERVWGALLSSCRVYSNMDIGSLAADKLLQLAPEESGDTYHPQSKEIYEELSVLMGKMKELGYVPETDSALHDEEEEDKECHPAVHSEKLAIVFAILKTQESPMRITKNLRVCGDCHIAAKLISQDIYSST

SEQ ID NO: 130279 - protein, 119 aa, Glycine max
  Coding DNA Sequence Number=SeqID_13501
  Gene Ontology: Mol. function=nucleic acid binding; Cellular component= intracellular; Biological process=protein amino acid phosphorylation
  Homolog annotation: Hit_ID=Q10PA0; Match level="QueryCoverage=98%, HitCoverage=15%, E-value=3e-27, Identity=52%"; Hit description =Pentatricopeptide, putative, expressed
  Pfam annotation: Domain name=PPR; Domain location=72-106; Score=26.2; E_value=0.00012; Accession=PF01535.11; Description=PPR repeat
IYIYKWRNVKWNPMQSLVLVFFKHVGIHEYVERKKLCPNLLTENSLIDMYAGCGSLEDAKRVFDRMKFRNVASWTSLISAYGMTGQGYNAVAFFTEMQNSGQDSDSIAFVATLSACSHS

SEQ ID NO: 130280 - protein, 81 aa, Glycine max
  Coding DNA Sequence Number=SeqID_13502
MVMGDFISRLSFPACLHFSGENTETFSSLTSYPELRRSEFLIGGYVGARASLLSTTPPFVAMTQELVARGDPLRLSALVIQ

SEQ ID NO: 130281 - protein, 94 aa, Glycine max
  Coding DNA Sequence Number=SeqID_13503
MVPMFHTLYVVYFFMRKNTCTGGHVTRCETPLRLRLIPVGGGGVAYARQGDFDTYCLVFLSESVVWTRLGYFLRDGTTLHLRVEVSCMYHTEHD

SEQ ID NO: 130282 - protein, 72 aa, Glycine max
  Coding DNA Sequence Number=SeqID_13504
DGVEDTVCEKYGISKEKWAQFCQTHRNPSWEVVRKKAQAIQKQNIALHVLSGSLIMLFQHPILGHFWVTFFD

SEQ ID NO: 130283 - protein, 76 aa, Glycine max
  Coding DNA Sequence Number=SeqID_13505
  Homolog annotation: Hit_ID=Q5W7C9; Match level="QueryCoverage=99%, HitCoverage=30%, E-value=8e-27, Identity=92%"; Hit description =Unknow protein
MGESLTEQCRVKVEGLRVMNFFSRRRSNDAAAVRQRMQALSGMIGRKASVGGFLSSPSNPRAQPWTGGGNYQAGVR

SEQ ID NO: 130284 - protein, 184 aa, Glycine max
  Coding DNA Sequence Number=SeqID_13506
  Homolog annotation: Hit_ID=O04133; Match level="QueryCoverage=89%, HitCoverage=51%, E-value=4e-24, Identity=41%"; Hit description=SRC2
  Pfam annotation: Domain name=C2; Domain location=6-101; Score=30.4; E_ value=6.5e-06; Accession=PF00168.20; Description=C2 domain
MEYRTLELNLTSAKVLKDVNRPSWEEEDLFSEMGLYVVVSLPGNNEEFKTPVDRSGGTDPEWNFPIKFTFEESLLQQDRLTLQMKLCYDHHTETHIIGEVHVSLSQLVDLNTPENLFFNHVSYLLREQSSGCPKGILDFFYKFGEKFTSRVKNFPTPSPGARYPRPRRDLLQHVVEFGCLPPKD

SEQ ID NO: 130285 - protein, 175 aa, Glycine max
  Coding DNA Sequence Number=SeqID_13507
MLVNKTLCWCENSVTTFGPKNRNEICHNLMGYAYGSSFINPSLEPTKPPTLLLEVWIEENPTYTLGTRVLKHLWVLKAQSFLREYCCMRYEESFKFRAILLDLTAIVTIWVRGSEQKVGPSIVCVAFSSFFGNFQDSNNSGKATYFAAFVPLSCRQLMNTKEMQRKCLTLSHHAE

SEQ ID NO: 130286 - protein, 68 aa, Glycine max
  Coding DNA Sequence Number=SeqID_13508
LFKVLISGYWSKTLPRSSKERTGFLGTPMIFELKKPKLRVRLRVKSKLNQKLTAKWQKNEKFVLLTLR

SEQ ID NO: 130287 - protein, 40 aa, Glycine max
  Coding DNA Sequence Number=SeqID_13509
  Gene Ontology: Mol. function=oxidoreductase activity, acting on single donors with incorporation of molecular oxygen, incorporation of two atoms of oxygen
  Homolog annotation: Hit_ID=P38417; Match level="QueryCoverage=85%, HitCoverage=4%, E-value=4e-13, Identity=100%"; Hit description =Lipoxygenase-4
MGGVAVKDPSAPHGVRLLIEDYPYASDGLEIWDAIKSKGY

SEQ ID NO: 130288 - protein, 128 aa, Glycine max
  Coding DNA Sequence Number=SeqID_13510
MEGKKFIMFIAYLLEVAVAQKHKAKRVESVNVDAEAFGDHWESSDCSMHSEAEALEHMKKRNRGHQSLLLENKTGDSTVVKMSQKNNNVDAGNCMTLEDHEGEEHCCGKGTNARSVSFLPRSQEKIGD

SEQ ID NO: 130289 - protein, 99 aa, Glycine max
  Coding DNA Sequence Number=SeqID_13511
MATRIIESLVKISETYSLIFDLLYGFNSFNDNVQVLEMKLEELCSLEYDINKELEIAELQQGKKRKREVENWQRNVQRKKIEVYGIVQELRDCGVFKHL

SEQ ID NO: 130290 - protein, 607 aa, Glycine max
  Coding DNA Sequence Number=SeqID_13512
  Homolog annotation: Hit_ID=Q8W0H5; Match level="QueryCoverage=9%, HitCoverage=10%, E-value=6e-12, Identity=71%"; Hit description =Putative glutamate transporter
  Pfam annotation: Domain name=C2; Domain location=201-303; Score=18.5; E_value=0.0055; Accession=PF00168.20; Description=C2 domain
  Subcellular localization annotation: CTP_CleavageSite=59; ConfidenceScore=5.72e-01
MAALSSTVTLAAKSLSLPQNHRAKVAAAFHSPKRHLKRTEFKFFTNGLAASLRSLRRLYASSNDARFNSGPEESLQEQSSSFAEFITSERVKVVAMLALALCNADRVVMSVAIVPLSLANGWSRAFARIVQHADEVFHLGGDFAGFHDTTDFAGWLRRLRDGATANENGAQPSRKRPRPHESVGFCISLANNTVIMEYKTLELNITSAKDLRDVNSKKMDVYAIVSLSSNYQKIRTFVNKNGGSSPTWNFPVNFTFEQPVDRVIPCRSSTKSVATENPSHSSPTRPEIKPLRNPRTGFLGGTLAGVLFVEIMSVLGVENVWPWNPNMNLVLALEDMDCVMDEVLEVFGKFSIRVHRLLSRIIDIGIMGVINVSECPKIVRIDEKDIHELLRVRDGGVSEKKNLDTVITDQWEVFDDDLIVDVIGSASNEFYTYGDVVVCRNFLMDNVEAMPSKVILMMPKNQELSKVSSKDSRIKFQDSRLKNQVSRIKIKIQDSRFKNQEEDSGTSFVLKVKGTSTWVVVTENKRRYISCGSVQVEGTSTRLFKENKGGYIPCGSLLVKDFTRLKEISRTGGCLGTGCRHGLLPNQYKILVFVFFFLTLFNFRYAL

SEQ ID NO: 130291 - protein, 302 aa, Glycine max
  Coding DNA Sequence Number=SeqID_13513
  Gene Ontology: Mol. function=RNA-directed DNA polymerase activity; Cellular component=chromatin; Biological process=RNA-dependent DNA replication
MEASSYASVVWSIMYAQIYTRPNISFAAGMLGRYLSNLGMEHWKAAKKESKCTEEKSHYGQSIDGCGGGDNGDGGKYLCPSGGGGEIVHFLEEFHANSVFPKGTNSSFISLISKIDIQQNLGDYRPISLVGCMYKIVSKILASRMKRVLGKIIDLRQSAFMGDRNLLHSVVVENEGATSRRPFDTFYLYVGGRWSKGLMRDALQKNLFKGYKVGDGEVEVSLLQYANDTIFTKEASLANVKTIKCTLWCFELASGLKINFGKSNFMALGVENCVEEKFTGLLNCNLMKLPFVYLRVPIGANP

SEQ ID NO: 130292 - protein, 94 aa, Glycine max
  Coding DNA Sequence Number=SeqID_13514
MTIVMTAIMVLVVVTVMVTTIMLVVAMVDDHDGDYDDNHDNYDRNGHNNDDGHEQDYCKREYKVRCSKNPQKGYSTGGVRIWDAVMPFFYGRIW

SEQ ID NO: 130293 - protein, 190 aa, Glycine max
  Coding DNA Sequence Number=SeqID_13515
  Homolog annotation: Hit_ID=Q208U9; Match level="QueryCoverage=37%, HitCoverage=21%, E-value=5e-21, Identity=68%"; Hit description=CFM6
MKSKEGVRRVWECRWEEGCRGNREEVELEREKFYRLKAKKKMISPNLEVRIRYKLEKSFILTYNSKGQAKGNLELRKFDVAKSPPETIIVYHGKNYVEPEVMPPPNTLSKVKALEKYRYEQSLEHTSQFIERLEKGLEEYHQHLAKFKNGKNDIAKDVNLAGLGKHDSIYTGHKMPHTRGLDNLILFAIE

SEQ ID NO: 130294 - protein, 172 aa, Glycine max
  Coding DNA Sequence Number=SeqID_13516
MLGAFLVLTRGVLREGGHAGREVVGGEVKIGVTRIGKEREKMGHPREAYEALREKKLAVGQDQRATSTPGATKHLGGVRARAARHRSSQLNLIRAISWVRDMVGLSSTDTPSIPELQHLTEATQIGEPTSSSTEVIIQKRREMSVLRKEKEKEKGSGGSVKKCQEGSFSEGF

SEQ ID NO: 130295 - protein, 47 aa, Glycine max
  Coding DNA Sequence Number=SeqID_13517
  Homolog annotation: Hit_ID=Q2HV28; Match level="QueryCoverage=99%, HitCoverage=28%, E-value=9e-09, Identity=79%"; Hit description=C2
MDEQLRILKVIVVQGKKLVIRDSRAVTLMLLSSWGIRQQRPGSFIVA

SEQ ID NO: 130296 - protein, 57 aa, Glycine max
  Coding DNA Sequence Number=SeqID_13518
  Subcellular localization annotation: CTP_CleavageSite=37; ConfidenceScore=5.06e-01
MVARTRKALTHSVLHSLSKAVTHSPYTLCPHSDRALRQSLAVKGVSHATPQSLSSLK

SEQ ID NO: 130297 - protein, 217 aa, Glycine max
  Coding DNA Sequence Number=SeqID_13519
MEANISLGWKPLNLERNNGTTNLDEHLDTFLTQANLYTDDDAILCRVFPTSLKWATLTWYGGLPPRPIDSMNELCERAKGYIQMEEMSRFKNEVRQDKSKRDKREGGTDKATSATSSQAEGDKDTISKDVINNLSKNEPVQQISGVINTIAGGFSYGSDVAPCGACRPWIFFINEVLCFLKFDDSGMEKENDDWRRHFNEKMSLEETHHHRKSWIRA

SEQ ID NO: 130298 - protein, 194 aa, Glycine max
  Coding DNA Sequence Number=SeqID_13520
  Gene Ontology: Mol. function=zinc ion binding
  Homolog annotation: Hit_ID=Q53MN0; Match level="QueryCoverage=71%, HitCoverage=13%, E-value=5e-24, Identity=45%"; Hit description=PHD -finger, putative
MVLLSDNHSLSHHGLSQCINNAEKENKFEKEFQPDPKDEANTSESLNATVPYPIADPVWRGSLRISDPSFGTVIGLLAHVSTLASPKVLEETRFFPDVLCPDLRPRTAVWPKSFMKCGPNMDSIALYFFPDSERVERAFHKLVEDMMYFDLSLRTEVENAELLIFPSILLPIQCRRFQEKYYLWGVFRAKKPSL

SEQ ID NO: 130299 - protein, 178 aa, Glycine max
  Coding DNA Sequence Number=SeqID_13521
MKLKAHTILMSMLLTSIGIKYEGSNTNPLQHSSPIKMLFITAICCHVLGHTAEMSLPTTIFIFHVSGIVGRQALMWILVAELLWWYIINLLLLLVASFCFNYKHVIEIICGGMGDIMTNLEAHEAQMEKKESHEDSTSGGFNLFSVSNVREFYWSSQRKNWRNIRKPLEMPQLLSKDT

SEQ ID NO: 130300 - protein, 90 aa, Glycine max
  Coding DNA Sequence Number=SeqID_13522
  Homolog annotation: Hit_ID=O64438; Match level="QueryCoverage=41%, HitCoverage=16%, E-value=1e-09, Identity=76%"; Hit description=ARG10
MFCLFQHITTVGGLRCYENPKNKITAVPAEEEQIWGAFIKNRESVIGPNSNIRLMSVETALGTKGKCEVILELKKLELNIHYVTRIGSCN

SEQ ID NO: 130301 - protein, 170 aa, Glycine max
  Coding DNA Sequence Number=SeqID_13523
MEPSRMSMMNLWHCSYFEPYIPYEEHKQTEISFSEKNFLSQKLLKAVEKWEEDKKCQGQSFVNNETDPDDTDEDDEYVFRQKLFSSIDKENSDTKSIEDLLEKIDLHEFYEKEINFKNTLEINSKIDETESLVSFPESYKGLMADASGHVSTSQDMIARAETYLGDIARA

SEQ ID NO: 130302 - protein, 74 aa, Glycine max
  Coding DNA Sequence Number=SeqID_13524
DHFLVTAFSCLFDSGTTSINPTPDQFRAEVTWPEDWPETQAGEAPAEAPGDAEEARMDEEMTDLLGFLGGSGAT

SEQ ID NO: 130303 - protein, 127 aa, Glycine max
  Coding DNA Sequence Number=SeqID_13525
  Gene Ontology: Mol. function=RNA-directed DNA polymerase activity; Cellular component=intracellular; Biological process=RNA-dependent DNA replication
MELYIDDVVVKSIDINQHLADLEPALQKLRFCGIFGTSKGIKVDKNKAITVLEASPPRNKKELQSLTGKINFLRRFIANSAAKPQVLVSLILGKPLKLCISTANRSIGCLLAQYAKDGIERAIYYLS

SEQ ID NO: 130304 - protein, 359 aa, Glycine max
  Coding DNA Sequence Number=SeqID_13526
  Subcellular localization annotation: CTP_CleavageSite=59; ConfidenceScore=5.30e-01
ELEARKVHVGENSASSMSRNLEVRNQATLPNTTSTRMSNTVQPIGNQMGFILRALVAIMSYMPVNVGNLFATTFGGQADENDYANQVVPTHVVNKRVNNGEPSYVNSDVGLGANVVGHDNYLPLRTTMTLLIDLELLAETMKKYFDIHQKPMKRCTFSWYSNLPPYSVQRWADMEKLHRNVGRCCSMQFPEVECATMTVGNMHPRLKEKLVAQEYGDLSQLASKANQIDQKVFQKEVEIMAAEILWGKPYSCPVLKLGKNKEFAGDVKLKALKEGHFKLANKGTTGMAVDTDPFSKLNINMVFYEKPTTKKKEDEAKGTSKGSTYQITGPKLVDMRKALRRKEESMEFEKLRKQIHGNI

SEQ ID NO: 130305 - protein, 337 aa, Glycine max
  Coding DNA Sequence Number=SeqID_13527
  Gene Ontology: Mol. function=metal ion binding
  Homolog annotation: Hit_ID=Q6ZGA0; Match level="QueryCoverage=94%, HitCoverage=93%, E-value=1e-64, Identity=42%"; Hit description =Putative S-ribonuclease binding protein SBP1
MLGGNNGNCLLPVFLDETQFQHQTNVSNQLQLFGNLQAGCSVDPVNYFGNEHISSMIQPNKRSKEMEDISKQRLQISLNYNVHQDDAERLASIPNPNPVSTGLRLSYDDDERNSSVTSASGSMAATPSIILSLGDNIRTELDRQQEELDQYVKLQKEQLSKGVRDMKQKHMAALLTSIEKGISTKLKEKDVEIENMNRKNRELAERIKQVAVEVQSWHYRAKYNESIVNTLRNNLQQAISQGAEQGKEGFGDSEVDDDASYIDPNNFLNILAAPINSTHKSYQDMENLTCRACKVKTVSMLLMPCRHLCLCKDCEGFINVCPICQLIKTASVEVHLS

SEQ ID NO: 130306 - protein, 531 aa, Glycine max
  Coding DNA Sequence Number=SeqID_13528
  Gene Ontology: Mol. function=DNA binding; Biological process=DNA methylation
  Homolog annotation: Hit_ID=Q1SW07; Match level="QueryCoverage=97%, HitCoverage=98%, E-value=1e-150, Identity=49%"; Hit description =Ubiquitin-associated
  Pfam annotation: Domain name=DNA_methylase; Domain location=122-399; Score=-140.8; E_value=0.02; Accession=PF00145.8; Description=C-5 cytosine-specific DNA methylase
MGSEGDDSSPSDYDWNTDDELEVFGIPPSDPTISSQESCEDSVGESSASCSSAKHSKLIHLFVGMGFSRETVIKAIDENGRDNEEDIMEALLTLTAEKPLTVEKDEALSVLVNMGYPFEEALTAIDKCGPKAHISELADFISASQLEKGLHSPQESPNNKHDASDYTHEKPCQPSGEYYLHTSKKVKLGLGIFNEASQVISRKFPREVANKPYFYFENVALAPKGVWKTISRFLYEIEPEYVDSKYFCAATRKRGYIHNLPTHNRSPLLPIPPLTIQEAFPTTKKWWPSWDRRTKLNCLLTRVAPGPVTERIRKLLEKFGDEPPLHVQENVLVEIRKWNLVWVGKNKLAPLEPDEYEMLLGFPRDHTRGGGVTRTERYKSLGNAFQVNTVAYHLSVLKGRFPNGINVLSLFSGIGGAEVALHRLGMMLKNVVSVEIAEVNRNIIRSWWEQTNQRGNLIEVEDVQKVSSNELSQWITKFGGFDLIIGGSPCNNISGSNRVSRHGLEGEQSSLFYEYFRIVEAVMEIQRDELL

SEQ ID NO: 130307 - protein, 286 aa, Glycine max
  Coding DNA Sequence Number=SeqID_13529
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=94%, HitCoverage=89%, E-value=8e-46, Identity=34%"; Hit description=MRNA, complete cds, clone: RAFL21-92-C23
MAPDTTALSYWLNWRFFLCALFILLTMGLASFLIWKYEEFNKSRNERRERQRETAGSLYEYEAWSTCLNGIHPAWLLTYRIISFLLLFSLLTANVVADGGGIFYFYTQWTFTLVTIYFGLGSCVSIYGCRYKHNKIDSSTVNRADLDTEEGTYVAPTLDGTPELPNLYKNSNANQELYTRNIAGVWGYIFQITFQTCAGAVVLTDVVFWLVLYPTYLNTKDFHLHFMDVCLHSLNAIFLLGDASLNCMWIIHACVSLWWPYPFLDLSSPYAPLWYVLKFNASPPLK

SEQ ID NO: 130308 - protein, 221 aa, Glycine max
  Coding DNA Sequence Number=SeqID_13530
  Homolog annotation: Hit_ID=Q1S6N2; Match level="QueryCoverage=32%, HitCoverage=32%, E-value=4e-09, Identity=37%"; Hit description=RNA -directed DNA polymerase
MPQNYKEKLKLKEWHKEVYGNLSFGIRTVVDELDDVEVRLCEEQPVDCDQRKLLSSEFWRAKWIKEGNTISHFFHASLKDRYIKNYLVGLHTENGGEVKDVVVHHFQRIFMEPNLERPFLSGIQFNQVSSCDCVSLTVLKKDVVDDVMVTNELIDLVQKGQKSCFLFKIDFEKTYDSVSSMSVLVNDSPTGEFVAQRGLKQGTLLGTLLFFMVAEGLSGLV

SEQ ID NO: 130309 - protein, 107 aa, Glycine max
  Coding DNA Sequence Number=SeqID_13531
MSPLVRNLVKRAVKLSLDDLKANHSQAFLSSRDVEGECISLLGLQSQGVGTEIVENCIEERIVSVVEMDNKKPHNSQEPAPFLFEEDPVEELEFQENDFSPLNSLLF

SEQ ID NO: 130310 - protein, 293 aa, Glycine max
  Coding DNA Sequence Number=SeqID_13532
  Subcellular localization annotation: CTP_CleavageSite=37; ConfidenceScore=5.41e-01
MAEIQSKQAASSSTTFVSNSIFVCKRISYLLVFVSARSQKFKCNVRIHDYGSVRPIHTLMGLAIGSYHEPTAFSVIYKFDFRKPLLISAREFQRVLILNGVFFCSETVFTFNIFIVSEMPIIGADLQTRCYSHSLFIFAPFSSNLKWNASSQNHHHVEICQVLCFLGARVIILCHCSRVKQSMDIVGISDTEIHNYQINLKGSGSSRITRLSPNIKNGEKIRHAMVVKFVCLLLLALISYWLIFIPFYRSLIITVPQSCDSPIENFNHEPRSKQLGHIFQLELESKLSKLNAY

SEQ ID NO: 130311 - protein, 151 aa, Glycine max
  Coding DNA Sequence Number=SeqID_13533
  Subcellular localization annotation: CTP_CleavageSite=28; ConfidenceScore=5.19e-01
MSLQVQPQSQTQPLMQQQQQPVQVYPTSVTYESPPHHSNGSFGSVFVVLAIIIVISAVACCLGRLCNRRGHSHGHNQKHVKPQKQQQQQNHHNFRPKEVDIEFGFDKRIAASKPNGAGAGAGRGIKPLPHHGDMRTFEMKLGHQGKIRPGP

SEQ ID NO: 130312 - protein, 104 aa, Glycine max
  Coding DNA Sequence Number=SeqID_13534
  Subcellular localization annotation: CTP_CleavageSite=63; ConfidenceScore=5.01e-01
MKLIKLDCGTLGDTPLGNETLTIGVFASRIRVGLTIGASGTNVGTLAASTTVAGAAVGVTTTSALTLVTFKATSHTSTNGKIPFHPSSIVTDFSLNCVLSPSLL

SEQ ID NO: 130313 - protein, 108 aa, Glycine max
  Coding DNA Sequence Number=SeqID_13535
MELVQLELDASAAHKESQMASQRLKELCVAKEEIEGMAAYVKSHEQALEVEVDALRKSVDSQSGVASAMDSTRVRDLISKIAMDKQVLELLLAQLKDDQDAANLSLAI

SEQ ID NO: 130314 - protein, 193 aa, Glycine max
  Coding DNA Sequence Number=SeqID_13536
MNSLSELAALSEFIHTHCIKRKSIGARPTTQYDTRRFHSFEAWTRYTYNVLGRHMLVERKVEIYQTELDEFKAELERRNFHKRLTNLADNSINLALVKEFYANLYSPEGPSPKQVKIRGHLIKIDANNLNTFLETPVVLAEGESLPTYSRYCRMPTDIREIEAALCIPGRGFVLNVEGHPGKILKKDLTTLAQ

SEQ ID NO: 130315 - protein, 239 aa, Glycine max
  Coding DNA Sequence Number=SeqID_13537
MEVYLVHDWARSSSELESESIPVGPVQLQPVIHPAIKSTSASNSPVVSFETKLAIIHGAKSCPKRFGVVVPMTANQGFANGTTSQDPLQSLEHQLRSTAPSTEKTSNTTHTLFQPVESVPPTLSLNTAHSHPTLNTLLVKRIVSSRELVVVNGNESTSPQKHTLTSSVSQSKPYSTYTKAHADADDGVQCMDEFAGVKSYQAISDALSLLPVNPPQDEEDEETPIQYTMKRLASRPRAD

SEQ ID NO: 130316 - protein, 251 aa, Glycine max
  Coding DNA Sequence Number=SeqID_13538
  Homolog annotation: Hit_ID=Q1SFC5; Match level="QueryCoverage=75%, HitCoverage=27%, E-value=7e-10, Identity=25%"; Hit description =Asp/Glu racemase
  Pfam annotation: Domain name=DUF1723; Domain location=79-128; Score =37.2; E_value=5.5e-08; Accession=PF08330.1; Description=Protein of unknown function (DUF1723)
MATSSISTNSTLLIVVSVTKLIEFDMHSVPSLGLEDETKKLWETQVMISYSLTEKSFCRGSSKIGIYDLLQPSKLDVSNIDISMIMATAFFWNQNTCALELPCGLASPTLLDVAAIIGLMPIGEKYLVAFNDIVNVMRREEPITGLSRPSWFIQLWINSILKKHLRPDMRFFPPRALEDARLIYYTPTKKPLENSFKIFIEVLQITTEFTKDLAPFALSTIIGPLCLKKFFLADTLGEQAKLMEMWSSFLT

SEQ ID NO: 130317 - protein, 201 aa, Glycine max
  Coding DNA Sequence Number=SeqID_13539
  Gene Ontology: Mol. function=protein serine/threonine kinase activity; Cellular component=membrane; Biological process=protein amino acid phosphorylation
  Homolog annotation: Hit_ID=Q9FFW5; Match level="QueryCoverage=84%, HitCoverage=24%, E-value=1e-49, Identity=57%"; Hit description =Similarity to protein kinase
MAPEYATSGKLTDRSDVFSFGVVLLELITGRKPVDPMQPIGEESLVEWARPLLLRAVETGDFGELVDPRLERQYADTEMFRMIETAAACVRHSAPKRPRMVQVARSLDSGDQQYDLSNGVKYGQSTIYDSGQYNEDITIFKRMVNGSFDDSEFDMDSTTDYRSTVSREMSGSRHARMLYSEGGDSDYRVFHGQRSNTQNMS

SEQ ID NO: 130318 - protein, 479 aa, Glycine max
  Coding DNA Sequence Number=SeqID_13540
  Gene Ontology: Mol. function=protein serine/threonine kinase activity; Biological process=protein amino acid phosphorylation
  Homolog annotation: Hit_ID=Q1S4F8; Match level="QueryCoverage=48%, HitCoverage=33%, E-value=2e-73, Identity=58%"; Hit description =Protein kinase
  Pfam annotation: Domain name=Extensin_2; Domain location=1-296; Score= -126.1; E_value=0.022; Accession=PF04554.4; Description=Extensin-like region
  Pfam annotation: Domain name=Pkinase; Domain location=315-479; Score=- 28.7; E_value=7.4e-07; Accession=PF00069.15; Description=Protein kinase domain
  Pfam annotation: Domain name=Pkinase_Tyr; Domain location=315-479; Score=-8.7; E_value=6.2e-12; Accession=PF07714.7; Description =Protein tyrosine kinase
  Pfam module annotation: Pfam domain module=Extensin_2::Pkinase::Pkinas e_Tyr; Domain location=1-296::315-479::315-479
  Subcellular localization annotation: CTP_CleavageSite=68; ConfidenceScore=5.50e-01
MANDTSSNESSSSDSDKDKASPPSPSSSSNDSESPKSAPSKSPPPSPPPSPSPPPPEKSSPPPTESLPAPENSPPPTPSQSPPPTPSQSPPPSPSPPTPPSPPPSSTPPPSKDSAPPPSPSEPPPSPPQSSPPPPQNSPPAPQSQAPPPHSLSPPTAIQTPLSPGSHVTPPPAPTGSGPNHPSPPRSPPSTQPKPSGALPKNDPPSTSPSSGNNTGETVGLALAGVVMIAFLALVIFFIFRRKQKRAGVYAMPPPRKSHMKGGGADVHYFVEEPGFGSGAQGAINLRCPSEPAQHMNTGQLVFTYEKIAEITNGFASENIIGEGGFGYVYKASMPDGRVGALKMLKAGSGQGEREFRAEVDIISRIHHRHLVSLIGYCISEQQRVLIYEFVPNGNLSQHLHGSERPILDWPKRMKIAIGSARGLAYLHDGCNPKIIHRDIKSANILLDNAYEAQVADFGLARLTDDSNTHVSTRVMGTF

SEQ ID NO: 130319 - protein, 121 aa, Glycine max
  Coding DNA Sequence Number=SeqID_13541
MNQQWDELLDDLRQNLLKARDRMRKQAKKYRRCVEYAVGDQVFSICSPIRWPMSLIYRRIAGFNQLPCHCLCLFKKAVSTPQFVPTFPLALADDMEFQVEPANMLDLRQNLRPCEDSWEAA

SEQ ID NO: 130320 - protein, 276 aa, Glycine max
  Coding DNA Sequence Number=SeqID_13542
  Gene Ontology: Mol. function=carbonate dehydratase activity; Cellular component=chloroplast; Biological process=carbon utilization
  Homolog annotation: Hit_ID=Q5NE21; Match level="QueryCoverage=99%, HitCoverage=95%, E-value=1e-104, Identity=68%"; Hit description =Carbonic anhydrase
  Pfam annotation: Domain name=Pro_CA; Domain location=75-265; Score =279.5; E_value=6.5e-81; Accession=PF00484.9; Description=Carbonic anhydrase
MAGESYEEAIASLTKLLSEKADLGGVAAAKIKDLTAELDAAGSKPFNPEERIRTGFIQFKNEKFEKNPDLYGELAKGQSPKFMVFACSDSRVCPSHILDFQPGEAFMVRNIANMVPPYDKGQYKSSFKCTNRKTKYSGAGAAIEYAVLHLKVENIVVIGHSCCGGIKGLMSIPDDGTTARQLFSTSNEFIEQWVQICTPAKSKVKAGKSDLSFSEQCTNCEKEAVNVSLGNLLTYPFVRDGVVNKTLALKGAHYDFVNGNFELWDLNFKLLPTISV

SEQ ID NO: 130321 - protein, 162 aa, Glycine max
  Coding DNA Sequence Number=SeqID_13543
  Gene Ontology: Mol. function=nucleic acid binding
  Homolog annotation: Hit_ID=Q5JML8; Match level="QueryCoverage=79%, HitCoverage=95%, E-value=2e-49, Identity=72%"; Hit description=DNA -binding protein-related-like
  Subcellular localization annotation: CTP_CleavageSite=34; ConfidenceScore=5.13e-01
MADSKAGLRKPVFTKVDQLRPGTSGHTLTVKVVNAKMVMQKGRSDGPQSRQMRIAECLVGDETGMIIFTARNDQVDMMKEAATVILRNAKIDMFKGSMRLAVDKWGRVEVTEPASFTVKEDNNLSLIEYELRFEKPVVPTVASYCCNRLCGSCSLTTEQMVD

SEQ ID NO: 130322 - protein, 88 aa, Glycine max
  Coding DNA Sequence Number=SeqID_13544
  Gene Ontology: Mol. function=nucleic acid binding
  Homolog annotation: Hit_ID=Q5JML8; Match level="QueryCoverage=82%, HitCoverage=54%, E-value=2e-18, Identity=60%"; Hit description=DNA -binding protein-related-like
  Subcellular localization annotation: CTP_CleavageSite=34; ConfidenceScore=5.23e-01
MADSKSGLRKPVFTKVDQLCPGTSGHTLTVKVVNAKMVMQRGRSDGPQSRQMRIAECLVGDETGMIIFTARNDQEEDTQQYTDRERAG

SEQ ID NO: 130323 - protein, 319 aa, Glycine max
  Coding DNA Sequence Number=SeqID_13545
  Gene Ontology: Biological process=ripening
  Homolog annotation: Hit_ID=P92990; Match level="QueryCoverage=92%, HitCoverage=64%, E-value=7e-89, Identity=43%"; Hit description =Probable polygalacturonase non-catalytic subunit JP650 precursor
MNKQLRLLCLFILFSLFLCVGFAGAGDTAEKNPFTPKAFAIRYWDKEIRSGLPKPPFLVSKASPLSAAEAAAFLKLVSGNSLSTRLPEFCAAAKLLCFPEVGPRLEKHDKDANFAVYRDNNFTNYGTGRPGGLDSFKNYSEGENIPVNDFRRYSRDSAGHKDGFLSYGTNGNVVQQSFHTYAAGATGGTGEFKHYADETNVPNLGFTSYSDNANGRTQSFSSYSENGNAGEQTFTSYGKNGNGPTNVFASYGTESNVVGSGFSNYAETANAANDTFKGYGIDMNNPTNTFSNYAAGGNGAVERFSSYRDKANVGADSFT

SEQ ID NO: 130324 - protein, 573 aa, Glycine max
  Coding DNA Sequence Number=SeqID_13546
  Homolog annotation: Hit_ID=Q2QYH0; Match level="QueryCoverage=20%, HitCoverage=17%, E-value=8e-16, Identity=40%"; Hit description =Expressed protein
  Pfam annotation: Domain name=DUF936; Domain location=1-572; Score =115.0; E_value=2.2e-31; Accession=PF06075.3; Description=Plant protein of unknown function (DUF936)
MATLAPGILLKLLNGLNTGVKPTNEHRSSLLQVTDIVPADLDEKNLIPKQGFFIKVSDSSHSIYASLPSDQDDIVLSNKMQLGQFIYVDRLEPGSPVPVLKGAKPLPGRHPLIGTPEPLMGLRDQNQKPNSVPRRGSWGTGGDGGFNFKPVNLDFDQCTPVKVRNGGFQPVSSSPLIRGTPGSAVRCSVGGGLLLAKMSDAKAESPALLRKSCVVATSNSKFARSRSVSEREHRIPASPFKSAEKKFGTTPPRLRNARVITSSSYGDAQGQNTDTSVSSSSQSQSQSTANSAFDNCNNLSIPMNLPGKLSSLGKEAVQQREVAQKIALQALRDASATETVVRSLKMFSNLCKSARTDAPKACFERFLEFHMEIVQAVNEMVSIQAATSASELAQKSDKQELQVLHEVMDNCENSESNLSKRRGALYKSMAVIPEKHEQKANMGRLLRSSTNQKEILEKKGSTPLTKMPLGPIVENDENKKPGGSCSLSNTIKLGKQIETEAGNWFMEFIEKALETGLKKTKDASDGDVRKVPQSLILKVMNWVEVEQCQSNKRPGHPKAAQVARKLRIKMKNP

SEQ ID NO: 130325 - protein, 551 aa, Glycine max
  Coding DNA Sequence Number=SeqID_13547
  Gene Ontology: Mol. function=aldehyde dehydrogenase (NAD) activity; Cellular component=mitochondrion; Biological process=metabolic process
  Homolog annotation: Hit_ID=P93344; Match level="QueryCoverage=90%, HitCoverage=92%, E-value=0.0, Identity=80%"; Hit description =Aldehyde dehydrogenase
  Pfam annotation: Domain name=Aldedh; Domain location=79-541; Score =862.4; E_value=2.2e-256; Accession=PF00171.12; Description=Aldehyde dehydrogenase family
MKSELYFIGWPLFLFSYHLFFSQFHCPFKLCFCFGAFINGGSGALGAGLSKFSTAAAIEEPIKPPLKVEHTQLLIDGKFVDAATGKTFPTLDPRTGDVISHVAEGDHEDVDRAVAAARKAFDRGPWPKMTAYERQRILLRAADLFEKHNDDLAALETWDNGKPYEQSAQIEIPMLVRLFRYYAGWADKIHGLTVPADGPYHVQTLHEPIGVAGQIIPWNFPLVMFAWKVGPALACGNTIVLKTAEQTPLSALYASKLLHEAGLPPGVLNIISGFGPTAGAAIASHMDIDKLAFTGSTETGKIVLELAARSNLKPVTLELGGKSPFIVCEDADVDEAVELAHFALFFNQGQCCCAGSRTFVHERVYDEFIEKAKARALKRAVGDPFKGGIEQGPQIDSEQFQKILKYIRSGVESGATLETGGDRFGNSGFYIQPTVFSNVKDDMLIAKEEIFGPVQSILKFKDLDDVIQRANNTHYGLAAGVFTKNINTANTLTRALRAGTVWVNCFDTFDAAIPFGGYKMSGQGREKGEYSLKNYLQVKAVVTSLKNPAWL

SEQ ID NO: 130326 - protein, 114 aa, Glycine max
  Coding DNA Sequence Number=SeqID_13548
  Homolog annotation: Hit_ID=Q00M75; Match level="QueryCoverage=26%, HitCoverage=5%, E-value=5e-10, Identity=100%"; Hit description=PPR -repeat containing protein
MVGAMINGINTSEPINERINLQLIIEQTVVGLVTCEYPNTEASNITTYQKVRIFLLRTPLPGGSSLCEGMGEGCCTQPYPCICKEAVSGFEPMTNKSPRHNFTAAPGLALIPES

SEQ ID NO: 130327 - protein, 171 aa, Glycine max
  Coding DNA Sequence Number=SeqID_13549
  Homolog annotation: Hit_ID=Q00M75; Match level="QueryCoverage=18%, HitCoverage=5%, E-value=2e-09, Identity=96%"; Hit description=PPR -repeat containing protein
MRGENERVLRSKDVWNGAVGSQNQKRKIGDEPALPLAGDGDKKIGLRGNGDANGMTVSTNRDINSHGVPTVAPLLEQKKEEEGVAEDVKVNLFPEGEEPVGRGWQGASGLKASPGAAVKLCLGDLLVMGSNPETASLHMQGNVTSFCVWVFTSHKTNNSLFNYKLEIDPQV

SEQ ID NO: 130328 - protein, 577 aa, Glycine max
  Coding DNA Sequence Number=SeqID_13550
  Gene Ontology: Mol. function=ubiquitin-protein ligase activity; Cellular component=ubiquitin ligase complex; Biological process =protein ubiquitination
  Homolog annotation: Hit_ID=Q9C7R6; Match level="QueryCoverage=98%, HitCoverage=77%, E-value=3e-72, Identity=34%"; Hit description=Arm repeat-containing protein, putative; 6839-9028
  Pfam annotation: Domain name=Arm; Domain location=304-344; Score =29.7; E_value=1e-05; Accession=PF00514.13; Description=Armadillobeta- catenin-like repeat
  Pfam annotation: Domain name=Arm; Domain location=345-386; Score=2.6; E_value=5.7; Accession=PF00514.13; Description=Armadillobeta-catenin -like repeat
  Pfam annotation: Domain name=Arm; Domain location=427-468; Score =17.8; E_value=0.039; Accession=PF00514.13; Description=Armadillobeta- catenin-like repeat
  Pfam annotation: Domain name=U-box; Domain location=172-243; Score =46.6; E_value=8.5e-11; Accession=PF04564.6; Description=U-box domain
  Pfam module annotation: Pfam domain module=Arm::Arm::Arm::U-box; Domain location=304-344::345-386::427-468::172-243
MESDRVATQFRVISRSVATALDVFPFGSVEISEETKEHVLLLNEQARRARLEFEQEDKRVVVSVVSGLTRFENRVPPGEGDLKWVLEYIGVKKWSECNKEVKFLEGEIGFECLKNEEKGKMVFLSSLMGFMSYCRCVVMEDVDCEESNKKINVRESSVESEVSLSLTFLNSDDFRCPISLELMSDPVTIETGHTYDRSSILKWFSSGNLMCPKTGKRLSSTEMVPNLVLRRLIQQHCYTNGISIPFVDSSHRNRKITRTEEPGSVAAEGAMRMLASFLNGMIENGSGEEKNRGAFEIRLLSKTSIFSRSCLVEAGLAPLLLKLLSSSDSLTQENAAAALLNLSKCAKSRSVMVEKWGLELIIDVLRKGLKIEASQHVAAVLFYLSAEYGNLIGEEPEAIPSLIRLIKDGSYRSKKNGLVAIFGLLKHPENHRRVLEGGAISSLVDILKGCEKEDLITDSLAILATLAERSEGMLAILHGEALHVAVEILSCSTSRVGKEHCVALLLSLSLHGGEDVVAYLVKRTSLMGSLYSQLSEGTSRASKKASALIRVLHDFYERRSSGFKASVIPQEQFIHVR

SEQ ID NO: 130329 - protein, 168 aa, Glycine max
  Coding DNA Sequence Number=SeqID_13551
  Subcellular localization annotation: CTP_CleavageSite=37; ConfidenceScore=5.26e-01
MAIPSKTSSPRVRYSVFTYRFILLAQSDALVGRRTMFCMHRSPTNNLVPMDLEIEATLRRNRAERRRKLLQGWRQELNPYNQYEEERTPDLESVFSEFMAYHASSKANYNSLQNQEIHFGKSYSLEDYQGELELQLYYQNEAGRSSNLDTLLMQFKDTIGSIERAFKS

SEQ ID NO: 130330 - protein, 84 aa, Glycine max
  Coding DNA Sequence Number=SeqID_13552
  Gene Ontology: Mol. function=spermidine synthase activity; Biological process=spermidine biosynthetic process
  Homolog annotation: Hit_ID=Q9ZTR1; Match level="QueryCoverage=71%, HitCoverage=15%, E-value=4e-09, Identity=54%"; Hit description =Spermidine synthase 1
MAAENVVEFTDLPVKRPREEEEEEQTNGVSNDAVSTLPNDPQYPGISAVIPGWFSEISPMWPDSRVVEPFSLLDFKDALICVIS

SEQ ID NO: 130331 - protein, 287 aa, Glycine max
  Coding DNA Sequence Number=SeqID_13553
  Gene Ontology: Mol. function=drug transporter activity; Cellular component=membrane; Biological process=multidrug transport
  Homolog annotation: Hit_ID=Q4PSF4; Match level="QueryCoverage=93%, HitCoverage=58%, E-value=2e-80, Identity=55%"; Hit description=MATE efflux protein-related
MAQTYLLFLLPDLLINSFLHPIRVYLRAQNVTHPVTLASLAGTLLHVAFNLALVERGLGGVAAAAAASSFSILCLLWGPPGHVDRAEPGVFNLLGAANSARGAELCLRLFGVVVRGGYGDFNPDYVLDLRFSLLAGACGVYARGKRAWRQQGTTRQDVGGGGGVLCRRNGVLRGGFCDGDAEEVGEDVHRRRGDSAADGGGATDSGAVRAGKLPADGGMRGGEGDGAAERGGEREPGSVLSGGDAGGGWACVLARGWVLWALAGPVVGPGSDGHKQPLLAAVDNNNS

SEQ ID NO: 130332 - protein, 69 aa, Glycine max
  Coding DNA Sequence Number=SeqID_13554
MAYDARLRKMTIETNCIDVVRQLEAGSFFGSHYAVLLYEISNAKAKFQQCLIVHILRNKNKLVDAFARV

SEQ ID NO: 130333 - protein, 168 aa, Glycine max
  Coding DNA Sequence Number=SeqID_13555
  Gene Ontology: Mol. function=protein serine/threonine kinase activity; Biological process=protein amino acid phosphorylation
  Homolog annotation: Hit_ID=UPI0000DB765A; Match level="QueryCoverage =55%, HitCoverage=34%, E-value=1e-10, Identity=34%"; Hit description =PREDICTED: similar to ankyrin repeat domain 50
  Pfam annotation: Domain name=Ank; Domain location=20-52; Score=20.9; E_value=0.0046; Accession=PF00023.20; Description=Ankyrin repeat
  Pfam annotation: Domain name=Ank; Domain location=53-85; Score=24.0; E_value=0.00054; Accession=PF00023.20; Description=Ankyrin repeat
  Pfam module annotation: Pfam domain module=Ank::Ank; Domain location =20-52::53-85
MEFLLARYDGELDVDAVDSEGRTTIHVVVREGHTRVIRFCVTMGGNPNRVDSKGWTPLYYAAWKGHVKAAECLLECSNVKCVRDREGRRTFSVVAESEHEHSAGAPVIDKVQKETKSRAGKPCSLVHIIFWHGSISLSSVSEILIVEEVKKVKHDMRIWSLGRAKLWL

SEQ ID NO: 130334 - protein, 88 aa, Glycine max
  Coding DNA Sequence Number=SeqID_13556
MFSNSKEITIRYAIDDQFITSDKALASTLMKFSFLQLIRVKVLRRFIIKKNMYEGFKVVLATMIKRVRVCLVVGRENDRISEKRKEKK

SEQ ID NO: 130335 - protein, 89 aa, Glycine max
  Coding DNA Sequence Number=SeqID_13557
MLKRKDVPQSISGRDELHKHELHNVVAVTEAQASLQQRRTQAEGERRRTIGFERAVTQGFSVSNGGVSVALYNSSSGCSVSAKEKEQRT

SEQ ID NO: 130336 - protein, 161 aa, Glycine max
  Coding DNA Sequence Number=SeqID_13558
  Gene Ontology: Mol. function=DNA binding; Cellular component =chromosome; Biological process=chromosome organization and biogenesis (sensu Eukaryota)
  Homolog annotation: Hit_ID=Q9SGE3; Match level="QueryCoverage=62%, HitCoverage=41%, E-value=1e-22, Identity=52%"; Hit description =Histone H2B.2
  Pfam annotation: Domain name=Histone; Domain location=66-136; Score =37.9; E_value=3.4e-08; Accession=PF00125.14; Description=Core histone H2AH2BH3H4
MNLKKCQNALGVGHHGTRQKGITECGYYVMHWMSTIILGSFRNNWETYFNEVRPLEAERFKALRIQWAQNYLKRYVYRLLKKVHHKRGISSKCMTVLNNLMYDMFDRLAFEASKLNNYIGHMTLSLREIQGAVRLVLPGELGKHAIVEGVKVVNNYTSYDA

SEQ ID NO: 130337 - protein, 109 aa, Glycine max
  Coding DNA Sequence Number=SeqID_13559
MAEHVWLAWMKLAVPPLHHAFVCNVRFLQRKLSVEKLASTVLWKLSTPCSYTETESWGWYMFPMLPHSMFGYFVLNVIPHHFVPQHPCMLGARVDSHHVTLRISKGSSS

SEQ ID NO: 130338 - protein, 75 aa, Glycine max
  Coding DNA Sequence Number=SeqID_13560
  Subcellular localization annotation: CTP_CleavageSite=28; ConfidenceScore=5.48e-01
MAIPSNSPHPPPTDAASHSPSTLKRTRKATHLKSLATRPVGAKRPLAHVDPATGKVDGPYRKKLRTYLGIVTWDK

SEQ ID NO: 130339 - protein, 95 aa, Glycine max
  Coding DNA Sequence Number=SeqID_13561
MVQANRQWNWRGRYAHAQEQIASETGDIGGRWEPSVKLTSSRLFRKPAFCRWQRCCLAFSGQKASCNCHWRVHGKCHWQLRAKKIVIPNGDSVPL

SEQ ID NO: 130340 - protein, 113 aa, Glycine max
  Coding DNA Sequence Number=SeqID_13562
  Subcellular localization annotation: CTP_CleavageSite=49; ConfidenceScore=5.12e-01
MTLPLSNILPNDHNVNLPLRKYQLGSRPQDTQWTRRSPTGPWGFQLGLRASVSPTGCPFPPARSYHHDIALITGLCQLYKASVAPNKVIRPPINRAFIMKYCAPRQAQGETPQ

SEQ ID NO: 130341 - protein, 150 aa, Glycine max
  Coding DNA Sequence Number=SeqID_13563
MPLKGKQLVIYPCKTHWRVLSITHNHTHCIPQRVKTLMLWQKWEKLDHLEERLRVIEGGKDYAFTGVEELFLVPKHVLKFKVLDFDKYKGTTCPKNHLKMYCRKMGAYAKDEELLIHFFQESLTRAAVTWYTNLEPSQVQFLEGPNGCLR

SEQ ID NO: 130342 - protein, 81 aa, Glycine max
  Coding DNA Sequence Number=SeqID_13564
  Gene Ontology: Mol. function=xylose isomerase activity; Biological process=carbohydrate metabolic process
  Homolog annotation: Hit_ID=Q8U7G6; Match level="QueryCoverage=64%, HitCoverage=12%, E-value=3e-25, Identity=98%"; Hit description =Xylose isomerase
KGVPVGHRKTQMVFHALARDDFIRVVVAEGQRIGAVGAFIFDLGDIAEEACAHWVVPPWWVSTSCEAEDEAKCPPLADLPP

SEQ ID NO: 130343 - protein, 65 aa, Glycine max
  Coding DNA Sequence Number=SeqID_13565
MGYVGVRELNWRWAIGDGGVVPGDMSRGSGDLGDVRRAPGSQQIKGTKTTKQGGLCGGWPAMNFD

SEQ ID NO: 130344 - protein, 80 aa, Glycine max
  Coding DNA Sequence Number=SeqID_13566
LKCIARGVRDVWNSPILPIYRKKGEEVAAQLAQITQQCFFFTSGMSRNFADYLMMDVKYLEAVERRLHAVKQWSPNEIRV

SEQ ID NO: 130345 - protein, 372 aa, Glycine max
  Coding DNA Sequence Number=SeqID_13567
  Gene Ontology: Mol. function=DNA binding; Biological process =regulation of transcription
  Homolog annotation: Hit_ID=Q1RY17; Match level="QueryCoverage=88%, HitCoverage=68%, E-value=2e-70, Identity=53%"; Hit description =Homeodomain-related
  Pfam annotation: Domain name=Myb_DNA-binding; Domain location=208 -258; Score=35.8; E_value=1.5e-07; Accession=PF00249.21; Description =Myb-like DNA-binding domain
MLAVSPLRSNIKDEKKQGEMEGNFSMATTTTDDVVFGDLSEGNLLESINFDELFVGIDIHGDVLPDLEMFGEFSVDVSTGEESSEMNSSAKSSKLENDQNVIATTSKKEEEEDKTSCNASGQDLGSNRGEEIVSERDESVVVNPAPKDGGKGRKSSSAQSKNNSSSNNNPQGKRKVKVAKNELASFSEASNGSCHETYESCATELTLKVDWTPELHRRFVQAVEQLGVDKAVPSRILEIMGIDCLTRHNIASHLQKYRSHRKHLLAREAEAASWSQRRQLCAGGGKREGSPWLAPTMGFPPMTPPMHHFRPLHVWGHPSMDQSFMHMWPKHLPNSPPLSWPPPAAPPQEPSFWHQLVNFLNIDLSIQSLIFF

SEQ ID NO: 130346 - protein, 61 aa, Glycine max
  Coding DNA Sequence Number=SeqID_13568
MYIGIIQGLRREIKVPKGNAINDVGDVEVAPLKEPRTMRGWVSLRGLLGLGGQASRGKNNA

SEQ ID NO: 130347 - protein, 274 aa, Glycine max
  Coding DNA Sequence Number=SeqID_13569
  Gene Ontology: Mol. function=oligopeptide transporter activity; Cellular component=integral to membrane; Biological process =oligopeptide transport
  Homolog annotation: Hit_ID=P0AFH2; Match level="QueryCoverage=100%, HitCoverage=89%, E-value=1e-127, Identity=84%"; Hit description =Oligopeptide transport system permease protein oppB
  Pfam annotation: Domain name=BPD_transp_1; Domain location=94-274; Score=130.1; E_value=5.9e-36; Accession=PF00528.12; Description =Binding-protein-dependent transport s
MLKFILRRLLEAIPTLFILITISFFMMRLAPGSPFTGERALAPEVMANIEAKYHLNDPIGKQYLSYLVQLAHGDFGPSFKYKDYSVNYLVGHAFPVSAKLGLAAFFLAVVLGVTAGVIAALKQNSLWDYAVMGVAMTGVVIPSFVVAPLLVLIFAITLRWLPGGGWNGGQWNYMLLPMVALSLAYIASIARITRGSMIEVMHSNFIRTARAKGLPLRRIVLRHALKPALLPVLSYMGPAFVGIITGSMVIESIYGLPGIGQLFVNGALNRDYSL

SEQ ID NO: 130348 - protein, 79 aa, Glycine max
  Coding DNA Sequence Number=SeqID_13570
MSPFHRPHRVGRARMSLRYRRYSPCHVPVIPQTTNGIHHAADAGALPGLTGALSINPLIYSSKAGREKCLENVKINAKW

SEQ ID NO: 130349 - protein, 103 aa, Glycine max
  Coding DNA Sequence Number=SeqID_13571
  Gene Ontology: Mol. function=transporter activity; Cellular component= periplasmic space; Biological process=transport
  Homolog annotation: Hit_ID=Q5PF00; Match level="QueryCoverage=99%, HitCoverage=31%, E-value=7e-43, Identity=77%"; Hit description =Glycine betaine-binding periplasmic protein
VPFSSLPGAQSKVDTRLANGANYGFPVNTMHIVANKAWAEKNPAAAKLFAEMKLPIGDINAENAAMHAGHASEADINGHVDGWIKAHQAEFDKWVSDAMAAAK

SEQ ID NO: 130350 - protein, 200 aa, Glycine max
  Coding DNA Sequence Number=SeqID_13572
  Gene Ontology: Mol. function=protein binding; Cellular component =integral to membrane; Biological process=protein amino acid phosphorylation
  Homolog annotation: Hit_ID=Q949G9; Match level="QueryCoverage=89%, HitCoverage=27%, E-value=6e-23, Identity=33%"; Hit description =HcrVf1 protein
  Pfam annotation: Domain name=LRR_1; Domain location=102-124; Score =10.0; E_value=3.8; Accession=PF00560.23; Description=Leucine Rich Repeat
  Pfam annotation: Domain name=LRR_1; Domain location=126-148; Score =12.1; E_value=1.5; Accession=PF00560.23; Description=Leucine Rich Repeat
  Pfam annotation: Domain name=LRR_1; Domain location=150-172; Score =21.1; E_value=0.004; Accession=PF00560.23; Description=Leucine Rich Repeat
  Pfam annotation: Domain name=LRR_1; Domain location=27-49; Score=7.3; E_value=12; Accession=PF00560.23; Description=Leucine Rich Repeat
  Pfam annotation: Domain name=LRR_1; Domain location=3-25; Score=11.2; E_value=2.3; Accession=PF00560.23; Description=Leucine Rich Repeat
  Pfam annotation: Domain name=LRR_1; Domain location=51-76; Score=3.9; E_value=53; Accession=PF00560.23; Description=Leucine Rich Repeat
  Pfam annotation: Domain name=LRR_1; Domain location=78-100; Score =9.5; E_value=4.8; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=102-124::126-148::150 -172::27-49::3-25::51-76::78-100
MTSLTHLDLSLTGFMGKIPSQIGNLSNLVYLDLGGCKLPHYNEPSLLNFSSLQTLHLSRTSYSPAISFVPKWIFKLKKLVSLQLLDNGFQGPIPGGIRNLTLLQNLDLSFNSFSSSIPDCLYGLHRLKFLNLMGNNLHGTISDALGNLTSLVELDLSHNQLEGNIPTSLGNLCNLRKFLLLVFPMDSQDLQFRVHDFQAI

SEQ ID NO: 130351 - protein, 59 aa, Glycine max
  Coding DNA Sequence Number=SeqID_13573
MLGVAVVGGGKRGMQKVMNEDEWMYEIMSERVDVDYENAEACGANEPHVDCSDAFNTSQ

SEQ ID NO: 130352 - protein, 182 aa, Glycine max
  Coding DNA Sequence Number=SeqID_13574
  Gene Ontology: Mol. function=gamma-tubulin binding; Cellular component=microtubule organizing center; Biological process =microtubule cytoskeleton organization and biogenesis
  Homolog annotation: Hit_ID=Q9LF43; Match level="QueryCoverage=99%, HitCoverage=31%, E-value=1e-63, Identity=70%"; Hit description =Spindle pole body protein-like
  Pfam annotation: Domain name=Spc97_Spc98; Domain location=1-182; Score=-209.5; E_value=0.02; Accession=PF04130.4; Description=Spc97 Spc98 family
MEDKSLQKESLTQDYEAKYWQQRYSLKDGIPSFLANIAGAILTTGKYLNVMRECGHTVRAPPSENSKLMSFGSNHHYLECIKAAYNFASSELLNLIMEKYDLTGRLRSIKHYLLLDQGDFLVHFMDIARDELAKKPDEVSVEKLQSLLDLALRTTAAAADPFHEGLTCVVASSLATVYSVIT

SEQ ID NO: 130353 - protein, 88 aa, Glycine max
  Coding DNA Sequence Number=SeqID_13575
  Homolog annotation: Hit_ID=Q1SD84; Match level="QueryCoverage=64%, HitCoverage=3%, E-value=2e-20, Identity=80%"; Hit description =Integrase, catalytic region
MEVVCSKRGIVVSQQKYILDLLEETGMSGCRPADTPIDPNGKLWEKGSVPVDIGRYESDLEKSKKQGVVAKSSVEAKFRAMAQGICEG

SEQ ID NO: 130354 - protein, 98 aa, Glycine max
  Coding DNA Sequence Number=SeqID_13576
MEYDTTSNKMPPAKAVLLIPMSIDYDSYLTNIQAPFESVCGSNVFQVYFDDAKDFSQESRVRQVSRITELFNQSKFQESKQVSRIKIKVKIQEKTQLG

SEQ ID NO: 130355 - protein, 142 aa, Glycine max
  Coding DNA Sequence Number=SeqID_13577
MATPTKRRWRSSQFLVRSDWLMNSGALGVFGALWRGLHLPLLQKENVKKGSREVKEKHKGKGDGEEEKKSGEENNLKTEGFALALFCFSLGTVKDKYVKPSLAFIPFAMLPFSPFRFPHQYALTNYIPVSLSKYPKLLYLSV

SEQ ID NO: 130356 - protein, 169 aa, Glycine max
  Coding DNA Sequence Number=SeqID_13578
  Gene Ontology: Cellular component=cytosol; Biological process=protein targeting
  Homolog annotation: Hit_ID=Q9LVS8; Match level="QueryCoverage=98%, HitCoverage=68%, E-value=3e-54, Identity=60%"; Hit description =Similarity to EREBP-4
  Pfam annotation: Domain name=DUF862; Domain location=1-105; Score =140.0; E_value=6.4e-39; Accession=PF05903.5; Description=Eukaryotic protein of unknown function (DUF862)
MEYGFGAHEYPTSGIFEVEPRSCPGFIFRRSVLLGSTDMSSSEFRSFIERLSGKYHGDSYHLIAKNCNHFTDEVCQQLTGKPIPAWINRLARVGSFCNCLLPESLQVAAVRHLPEHLALSDDEELESDGLSDSEESEDEDSNHHLLTTSNGGELTIIKEKPMTLARDLL

SEQ ID NO: 130357 - protein, 363 aa, Glycine max
  Coding DNA Sequence Number=SeqID_13579
  Gene Ontology: Mol. function=protein tyrosine/serine/threonine phosphatase activity; Cellular component=mitochondrion; Biological process=protein amino acid dephosphorylation
  Homolog annotation: Hit_ID=Q1S1L6; Match level="QueryCoverage=84%, HitCoverage=97%, E-value=1e-114, Identity=71%"; Hit description=Dual specificity phosphatase, catalytic domain, putative
  Pfam annotation: Domain name=DSPc; Domain location=110-239; Score =30.9; E_value=6.1e-07; Accession=PF00782.11; Description=Dual specificity phosphatase, catalytic domain
MHIEELEGVEVLEGVEEGGSRFVGGYDAKRVLVGAGARALFYPTLFYNVVRNKIQTEFRWWDKVDEVAPKSDALNFQFILLGAVPFPIDVPHLKELGVRGVITLNESYETLVPTALYYALWNISITLGYYSILTVFMTSKFHAHGIDHLVIPTRDYCFAPSLHDICRAVDFIHENALSGRTTYVHCKAGRGRSTTIVICYLVHHKMMTPDAAYAYVKSIRPRVLLASSQWQAVQEYYYHLMVRRAVGCAPTANLLVKASQTAAGSRDLVMFDDNSVVMVTESDLEGYDPSSQSAMASEIWADLSVVYRVRVAGQAALARISCLWLRYATTDQKISSEKLSSRESSCSIRANHLGEISVDIHVY

SEQ ID NO: 130358 - protein, 165 aa, Glycine max
  Coding DNA Sequence Number=SeqID_13580
VPSILKRPIKGCMSSSNNPRTKLGYDTNLEPSRVYSWKDLMVAFVRQYQYNYDTAPDRTQLQNMCKKEHESFKEYAQRWRDLTAQVAPSMTEKKMITMIVYTLPVFYNEKMVGYTLSSFADLVFAGKRIEGGMIQSYPARALDRRLQVDWARDPREGPRVLMSLK

SEQ ID NO: 130359 - protein, 122 aa, Glycine max
  Coding DNA Sequence Number=SeqID_13581
  Gene Ontology: Cellular component=integral to membrane; Biological process=autophagy
  Homolog annotation: Hit_ID=Q67WQ6; Match level="QueryCoverage=78%, HitCoverage=37%, E-value=2e-28, Identity=52%"; Hit description =Putative senescence-associated protein 5
MNDSYITRMFLHDSIDILLYNSGCCKPAEECQFSYVNPTTWTKPTNVTNQSNPDCDAWNNDPTVLCFNCQSCKAGLLQNLKTDWKRVAVVNIVFLVFLIIVYSIGCCAFRNNRRENWKGYSR

SEQ ID NO: 130360 - protein, 444 aa, Glycine max
  Coding DNA Sequence Number=SeqID_13582
  Gene Ontology: Mol. function=transferase activity, transferring phosphorus-containing groups; Cellular component=integral to membrane; Biological process=two-component signal transduction system (phosphorelay)
  Homolog annotation: Hit_ID=UPI00005F9419; Match level="QueryCoverage =67%, HitCoverage=62%, E-value=1e-107, Identity=67%"; Hit description= COG0642: Signal transduction histidine kinase
  Pfam annotation: Domain name=HAMP; Domain location=24-93; Score=35.9; E_value=1.4e-07; Accession=PF00672.15; Description=HAMP domain
  Pfam annotation: Domain name=HATPase_c; Domain location=209-321; Score=72.2; E_value=1.7e-18; Accession=PF02518.16; Description =Histidine kinase-, DNA gyrase B-, and HSP90-like ATPase
  Pfam annotation: Domain name=HisKA; Domain location=97-162; Score =47.6; E_value=4.1e-11; Accession=PF00512.15; Description=His Kinase A (phosphoacceptor) domain
  Pfam module annotation: Pfam domain module=HAMP::HATPase_c::HisKA; Domain location=24-93::209-321::97-162
MATILVAETLESRRYLARQMMIAALLSQGTVVVLTLILAFALLKRVLKPMRKLSGIMLRRDPGELTPLPRVLPWSEMQPLLVAFNRYIERLRLMVARQERFSADASHQLRTPLAVLKTQVGVALASDRPQQWRESLQAMSATLDNTVALTDRLLHLSRLKASEHQAERQLQPVNLAQVLRDACFSRLPQARSKQIDLGFEGEAACQVAGEPLLLAELCANLLDNALKYTPRQGIVTARLTQDKAAGEGVLEIEDSGPGIALQDKALALQPFHRLDNVGDQPGAGLGLALVKDITAYHGTRPELLSSAALGGLLVRDSTLAAGALALRVSGVRSRCDRITPSRVMPPPIRCTAIAAVNTGARFMKIEAVLAPRRITPWIHRNGAMIEAGMPANSTSGRLWPFKPTSCAIRKLGSSSSTPNRICTYSDCQFGSAMAQRLVNTPYSA

SEQ ID NO: 130361 - protein, 83 aa, Glycine max
  Coding DNA Sequence Number=SeqID_13583
MEVKESLIGLRLPLHYRADTGGWCLVLDVQQVDFMADLGVAFVDDWAFLVGRVGGYWHMGFKRASGKFGHVGMTVKVWVSPSF

SEQ ID NO: 130362 - protein, 304 aa, Glycine max
  Coding DNA Sequence Number=SeqID_13584
  Gene Ontology: Mol. function=hydrolase activity; Cellular component =membrane; Biological process=aromatic compound metabolic process
  Homolog annotation: Hit_ID=Q35NC2; Match level="QueryCoverage=93%, HitCoverage=88%, E-value=1e-97, Identity=62%"; Hit description =Putative hydrolase
  Pfam annotation: Domain name=Abhydrolase_1; Domain location=71-301; Score=50.0; E_value=7.8e-12; Accession=PF00561.10; Description =alphabeta hydrolase fold
MSLPALDAAPRWSQPVDHLPQFNHAYATVAGVRLHYVSGGNAQGPVLVLLAGFPQSWFAWRKVMAQLAADYYIIAPDLPGQGDSDKPASGYDTTSLAHSVQGLLQQLGVERYYLAAHDVGAWVAWPLAMLHGDAISKLALLDAGIPGVTLPDALPATPDKAWKTWHFAFHLLPDLPEALIAGREALYLQWFLQRKAASPMVFGDEEMAEYVRLLQQNGALRAGMAAYREVSTSAEQNRQLLQTRGKLAIPLLAVSADQGSIADMAQPLCTFAADVSGIRLAHCGHFIPDEQPQALADALRQFFV

SEQ ID NO: 130363 - protein, 297 aa, Glycine max
  Coding DNA Sequence Number=SeqID_13585
  Gene Ontology: Mol. function=transcription factor activity; Cellular component=phosphopyruvate hydratase complex; Biological process =regulation of transcription, DNA-dependent
  Homolog annotation: Hit_ID=Q09KH2; Match level="QueryCoverage=97%, HitCoverage=98%, E-value=1e-98, Identity=63%"; Hit description=FitR
  Pfam annotation: Domain name=HTH_6; Domain location=15-120; Score =3.1; E_value=0.0005; Accession=PF01418.8; Description=Helix-turn -helix domain, rpiR family
  Pfam annotation: Domain name=SIS; Domain location=138-275; Score =35.2; E_value=2.3e-07; Accession=PF01380.12; Description=SIS domain
  Pfam module annotation: Pfam domain module=HTH_6::SIS; Domain location=15-120::138-275
MAANNIKNRVDVFGERYRARVTTLSASLQTVARYIHEHREAILDATALDIAQATQTSDATVVRTVQALGFAGLRDLKTTLAAWFGPAQNSEEKMSATISELSCDINSGIDFVLGGHQRACEVLAEPVNRQAVAAAVTLLLEARQVALFGINASGILAEYSARLFRRIGLPAVTLNRAGIALAEQLITLQRGDVLIMMAQKSAHREGMTTLKEAQRLGMPVILLTHALDSAFAQQADVVINVPRGGENGRMPLHGTVLVCLEMLILAVASASSARTVKTMKRIQDLNRSLKPTSKKAG

SEQ ID NO: 130364 - protein, 141 aa, Glycine max
  Coding DNA Sequence Number=SeqID_13586
  Homolog annotation: Hit_ID=Q9ZQR0; Match level="QueryCoverage=32%, HitCoverage=3%, E-value=8e-10, Identity=56%"; Hit description =Putative helicase
MVESERLIYIRNNKTKKLRVDKYCSLQTSLDAGSSKGSSKGKRVIFPSTFVGSPCYMDQLYFDDEIDQIISAEIPSHENDPELYSLVQNHMVHDPCGILQSKSPCMKEGYDRVTAVVVYDANGALENPITQNDEIKEYLDC

SEQ ID NO: 130365 - protein, 105 aa, Glycine max
  Coding DNA Sequence Number=SeqID_13587
MAQDMGVTSGQGQASVLTKLLCMEERDMEEAKRMGNREVKWELQSAINRAGGLLCLWNESSFRLDRKTSGQGFIYLEGIWVPDGQKECCGVYWEISTVSGDQRRG

SEQ ID NO: 130366 - protein, 523 aa, Glycine max
  Coding DNA Sequence Number=SeqID_13588
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=98%, E-value=3e-79, Identity=42%"; Hit description =Integrase, catalytic region
  Pfam annotation: Domain name=Chromo; Domain location=417-467; Score =18.0; E_value=0.0074; Accession=PF00385.14; Description='chromo' (CHRromatin Organisation MOdifier
  Pfam annotation: Domain name=rve; Domain location=154-310; Score =80.6; E_value=4.9e-21; Accession=PF00665.16; Description=Integrase core domain
  Pfam module annotation: Pfam domain module=Chromo::rve; Domain location=417-467::154-310
MGAVLSLKNHPIAYFSKPFTPKLLHSSTYVREFAAITVTVKKWQQYLLGHSFIISTDHRSLKELMSQVIQTPEQQVYLARLLGYDYSIHYRSGKSNMAADALSRIPEASSGALMNFTWLGIKEDVRTFVLNRLRCQQTKYDHQKCPGLLCPLSIPHRPWEDLSLDFIGGLSAFRGHSVILVVVDRFSTGIHLGMLQPNYTTSTMAHLFMDIVGKIHGMPHSLVSDRDPLFLSHFWQELFKLSGIKLCMSLTYHPQLDDQTKVLNRVIEQYLRAFVHQQPSSWGKFLIWAEWSYNTSIHTATGVTPYEATFGKKSPSIPQYLVGTSNIDAVDDFFLSHEAVFAVLRKKLLKAQQESGCWSSFDLVVKPRSPARLIPSWPNNYPLIPEYTPYSTFHPNSTEHTPVDTLPPKSVDNDPGVTPLAILDTKWATSANGPKLLVLVQWRGLLLEDTSWELWTTLKDYHLEDKVLLDGQMDAMKQFNTEQSNTEELRADKEQTGTNLRTKRKTCRPHYLEDFVTNANPKR

SEQ ID NO: 130367 - protein, 228 aa, Glycine max
  Coding DNA Sequence Number=SeqID_13589
  Homolog annotation: Hit_ID=Q10QS2; Match level="QueryCoverage=61%, HitCoverage=11%, E-value=1e-19, Identity=43%"; Hit description =Expressed protein
MARHSSSWVFGTFSSDTDGLAMMLSEVHSSMKKSNDEETSQPKSDSVNQLLTHILAVLTFALINNVNIASAAQVANQLSSVVVNLAAKQLRNASNSGDAYPLADLLSVEPLAGPFKSFKKDNLPKIDAADSALATLEGIKALTEVCNEDSFIGSLGVDNLEAEVSNAVMNKATLPRATNGARIKSCWYQSLVSRLSSSQSRGKKTPKRMEEGYVVNKPPMFKGANYNY

SEQ ID NO: 130368 - protein, 109 aa, Glycine max
  Coding DNA Sequence Number=SeqID_13590
MLDVGSWFFVLHCNFDNEEEGGLFLKSGVTRPTWGWFYFMAIILGLGDIWLIERKKGSSPIVGAKLHDESRLIQRCFDDKKGDDKKLKGQSKNEFKMFKIESRTLQDSR

SEQ ID NO: 130369 - protein, 82 aa, Glycine max
  Coding DNA Sequence Number=SeqID_13591
MKFNDTESDKDLSELDESIAYLRLDNEFRSWSTHSTYGWSLRRREPTRCVTKRNNLECQIIGHPTDHIQPRSSLRPQGNTAR

SEQ ID NO: 130370 - protein, 107 aa, Glycine max
  Coding DNA Sequence Number=SeqID_13592
MPHLWRSTQARPNKWLKGPLAASEPTQKKNPKEECKAVWTRSQQRTEGDQSKEGRAYKEGDRDEERKKEEEKEEEKKVSKTKNQLAREARKKEPPVSLKEPSYPFVP

SEQ ID NO: 130371 - protein, 205 aa, Glycine max
  Coding DNA Sequence Number=SeqID_13593
  Gene Ontology: Mol. function=RNA-directed DNA polymerase activity; Biological process=RNA-dependent DNA replication
MEHLALTATNVYKSMLQFFTQGWITPNLNSDMVILIPKIPRVDCIEKFHPLALANFKFKVFIKAYPLSPLLFYLAEDVRSRATRKLVEEGNLHLMISLKGSLVPFHLMYAGDIMIFAKHMKRNVQKLIRLLNLYELSSDQAISPQKCKFYQGDISSSHVNAFHEMLGFSMGTLPFTYLGALIFSGKPKCAHLLTIIDRLKEKLVK

SEQ ID NO: 130372 - protein, 79 aa, Glycine max
  Coding DNA Sequence Number=SeqID_13594
MESSLEQRTVTKTDLLLKGPKWGQMSYRMSRHHASEHADYMCPYEQIKQVNNTRELFTQFGATSPTSGGYQAREEIHSQ

SEQ ID NO: 130373 - protein, 70 aa, Glycine max
  Coding DNA Sequence Number=SeqID_13595
  Subcellular localization annotation: CTP_CleavageSite=37; ConfidenceScore=5.10e-01
MEPSSSSSCMRPLREKRSPFSSSSKLHNDVFYTSSLKALIKQVNNTRELLTQFGATSPTSGGYQAREEIH

SEQ ID NO: 130374 - protein, 86 aa, Glycine max
  Coding DNA Sequence Number=SeqID_13596
MSNEELKLQDPRCRIQCPDILPENTGVAVQCKIKVKCRSEVAGSTMSDTIFFQKKIDLLQHKPLQPRNANCYIIMEAARVLYQVRD

SEQ ID NO: 130375 - protein, 69 aa, Glycine max
  Coding DNA Sequence Number=SeqID_13597
  Subcellular localization annotation: CTP_CleavageSite=46; ConfidenceScore=5.27e-01
MAFFQSYLDYKAQNAQVTNALGNGNFAHTPDVFSKIPTVKSSFLPRQLHVASLRSFIKRLSQEASSWLL

SEQ ID NO: 130376 - protein, 99 aa, Glycine max
  Coding DNA Sequence Number=SeqID_13598
IAIGKEFYANLYDPEDKPPKQVKVRGHLVKFDEDTLNTFLKTPVVLEEGENLCTYSRFALLRPDPQELAAKLCIPRRGFELNADGQPLKILRKNMTTLA

SEQ ID NO: 130377 - protein, 77 aa, Glycine max
  Coding DNA Sequence Number=SeqID_13599
MELYIQHLADQQVANHRGQHQDPNPYPWATPKKFRATIAWPGDMPNFQARVGPTEAPGDDDGTEGDGDMADVIDFFL

SEQ ID NO: 130378 - protein, 136 aa, Glycine max
  Coding DNA Sequence Number=SeqID_13600
MDSRDGGYCRGGGGVSVAGCYYWSCPSSFVCLGMQYFSMNDLLMGGRMSFKCDTCKLVNGIRDKLGYTNTDLGQNSINQLAFRQPEIRVMVVGKDVAEEKHHSDLCLGGHASAHDPHPPWIFFINGVLCFLKFNGN

SEQ ID NO: 130379 - protein, 150 aa, Glycine max
  Coding DNA Sequence Number=SeqID_13601
MIYDTNDRLKFTLQEEKRLLMIREGDEDAQNNKEDPKWCIDHIQILKTKTNRMTNEEHQMKNDVEVDYGHNSVAPRPRFVFFLLLLTSFSQNLSMLNLRTLYSTSLMPTYSKKRHLVDLQLAQASFCLVHKKLAHPGELQLAQASWFLQP

SEQ ID NO: 130380 - protein, 51 aa, Glycine max
  Coding DNA Sequence Number=SeqID_13602
MVQLQPPLLQANAVVWLPRFFTTRDSQSLNPLENEKKKRNKSLLKEMDFTD

SEQ ID NO: 130381 - protein, 78 aa, Glycine max
  Coding DNA Sequence Number=SeqID_13603
MVDHGIGNGVGAKRAHLEVATDERNVPPSLPEEGQIPVDNGSKTSSSSSSSGDSGSSSSDSDSDSSSASGSDAGSPKI

SEQ ID NO: 130382 - protein, 39 aa, Glycine max
  Coding DNA Sequence Number=SeqID_13604
MARGIHTRIGIPSSHTCLSHMPIVVNTKIYNCITKMLRH

SEQ ID NO: 130383 - protein, 175 aa, Glycine max
  Coding DNA Sequence Number=SeqID_13605
  Gene Ontology: Mol. function=amino acid-polyamine transporter activity; Cellular component=integral to membrane; Biological process=amino acid transport
  Homolog annotation: Hit_ID=Q1SJF1; Match level="QueryCoverage=69%, HitCoverage=39%, E-value=1e-38, Identity=47%"; Hit description=Amino acid/polyamine transporter I
  Subcellular localization annotation: CTP_CleavageSite=64; ConfidenceScore=5.12e-01
MALGPIVGDDGAKEKQRYTNCKVYTRKALKGSKKKGNTISTVNVVPPQQKPSSLGSESSFAQVTGNTTMDLVEKRLNELVVSFFTWFVGIAMAEICSSFPTIGLVARIGTQAYARSQTLQSIILLSTGTNKGGGYFTPKWLFLCMYIGLTITWEALNTFALEVIDLIDIVSIWWQ

SEQ ID NO: 130384 - protein, 60 aa, Glycine max
  Coding DNA Sequence Number=SeqID_13606
  Homolog annotation: Hit_ID=Q2HTK4; Match level="QueryCoverage=73%, HitCoverage=7%, E-value=3e-09, Identity=50%"; Hit description =Protein kinase; U box
MPWFGVSAALKDSIEKGILELISQHGIRKFVMGAASDKYFNSHIQFVCIGHLIHIRYKAS

SEQ ID NO: 130385 - protein, 82 aa, Glycine max
  Coding DNA Sequence Number=SeqID_13607
MKEEVEEKAEERGVEGLRCENGELLLARGKAHRCGAQGKVVEGEAREVEEERQRGVSGKEGKGEEGMHGIIIPIVGLFKRNE

SEQ ID NO: 130386 - protein, 115 aa, Glycine max
  Coding DNA Sequence Number=SeqID_13608
MRLNPGKCNFGVGRGKFLNFMITHWGIEANPDKCTTIQEMGIPTNIQEVPLDEDMTKSKGEDPLEGLGGPMTRARERKAKEALQQVLSILFEYEPKFQGEKSKVVSCIMAQIEED

SEQ ID NO: 130387 - protein, 327 aa, Glycine max
  Coding DNA Sequence Number=SeqID_13609
MPKGSFVPQVRDDILKTTIGRPDHGGRVRVAGSGVTITQYYGRSSRASTASSISISQEQMAEIIGSIREQVRNEIEEEKRQSIETWKKELKDAIIIEMSQKGSQVAQATHVDINVLGARVSTKESNAEICVNPSGEEQVPDVSPTMGLYVQHQDSTQLAALGKIYHGASTIHCVAYADDVVRVSIDKVIDGEAEVLFSTSEIKYVRQALNTFIAWPTPLVKLDSAISPKKVVEAVNGVKDVVVHDPLRELIKCLVDIYDNPVQFVWDGGKFGIPNVDSTLFLTYADVNKITTGDKWLNIAILQLWTMYMDEWSNSLGHGSLYGFLEP

SEQ ID NO: 130388 - protein, 72 aa, Glycine max
  Coding DNA Sequence Number=SeqID_13610
MKCYILEPKSSRRKADYPHKVLDFRRYSQPPKLIPATRDKEIPNCEVHKFRGRLVSNEVSGKDTSLMYKDLI

SEQ ID NO: 130389 - protein, 443 aa, Glycine max
  Coding DNA Sequence Number=SeqID_13611
  Gene Ontology: Mol. function=transmembrane receptor activity; Cellular component=membrane; Biological process=defense response
  Homolog annotation: Hit_ID=Q1SGR7; Match level="QueryCoverage=99%, HitCoverage=45%, E-value=2e-42, Identity=29%"; Hit description=TIR; Disease resistance protein; AAA ATPase
  Pfam annotation: Domain name=LRR_1; Domain location=106-128; Score =1.2; E_value=1.7e+02; Accession=PF00560.23; Description=Leucine Rich Repeat
  Pfam annotation: Domain name=LRR_1; Domain location=130-153; Score =5.0; E_value=32; Accession=PF00560.23; Description=Leucine Rich Repeat
  Pfam annotation: Domain name=LRR_1; Domain location=228-249; Score =8.7; E_value=6.7; Accession=PF00560.23; Description=Leucine Rich Repeat
  Pfam annotation: Domain name=LRR_1; Domain location=251-271; Score =12.5; E_value=1.3; Accession=PF00560.23; Description=Leucine Rich Repeat
  Pfam annotation: Domain name=LRR_1; Domain location=46-69; Score=3.4; E_value=67; Accession=PF00560.23; Description=Leucine Rich Repeat
  Pfam annotation: Domain name=LRR_1; Domain location=83-104; Score =5.2; E_value=30; Accession=PF00560.23; Description=Leucine Rich Repeat
  Pfam annotation: Domain name=LRR_3; Domain location=60-79; Score =20.8; E_value=0.0048; Accession=PF07725.3; Description=Leucine Rich Repeat
  Pfam module annotation: Pfam domain module=LRR_1::LRR_1::LRR_1::LRR _1::LRR_1::LRR_1::LRR_3; Domain location=106-128::130-153::228 -249::251-271::46-69::83-104::60-79
MGYFFEGIKLHNLATENLEAILLVECQANGPPQTTMKANALSKMSNLKLLILRDVNFSDRLVELHLPHNNIKRPWKDTKPLRNLRIVDLSHSQKLIKIQNFGEAINLERINLEGFIQLKQIDPSIDFLRKLTVLNLKDCKNLLLDIARDAEHLKKLCISENPIHSQSTSSIIKRWFTWPLHLLYSPIHSKSTSSIVKRWSKWPLYLLYSRAHKNLVSCSLPSLPTSPSMHELDLNFCNLLQIPDAVGNLCCLERLNLRGNNFAKLPSLKEFSELNQELTYSVVWYQAEHRYKCLERVTVCSNIQSIIAGSQIPRWFNNQHVGRRSLTSREATPLLQDFNICIGFACCAVFVLRDEMDTIEMDLLKVELYTVDISGFLEGDLIMNESDNMWLCYITRSRFLGLCRLHMLPYNDKLKLNFFIKNKRGFPIVVKKHGYRWVYEEDL

SEQ ID NO: 130390 - protein, 154 aa, Glycine max
  Coding DNA Sequence Number=SeqID_13612
  Subcellular localization annotation: CTP_CleavageSite=43; ConfidenceScore=5.36e-01
MLLRNRSRAVTKPGLIADHNTHNSSSTISQPNILVVLPSTPTSAWTVATSLLTEGSTSEDPSSSTTLITAAHINIGSPSVVVPTPEIPAPETALKLVLSNPQFNLHYYLIHGEPKSTKLAFASPICHTTMKAEYDAFLTNQTWTLVHLPPSSPI

SEQ ID NO: 130391 - protein, 370 aa, Glycine max
  Coding DNA Sequence Number=SeqID_13613
EYFPAFDHRKRWPESPSPQPQQQPQEDQIKEILVDTFEIRSSPPPVKSTTPPPPPPPPPPPPPPPESARRNTRRTHRKIERERESEITVELDHSEFTTIRSQPAAPPTPPQPPSAKARSERKSERKKSTVKREMAMIWASVLSNQRKKKKKQKTKNNENHDQHYDDNVDELTSNTTVPPPPPPPPPPPSVFHSLFRKGLGKSKKIHSVSAPPPPPPPPPSKRKSQIPPSPSSPPEPPRRRNSGRPPLPNRAVTFNDETLNAGNQSPLIPIPPPPPPFKMKAMKFVVRGDFVKIRSNQSSRCSSPEREDIINVSETTIIDAVTDSVNETVTDRNVFCPSPDVNVKAATFIARLRGEWRLEKLNSLKEKGNG

SEQ ID NO: 130392 - protein, 125 aa, Glycine max
  Coding DNA Sequence Number=SeqID_13614
MTDNKSSFHSSLAVSNIRNHISITLEMENVCRKAASSFNLFWVSQVHIEARSMLILEEAGSAMVAVSQSIYDSNISHSDQQQRGKPSGYHKNSEKKKKIVGVVLGPVRDSLNVRVRQPLASTAEV

SEQ ID NO: 130393 - protein, 333 aa, Glycine max
  Coding DNA Sequence Number=SeqID_13615
  Homolog annotation: Hit_ID=Q9FJB4; Match level="QueryCoverage=86%, HitCoverage=94%, E-value=1e-86, Identity=52%"; Hit description =Arabidopsis thaliana genomic DNA, chromosome 5, P1 clone:MOK9
MEEQEAVFHSRNSGSGSASASASAYIISQTIFLCLNRTHMSMSDNEDHADYTDNNSSAKRRFRDRSKEVLSKQAVKLAKQAEEHERFINKVGLFCLISDSRDSFFGGSWLWLVLLHLWGKATSRSLGILLVLCRVCSSPLDILQVQEMALLSPGLVFFTIRWWNPATFEAMRPAGMAGRSTWPYIEDKSYLWMWLFLVPLAVYILWQVLYFLIVNVLRQQRFLRDPEVMTSYRELSKKAQKANNIWWRLSGLLGDQNRLLMYIVLQGIFTVATTALTVPIFLSYELSVVFQLLKISASVWNGGSFLIDVMPRQVILKEKKKSEMQLVQNQKDQ

SEQ ID NO: 130394 - protein, 109 aa, Glycine max
  Coding DNA Sequence Number=SeqID_13616
MAHFLAGGIQGPFPASYYFVGGWMGMAVRVVFGLDRGGRSEAADVGLEYFPTLLLVLNNRALQLELENPPNQSPKNDDLEPVHRWIVVKFEYHVRNTIPSILTVGNFDI

SEQ ID NO: 130395 - protein, 208 aa, Glycine max
  Coding DNA Sequence Number=SeqID_13617
  Gene Ontology: Mol. function=nucleic acid binding; Biological process= DNA integration
  Pfam annotation: Domain name=zf-CCHC; Domain location=128-145; Score =7.2; E_value=0.065; Accession=PF00098.13; Description=Zinc knuckle
MVVSWLVHPITPSIRQSILWMNDARDIWKDLKSRYSQGDLLRISRLRQDMASISSVMERKKQDREMSFLRGLNDQFNMVRSNVLMMDPLPSIAKVFSCVVQQERRISSNDLMGGDNLINATSSTIPLNLCTYCGKDNHIVDRCFRRMVFLQIMFPKEEEIIKVARAEGVLVEEEARYSHILVSPTTLLMSVTKSMDILLDTSSISLKA

SEQ ID NO: 130396 - protein, 132 aa, Glycine max
  Coding DNA Sequence Number=SeqID_13618
MERSSNKSGQYLWPQYAKIDGIVRKIINILGPKFSCLPNDDLAGMESHVEELAVAMFGDKIEWIRRMKKVVGRITPPELMMTKVMTKSSKVNQRMSSRCSRRNQEQFKTQEEKLKNTSRFKIEEHFKIQEES

SEQ ID NO: 130397 - protein, 63 aa, Glycine max
  Coding DNA Sequence Number=SeqID_13619
MACGGDKLMLPAKRQIQQFSMHPTDLPPNSPSLIYISKPPKSHDNSSNVSTFYLPFTLRVYVN

SEQ ID NO: 130398 - protein, 158 aa, Glycine max
  Coding DNA Sequence Number=SeqID_13620
  Homolog annotation: Hit_ID=Q9LUH6; Match level="QueryCoverage=95%, HitCoverage=68%, E-value=3e-09, Identity=27%"; Hit description =Arabidopsis thaliana genomic DNA, chromosome 5, TAC clone:K24F5
  Pfam annotation: Domain name=DUF599; Domain location=1-152; Score =103.6; E_value=5.7e-28; Accession=PF04654.3; Description=Protein of unknown function, DUF599
MGSTLMATTSMLICTGLGAVISSTYSVKNVINDTIFGAHSDFMVGLKYAIILAILLFSFLFHTFSIGFLNQVNILICTPQDVKSLVTLEYLTQLLDKAILLNTVGNRLFYSALPLLLWIFGPVLTFFSSMAMVLILYNLDFLAGNSNSKIEVFIPNGI

SEQ ID NO: 130399 - protein, 188 aa, Glycine max
  Coding DNA Sequence Number=SeqID_13621
  Gene Ontology: Mol. function=protein binding; Cellular component =nucleus; Biological process=mRNA polyadenylation
  Homolog annotation: Hit_ID=Q8L4J2; Match level="QueryCoverage=74%, HitCoverage=32%, E-value=3e-58, Identity=70%"; Hit description =Cleavage stimulation factor 50K chain
  Pfam annotation: Domain name=WD40; Domain location=21-59; Score=16.9; E_value=0.073; Accession=PF00400.22; Description=WD domain, G-beta repeat
MYVTASKDGAIRLWDGITANCVRSITAAHGTAEATSAIFTKDHRFILSCGKDSTIKLWEVGSGRLIKQYLGAMHTQLRCQAIFNETEEFILSIDELSNEIVIWDAITTEKVAKWPSNHVGAPRWLEHSPIESAFISCGTDRLALQNRLMHSTLGIGRLSIYGDVMCSIFQAILNNYLCFIFHIFIKVA

SEQ ID NO: 130400 - protein, 214 aa, Glycine max
  Coding DNA Sequence Number=SeqID_13622
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=11%, E-value=6e-57, Identity=59%"; Hit description=Chromo
  Pfam annotation: Domain name=RnaseH; Domain location=70-191; Score= -32.4; E_value=0.06; Accession=PF00075.14; Description=RNase H
MDQEKVQAVPELAISYKSEAIERLPPSDWILPTNLSKKENVHWNDHASKAFDNLKAAITKAPVLALPDFSKAFTLETDASGIGIRAVLSQEQHPIAFFTKKFTPRMQRQSAYIRESYAITEAVAKFRHYLHGHRFVIKTDQRSLKSLTEQAIQTPEQQKWLHKLLGYDFSIENKLDNENLVADSLSRSFFMAWSEPKLKLIQLLKEAIQADSQL

SEQ ID NO: 130401 - protein, 59 aa, Glycine max
  Coding DNA Sequence Number=SeqID_13623
MGEASTGSNQLAWASKVASRGSLQLAWASWAASSSPILAIKGCGRLNERVQHPGKANFT

SEQ ID NO: 130402 - protein, 307 aa, Glycine max
  Coding DNA Sequence Number=SeqID_13624
MASRKRKATTLASRDGYDRSRFVSQEAWDRYLDNVLARNILTETNVKLYINEFDDFRRELIRRNWHKKLTNLTERSIDVAIVMEFYENLYVPDDKFPKQVRVRGHLIKFDVNSLNTFLETPVVVEQGESLPFYSRRGFVLNAEGLLWKLLRKNLTTLVQTWSVLSYSNLAPTSHTSDLNLDKAKLVYGLVMKMNMNLGSLISGTQKSKARRSEAPSTSAGPAPPASAPSTSGLPSPPAAPILSEPASGPAPDHAEFAGYGLATTSYEHRGVSSKATPQVTPKPSTTVLDMSSSQPESSTPVPDLPLP

SEQ ID NO: 130403 - protein, 197 aa, Glycine max
  Coding DNA Sequence Number=SeqID_13625
  Homolog annotation: Hit_ID=Q1SNL3; Match level="QueryCoverage=62%, HitCoverage=35%, E-value=8e-07, Identity=25%"; Hit description =Immunoglobulin/major histocompatibility complex
MGKFSQNLWSWDLKWRRNLFDHENELAVAFMDDISAISIQHQLQDTMFWKADPSGLYSTKSAYRLLMSFNSPVPHRRIFQILWKLKIPPRAGVFSWRRRLVIFFFHCKMTRGLWWESMRWTQKCYKDYKVDHSKAEAEDKNSENNNDWGLTSEVWPKKLGLTGGGSKEAIIQKFQQLEERDKVEVEANRRDDSNTNQ

SEQ ID NO: 130404 - protein, 141 aa, Glycine max
  Coding DNA Sequence Number=SeqID_13626
MEGSALAWFQWMMRNHQLTTWPSFLQAIEARFAHSPYEDPTGLLFKLTQKGSVKDYLNHFEALANRIVGLLPSSLLSCFVSGLDPDIHREMTRPAPKPKLNRNLPNLKPNHSKPKLVYMPWQAKPAWKPYAWWVGFLIGTP

SEQ ID NO: 130405 - protein, 119 aa, Glycine max
  Coding DNA Sequence Number=SeqID_13627
MEAVDEWLKERDQILTSLARKLTKAQRMKEFADKQRRDVNFEVRDWVLLPADTSWEKWENLKEDYNLEDKAVWEARRDVMSEDTEQNAAIEHEAKSIQGEHRRSKREISKPRYLKDYAM

SEQ ID NO: 130406 - protein, 210 aa, Glycine max
  Coding DNA Sequence Number=SeqID_13628
  Gene Ontology: Mol. function=RNA-directed DNA polymerase activity; Cellular component=chromatin; Biological process=chromatin assembly or disassembly
VPEDVRKTAFRTYHGHYEFLVMPFGLCNAPSSFQVKYLGHIISKCGVKLVPAKVEVVLQWSIPQSIRDLRGFLGLSGFYRRFIQDYATLAAPLMDLLTKDSFQWSSTDDQAFIRLKEALCKAPILGLPDFSLPFVVETDASGISMGYTASSVARTFMDITGKIRGMPRSLVSDRDPLFISQFWQELFKLSGTKLRMSLAYHPHMTDKQKS

SEQ ID NO: 130407 - protein, 59 aa, Glycine max
  Coding DNA Sequence Number=SeqID_13629
MEIIEAMASNVYNDARDKRILKRHTGVFQMETLMKGQIEMMALAPPPHICDQYGEIGQR

SEQ ID NO: 130408 - protein, 77 aa, Glycine max
  Coding DNA Sequence Number=SeqID_13630
MAARPSELRLTPEVTGSPSNADVSRGHAEDNMVVLECVTLMRSLLEKLAWPCWNNMAYRRIISNWAWIRNWAEPAWT

SEQ ID NO: 130409 - protein, 227 aa, Glycine max
  Coding DNA Sequence Number=SeqID_13631
  Subcellular localization annotation: CTP_CleavageSite=32; ConfidenceScore=5.18e-01
MEQPAMKSLSHYTTVQACFGATSATSTFVATNTSMLGDIVKPMVLNEIQKTREKECCHGQSEATTNFVPRIQPCQPLVIGPVIGVEIFRPPAMQFGTLKPINRSVYKKPYSQPYQEKIGSPPWNIFLVANLMNTKQSSNESITDFLEWFRQMRIWLPFNPSPNAGDNPANSGDPRKNQRVTITKGTRTHLDVIRYVEGDKTHSNGVHLVTEVKVREGITTLKIMMMN

SEQ ID NO: 130410 - protein, 160 aa, Glycine max
  Coding DNA Sequence Number=SeqID_13632
MMMKHMTKSDEKIKSLELTMSNLVTLMSQRAQGTLPSQTEANLKEEVNVMTTRSGRPMIELKKKEKVAPPPEHEAFTEESSEKGGIGTSSDFAIIGLNKEYFVVILKKLPPKLKDLWSFSTPCFIGTLYFDRALCDLGASINLMPCFVYKKLGSQEPLTH

SEQ ID NO: 130411 - protein, 141 aa, Glycine max
  Coding DNA Sequence Number=SeqID_13633
  Gene Ontology: Mol. function=RNA-directed DNA polymerase activity; Cellular component=membrane; Biological process=RNA-dependent DNA replication
MTTLEGGILAEKGEWASLAKDLGAEKGISKQYKPPTDHVRHLKPLYVKVVINGRPISQAFFDNGVFLNKIPFSLVKKLVQTRFDWNKTMEVCTDDVVVKLAEFDQHLIDLEQAFKRMRLHNLKMNPEKCAFGITTDHFLGF

SEQ ID NO: 130412 - protein, 171 aa, Glycine max
  Coding DNA Sequence Number=SeqID_13634
MTIPLVPQVDSPLPKHKKYMHDTLLHLFLVTLRSSLLKLAVMNNPTIIPESKRKVYEKISLLLGDLEVKYKPDTRCKDQSASITRVNDYNEKKVELYEKGNQLDKDIASLHKQKHLLLQTLEKIDKELAQDDMEWGGFQDILIQAQSPVAVVLISSTTIVSNTPKGSSSVS

SEQ ID NO: 130413 - protein, 151 aa, Glycine max
  Coding DNA Sequence Number=SeqID_13635
  Homolog annotation: Hit_ID=Q1T493; Match level="QueryCoverage=85%, HitCoverage=24%, E-value=4e-18, Identity=35%"; Hit description =Nucleic acid-binding, OB-fold, subgroup
  Pfam annotation: Domain name=DUF223; Domain location=40-135; Score= -16.0; E_value=0.088; Accession=PF02721.5; Description=Domain of unknown function DUF223
MARVPDKIKLIDGSRETLKLSVRITDLWFIGIPEKFEQAEMVVVDSDGDEIHVVCKQDQLKSWKADLKENLTYVMHNFKVMKNDGKFRICDHEYKLCYTGVTAVRQCNMEHLPFRKFRFVDFSTVIAGHFETGLLVDVIGVVDEVVFRYVS

SEQ ID NO: 130414 - protein, 111 aa, Glycine max
  Coding DNA Sequence Number=SeqID_13636
  Gene Ontology: Mol. function=protein serine/threonine kinase activity; Biological process=protein amino acid phosphorylation
  Homolog annotation: Hit_ID=Q6RC06; Match level="QueryCoverage=80%, HitCoverage=19%, E-value=6e-13, Identity=56%"; Hit description =Serine/threonine protein kinase
MFNENSIPNREAKEVDGSDVVGVDAKEEVEVAEGEGGLAKEGGRADGGVGEVGGAVRLDGETLRRGREEIEGETAETGAANALTAHGAFKCGRIHGLQTHLRITFTTTTTP

SEQ ID NO: 130415 - protein, 73 aa, Glycine max
  Coding DNA Sequence Number=SeqID_13637
MSYTRNEPIIAKPPIKLLGPNKLKCPKSTPPVPHLARLIPGVLNYSDIDDISSKKEEEESNPRKVISSFIKTQ

SEQ ID NO: 130416 - protein, 207 aa, Glycine max
  Coding DNA Sequence Number=SeqID_13638
  Homolog annotation: Hit_ID=Q1T493; Match level="QueryCoverage=51%, HitCoverage=20%, E-value=7e-09, Identity=29%"; Hit description =Nucleic acid-binding, OB-fold, subgroup
  Pfam annotation: Domain name=Rep_fac-A_C; Domain location=1-107; Score=-64.9; E_value=0.038; Accession=PF08646.1; Description =Replication factor-A C terminal domain
MDNHSWCHPACSQCHKKADIETMSFTCPCGKDNDQPILRYRVEVMVNHKGEQTKFLLWDRECAELIGQSADEVNRLKIEDGDVDLNASPQALDTLLGCFLAFKVKDMLPDTEVVFCQPCCKIESSILELIDPTVLESQSVSVTIDDDHSMLDSTEPTELESISYRCPCVFFMQSVSVTADHDPLLKIPLTPTKCVSSDELDDGPKNF

SEQ ID NO: 130417 - protein, 573 aa, Glycine max
  Coding DNA Sequence Number=SeqID_13639
  Homolog annotation: Hit_ID=Q86L99; Match level="QueryCoverage=23%, HitCoverage=28%, E-value=5e-15, Identity=32%"; Hit description =Similar to Arabidopsis thaliana (Mouse-ear cress). F25I16.5 protein
  Pfam annotation: Domain name=Kelch_1; Domain location=115-166; Score =18.1; E_value=0.032; Accession=PF01344.15; Description=Kelch motif
  Pfam annotation: Domain name=Kelch_1; Domain location=171-217; Score =20.0; E_value=0.0083; Accession=PF01344.15; Description=Kelch motif
  Pfam annotation: Domain name=Kelch_1; Domain location=19-66; Score =5.3; E_value=0.97; Accession=PF01344.15; Description=Kelch motif
  Pfam annotation: Domain name=Kelch_2; Domain location=115-166; Score =18.5; E_value=0.024; Accession=PF07646.5; Description=Kelch motif
  Pfam annotation: Domain name=Kelch_2; Domain location=171-217; Score =27.5; E_value=4.9e-05; Accession=PF07646.5; Description=Kelch motif
  Pfam module annotation: Pfam domain module=Kelch_1::Kelch_1::Kelch _1::Kelch_2::Kelch_2; Domain location=115-166::171-217::19-66::115 -166::171-217
MRWEKVKGIGGEEGPGKRWGHTCNAVRDGRFLYLFGGYGKFNCQTNQVHVFDTHNTAQPTELNPLIGNDDFGNLNVKQSWSEPAIKGPPPTPRDSHSCTVIGDSLFVFGGEAPDAREGHDAALVGKRLFMFGGCGRSADNINEVYYNDLYILNTELFVWNRATTSGTPPSPRDGHTCSSWRNKIIVIGGEDENDSYLSDVHILDTDAQSLYNDLYMLNIGVFNIDASVAITPNGPSARFSVAGDCLDPYMSGVLVFVGGCNRNLEALDDMHYLYTGIARESEQRPKKLSLRKQLKLKCLEQNPNLVQNPVLCGYGVGADSNQPMSILNYSQPINQPLPPGKKMFQANVKGKNSAGYTIETVIDGKPLHGVLFKNQPNTLIPVPNTSSRKRTFSEILSPASNGIHSHNVMAYKVLRQDRMQDKQELRGESSESHERHKEADTIVVSSNPTTAAKSIKVKKLVINVIFCMVRDCVLFDIAGTAAREYFNGSRWSELMKDHLPFAVHESNPKFELFSPSWFLMVPKIITGNALQVSVNPEPEAVSMDQNGDEKNDTPKSLIESLKNDGSNDVTSSK

SEQ ID NO: 130418 - protein, 193 aa, Glycine max
  Coding DNA Sequence Number=SeqID_13640
  Gene Ontology: Mol. function=sugar porter activity; Cellular component=integral to membrane; Biological process=carbohydrate transport
  Homolog annotation: Hit_ID=Q2HSP6; Match level="QueryCoverage=92%, HitCoverage=31%, E-value=1e-74, Identity=79%"; Hit description=Sugar transporter superfamily; Major facilitator superfamily MFS_1
MEGGGVEVDVSAFRECLSLSWKNPYVLRLAFSAGIGGLLFGYDTGVISGALLYIRDDFKEVDSKTWLQEAIVSMALAGAIIGAAVGGWINDRFGRRKAILLADTLFFIGSAVMAAATNPSILIVGRVFVGLGVGMASMASPLYISEASPTRVRGALVSLNGFLITGGQFLSNLINLAFTKVRNYASSLHCFCC

SEQ ID NO: 130419 - protein, 121 aa, Glycine max
  Coding DNA Sequence Number=SeqID_13641
MDISKDTDIPVILGRPFMLTASCIVDMEKRKLELGFEDQKIDFDLFVEDKPAPEHNVCLQVMEGGQELHAKHIFGHALSRESQVLSPQPLHLRLIWSAKLAKDKLSQLQFDLNSAKLQPNR

SEQ ID NO: 130420 - protein, 81 aa, Glycine max
  Coding DNA Sequence Number=SeqID_13642
  Subcellular localization annotation: CTP_CleavageSite=63; ConfidenceScore=5.67e-01
MGVQIATRPTWAFQKIPPKGGCFWRKQPSSPGRAGKSKPMRFCNVFVGDFAKIFNRSSMFFVHSSSFFNLQPISKGLKINM

SEQ ID NO: 130421 - protein, 114 aa, Glycine max
  Coding DNA Sequence Number=SeqID_13643
  Subcellular localization annotation: CTP_CleavageSite=57; ConfidenceScore=5.64e-01
MAKPSSPANLASAIICFFASKKFPHRLKASPGRFARQNPSPHPSVMVHVHGFFKVLLADSRFTRPDMGFHPTKLNFVPSDADEAPLDVSICLHAFGIVGCGSFSGVKSCEREGA

SEQ ID NO: 130422 - protein, 40 aa, Glycine max
  Coding DNA Sequence Number=SeqID_13644
MWSGFSAQFYDGAEATRVPTANSKKKADQFGSEGWLNWHE

SEQ ID NO: 130423 - protein, 141 aa, Glycine max
  Coding DNA Sequence Number=SeqID_13645
  Gene Ontology: Mol. function=transferase activity, transferring glycosyl groups; Cellular component=endoplasmic reticulum; Biological process=DNA repair
  Homolog annotation: Hit_ID=O80505; Match level="QueryCoverage=71%, HitCoverage=26%, E-value=6e-40, Identity=72%"; Hit description =Probable dolichyl pyrophosphate Glc1Man9GlcNAc2 alpha-1,3- glucosyltransferase
MVRGFRRLLIMGGVVTAVFASAFGPFFHLGQIQQVIQRLFPFGRGLCHAYWAPNFWVFYIMSDKGLAFIFRKLGFNVQTPTGSFTAGLVGDSSPFSVLPQMTEVKFLICCIHFISMRRWRMMLYHFFKLVIMHHDLATDRL

SEQ ID NO: 130424 - protein, 48 aa, Glycine max
  Coding DNA Sequence Number=SeqID_13646
LVSRVAIPFDLEVCNRRTPSIYNRRTSTSLRLCVRAFNFIGISSLIQT

SEQ ID NO: 130425 - protein, 154 aa, Glycine max
  Coding DNA Sequence Number=SeqID_13647
  Subcellular localization annotation: CTP_CleavageSite=43; ConfidenceScore=5.38e-01
MFLSAIDEQGGHASARSSSAPMSSSTGLKSDALLGKETVMTARVASGAYLVVRWVFAKNLVVALVVGFLRILVVGWRAYNSAEEEEKRVEYMICCRGCTKFLVTNLTTNLVGSYWIASSLMHCDGVVIRGGSRVAYGGILRDYMGFSSLLMRVD

SEQ ID NO: 130426 - protein, 89 aa, Glycine max
  Coding DNA Sequence Number=SeqID_13648
  Gene Ontology: Mol. function=RNA-directed DNA polymerase activity
  Homolog annotation: Hit_ID=Q1S7G3; Match level="QueryCoverage=84%, HitCoverage=40%, E-value=1e-09, Identity=56%"; Hit description=RNA -directed DNA polymerase (EC 2.7.7.49) (Clone AmLi2)-garden snapdragon-related
MVKEVRGIQKYCGEVAPALLITPHKKYSLRFPRLEPIIEEGSDNIQGLQIMPKRMLFLVPALISFEVLGVHIKKPKVRGEEEMDYEKIL

SEQ ID NO: 130427 - protein, 75 aa, Glycine max
  Coding DNA Sequence Number=SeqID_13649
MITELGWFGVCCGLWWVVVAINTHHWKTNLTSKNSTAKERIGFMIHVVEQSRKVLKTGGGNGYGGGECGGECRHQ

SEQ ID NO: 130428 - protein, 148 aa, Glycine max
  Coding DNA Sequence Number=SeqID_13650
MDVVNDLHMGPPATTNMGGSTSTEDVNSSQKQKMARKKKQAVECEGVDFSLDKSLPKTDATIKHPLHGSPALPNFLSCQIFVEYSTNNEKSKRQKTTHNAIEDNVNGCSTPEYIFSPKASTPALDMPSEHPIQCFSSDPITSQSCVEV

SEQ ID NO: 130429 - protein, 237 aa, Glycine max
  Coding DNA Sequence Number=SeqID_13651
  Gene Ontology: Mol. function=ATP-dependent helicase activity; Cellular component=cytosol; Biological process=rRNA processing
  Homolog annotation: Hit_ID=Q7FGZ2; Match level="QueryCoverage=88%, HitCoverage=41%, E-value=1e-57, Identity=56%"; Hit description=DEAD -box ATP-dependent RNA helicase 1
  Pfam annotation: Domain name=DEAD; Domain location=50-226; Score =103.5; E_value=6.1e-28; Accession=PF00270.19; Description=DEADDEAH box helicase
  Pfam annotation: Domain name=ResIII; Domain location=46-221; Score= -7.3; E_value=0.00019; Accession=PF04851.6; Description=Type III restriction enzyme, res subunit
  Pfam module annotation: Pfam domain module=DEAD::ResIII; Domain location=50-226::46-221
MEQPSVAILPWMHHPVDITRCQELPVCSVPLMERRLQSVLEENMGISKLFSVQVALWQETVGSDDFERDLCINSPTESGKTLAYALPIVQNLSTNTSDRLFALVVVPTRDLALQVKRVFDALASSLGLHIGLAAGQSSLRHELSSLIYLPGEDDGPDPGFLSPLWFQSKVNILVATPGRLMDHVNKLSLKHLRYLVVDEADRLLREDYQSWFKSIVQDPVKVVNRTKVRGVGRGAWI

SEQ ID NO: 130430 - protein, 442 aa, Glycine max
  Coding DNA Sequence Number=SeqID_13652
  Gene Ontology: Mol. function=zinc ion binding; Cellular component =nucleus; Biological process=anti-apoptosis
  Homolog annotation: Hit_ID=Q10CF1; Match level="QueryCoverage=99%, HitCoverage=45%, E-value=9e-96, Identity=46%"; Hit description =Expressed protein
  Pfam annotation: Domain name=zf-C3HC; Domain location=79-219; Score =168.1; E_value=2.2e-47; Accession=PF07967.4; Description=C3HC zinc finger-like
  Subcellular localization annotation: CTP_CleavageSite=62; ConfidenceScore=5.32e-01
MREEVISSGGTVDPTPAASSAGASSPAVPMNVGSIDGSSHGQVSKAASLSCVGSQPPWTSLSTSAGGSAFGSSRSSCRPWERGDLLRRLATFIPSNWLGKPQIISSLACAQKGWMNNGVDKIACESCGSCLSFTALPSWTLAEGCPAHVCYWAMEAQNANESFARQLDSGHKVNCLWKGNSCPESLVQFPPTPPSALIGGYKDRCDGLVQFHSLPVVAISAIELMSVSRGPQIERFLSQSQNFMSGEVDIKPDIVSDLENAQDEAYCLYSRAQKLISLCGWESSWRLNVQDCEEHSAQSERNGYSFGPSKTQLHLTQDPGSKAVSASTKLDARKAKAPLKEPRLDSRSPLLDCSLCGATVRISDFLTVPRPARFASNSIDIPDTSKKIGLTRGASAASGISGWIAADDTEKDQTEDRDEVATTNEGKLLANTDLDLNLSMAG

SEQ ID NO: 130431 - protein, 475 aa, Glycine max
  Coding DNA Sequence Number=SeqID_13653
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=90%, HitCoverage=93%, E-value=1e-102, Identity=48%"; Hit description =Putative CBL-interacting protein kinase 23
  Pfam annotation: Domain name=NAF; Domain location=336-398; Score= -2.5; E_value=0.0087; Accession=PF03822.5; Description=NAF domain
  Pfam annotation: Domain name=Pkinase; Domain location=35-300; Score =247.5; E_value=2.9e-71; Accession=PF00069.15; Description=Protein kinase domain
  Pfam annotation: Domain name=Pkinase_Tyr; Domain location=35-301; Score=18.1; E_value=1.4e-13; Accession=PF07714.7; Description =Protein tyrosine kinase
  Pfam annotation: Domain name=RIO1; Domain location=36-194; Score= -95.3; E_value=0.06; Accession=PF01163.12; Description=RIO1 family
  Pfam module annotation: Pfam domain module=NAF::Pkinase::Pkinase _Tyr::RIO1; Domain location=336-398::35-300::35-301::36-194
MENEKIPSVYEHGSCSRSAEPEPRPNDSRILGRKYHLYWALGFGSSAIVKLASDVTTGHGVAIKIFDKEFIDGKKKSVKKRMKIALEREISAMTMLRSHPNVVRIIEVMATTTRVYIVMELVVGGATLLDKIGRTSGMSETQARQYFHQLICAVDYCHSRGVIHRDLNPSNLLLAADGVLKVSDFGMTALPQQARQDGLLHSACGALDYKAPEVIRNRGYEGEKADIWSCGAILFHLVAGDVPFTNVYDDRNTKIRQILQADFICPSFFSASLVALIRRILDPNPTTRITMNEIFENEWFMENYEPPRFYRQNFTFGHDSQKRVAKGHGAGSSAPPVPVMNAFEILNTFLGYYLIIGKLLNQLVQHKRETSFISQNPVDEIIDGIERVAGIMGFDVKRINSFRMSIEGGANARRKGHLAIFIKISEIAQPFHMVELRKAEGDVLEFHNFCKHIYAALSDFIWKGRAEPIDTETDG

SEQ ID NO: 130432 - protein, 265 aa, Glycine max
  Coding DNA Sequence Number=SeqID_13654
ALAPKKLLAKRARKATPGEGSSTAPQAKIEFDRHRFQSKEHQCHFKAIKDWRQWTQLTEPMAKYDLEIVMEFYANAWPTEEGEGQHYEYTERKSQVSGFDEEAIGQLLCSPGQDFAWSVTGRWVQIMRTSMTTLTQIWMMLLLSNILLLSVHGTGISSIDHRSLPVLWGTSYDQQQQPVVDAPPPPLHQPLSLESISAHMQRMEPYMQHLANQQVANHRGQFRAIVTWPGDRPNFQGGAGPTKARGNEDKAEEDGDMADVMDFFL

SEQ ID NO: 130433 - protein, 78 aa, Glycine max
  Coding DNA Sequence Number=SeqID_13655
MEKKKGGNGKGKTISLQQTMSEPYTELWPWIFFINGILCFLNFNGIEMEKEKDDWRCHFKEKMSLEEAHNHRKSWIRA

SEQ ID NO: 130434 - protein, 215 aa, Glycine max
  Coding DNA Sequence Number=SeqID_13656
  Gene Ontology: Mol. function=RNA-directed DNA polymerase activity; Biological process=RNA-dependent DNA replication
  Homolog annotation: Hit_ID=Q1S6X4; Match level="QueryCoverage=99%, HitCoverage=41%, E-value=2e-18, Identity=27%"; Hit description=RNA -directed DNA polymerase
MREAVGKGLFQGLPIGSNQMKVELLQYANGTIFIGKAKVENFLFIKSMLRCFELVSSLKINFFKSSLRAIGLENDLLTRFAGMLNCIPMGAIHRKENTWRPIVDKFDRKLTSCGEESEGRWFDRLIELTIGNDSKIRFWDDCWLGEVDFASIRLYLNSCHQGCLVEEMRSWIDGRWHWDLRWRRRWFKWELDSFKQIEDTIHDINLTLDVQDSWR

SEQ ID NO: 130435 - protein, 81 aa, Glycine max
  Coding DNA Sequence Number=SeqID_13657
  Gene Ontology: Mol. function=RNA-directed DNA polymerase activity; Biological process=RNA-dependent DNA replication
MEVDPKKVKWEVKNFFQKIFLVEDLDRPKLDGTRLKQISQQQYESFIARFEEDEVKEAIWECGSSQSPNLDGFNFHFIKAF

SEQ ID NO: 130436 - protein, 194 aa, Glycine max
  Coding DNA Sequence Number=SeqID_13658
  Homolog annotation: Hit_ID=Q10CM8; Match level="QueryCoverage=53%, HitCoverage=21%, E-value=3e-33, Identity=63%"; Hit description =Expressed protein
NQSHCTETKFTTVENIEKPLVLKEITKLWEKEEPDLPWEKGEFNESNTLLLDDSPYKALMNPRHSAIFPYSYRYYHTRDSELGPGGDLRVYLKGLAKAENVQNYVCECDSTSTIRGWMIEGFASWPWWCEGKIRVQRGKIESERIEGEPTPCMKENPMHDHNLVEGSTIEDDAIPFVPETPNNRRPQGQPTFPF

SEQ ID NO: 130437 - protein, 71 aa, Glycine max
  Coding DNA Sequence Number=SeqID_13659
MNPKAVSLLSPVITTKKLYLLLAMNPKAVSLLDPVINQEENPLLAMNPKAVSLLSPVLNQEDLLLKNSHQE

SEQ ID NO: 130438 - protein, 213 aa, Glycine max
  Coding DNA Sequence Number=SeqID_13660
  Gene Ontology: Mol. function=RNA-directed DNA polymerase activity; Biological process=RNA-dependent DNA replication
MAMASYITEELQGRRGVFRACNWKEKDCYITIVNISIHLVTFLNGKQCGRNWWPGSLESMLIFGVFWVISTLRKINKRQWNGVVGSKNDGISMFNQFIIEMELEDVPKVGREFSWYRPNVKAKSLLNRFLVQKEWFNIWSGSIQFILDRNISDHCPIVLKDANVDLGPKPFRSLDYWFQHENYVEVVEGAWRNMSIHRWGAYVLKEKLKGLKK

SEQ ID NO: 130439 - protein, 196 aa, Glycine max
  Coding DNA Sequence Number=SeqID_13661
  Gene Ontology: Mol. function=nucleic acid binding; Biological process= RNA-dependent DNA replication
  Homolog annotation: Hit_ID=Q53KJ4; Match level="QueryCoverage=81%, HitCoverage=26%, E-value=1e-14, Identity=32%"; Hit description =Transposable element protein, putative
MAQPPPRERTLREMATPDFSYESLCIQYPDEDVPYVLKTGLIHLLPKFHDLAGEDPHKHLKEFHIVCSTMKPPDVQEDHIFLKAFPHSLEGVTKDWLYYLAPRSIKSWDDLKKVFLENIFPASRTTTIRKDISGLNNMERSMIDAASGGALGDMTPAEARNLIEKMASNSQQFSARNDVIVIRGVLEVAMNSSSSI

SEQ ID NO: 130440 - protein, 64 aa, Glycine max
  Coding DNA Sequence Number=SeqID_13662
MESKTSKFKLGLQIEHPQELINTIQVGLGIEHPQELINNIQNAELASEVCHGRCKIPVADYKVP

SEQ ID NO: 130441 - protein, 108 aa, Glycine max
  Coding DNA Sequence Number=SeqID_13663
LGRIDGDSVLRETRIWATWEYVSSVGGGQQGMVVVPGDMSRGSGDLGDVRQAHGSQQIKGTKTTKQGGLCGGWPAVNLEARGASGNRLPGHVIDYQLQKGTGRLWRPL

SEQ ID NO: 130442 - protein, 122 aa, Glycine max
  Coding DNA Sequence Number=SeqID_13664
MADNTKSKTNTTHNAQFNELLQRMASLKSTFIDKMEDVPNRVTALENRSPIHSATSNFSSPNSYHQRHFLKLDIPRFLSVNGLNPSFLLSCFISRLKSELKREVLAQQPRSLSQTAGLARLP

SEQ ID NO: 130443 - protein, 634 aa, Glycine max
  Coding DNA Sequence Number=SeqID_13665
  Gene Ontology: Mol. function=transferase activity, transferring glycosyl groups; Cellular component=integral to membrane; Biological process=metabolic process
  Homolog annotation: Hit_ID=Q8S9A0; Match level="QueryCoverage=95%, HitCoverage=98%, E-value=0.0, Identity=71%"; Hit description =Glucosyltransferase-9
  Pfam annotation: Domain name=UDPGT; Domain location=10-485; Score= -59.2; E_value=1.2e-07; Accession=PF00201.9; Description=UDP -glucoronosyl and UDP-glucosyl transferase
  Subcellular localization annotation: CTP_CleavageSite=55; ConfidenceScore=5.21e-01
MVFQTNINPHFVLFPLMAQGHMIPMMDIARLLARRGVIVSIFTTPKNASRFNSVLSRDVSSGLPIRLVQLHFPSKEAGLPEGCENLDMVASNDLYKIFHAIKLLHKPAEEFFEALTPKPSCIISDFCIPWTAQVAEKHHIPRISFHGFSCFCLHCLYQIHTSKVCESITSESEYFTIPGIPDKIQVTKEQLPAGLSNELKDFGEQVIDADIKSYGVIINTFEELEKAYVREYKKVRNDKVWCIGPVSLCNKDGLDKAQRGNRASINEHHCLKWLDLQQPKSVVYVCFGSLCNLIPSQLVELALAIEDSKKPFVWVIREGSKYQELEKWISEEGFEERTKGRGLIIRGWAPQVLILSHPAIGGFLTHCGWNSTLEGISVGVPMVTWPLFADQFLNEKLVTQVLKIGVSVGAEVPMNWGEEEKTGVLVKKKNIERAICMVMDNDEEESKERRERATKLCEMAKKAVEKGGSSHLDMTLLIQDIMQQSSSKEDKQQTINIPQCYCENLDMIPSYSTGTSFFKATSLLQQPAEKLFEELTPLASCIVSECLPYATQIVKKINVLRVSFVGVIYFCLLCMHNITTHTVRESITSESECFVLPGIPDKIEITIAQAGQPMNESWKRLMKNLGKLKCLVTG

SEQ ID NO: 130444 - protein, 493 aa, Glycine max
  Coding DNA Sequence Number=SeqID_13666
  Gene Ontology: Mol. function=transferase activity, transferring glycosyl groups; Cellular component=integral to membrane; Biological process=metabolic process
  Homolog annotation: Hit_ID=Q8S9A0; Match level="QueryCoverage=96%, HitCoverage=95%, E-value=0.0, Identity=73%"; Hit description =Glucosyltransferase-9
  Pfam annotation: Domain name=UDPGT; Domain location=4-474; Score= -64.9; E_value=2.3e-07; Accession=PF00201.9; Description=UDP -glucoronosyl and UDP-glucosyl transferase
  Subcellular localization annotation: CTP_CleavageSite=39; ConfidenceScore=5.07e-01
MAQGHIIPMMDIARLLAHRGVIVTIFTTPKNASRFNSVLSRAISSGLQIRLVQLHFPSKEAGLPEGCENFDMVTSIDMVYKMFNVINMLHKQAEEFFEALTPKPSCIISDFCIPWTAQVAQKHCIPRISFHGFACFCLHCMLMVHTSNVCESTASESEYFTIPGIPDQIQVTKEQIPMMISNSDEEMKHFREQMRDADIKSYGVIINTFEELEKAYVRDYKKVRNDKVWCIGPVSLCNQDNLDKVQRGNHASINEHHCLKWLDLQPPKSAVYVCFGSLCNLIPSQLVELALALEDTKKPFVWVIREGNKFQELEKKWISEEGFEERTKGRGLIIRGWAPQVLILSHPSIGGFLTHCGWNSTLEGISAGVPMITWPLFADQFLNEKLVTQVLKIGVSVGMEVPMKFGEEEKTGVLVKKEDIKRAICIVMDDDGEESKDRRERATKLSEIAKRAVEKEGSSHLDMTLLIQDIMQQSSSKEEVRTSLKESQFSCNA

SEQ ID NO: 130445 - protein, 147 aa, Glycine max
  Coding DNA Sequence Number=SeqID_13667
  Gene Ontology: Mol. function=transferase activity, transferring glycosyl groups; Cellular component=integral to membrane; Biological process=metabolic process
  Homolog annotation: Hit_ID=Q9ZQ94; Match level="QueryCoverage=95%, HitCoverage=28%, E-value=7e-46, Identity=60%"; Hit description =Cytokinin-O-glucosyltransferase 3
MGPQEQQLHFVLFPLMAQGHMIPMMDIAKILVHRNVIVTVVTTPHNAARFTSIFDRYIESGFQIRLAQLQFPCKEAGVPDGCENLDTIPSLGMAAGFFNATNFLREPAEKLLEELTPPPSCIISDMCLPYTKHIARKFNIPRISFVG

SEQ ID NO: 130446 - protein, 921 aa, Glycine max
  Coding DNA Sequence Number=SeqID_13668
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=93%, HitCoverage=99%, E-value=1e-161, Identity=53%"; Hit description =Glucosyltransferase-14
  Pfam annotation: Domain name=UDPGT; Domain location=9-485; Score= -90.1; E_value=4.4e-06; Accession=PF00201.9; Description=UDP -glucoronosyl and UDP-glucosyl transferase
MGAQEQQLHFVLFPLMAQGHMIPMMDIAKILVHRNVIVTVVTTPHNAARFTSIFDRYIESGFQIRLAQLQFPCKEAGVPDGCENLDSIPSLGMAAGFFNATNFLREPAEKLFEELTPPPSCIISDMCLPYTNHIAKKYNIPRISFVGVSCFYLFCMSNVRIHNVMEGIANESEHFVVPGIPDKIETTMAKTGLAMNEEMQQVTDAVFAVEMEAYGMIMNSFEELEPAYAGGYKKMRNDKVWCLGPLSYSNKDQLDKSQRGKKATIDEYHLKSWLDCQKPGTVIYACFGSICNLTTPQLIELGLALEASERPFIWVFREGSQSEELGKWVSKDGFEERTSGRGLLIRGWAPQLLILSHPAVGGFITHCGWNSTLEAICAGVPMVTWPLFADQFLNESLVVEILQVGVKVGVESPVTWGKEEEVGVQVKKKDVERAITKLMDETIEREERRKRIRDLAEKAKRATEKGGSSHSNVTLLIQDIMQKIKRDGEVSLKKKKDECNAILKERDFIKAKTAFSHGIPTPAEAESWALLQAIQWAAHLGYERVVFESDCKLVVDYVTHDTNEAGVPDGCENLDMIPSLGTAASFFRAANPLQQPVENLLEELTPPPSCIISDMGLPYTSYITKNYNIPRISFVGGITNESENFVAPGIPDEIETTIAKTGITIYEGMKQVSHAMFEAEKEAYGMIMNSFEELEPAYAGGYKKMRNNKVWCFGPLSFTNKDHLDKAERGKRASIDLFHLKEENQLEALEKWVKQAGFEERMNARGLLIRVGTPPEAICAGVPMVTWPLFGDQFLDESLVVEILKVGVKVGVESPVKWGEEEEIGVQVKKKDIEMAIESLMDETSESEEKRKRVREVAEMAKRAVDKGGSSHSNVTLLIEDIMGKINFCIGTPFCVGAKTYLSFAPESRKSINYKGSAHPL

SEQ ID NO: 130447 - protein, 121 aa, Glycine max
  Coding DNA Sequence Number=SeqID_13669
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=95%, HitCoverage=25%, E-value=4e-31, Identity=57%"; Hit description =Glucosyltransferase-14
MGKCGWNSTLEAICAGVPMLTRPLFADQFLNEILVVHVLKVGVEIPLTWDKKVEIGVQLKKEDAERAIVKLMYETSESEERRKRVKELAEMAKRAVEKAGSSHSNMTLLIEEIMQKTKRDV

SEQ ID NO: 130448 - protein, 125 aa, Glycine max
  Coding DNA Sequence Number=SeqID_13670
MVEREKFDHIEERLRAIEGGRDYAFADMAELCLVLDVVIPLKFKVPDFDKYKGTTCSKNHLKMYNKKMGAYSKNEKLLMHFFQESLTRVVVTLYTNLEPSQVHSWKDLIVGFIGSISTILIWLRI

SEQ ID NO: 130449 - protein, 296 aa, Glycine max
  Coding DNA Sequence Number=SeqID_13671
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=93%, HitCoverage=59%, E-value=1e-108, Identity=65%"; Hit description =Glucosyltransferase-14
MTINEGMKEFTNTMFEAETEAYGMIMNSFEELEPAYAGGYKKMRNNKVWCFGPLSFTNKDHLDKAQRGKKASIDDGHLKSWLDCQKPGSVIYACFGSICNLTPSQLIELGLALEASERPFIWVFREGSQSEALEKWVKQNGFEERISDRGLLIRGWAPQLLIISHPAIGGFITHCGWNSTLETICAGVPMVTWPLFGDQFMNESLVVEILKVGVKVGVERPITWGKEEEIGVQVKKKDIERAIESLMGETSESEERRKRIRELAEKAKRAVEEGGSSHSNVTLLIEDVMQKVKRDV

SEQ ID NO: 130450 - protein, 108 aa, Glycine max
  Coding DNA Sequence Number=SeqID_13672
MSTRKRRDTISRVQEQEPEPPRLDMQKTLKNMNILSQRNMELIDGEGILRQLSQRALRGRARARLTGALSKGGKMRGVATNVYLWETSEKLKETGQNENSKFGSCIYA

SEQ ID NO: 130451 - protein, 489 aa, Glycine max
  Coding DNA Sequence Number=SeqID_13673
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=95%, HitCoverage=99%, E-value=1e-175, Identity=64%"; Hit description =Glucosyltransferase-14
  Pfam annotation: Domain name=UDPGT; Domain location=9-484; Score= -81.5; E_value=1.6e-06; Accession=PF00201.9; Description=UDP -glucoronosyl and UDP-glucosyl transferase
MASQEPQLHFVLFPFMAQGHMIPMMDIAKVLVQHNVIVTVVTTPHNAARFASTTDRCIEAGFQIRVAQLQFPSKESGLPEECENLDMLPSLGMGFSFFCAANISWQPVEKLFEELTPAPSCIISDMGLPYTVHIARKFNIPRICFATVSCFFLLCLHNLQTYNMMENKATEPECFVLPGLPDKIEITKGHTEHLTDERWKQFVDEYTAASTATYGIIVNSFEELEPAYARDYKKINKDKVWCIGPLSLSNKDQVDKAERGNKASIDECHLKRWLDCQQPGTVIYACLGSLCNLTPPQLIELGLALEASKRPFIWVIRRGSMSEAMEKWIKEEGFEERTNARSLLIRGWAPQLLILSHPAIGGFITHCGWNSTLEAICAGVPMVTWPLFGDQFFNEILVVQILKVGVKVGAESTIKWGKEEEIGVQVKKEDIERAIESLMDETNESEERRKRIKELAEVAKRAIEKGGSSHSDVTLLIQDIKQTIKRDVR

SEQ ID NO: 130452 - protein, 366 aa, Glycine max
  Coding DNA Sequence Number=SeqID_13674
  Gene Ontology: Mol. function=oxidoreductase activity; Cellular component=proton-transporting two-sector ATPase complex; Biological process=flavonoid biosynthetic process
  Homolog annotation: Hit_ID=UPI000034EE1D; Match level="QueryCoverage =94%, HitCoverage=95%, E-value=1e-132, Identity=65%"; Hit description= oxidoreductase, acting on paired donors, with incorporation or reduction of ...
  Homolog annotation: Hit description=molecular oxygen, 2-oxoglutarate as one donor, and incorporation of one atom each of oxygen into both donors
  Pfam annotation: Domain name=2OG-FeII_Oxy; Domain location=215-314; Score=158.5; E_value=1.7e-44; Accession=PF03171.10; Description=2OG -Fe(II) oxygenase superfamily
MALNEQKGKDDIPESQYQKGVKQLCEKGHLNAVPKKYILPVSERPTKSSVEDPNVVKQNLQLPIIDFAELLGPNRPQVLQSLANACQQYGFFQLVNHCMLEDVVRSMIDVSGRFFDLPLEERAKYMTTDMRAPVRCGTSFSQTKDTVLCWRDFLKLLCHPLPDFLPHWPASPVDFRKVVGTYAEETKHLFLVVMDAILESLGIMEDNILKDFENGSQMMVANFYPACPQPDLTLGIPPHSDYGFLTLLLQDEVEGLQIQHQDKWITVQPIPNAFVVNVGDHLEIYSNGKYKSVLHRVVVNEAKSRVSVASLHSLPFNCTVRPSPKLVDEANPKRYMDTDFRTFLAYVSSREPKKKDFLESRKVALN

SEQ ID NO: 130453 - protein, 74 aa, Glycine max
  Coding DNA Sequence Number=SeqID_13675
  Subcellular localization annotation: CTP_CleavageSite=48; ConfidenceScore=5.25e-01
MPRPDKPNWPTMHLRSAPHLALSAFRSRAGRAMHAGPVLLLDRALGACASVGSGAGRLAGLARVTVSATPSASS

SEQ ID NO: 130454 - protein, 67 aa, Glycine max
  Coding DNA Sequence Number=SeqID_13676
MAALPQRLRESESKKDSARAIDLCKPTYFFANHGGVFLNPLIKYLKLVSRYSSRSKSSSQGMHYSMK

SEQ ID NO: 130455 - protein, 501 aa, Glycine max
  Coding DNA Sequence Number=SeqID_13677
  Homolog annotation: Hit_ID=Q8S995; Match level="QueryCoverage=22%, HitCoverage=33%, E-value=6e-28, Identity=50%"; Hit description =Glucosyltransferase-14
MEVAEAYALDDAELRISISPYLAVHGCRHEAGTGIRDHFDGSASESFGGDVYIVYTCAKRLLDSCNGFSERAELKEDAKNESTEVVARTRKRCRQSELKAKVECCDQTVVSESEQVVENGESGINGAALGAPRNKMELKMSKKIVINRKPMTAKELLDTGFLDGVSVVYMGGIMLRTEQRTKLAMPNYTNGITASIMASNRMDNPGVIWAVVAINIHRWKTNFVLKAIAFGIYSLLPQPVPAMVVVEAVASVVVVVDVVACVAADIIADDGQSKRLRVDDVIHSEIGRYKKEPDRDRVDALLGVHGGDESGAKTQEGLGVRADSQSRMTSSLMVISRVLVVISKVWVVMVDRVGASGLRGVIRDGEYCARASLCHGRRARHQSKREGLKWIKEYGFEERIKGVGLLIRGWAPQQFLNESFVVQILRIGVESQVLWGDEEKTGVLVKKEDVVRAIEKLMDEGNEREERRKRVTELAEMAKKAVEGGSSHFNVTQLIQDIMQQ

SEQ ID NO: 130456 - protein, 224 aa, Glycine max
  Coding DNA Sequence Number=SeqID_13678
  Subcellular localization annotation: CTP_CleavageSite=57; ConfidenceScore=5.29e-01
MMQTFVSYLTTTSTNSTWSIKWQRRRRQQQQHIVLRQIAKGISLGLRQRNEGTTTTQEEAASSTTSGCKRTSLTKSRFSQSQQKQQVMPLMNAPLVWGNGRMGMCGYTPRLQRPHPMLLHTHSLSSHMRRKPRGLVMMGLKRSLPLDQTSSYIAITIQRDQLGEAFTSSNSSTKGVIMTSQYYNYRSRSRSRHLDHMSSVLMRSFSQFRNSTTASGRYNVILPN

SEQ ID NO: 130457 - protein, 91 aa, Glycine max
  Coding DNA Sequence Number=SeqID_13679
MALLPSLQNCQVTESNRAYTLRESPKRDFNVFCPLHFKDYQSLFPPRLSKFVGLRRLSMSSALQRLQSLLSRLSESSLHFQDYYYVFGWGI

SEQ ID NO: 130458 - protein, 78 aa, Glycine max
  Coding DNA Sequence Number=SeqID_13680
  Homolog annotation: Hit_ID=Q1RSZ9; Match level="QueryCoverage=56%, HitCoverage=3%, E-value=3e-11, Identity=77%"; Hit description =Polynucleotidyl transferase, Ribonuclease H fold
MVVSLTKAYNGVATLIRQCDLLPPFYQARSMLTLEEVGLAKKVATIFTPSNDDGGMIVVTLLSQCVEVVIKKGDLYNL

SEQ ID NO: 130459 - protein, 47 aa, Glycine max
  Coding DNA Sequence Number=SeqID_13681
HRVAKNHPFSLLTFATIAGGVLYNWVATEDGEAHDNIGMPSVGVWKG

SEQ ID NO: 130460 - protein, 1116 aa, Glycine max
  Coding DNA Sequence Number=SeqID_13682
  Gene Ontology: Mol. function=protein kinase activity; Cellular component=integral to membrane; Biological process=protein amino acid phosphorylation
  Homolog annotation: Hit_ID=Q0WR59; Match level="QueryCoverage=96%, HitCoverage=94%, E-value=0.0, Identity=49%"; Hit description =Receptor protein kinase-like
  Pfam annotation: Domain name=LRRNT_2; Domain location=25-72; Score =38.6; E_value=2.1e-08; Accession=PF08263.3; Description=Leucine rich repeat N-terminal domain
  Pfam annotation: Domain name=LRR_1; Domain location=102-124; Score =15.8; E_value=0.16; Accession=PF00560.23; Description=Leucine Rich Repeat
  Pfam annotation: Domain name=LRR_1; Domain location=126-148; Score =14.3; E_value=0.45; Accession=PF00560.23; Description=Leucine Rich Repeat
  Pfam annotation: Domain name=LRR_1; Domain location=150-172; Score =14.6; E_value=0.35; Accession=PF00560.23; Description=Leucine Rich Repeat
  Pfam annotation: Domain name=LRR_1; Domain location=174-196; Score =7.2; E_value=13; Accession=PF00560.23; Description=Leucine Rich Repeat
  Pfam annotation: Domain name=LRR_1; Domain location=198-223; Score =3.4; E_value=65; Accession=PF00560.23; Description=Leucine Rich Repeat
  Pfam annotation: Domain name=LRR_1; Domain location=226-250; Score =4.7; E_value=38; Accession=PF00560.23; Description=Leucine Rich Repeat
  Pfam annotation: Domain name=LRR_1; Domain location=252-273; Score =21.6; E_value=0.0029; Accession=PF00560.23; Description=Leucine Rich Repeat
  Pfam annotation: Domain name=LRR_1; Domain location=275-298; Score =7.6; E_value=11; Accession=PF00560.23; Description=Leucine Rich Repeat
  Pfam annotation: Domain name=LRR_1; Domain location=300-324; Score =10.3; E_value=3.3; Accession=PF00560.23; Description=Leucine Rich Repeat
  Pfam annotation: Domain name=LRR_1; Domain location=412-431; Score =10.8; E_value=2.7; Accession=PF00560.23; Description=Leucine Rich Repeat
  Pfam annotation: Domain name=LRR_1; Domain location=433-454; Score =7.7; E_value=10; Accession=PF00560.23; Description=Leucine Rich Repeat
  Pfam annotation: Domain name=LRR_1; Domain location=457-479; Score =11.2; E_value=2.3; Accession=PF00560.23; Description=Leucine Rich Repeat
  Pfam annotation: Domain name=LRR_1; Domain location=481-503; Score =9.3; E_value=5.1; Accession=PF00560.23; Description=Leucine Rich Repeat
  Pfam annotation: Domain name=LRR_1; Domain location=505-530; Score =8.8; E_value=6.5; Accession=PF00560.23; Description=Leucine Rich Repeat
  Pfam annotation: Domain name=LRR_1; Domain location=538-560; Score =10.5; E_value=3.1; Accession=PF00560.23; Description=Leucine Rich Repeat
  Pfam annotation: Domain name=LRR_1; Domain location=562-584; Score =13.1; E_value=1; Accession=PF00560.23; Description=Leucine Rich Repeat
  Pfam annotation: Domain name=LRR_1; Domain location=586-605; Score =16.7; E_value=0.083; Accession=PF00560.23; Description=Leucine Rich Repeat
  Pfam annotation: Domain name=LRR_1; Domain location=608-630; Score =10.8; E_value=2.7; Accession=PF00560.23; Description=Leucine Rich Repeat
  Pfam annotation: Domain name=Pkinase; Domain location=849-1108; Score= -23.2; E_value=3.5e-07; Accession=PF00069.15; Description=Protein kinase domain
  Pfam annotation: Domain name=Pkinase_Tyr; Domain location=853-1098; Score=-73.0; E_value=5.5e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=25-72::102-124::126-148::150 -172::174-196::198-223::226-250::252-273::275-298::300-324::412 -431::433-454::457-479::481-503::505-530::538-560::562-584::586 -605::608-630::849-1108::853-1098
MNSPPKLLLLSLLFLTLFTLSSSSSLPELRSLLEFKKGITRDPEKLLDSWAPTTVAESTATCPSSWQGVVCDEESGNVTGIVLDRLNLGGELKFHTLLNLKMLRNLSLSGNDFTGRLPPSLGSLSSLQHLDLSQNKFYGPIPARINDLWGLNYLNLSNNNFKGGFPSGLSNLQQLRVLDLHANHLWAEIGDVLSTLRNVERVDLSLNRFFGGLSLAVENVSSLANTVHFLNLSCNNLNGRFFTNSTIGLFRNLQVLDLSDNSITGQLPSFGSLPALRLLRLPRNQLFGSVPEELLQTSVPLEELDLSFNGFTGNCWRIDPFLSLSSFVRAELPLFKALVMGNCCIVRDGKGSCRKTRDLFDLQNIVMLPKSSLAVEVVLMKGEKGGRVGDGAERERIRGERNGSIGVINSTTLNFLNLSSNSLSGSLPTSLRRCTVIDLSRNMLSGDISVIQNWEAPLEVIDLSSNKLSGSLPSILGTYSKLSTIDLSLNELKGSIPRGLVTSSSVTRLNLSGNQFTGPLLLQGSGASELLLMPPYQPMEYLDVSNNSLEGVLPSEIGRMGGLKLLNLARNGFSGQLPNELNKLFYLEYLDLSNNKFTGNIPDKLPSSLTAFNVSNNDLSGRVPENLRHFSPSSFHPGNAKLMLPNDSPETSSVPDNIPDKGRHHSSKGNIRIAIILASVGAAIMIAFVLLVYHRTQLKEFHGRSEFTGQNTRRDVKLGGLSRSSLFKFNTNVQPPTSSLSFSNDHLLTSNSRSLSGGQSEFITEISEHGLTQGMVATSSVSVNPNLMDNPPTSSGRKSSPGSPLSSSPRFIEACEKPVMLDVYSPDRLAGELFFLDSSLAFTAEELSRAPAEVLGRSSHGTLYKATLDSGHMLTVKWLRVGLVKHKKEFAREVKRIGSMRHPNIVPLLAYYWGPREQERLLLADYIHGDNLALHLYVECNINVSVCTESTPRRYSPLSFSQRIRVAVDVARCLLYLHDRGLPHGNLKPTNIVLAGPDFNARLTDYGLHRLMTPAGIAEQILNLGALGYRAPELATASKPVPSFKADVYALGVILMELLTRKSAGDIISGQSGAVDLTDWVRLCEREGRVMDCIDRDIAGGEESSKEMDELLAISL

SEQ ID NO: 130461 - protein, 357 aa, Glycine max
  Coding DNA Sequence Number=SeqID_13683
  Homolog annotation: Hit_ID=Q1SS26; Match level="QueryCoverage=59%, HitCoverage=25%, E-value=4e-10, Identity=22%"; Hit description =Unnamed protein product; no similarity, hypothetical start
  Subcellular localization annotation: CTP_CleavageSite=17; ConfidenceScore=5.18e-01
MAESLKKRKGTSSTTAAAGHRRHRPSEAPTTPIHPSLSSPQSSTLFSSDDQHLRYNSQFSSRIILDPKYLDIDFFNDETFDCYQVFQNSRLVDFMSLKFPYYPELVRVFYSNLNIQDGIIRSEVHGISMIIDQTLLFSLTKLPNQGAPFEGTIVDDWKFDYSSHDACRMVCNDQADMTGRLLARSLTFDCRIMHYIIVRILLPRSSNLAQASKEDLILMWAFLTGCQVDRAHLVRYRMHKALRANAPLPYPQLVTLFLHHFQIPLDDEPFVQVKRSFAICASAITSFGYRKDRDGQWLKKDALPPQDERTPSPPPQRDDSSALMNEVLSELRGLRTYVGERFDSLDGRFEGMNTRIT

SEQ ID NO: 130462 - protein, 109 aa, Glycine max
  Coding DNA Sequence Number=SeqID_13684
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=51%, HitCoverage=16%, E-value=3e-26, Identity=100%"; Hit description =Photosystem II D2 protein (Photosystem Q(A) protein)
GLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKP

SEQ ID NO: 130463 - protein, 139 aa, Glycine max
  Coding DNA Sequence Number=SeqID_13685
  Gene Ontology: Mol. function=zinc ion binding; Cellular component =intracellular
  Homolog annotation: Hit_ID=Q0VJB4; Match level="QueryCoverage=98%, HitCoverage=57%, E-value=6e-34, Identity=56%"; Hit description =Putative zinc-binding protein
  Pfam annotation: Domain name=PLATZ; Domain location=1-67; Score=95.6; E_value=1.5e-25; Accession=PF04640.4; Description=PLATZ transcription factor
HDVVRVSEIQKVLDISGVQTYVINSARVLFLNVRPQPKSGKGVAQICEICGRSLLDPVRFCSLGCKLEGIKKNGDASFALDGRNEELTMDTSRGSVSSRQQEEGLREGSTQDMYSSTPSPPSSNARRRKGIPHRAPFGS

SEQ ID NO: 130464 - protein, 66 aa, Glycine max
  Coding DNA Sequence Number=SeqID_13686
  Gene Ontology: Mol. function=zinc ion binding; Cellular component =intracellular
  Homolog annotation: Hit_ID=Q5QLZ0; Match level="QueryCoverage=84%, HitCoverage=24%, E-value=5e-15, Identity=58%"; Hit description=Zinc -binding protein-like
  Pfam annotation: Domain name=PLATZ; Domain location=27-66; Score= -46.2; E_value=0.071; Accession=PF04640.4; Description=PLATZ transcription factor
MGFQQDTVVLIPPWLEQLLHTPFFNVCRIHADAARSECNMFCIDCNGEAFCFYCRSSRHKDHQVIQ

SEQ ID NO: 130465 - protein, 145 aa, Glycine max
  Coding DNA Sequence Number=SeqID_13687
  Subcellular localization annotation: CTP_CleavageSite=38; ConfidenceScore=5.63e-01
MNGPGPGILIGSNWNSHFPTSKKQPSFVPTFLSFLLAPVSEISRVSSLLNQQFGTKINSIYEFPIVRRGSQEQQSQDGSSQSQSWYPPSVVSSPTSSRPVTPTASSSSLSQRPSSHVPPSEAAAVIAVLKDKRFEFSSFIRFSWF

SEQ ID NO: 130466 - protein, 196 aa, Glycine max
  Coding DNA Sequence Number=SeqID_13688
  Homolog annotation: Hit_ID=Q5YJL6; Match level="QueryCoverage=60%, HitCoverage=68%, E-value=1e-29, Identity=55%"; Hit description =Autophagy protein AGP6
  Pfam annotation: Domain name=Mod_r; Domain location=1-122; Score =85.7; E_value=1.5e-22; Accession=PF07200.3; Description=Modifier of rudimentary (Mod(r)) prote
MALSKSTWQKLKDELCKENLQLAEENLQKEPRIMELRNQCRIIRTTELAAAKEKLNELEKQKEDMLKLNSPASLLQRIQESANKTDEESENLHQHLLDREIDLAAFLQKYKKLRTTYHRKTLVHLAAKTSTFTIVNSYHWSKIFATNYIEVAVVGIEPSTINEIVHIVEPEIVHCVDIVKWFQATWDEAMRSSSPI

SEQ ID NO: 130467 - protein, 549 aa, Glycine max
  Coding DNA Sequence Number=SeqID_13689
  Gene Ontology: Mol. function=RNA-directed DNA polymerase activity; Cellular component=extracellular region; Biological process=RNA -dependent DNA replication
MGGGGAMRTVAKLAAARIRGVPSVQRASSQTAAAAWDDWEVADGGEEDGEGAARVVLGDVPSIQEAKAATAELKHAIHNGQVSVVSPSHTELENKSHFTEAITYPSAPNRALQAFQLLSESPEAQSVVASIACDPNIWNAIAQNPTLQDFFQSHQTAICAATADFEVEGTHDQRVGDFLYSDSVYAFVDSLNILHNVNFTVTEMVSSVSNYLQNMFGFLTGQTSSAVIDARGNTKANFVDPITMGGTFLGFAVLVVMALSGMLEKLVKDDVLHGIKIANSAPMISHLFFADDSIMFSRATREEASHILAIIKSYEEVSGQRINYNKFELSCSQNVLGTRFDELSQLLEVKALESHDRYLGFPTLIGRSKTQLFEFIFDRVWKKLKGWKGRALSQARGVSLLVSFGEEMSKEGSLTGLMVNEESLMSRVIKARYFPKKSLWEVKKRIKCLLHVDKHYGGKVADGKRLFMEEVVLKDFRVQNPFGEEEGTWNNELIKDLFSSSIATNIKATPLQVSTMALEIHSQRHIFVAMWVGEGGAVGGEMKGFVGKG

SEQ ID NO: 130468 - protein, 532 aa, Glycine max
  Coding DNA Sequence Number=SeqID_13690
  Gene Ontology: Mol. function=transporter activity; Cellular component= integral to membrane; Biological process=transport
  Homolog annotation: Hit_ID=Q9LHQ6; Match level="QueryCoverage=94%, HitCoverage=93%, E-value=1e-167, Identity=58%"; Hit description =Organic anion transporter-like protein
  Pfam annotation: Domain name=MFS_1; Domain location=53-495; Score =66.9; E_value=6.5e-17; Accession=PF07690.6; Description=Major Facilitator Superfamily
  Pfam annotation: Domain name=Sugar_tr; Domain location=49-527; Score =27.9; E_value=9.6e-08; Accession=PF00083.14; Description=Sugar (and other) transporter
  Pfam module annotation: Pfam domain module=MFS_1::Sugar_tr; Domain location=53-495::49-527
MTSAEMIPTALSIETSDQSNDLRSSPVKKMSVDEMLQQYCGEFGKWHLRHFVLTNLSWVLLGFHIMVMIFADHEPYWSCHAGSVGSGCNAAATSICQLKPGSWEWVGGHGGTTVSEWGLICGNKYKVGLVRAVFFVGWMIGGGVFGHLSDSFLGRKHSLGVASALNAIFGCLTALSPNYWIYVVFRLLTGFSSGGVALCAYVLASEPIGPKKRGAIGMCTFYFFSGGIAVLSGIAYIFQTWRYLYIASSIPSFLYTFLVFPFLFESPRWYLVRGRVSEAMKLMSAIASSNGKHLPEGILLALDEEVNNESSCQGRNSQDERLENKGGARVGSIVDIVRCPTTRVRLLIAMMLNFLCDFVYYGLSLNVVNLKNNLYLNVLLNAVGEMPAFVITTVLLGKFNFGRKPLTVATMWFSGFFCLIASLMKNVGVWKILRMVCGVLAVSGMAGTYNLLYIYTTELFPTVVRNTALGFTTQTAQMGAMLAPFVVVLGGWLTFAVLAACGIMGGVFALVLPETSNQPLYDTFSGLEAGLA

SEQ ID NO: 130469 - protein, 98 aa, Glycine max
  Coding DNA Sequence Number=SeqID_13691
MEGCIKLNCAGAYLPAIEVASCAVVLRGWVIVRYWKQSSGPFYMICEKGIASLMVERDSFDAIKLLDDKSGDGNCFKMLVGEIWRVEEKFHLCYETYS

SEQ ID NO: 130470 - protein, 381 aa, Glycine max
  Coding DNA Sequence Number=SeqID_13692
  Gene Ontology: Mol. function=ubiquitin-protein ligase activity; Cellular component=intracellular; Biological process=protein modification process
  Homolog annotation: Hit_ID=Q9AUK0; Match level="QueryCoverage=99%, HitCoverage=50%, E-value=1e-176, Identity=79%"; Hit description =Putative ubiquitin protein ligase
  Pfam annotation: Domain name=HECT; Domain location=67-381; Score =486.4; E_value=3.4e-143; Accession=PF00632.15; Description=HECT -domain (ubiquitin-transferase)
MAGEISEPGSRAIEIVVRRGHIVEDGFRQLNSLGSRLKSSIHVSFVSECGLLEAGLDYGGLSKEFLTDISKSAFSPEYGLFSQTSTSDRLLIPTASARYLENGLQMIEFLGRVVGKALYEGILLDYSFSHVFVQKLLGRYSFLDELSTLDPELYRNLMYVKNYDGDVKELSIDFTVTEESLGKMYVVELKSGGKDISVTNENKMQYIHAMADYKLNQQILPFSNAFYRGVTDLITPSWLKLFNASEFNQLLSGGNYDIDVDDLKNNTRYTGGYNEGSRTIKIFWEVIKGFEPKERCMLLKFVTSCSRAPLLGFKYLQPPFTIHKVACDVPLWATIGGQDVDRLPSASTCYNTLKLPTYKRPGTLRAKLLYAISSNAGFELS

SEQ ID NO: 130471 - protein, 627 aa, Glycine max
  Coding DNA Sequence Number=SeqID_13693
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=95%, HitCoverage=92%, E-value=1e-151, Identity=46%"; Hit description =Putative wall-associated receptor kinase-like 20 precursor
  Pfam annotation: Domain name=APH; Domain location=343-532; Score= -12.7; E_value=0.046; Accession=PF01636.13; Description =Phosphotransferase enzyme family
  Pfam annotation: Domain name=Pkinase; Domain location=341-617; Score =159.5; E_value=8.8e-45; Accession=PF00069.15; Description=Protein kinase domain
  Pfam annotation: Domain name=Pkinase_Tyr; Domain location=341-617; Score=122.9; E_value=8.9e-34; Accession=PF07714.7; Description =Protein tyrosine kinase
  Pfam module annotation: Pfam domain module=APH::Pkinase::Pkinase_Tyr; Domain location=343-532::341-617::341-617
MRHSFHFWYAFLLILVLGRHISSLKTCPNCGTIQVPYPLSTDSTCGDQNYKLRCDPHSQRLLFDILNGSSYLVLRIMSSNQRMVVQPSPWLPGSCVTQDMPRSNGIWLNQSLPFNITSSNTVFLFNCSPRLLVSPLNCTSSSICHRYLENSGHVDTKLSLECASGLHPCCTFLAGGIPSAYRIRLHDSGCKAFRSIIHLNQDKPPNQWEEVLEIQWSPPPEPVCNNQRDCSEDSKCSPTNRNGLFRCLCNGGHVWNPFEATCVRYERKSKWKTSLVVSIGVVVTFFSLAVVLTIIKKSCKLSNYKENQAKDEREEKLKSSAMEKPCRMFQLKEVKKATNGFSHERFLGSGGFGEVFKGELQDGTLVAVKKARVGNLKSTQQVLNEAAILSQVNHKNLVRLLGCCVESELPLMIYEYISNGTLYDHLHGRYCSNFLDWKTRLKVAFQTAEALAYLHSAAHTPIYHRDVKSTNILLDDEFNAKVSDFGLSRLASPGLSHVSTCAQGTLGYLDPEYYRNYQLTDKSDVYSYGVVLLELLTSQKAIDFNRDQDDVNLAIHVNQHASNGTIMEVMDQRLLISLETLGDKMFTSIKLFLELALECLREKKGERPNMRDIVQRLLCIIRIVEQE

SEQ ID NO: 130472 - protein, 235 aa, Glycine max
  Coding DNA Sequence Number=SeqID_13694
  Homolog annotation: Hit_ID=Q9FFN1; Match level="QueryCoverage=26%, HitCoverage=7%, E-value=5e-10, Identity=57%"; Hit description =Selenium-binding protein-like
EEMERVVLAVLGEEGDEGGVGDDVGGREGEEEAEGVGEEVEFEVSGDEGVGEMGVFFVAFEERGVDGLGQVGVAGAGGHVEGVEEGVGLRGKVVGAMAEFVAEREGGRWFGVGRRKGRVEEGFAVEAYLPLPLPSIHNAISSTVSLRGASAKEITRDALLLKVSQERELRNYAKRAAAAALFIQQLQQQQSLIPLGEVGNKAVTTISCNSNRLAKSIGRNDRPEVDIVYYNMATI

SEQ ID NO: 130473 - protein, 336 aa, Glycine max
  Coding DNA Sequence Number=SeqID_13695
  Gene Ontology: Mol. function=ubiquitin-protein ligase activity; Cellular component=intracellular; Biological process=protein modification process
  Homolog annotation: Hit_ID=Q9AUK0; Match level="QueryCoverage=29%, HitCoverage=13%, E-value=6e-12, Identity=43%"; Hit description =Putative ubiquitin protein ligase
METLQGHKDDFPAASAGMGDSGESLYWCDDSKLDFKRFVETISVLYHPYISALENHSSQSKSITQADDFFFITASAITIAVRPFYLTNYDVEVPGALDVNHAAEQFFVYLLTIPWLVQHLPPVLLPALKHKSILFPCFQTLLTLKEKVLPEMSEFVKSEILVSFKAIPPVGWALTNSICLATGNEIESFNQGLEYALYVRVVTTLPEALLACLDNIGWVKRKKKSLQTDVESSTQPVDTIQHEGEATNESLIMSYMDQFRPVCQQWHLKNLLASIDRDATNKAEAVLSNGLACLGKLELCDVALFYSNLLRIFSFLSPIRGSLSVLNMLAFTPGFL

SEQ ID NO: 130474 - protein, 131 aa, Glycine max
  Coding DNA Sequence Number=SeqID_13696
  Gene Ontology: Mol. function=binding; Biological process=metabolic process
  Homolog annotation: Hit_ID=Q94E87; Match level="QueryCoverage=74%, HitCoverage=40%, E-value=6e-14, Identity=38%"; Hit description=PPR -repeat protein-like
  Pfam annotation: Domain name=PPR; Domain location=78-112; Score=40.9; E_value=4.4e-09; Accession=PF01535.11; Description=PPR repeat
MSVGGFKTVTSLSSLLLSLFSNCQVNLVFLKVLHCDILKKGLESKVDVGSAITYMYAKCGRLDIAYEFFRGMFEKDSVCWNSMISSFSRNGKPEMAIDLFRQMGTIGAKFDSVTRNSICCLCCCKFNSTIL

SEQ ID NO: 130475 - protein, 91 aa, Glycine max
  Coding DNA Sequence Number=SeqID_13697
MLVRMIRTRLFAAVRVKSCPGMHSSCVIASLSGCIRTVGALQYQGWPGKKNGKMTLNPLKVWIWSPLKVRTHSPQKARESAALRRRGRVAL

SEQ ID NO: 130476 - protein, 196 aa, Glycine max
  Coding DNA Sequence Number=SeqID_13698
  Gene Ontology: Mol. function=RNA-directed DNA polymerase activity; Cellular component=intracellular; Biological process=RNA-dependent DNA replication
MSKWEHESFKEYAKWWSDLAAQVAPPMVEREMITMVVDTPPVFYYEKLVGYMPSSFIDLVFMGERIQYAQHQPRFLARIGNPSNPVPIQQRALSQRAPTQNSAPSQPRPAGNSNPSTSANPGRNFLVKKLTKFAPIPMSYVDLLPSLIANQMAVVTPGKIYQSPFPGWYNPIVTCPYHRGVLGHSIEQCVALKHKV

SEQ ID NO: 130477 - protein, 79 aa, Glycine max
  Coding DNA Sequence Number=SeqID_13699
MEEVGEIKARGTLRQKTKYDSNSLINPDLNEEVTMWLYVRSMSKTSIVTHGWAEQAAIPTMFGDCGGDESGSMIVVFLG

SEQ ID NO: 130478 - protein, 282 aa, Glycine max
  Coding DNA Sequence Number=SeqID_13700
  Homolog annotation: Hit_ID=Q1FX89; Match level="QueryCoverage=72%, HitCoverage=90%, E-value=5e-29, Identity=36%"; Hit description =Hypothetical protein precursor
MKMKKIIALALGSLLLAGCTTPAHNYVPQVKSFSIPQLNTVTTTYVGEDMIRQGVDASMEVLHFDSPTEIGSLGTYTVPAGDYVKTGDDAKSEYFLSTERTTGTQVPFRVMVNDPPQSIQVSKLGKEVCVVSIYGGTKCSSNVAYSKKKVNTERESSFQQTLIYNGKVGQKINIGYREFQGGLARAAFSNEVEYDLAESKTIRYKGAIVEIMDANNQSITFKGVIMIKKRVAPILLSLEQVEALQKIQQQERAKSPLGVAPTIHVIARGLMDKAIAQFAEGA

SEQ ID NO: 130479 - protein, 56 aa, Glycine max
  Coding DNA Sequence Number=SeqID_13701
MTVYHFFNYAILTFGPHAVFYFATPLSEYDTLRTSIKAVVVYLATTLVKVGEYTEF

SEQ ID NO: 130480 - protein, 49 aa, Glycine max
  Coding DNA Sequence Number=SeqID_13702
MLNPAKFITEMSISRLAGGEEGTVRLWGERICGGDYEALGSVAGVLKGA

SEQ ID NO: 130481 - protein, 55 aa, Glycine max
  Coding DNA Sequence Number=SeqID_13703
MTMVINRCSWSQITNVECCFSSNEGGRETSRFIAKMKTKVVNNIDIPGTQAQDHL

SEQ ID NO: 130482 - protein, 89 aa, Glycine max
  Coding DNA Sequence Number=SeqID_13704
MIVTGSPSSLLKLEISSFPLSSNSVLHHKRRETKHVLMEALALYEYQREPNHEMWRDSHLIRVQDIERRMRQLEGKRLRDAILPRKGIG

SEQ ID NO: 130483 - protein, 154 aa, Glycine max
  Coding DNA Sequence Number=SeqID_13705
  Homolog annotation: Hit_ID=Q6CQF2; Match level="QueryCoverage=26%, HitCoverage=50%, E-value=1e-10, Identity=73%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWVGRCGCSVEPRHGIESSKWAIFGKQNWRCGMNRKLGYGAQLRANLDPTKGV

SEQ ID NO: 130484 - protein, 127 aa, Glycine max
  Coding DNA Sequence Number=SeqID_13706
MAAQLIHDRVVMECLEGVWETLEGNEKCRFVGTIRLTVVSLVHPEEPARTLQQPVEWILPTPTPYQLVEPVQVIEMSSSEEDLEKDPEELPPEPAMDALDLPEDDEDPLPDVDFLEDIMSVSEVDST

SEQ ID NO: 130485 - protein, 175 aa, Glycine max
  Coding DNA Sequence Number=SeqID_13707
MHKAVQKAISLKHQKIQSKIDRCKKNKKFLDDLNKNALKYEDIWKTKILRIEESKFESMNKLQNQLEKVESLTQDLEEGLEFPFRNLINTRGIVRSCACPINSSADPVATTEGEYEEVIQLCGKTLDSVEQNACPLDAGCKVTDLDDSQLSKGFYFRIWRCSMMLKAYIHLGLAV

SEQ ID NO: 130486 - protein, 113 aa, Glycine max
  Coding DNA Sequence Number=SeqID_13708
MYHSQTSMLIFLFTFGCVALCILSLKIRTVIIVIKRKELALRCPYQTRAKARVMGEMMEAMKEQMTIMMEAMMIMRRMMKVNAAIVVAACTATEVDPTHPSSFNQVNHPTSDM

SEQ ID NO: 130487 - protein, 71 aa, Glycine max
  Coding DNA Sequence Number=SeqID_13709
HTPPLLGFAKNCLWREKYASHEALQNGGFNPFSFSLTFGNSIRAIRGKIEESQKIARDAAIAVGRHVIPLR

SEQ ID NO: 130488 - protein, 126 aa, Glycine max
  Coding DNA Sequence Number=SeqID_13710
APQRRRPTTSARRQRTAVVVAEDVDHVDHTADEVHEEPQGPVPDDVRVDTQGFLSKPKDTSVLTDYVYHVGARVWEEELPITGTFHTFNALDVDQVVDLLVELLEVSTQEAKDKTLQCQGAYVHLV

SEQ ID NO: 130489 - protein, 86 aa, Glycine max
  Coding DNA Sequence Number=SeqID_13711
  Homolog annotation: Hit_ID=Q9SDN4; Match level="QueryCoverage=40%, HitCoverage=6%, E-value=1e-07, Identity=71%"; Hit description=Amino acid/peptide transporter
MSVVNVWPSSELQLILVPILPPDYMKETFLLKETSAYVNSGRYSGGVAPIPDGHLFSEAVSCRGWSGRYRGGTGSGAVFHATTSKH

SEQ ID NO: 130490 - protein, 78 aa, Glycine max
  Coding DNA Sequence Number=SeqID_13712
MYIVVVQQGQDHLGLPSGVKTKHERQKPIKVLKDERKQGWGHDRPIVTFLCAKQAGNVAARQPRILYILQLSFTICLF

SEQ ID NO: 130491 - protein, 133 aa, Glycine max
  Coding DNA Sequence Number=SeqID_13713
  Gene Ontology: Mol. function=RNA-directed DNA polymerase activity; Cellular component=mitochondrion; Biological process=RNA-dependent DNA replication
  Homolog annotation: Hit_ID=Q1SAS4; Match level="QueryCoverage=98%, HitCoverage=5%, E-value=2e-48, Identity=68%"; Hit description=RNase H, putative
MEAVLPFEVEVPSQNILAESGLEESEWAQTHYDQLNLIEGKCLTAISHGRLYQQRIKNAFDKKVHPRKFNEGDLVLKKISHAVKDNRGKWAPNYEGPFVVKRAFSGGALVLTNMDGEKLPSPVNSDVVKRYYA

SEQ ID NO: 130492 - protein, 101 aa, Glycine max
  Coding DNA Sequence Number=SeqID_13714
MEEKKPKLNEIKMKAKKQKGIKSLGFGNLPIEERRTDEQQMRNGEERRKTITNLLTETSRKRYGSTSAWIFSQKQFFSPKIAEMHSQEDKGPLEQPPFAFL

SEQ ID NO: 130493 - protein, 153 aa, Glycine max
  Coding DNA Sequence Number=SeqID_13715
MAPKHMEQLTQKIRDQLEESITEKVTRQVLTLPPEPVDGRSATHVSTKENVVIWFCSLHNRLDFLKGIIIRSDIFFNTFTLALFGNINILIVQFTSMFVLNNALKGFDDTPQSKSKATARWIVVKCNRQKGSTACEYYVMHRMSTNNLRKFQE

SEQ ID NO: 130494 - protein, 105 aa, Glycine max
  Coding DNA Sequence Number=SeqID_13716
MTDPLDESISCFLIRVNPWVLVTLTIRGLHALTSRGLHVLALRGLHALTLGTSYPHRQRTTRPRQQRASRPHLEEDYTSSPTEGCTPSPLEDYTSSPTEGCTPSS

SEQ ID NO: 130495 - protein, 75 aa, Glycine max
  Coding DNA Sequence Number=SeqID_13717
MASSTLHPPDSFEEQATQGSFVPHGRQDVLAAAIGHPEHPGHVRAAGAGVTIKQYFGSAPRTSRSASSMPPDELQ

SEQ ID NO: 130496 - protein, 124 aa, Glycine max
  Coding DNA Sequence Number=SeqID_13718
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8VNZ4; Match level="QueryCoverage=98%, HitCoverage=14%, E-value=3e-48, Identity=79%"; Hit description =Putative two-component sensor protein
MPVRHHGHPQHPGCRCRAPGAHAAGLAARPGRSGAGRNRPQAPARAPGPHPPECHSRQPAHQPAADGRHHHAPAGQGRARAGGRGRDHQRNPAPYRAAGGAAPAHRDRPRGAPCPHRGRSRVAA

SEQ ID NO: 130497 - protein, 194 aa, Glycine max
  Coding DNA Sequence Number=SeqID_13719
MAYHASSKANQNSMKNHEIHFGKNYSIENFQGGQELQPYYQNEAERGSNLDKLLMKFMETTKSTQQALQSVEIQVGELAEAVTQFMSRREKSFVEAEAQEKSPVKEHESREKDKEKDEEQAQQQWEKYSTIENQQENILQSNSLPHQLIDKKGRQGEHEETLSAILSLITNTFLEMIWNVLPDYMKFMEFLAKR

SEQ ID NO: 130498 - protein, 80 aa, Glycine max
  Coding DNA Sequence Number=SeqID_13720
MVGYTPSSFANLVFTDERIKAAITPAKVHQPPFLREYDSNATCACHGEALGRSIEHGRALKRKVQDLTDAGWLKFEENRV

SEQ ID NO: 130499 - protein, 61 aa, Glycine max
  Coding DNA Sequence Number=SeqID_13721
MTKARQKRENGGDACHPARPGELGCFLQKQPPSGGIFWKAKVGLVAICTPIFTKHTPAFFW

SEQ ID NO: 130500 - protein, 163 aa, Glycine max
  Coding DNA Sequence Number=SeqID_13722
HALRCPHRTCARARVMGKVEEVQEKMKADMEAMKEKMAAIMEAMMSMKKIMEANAVAVAATSIVAKVNPKSPSGLNQMNHPTSTMVGKDLGSTGGPHYAQSQNKHAIPPYGLPPNYTPPNVAYTPNKNVNNSTPIPIESQQPRMIMHMSLKPWGRHMKFPTTI

SEQ ID NO: 130501 - protein, 259 aa, Glycine max
  Coding DNA Sequence Number=SeqID_13723
  Pfam annotation: Domain name=Transposase_23; Domain location=159-229; Score=10.7; E_value=7.7e-05; Accession=PF03017.5; Description =TNP1ENSPM transposase
MARTKKTGETMTEAAKEIAEKIDSFEEQATQGSFVPHGRQDVLAAAIGRPEHPGCVRAAGASVTIKQYFGSAPRTSHIASSMPPDELQQLTQQIRDQLEESITEKVTRQVMASFSHLQSQMQSQGVAVPPEPVVGPGPSIPRVITKGSCVDPSGNDPEIGDSDKCGLYIKADPARLVAIGRVYEGSTAVHNTPLLPGQVKVSVEEVRDADAPVPVPTDEVSLVGHALHTFLAWATHLVKSLSQQVAVSPPKPPPKPDPE

SEQ ID NO: 130502 - protein, 130 aa, Glycine max
  Coding DNA Sequence Number=SeqID_13724
MTGPLDESISCFLIRVDPWVLVPIFFRGLRVLTSLILEGANCANTTREGGYHVVTMHTMARFHSCHCKETSADRAYQHDHSYTDIGRAHKTPSGPKEVQQGPGSPALVMGLYQSYRVPVPPGKVMPLRHR

SEQ ID NO: 130503 - protein, 36 aa, Glycine max
  Coding DNA Sequence Number=SeqID_13725
VPCYKVMTKDNDCTTKPYTRAMKGTMQKPQANLGAD

SEQ ID NO: 130504 - protein, 314 aa, Glycine max
  Coding DNA Sequence Number=SeqID_13726
  Gene Ontology: Mol. function=hydrolase activity
  Homolog annotation: Hit_ID=Q1SP02; Match level="QueryCoverage=81%, HitCoverage=65%, E-value=2e-32, Identity=31%"; Hit description=IMP dehydrogenase/GMP reductase
  Pfam annotation: Domain name=DUF1723; Domain location=96-145; Score =56.0; E_value=1.3e-13; Accession=PF08330.1; Description=Protein of unknown function (DUF1723)
MTGAVDAIQTEGVATDGSLGSPAADEGFPGGPRDPSILTDFAVHVAHSIWSGQEQPDLKLVSHGRKVDKIGRPAPEIEGLIAGTELSPLIRCSIITTDSGLISAFIERWHRKTSTFHLPVGELTIMLDDVASLLHLPITGALHTFEPLVTSDAIGLLTELLEAFKNLAQAGGFAWGAATLVHMHEHLNDASQASTRQLGGYITLLQCWIYEHFLTVHTCVVHDAYDEGSPQACRWLTGKAHMTGIKGAPYRRRLDALTVTDVCWMSYAEHRGVRGFDLISSYTSQLRWGQIVVYVRPERVLRQFGYLQTVPPPP

SEQ ID NO: 130505 - protein, 133 aa, Glycine max
  Coding DNA Sequence Number=SeqID_13727
SLILKDELKVCSWSKRNLSQRLCETETNMLAIVSKYQEELNLATAHGHKMADEYAQVYAEKKARGRVIDSLHQEVTMWMDRFALTLNGSQELPRLLGKAKAMADTYSAPEEIHRLLSYCQYMIDLMARIIRNC

SEQ ID NO: 130506 - protein, 147 aa, Glycine max
  Coding DNA Sequence Number=SeqID_13728
MALRKRARTEDIPSSSTPAPPLQELAHNRSILTMEHFLEQVAWHEAQLPLVRPNEASPPEPTPVQVDPKQGGPQSPVVNPPSSPKREVVPPSPPLIVISDASSDEAAAPPDSPVGETADPLTSPIEGIADLSDSSSGEVVAPTDSPV

SEQ ID NO: 130507 - protein, 86 aa, Glycine max
  Coding DNA Sequence Number=SeqID_13729
MTLLLSNILPSDRNTNLPLQKYQLVCVVPTWGLHPQDTQWTRKSPTGPWGFQLCKGIRPPTDQAFIKKYCVPRQAQGETPQQHWDG

SEQ ID NO: 130508 - protein, 47 aa, Glycine max
  Coding DNA Sequence Number=SeqID_13730
MPKLMEADVQFESPTCPSNTAVDPELNGEDQVLCSVSIAPLRPTTES

SEQ ID NO: 130509 - protein, 179 aa, Glycine max
  Coding DNA Sequence Number=SeqID_13731
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=9e-21, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPLNESISCFLKRVHPWVLVPSPSEDYTSLPSEDYTFSPSEDNTSSPTEDYTFSPSEGCTPSPSEGYASSPSEGYMHALRGLHVLTFRGLHALAFRGLHGLTFRGLHILTFRGLHVLAIRGLHVLTFRGLHALTFRGLHAFTFRGLHVLAFRGLHTLSFSGMHALTFRGLDALAFKG

SEQ ID NO: 130510 - protein, 245 aa, Glycine max
  Coding DNA Sequence Number=SeqID_13732
  Homolog annotation: Hit_ID=Q83Z96; Match level="QueryCoverage=88%, HitCoverage=94%, E-value=1e-51, Identity=47%"; Hit description =Microcin M activity protein McmM
  Pfam annotation: Domain name=Abi; Domain location=146-241; Score =79.1; E_value=1.4e-20; Accession=PF02517.7; Description=CAAX amino terminal protease family
MGINCPRYLALLLFRQSLLKTKDGYMVDNAFIARTRAVNGCFSMFLLMFLITFIPLFLENRAALMRQGLLLPLLYGMEFVAIFSLYLLFFRRREGLGKGEVKRSDFALLLFALLVIQFIFPRLMGVEKTETWVTEQVALPGEILALNAALLVFVVPVYEEIVFRGCLFNALMYWFNDKVLWAALTVSVIFAVLHTQYTDWRTLAALVLISLVLTAARVKSKGIYLPIGLHMTMNGVVMAASYALS

SEQ ID NO: 130511 - protein, 219 aa, Glycine max
  Coding DNA Sequence Number=SeqID_13733
  Gene Ontology: Mol. function=oxidoreductase activity; Cellular component=integral to membrane; Biological process=carotenoid biosynthetic process
  Homolog annotation: Hit_ID=Q2Y8E1; Match level="QueryCoverage=59%, HitCoverage=30%, E-value=3e-40, Identity=63%"; Hit description =Pyridine nucleotide-disulphide oxidoreductase, class-II
  Pfam annotation: Domain name=Seleno_W_rel; Domain location=120-217; Score=89.0; E_value=1.5e-23; Accession=PF05169.3; Description =Selenoprotein W-related family
GSGWCDVDKLTLQHKHWPDIFAVGDCCSTPNAKTLAAARKQVVVAAENVAALIQGAPLTAHYDGYGSCPLTVEKGKVVLAEFGYDGKLLPTFPLLDATQPSRLAWWLKAWFLPRFYWAGMLRGTLDYLARRGHHRLQVPQADCKPLPLPLLNTFGDDLASVTLMPGTGGVYQISVDGVMIWDRKIDGGFPDAAQLKQRLRDHSFPDRSLGHSDGKKARH

SEQ ID NO: 130512 - protein, 216 aa, Glycine max
  Coding DNA Sequence Number=SeqID_13734
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-33, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILVIRGQHFLAFRGLHALAFRGLHVLAIRGLHVLAFGGLHILTIEGLHVLALRGLQVLTFRGLHSLAIKGLRVLVFRGLRALAFVGLHVLNFRGLHVLAFRGLHTLAIRPLHVLTFTGLYVVAFRELQVLAFGGLDAIAVRGQHVLAFRGQHVLTFRGIHILTFRGLHVLAFSGLHVVTFKGLHVLTFRGLHVLAFRGLDILTFKGLHILAFR

SEQ ID NO: 130513 - protein, 156 aa, Glycine max
  Coding DNA Sequence Number=SeqID_13735
  Homolog annotation: Hit_ID=UPI00005F72E4; Match level="QueryCoverage =95%, HitCoverage=96%, E-value=3e-46, Identity=59%"; Hit description =COG3516: Uncharacterized protein conserved in bacteria
  Pfam annotation: Domain name=DUF770; Domain location=9-148; Score =173.0; E_value=7.5e-49; Accession=PF05591.2; Description=Protein of unknown function (DUF770)
MAPTKSSGQKFIARNRAPRVQIEYDVEIYGAERKIQLPFVMGVMADLVGKPLEPQASLDERKFLEIDIDNFDERMKALKPRAAFQHGRFLTGCDCPQSRTAEQPVEARTQLSNLLTYMDGKNGAEELIGKILQDPTLLKALTHLPKQDESAEGKEE

SEQ ID NO: 130514 - protein, 338 aa, Glycine max
  Coding DNA Sequence Number=SeqID_13736
  Homolog annotation: Hit_ID=UPI00005F72E5; Match level="QueryCoverage =90%, HitCoverage=97%, E-value=5e-64, Identity=45%"; Hit description =COG3515: Uncharacterized protein conserved in bacteria
  Pfam annotation: Domain name=ImpA-rel_N; Domain location=54-114; Score=67.2; E_value=5.1e-17; Accession=PF06812.2; Description=ImpA -related N-terminal
MTMNIDALLAPVSSDNPCGDNLEYHADYQAMEQASTGKAEQQFGETIIPAESADWNKVEKLAIDLLSRSKDLRVMLALTHAWTELKGLPGYAQGLKLIEQALLLYWEPLWPRLEEYGEQDPFYRINAVALLGDKSALSSAVRQSWLLRYASDGITLRDAAALCDGSKTEVADYPGGLPRLTDELARGEQPGIEAVLQISERLQTITETLTEQLGEAAVPELSQLRRQIAMIAERCQATDLSTLQPAVVTEPPPEPSVAAPAAAVRTADWRSVQLSSRADAQLMLEKVKHYFAQHEPSHPAPLMIDRVQRLIELDFMDIIRDLAPDGVHQLENIFGRRD

SEQ ID NO: 130515 - protein, 73 aa, Glycine max
  Coding DNA Sequence Number=SeqID_13737
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=63%, HitCoverage=24%, E-value=1e-17, Identity=89%"; Hit description =Anaphase-promoting complex subunit 10
  Pfam annotation: Domain name=APC10; Domain location=3-73; Score= -88.3; E_value=0.084; Accession=PF03256.7; Description=Anaphase -promoting complex, subunit 10 (APC10)
KPYTALGTVVGAQSSKLSTLPVNKLDESYTPSKVSIRAGDGFHNLKEIKTVELLKPTGWVYLSLSGVDPRFLA

SEQ ID NO: 130516 - protein, 62 aa, Glycine max
  Coding DNA Sequence Number=SeqID_13738
APGCPALAVAPAAGAPPVVPDPWALPKAPASGALPPCATCHVHSGGAWVGGALQLKNRPPRK

SEQ ID NO: 130517 - protein, 109 aa, Glycine max
  Coding DNA Sequence Number=SeqID_13739
AKRSYFKELLKVDVSLSELNALSECHPLSEASAHLTNRRNLEGNLSCRHALNTSLARSASRLSPSRLSASLALNESSLTRAKHENGAKRDIKELPCYGRLNPQLGILAE

SEQ ID NO: 130518 - protein, 70 aa, Glycine max
  Coding DNA Sequence Number=SeqID_13740
LEVDSGSYWKLKVEKWKLEVGSESYWKLMFEVGSYWKLKVENGSWKLEVGSKSYLKLKLEVGSWNLKFKI

SEQ ID NO: 130519 - protein, 88 aa, Glycine max
  Coding DNA Sequence Number=SeqID_13741
  Gene Ontology: Mol. function=DNA binding; Cellular component=nucleus
  Homolog annotation: Hit_ID=Q0PJB3; Match level="QueryCoverage=81%, HitCoverage=35%, E-value=2e-10, Identity=52%"; Hit description=MYB transcription factor MYB149
APVASVSISCPSCSATDGVVMEPWPEKEEEQVVLPSARSKPVLPVPPSSKMAELDLSGKSLSLKLPVSKPPISNENFGGIPLSVLLEG

SEQ ID NO: 130520 - protein, 100 aa, Glycine max
  Coding DNA Sequence Number=SeqID_13742
MPVKERSTGCQSTHCYLIALITIFTYRIIMLFGQSSYSESMSDNLARASSAREYQIELQQVGINTATSPMLNEIAFIFQSFRAKKFERGSLPCHSEGRSR

SEQ ID NO: 130521 - protein, 86 aa, Glycine max
  Coding DNA Sequence Number=SeqID_13743
MSTRRWPRHVTVRGRKRRAKVCLANNNAVKVRPSLQKKLRELQGAVPGSEGMDMHTLFQSIEQYILQLEAKVTVLREIVLFGSKQA

SEQ ID NO: 130522 - protein, 186 aa, Glycine max
  Coding DNA Sequence Number=SeqID_13744
  Gene Ontology: Mol. function=transcription regulator activity; Cellular component=nucleus; Biological process=regulation of transcription
MRNINSVKQEFLKKWIWGLRKYSSQKKNMSLMERKKAIKLSADLAMASTRNKSTRWSRALIANASRDGNNKVLTEHVSPSSSSPPQRPATRKSFRRIRSCRNMLIRRNRAAVHCRTKDRVVAASFVAKRLVQKRTRRLKSLLPGGESMDAVSLVEETLDYIQSLRAQVEVMRRLVTASEIMILNPS

SEQ ID NO: 130523 - protein, 67 aa, Glycine max
  Coding DNA Sequence Number=SeqID_13745
MKLEETLAQFMLVSMSNQKSTESAIKNLEVQVGQLATQLADRLSSSFGANTEKNPKEELMEACLWGF

SEQ ID NO: 130524 - protein, 70 aa, Glycine max
  Coding DNA Sequence Number=SeqID_13746
MSSAIYAVKDDNVFISKTSMSFVLELHRTRRPLCFDAILPPRVLDRIIKEDWARAAKEGPSVIMNLRVDF

SEQ ID NO: 130525 - protein, 219 aa, Glycine max
  Coding DNA Sequence Number=SeqID_13747
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=98%, HitCoverage=27%, E-value=2e-49, Identity=49%"; Hit description=DNA -directed DNA polymerase
MNSLYGRFGINPQSTKTEMCNKSKRDRIFRRPEFIDDVFLREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRIPFFNEKGKY

SEQ ID NO: 130526 - protein, 128 aa, Glycine max
  Coding DNA Sequence Number=SeqID_13748
MYCRKTGAYAKDEELLIHFFQEGLTGVAVTWIGYNYRTYAKRGHESFKEYTQRWKDLVAQVAPPMTKREMIIMMVDTFVEAKLHGESKMMTKVMTKSSKINQRKTQVNQEQFKSSRYNQEEFKTQEES

SEQ ID NO: 130527 - protein, 62 aa, Glycine max
  Coding DNA Sequence Number=SeqID_13749
GRRQRQRHRRNRDGMDDVNVKIPKFLGTYDLEAYLDWKMKVDQNFICNNFSGKEKAVGKLRI

SEQ ID NO: 130528 - protein, 161 aa, Glycine max
  Coding DNA Sequence Number=SeqID_13750
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1RXT3; Match level="QueryCoverage=98%, HitCoverage=35%, E-value=3e-42, Identity=51%"; Hit description =Glycoside hydrolase, family 17
MAPFEEGVFERDEVSVLHEDVGLVEEALGGREGVEDDGGGVRGGNEDVVMEIGIDEGGVEGAEGEEEEGGDGGEGGEDLVAEGDGGDAGGGVVGGDVSADPRGGGGVGGGDGEELVVGDADGDVDVGTRQGAEDVGVGVVEADVGDLLVHEEVDQVRHRSH

SEQ ID NO: 130529 - protein, 121 aa, Glycine max
  Coding DNA Sequence Number=SeqID_13751
  Gene Ontology: Mol. function=protein serine/threonine kinase activity; Biological process=protein amino acid phosphorylation
  Homolog annotation: Hit_ID=Q49N12; Match level="QueryCoverage=77%, HitCoverage=15%, E-value=3e-23, Identity=42%"; Hit description =Putative receptor-like protein kinase 2
MVLVVFRKLVWKDFNIAYEAGGVGKEIKIPFPAYVNNNSLEIRFYWAGKGTNAIPYKSIYGPLISAISVTRELKDLNMQTSLFTNNFDISNKIGEGGFGPVYKVLGVLLWDMEQHKRLAHF

SEQ ID NO: 130530 - protein, 141 aa, Glycine max
  Coding DNA Sequence Number=SeqID_13752
  Pfam annotation: Domain name=zf-CCHC; Domain location=114-131; Score =19.4; E_value=0.00061; Accession=PF00098.13; Description=Zinc knuckle
MKAKYIVLSLLKNLEKIKNKLVRTSFVCMISTRQGYGYVSMNYYQYVDVVYTNKHILKAYFAQWWPLGNEATIPPSNDTWTLIPDPTIIRAKGQPKSARIRNGMDWLEPSEHRQKCSRCGAEGHNRRRCPMQSERGSCSFN

SEQ ID NO: 130531 - protein, 102 aa, Glycine max
  Coding DNA Sequence Number=SeqID_13753
MKREDARWHGHVGLEVKDLRWDGSWGSKVVELDHRTCNHSSRWRRMRGSDCVYSKEKKMKLQIRFFVYIRTMYFEFLQAITINRSSYPEKENNVPNPRVLYE

SEQ ID NO: 130532 - protein, 87 aa, Glycine max
  Coding DNA Sequence Number=SeqID_13754
MENNMACQSTIGSRICLAPSIVAPNQTFKPWGDGTYLYEMKENAKNESKSAQWKLGATAKGGSCKLVDGGVLWGKKWGEKWLHPSPL

SEQ ID NO: 130533 - protein, 113 aa, Glycine max
  Coding DNA Sequence Number=SeqID_13755
MDGDDAEVGDERGVLFYSGYTFFTRGKGNNEERTVVLTSTVDADDAPSTVDGGVALHGNLLNAPHNLFTISSSSRQQWFVAEYENGKLELAGERERSERSPTKYENGFEEEEE

SEQ ID NO: 130534 - protein, 88 aa, Glycine max
  Coding DNA Sequence Number=SeqID_13756
  Subcellular localization annotation: CTP_CleavageSite=43; ConfidenceScore=5.35e-01
SLLNNKEKNKMKDCKNTTGEDVSFTSRISQSLTNSSQALKPASASSSGGLIRAYVLITPMRLANLYNSSSSGFFLVLSPGVLRLADAR

SEQ ID NO: 130535 - protein, 116 aa, Glycine max
  Coding DNA Sequence Number=SeqID_13757
MYDQLNDASINSSRQLGGYITLLQCWIYEHFPQSRSPLLIRTTTRIPRVHRGSFDSLDTHRPFWLRLSIHGCRMMIYTTGGCTTRIISFQQVRCTLCQVSVPVTTWTGSSASRILS

SEQ ID NO: 130536 - protein, 56 aa, Glycine max
  Coding DNA Sequence Number=SeqID_13758
  Gene Ontology: Cellular component=microtubule organizing center; Biological process=microtubule cytoskeleton organization and biogenesis
  Homolog annotation: Hit_ID=Q9LF43; Match level="QueryCoverage=92%, HitCoverage=12%, E-value=9e-15, Identity=52%"; Hit description =Spindle pole body protein-like
MGLSLPGLPGFGGTTRTPISAWKAFPSRIVVLLSGKGYGWRQCCQDDAGENDTMCK

SEQ ID NO: 130537 - protein, 119 aa, Glycine max
  Coding DNA Sequence Number=SeqID_13759
MKRPGRECDVVASSGRNCSVAQCNGRTERTRKLGIHSTINYKALNNLMSRMVWNMLSLDGSFAGVLGKNKKSEHLSGQPSKVDKSVLKLQYEKIHLLILLSLSNEVLYEVFEEQSAFGL

SEQ ID NO: 130538 - protein, 104 aa, Glycine max
  Coding DNA Sequence Number=SeqID_13760
MDKEECKEVSVSSMRLAKKESHFAIKTKIKETSPLRQPPHLLLCKMIFVSTVTPLGLKVILQVKELLDEGLVRKSLNPCVLLVPKIGIINMKIQKKGFPRTLRE

SEQ ID NO: 130539 - protein, 180 aa, Glycine max
  Coding DNA Sequence Number=SeqID_13761
  Gene Ontology: Mol. function=cysteine-type peptidase activity; Biological process=proteolysis
  Homolog annotation: Hit_ID=Q1S7S2; Match level="QueryCoverage=91%, HitCoverage=40%, E-value=2e-10, Identity=31%"; Hit description =Peptidase C48, SUMO/Sentrin/Ubl1
  Pfam annotation: Domain name=Transposase_23; Domain location=40-112; Score=-11.1; E_value=0.019; Accession=PF03017.5; Description =TNP1ENSPM transposase
  Subcellular localization annotation: CTP_CleavageSite=25; ConfidenceScore=5.05e-01
MKNQFMTTQPKDKTDNVQHVDDVIRSGKGSCTVPSSNFPEGVSSCKLFVVPPSLLLVAHGKVHNIQSDTLHGRHLPDGHLKVSVEVVVELDASLSIPGDDDDIMTIKDAVGTFVAWPLNLIQVSFMAQIGAKVSKTKSSNITWSTIKCPRQSNNNDCGYYVYRYMKEIIKHFEGGSIPID

SEQ ID NO: 130540 - protein, 84 aa, Glycine max
  Coding DNA Sequence Number=SeqID_13762
MVLREHDVAPCGACKPWIFFINEVLCFLKINGSGMEKEERYKDKWAHTEPMGPKSILRLMRILGSSPASLVQSSWSLLSNVLGG

SEQ ID NO: 130541 - protein, 218 aa, Glycine max
  Coding DNA Sequence Number=SeqID_13763
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=99%, E-value=1e-26, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSYGFGMTGPLDESISCFLIRVDPWVLVPITFVGLHALTFRGSHVLTFRGLHALAIRGLHVLTFRGLHVLAIRGLHVLTFRGLHALAIRGLHVLTFRGLHALAIRGLHVLTFRRLHALAIRGLHVLTFVGLHALTFRGSHILTFRGLHALAIRGLHVLTFRGLHALAIRGLHVLANRGLHALTFRGLHVLTFKGLHVLAIRGLHVPHFQRGTCPHL

SEQ ID NO: 130542 - protein, 118 aa, Glycine max
  Coding DNA Sequence Number=SeqID_13764
  Subcellular localization annotation: CTP_CleavageSite=16; ConfidenceScore=5.04e-01
MCPSPLTRSSGLLLIELSSRSTVPPDRHRARHHSSQGMVGSRQQTYRRHLQSPSAHLQMLERCLRLVVDQQATKSKAKGSKIPHEKRNRKLKKASPLSPNRWPNQHPDIYHVQSFYKP

SEQ ID NO: 130543 - protein, 101 aa, Glycine max
  Coding DNA Sequence Number=SeqID_13765
METRGGLFYHGCRQQYWRETRAAIVNGEKLGDVEGVTIVNGETVDVDTVSLLPLARSMLSRCSQWRETFHISNVAIASCETPSRHAEDATVLKMAVLACNV

SEQ ID NO: 130544 - protein, 55 aa, Glycine max
  Coding DNA Sequence Number=SeqID_13766
MEQHQIKEQTSPSSVNIDLDKRMFKIQLKVSDDTIIATFTIFDRDAQQILDTRCK

SEQ ID NO: 130545 - protein, 81 aa, Glycine max
  Coding DNA Sequence Number=SeqID_13767
MGLHHFGHQSYGSRLSKILEGGGEYQLDGAQRFLLDALNAQMQRLLREKNEELYERIERLENRERHEDERRGGNGGGPRPN

SEQ ID NO: 130546 - protein, 312 aa, Glycine max
  Coding DNA Sequence Number=SeqID_13768
  Gene Ontology: Mol. function=transferase activity; Cellular component= membrane
  Homolog annotation: Hit_ID=Q9FFN2; Match level="QueryCoverage=59%, HitCoverage=45%, E-value=4e-62, Identity=58%"; Hit description =Similarity to limonene cyclase
  Subcellular localization annotation: CTP_CleavageSite=83; ConfidenceScore=5.38e-01
MGGVRWGQESSSSMKLLLFMVPLVLVAGLVFILGPNPSSWVSFANAPVLLGGSVITSSSSTSSGAVTVTDPSEAKQREGLVVVAVENRGGEKAISDDTDFNHSSTPPFSVQAIQTPQQPDEQNVSQLSPNVTPVNESYVPPERPKLQRKLSILDRTEAGLIQARAAISEARNGNQTQDKDYVPVGPMYNNANAFHRSYLEMEKQFKVFVYEEGEPPVFHNGPCKSIYSMEGNFIHAIEMNDQFRTRDPEKAHVFFLPFSVAMLVQFVYVRDSHDFGPIKKTVTDYVNVIAGRYPYWNRSLGADHFYLACHDW

SEQ ID NO: 130547 - protein, 182 aa, Glycine max
  Coding DNA Sequence Number=SeqID_13769
  Gene Ontology: Mol. function=structural constituent of ribosome; Cellular component=ribonucleoprotein complex; Biological process =translation
  Homolog annotation: Hit_ID=Q9FUL4; Match level="QueryCoverage=56%, HitCoverage=55%, E-value=2e-44, Identity=85%"; Hit description=60S ribosomal protein L24
  Pfam annotation: Domain name=Ribosomal_L24e; Domain location=3-73; Score=174.8; E_value=2.2e-49; Accession=PF01246.10; Description =Ribosomal protein L24e
MVLKTELCRFSGAKIYPGKGIRFVRGDSQVFLFANSKCKRYFHNRLKPSKLTWTAMYRKQHKKDIAQEAVKKRRRAAKKPYSRSIVGATLEVIQKKRAEKPEVRDAAREAALRALLFNVDYICLSESLMWCSEIKERIKKTKDEKKAKKAEVTAKSQKAGGKGISKGAMPKGPKLGGGGGKR

SEQ ID NO: 130548 - protein, 184 aa, Glycine max
  Coding DNA Sequence Number=SeqID_13770
  Gene Ontology: Mol. function=magnesium ion binding; Cellular component=membrane; Biological process=metabolic process
  Homolog annotation: Hit_ID=Q9FFN2; Match level="QueryCoverage=85%, HitCoverage=38%, E-value=5e-68, Identity=74%"; Hit description =Similarity to limonene cyclase
  Pfam annotation: Domain name=Exostosin; Domain location=1-151; Score =18.6; E_value=1.2e-10; Accession=PF03016.6; Description=Exostosin family
DVSFPEINLQTGSINGFIGGPSASGRPLLAFFAGGLHGPIRPVLLEHWENRDEDIQVHKYLPKGVSYYEMLRKSRFCLCPSGYEVASPRVVEAIYTGCVPVLISDHYVPPFNDVLNWKSFSVEVSVKDIPRLKEILLSISPRHYIRMQRRVGLVRRHFEEEGKEEARLREEGEREQPLQVSWGK

SEQ ID NO: 130549 - protein, 117 aa, Glycine max
  Coding DNA Sequence Number=SeqID_13771
MVLNLLSEEALEFSRLNLKHSRALPLKLCCLVVLKLSSPSSSQDHRVHRRRSANSSTTGLYSLEVSVDVDDIGFEVWQGVLGFVVKMHHASSLEMLSLAISYLSSVFGGSYYVPLEI

SEQ ID NO: 130550 - protein, 313 aa, Glycine max
  Coding DNA Sequence Number=SeqID_13772
  Gene Ontology: Mol. function=pyruvate kinase activity; Cellular component=coated vesicle membrane; Biological process=glycolysis
  Homolog annotation: Hit_ID=Q1S8N3; Match level="QueryCoverage=89%, HitCoverage=53%, E-value=1e-144, Identity=91%"; Hit description =Pyruvate kinase
  Pfam annotation: Domain name=PK; Domain location=1-296; Score=113.5; E_value=6.2e-31; Accession=PF00224.11; Description=Pyruvate kinase, barrel domain
ARFDFSWDDPEYHQETLENLKNAIKTTKKLCAVMLDTVGAEMQVVNKSEKAISLEADGQVVLTPDRGQEASSQILPINFDGLAKSMKKGDTIFIGQYLFTGSETTSVWLEVSEVKGQDVICTIKNSATLAGSLFTLHASQVHIDLPTLTDKDKEVISTWGVKNKIDFLSLSYTRHAEDVRQAREFLSKLGDLSQTQIFAKIENVEGLTHFDEILQEADGIILSRGNLGIDLPPEKVFFFQKSALYKCNMAGKPAVLTRVVDSMTDNLRPTRAEATDVANAVLDVKFNQPIGHRNMSNALVQCCACACMRSECK

SEQ ID NO: 130551 - protein, 455 aa, Glycine max
  Coding DNA Sequence Number=SeqID_13773
  Gene Ontology: Mol. function=DNA binding; Cellular component=nucleus; Biological process=regulation of transcription
  Homolog annotation: Hit_ID=Q1S8N2; Match level="QueryCoverage=85%, HitCoverage=85%, E-value=1e-120, Identity=56%"; Hit description =Homeodomain-like
MEPNALGGGIFPNISSGLLGVENPLQQQPNLQNQQNPHPLHHLQMVSYTTNHDTDTHHQQPPPQQSIKHGYNFSATKSNKSQITLSDEDEPVFTAEDNSSGDPKRKVSPWHRMKWTDTMVKFLIMAVYYIGDEAGSEGTDPTKKKASGLLQKKGKWKSVSGGMMEKGYYVSPQQCEDKFNDLNKRYKRVNDILGKGTACRVVENQTLLDTMDLSPKMKEEVRKLLNSKHLFFREMCAYHNSCGHNNNNNCGSTSNVQQSTDQPLHQHNHQQQQCLHSSENGVGSLRMLKEDEDEDIEDDDSDEFSDEDEDESGEGGSRGMEEDENDHVMRKRARNKGGFGVSSISSQMMQQLNGEVSGVLQDGGKSAWEKKQWMKKKVVQLEEQQVSYQMQAFEMEKQRLKWARFSSKKEREMEKDKLQNERKRLEIERMVLLLRHKELELVNVQQQHQQQHSST

SEQ ID NO: 130552 - protein, 308 aa, Glycine max
  Coding DNA Sequence Number=SeqID_13774
  Gene Ontology: Mol. function=protein binding; Biological process =ubiquitin cycle
  Homolog annotation: Hit_ID=Q10SN2; Match level="QueryCoverage=91%, HitCoverage=89%, E-value=4e-85, Identity=54%"; Hit description=F-box family protein, putative, expressed
  Pfam annotation: Domain name=F-box; Domain location=17-64; Score =27.2; E_value=5.9e-05; Accession=PF00646.23; Description=F-box domain
MGASLSNLGSNGSAAAPGLGDIPENCVARVFLHLTPPEICNLARLNRAFRGAASADSVWQTKLPRNYQDLLDLMPPERHRNLSKKDIFALLSRAVPFDDGNKEVWLDRVTGRVCMSISAKAMSITGIDDRRYWTWVPTEESSALKLDAEGALFDRFNTVAYLQQIWWFEVDGEFSFPFPADIYTLSFRLHLGRFSKRLGRRVCSYEHTHGWDIKPVRFELSTMDGQQASSECYLDETEPDDLHGNHKRGHWVDYKVGEFIVSGSEPTTKVRFSMKQIDCTHSKGGLCVDSVFIIPRDLRERKRSGILK

SEQ ID NO: 130553 - protein, 202 aa, Glycine max
  Coding DNA Sequence Number=SeqID_13775
  Gene Ontology: Mol. function=pyruvate kinase activity; Cellular component=mitochondrion; Biological process=glycolysis
  Homolog annotation: Hit_ID=Q2QXR8; Match level="QueryCoverage=92%, HitCoverage=35%, E-value=2e-94, Identity=94%"; Hit description =Pyruvate kinase family protein, expressed
  Pfam annotation: Domain name=PK_C; Domain location=69-199; Score =103.2; E_value=7.6e-28; Accession=PF02887.6; Description=Pyruvate kinase, alphabeta domain
MSAVCGTKELKVNVRSDAILLGAETLRGLYPVETISTVGKICAEAEKVFNQDLYFKKTVKYVGEPMTHLESIASSAVRAAIKVKASVIICFTSSGRAARLIAKYRPTMPVLSVVIPRLKTNQLKWSFSGAFEARQSLIVRGLFPMLADPRHPAESTSGTNESILKVALDHGKASGVIKSHDRVVVCQKVGDASVVKIIELED

SEQ ID NO: 130554 - protein, 185 aa, Glycine max
  Coding DNA Sequence Number=SeqID_13776
  Gene Ontology: Mol. function=protein kinase activity; Biological process=protein amino acid phosphorylation
  Homolog annotation: Hit_ID=Q1S8N8; Match level="QueryCoverage=76%, HitCoverage=29%, E-value=2e-27, Identity=39%"; Hit description =Protein kinase
RGGPTEGVVSGEAYIAEFGEHGIGDVAAEFVVGDVEYGEIKEGSGKLCGDWAADVVVGDVKAEEKAERGYLRRNLAGEIVAGEGINWAAEVEGRESEAHYSAVWGAFHAAPRGGAGVGAGPVGEEVAVGVGLETEFGESECIILPCSLCSNTEDAQAQGQCQEYGTMTNFFHVMVWEGRERVVER

SEQ ID NO: 130555 - protein, 570 aa, Glycine max
  Coding DNA Sequence Number=SeqID_13777
  Gene Ontology: Mol. function=receptor activity
  Homolog annotation: Hit_ID=Q2QXR0; Match level="QueryCoverage=86%, HitCoverage=89%, E-value=3e-58, Identity=34%"; Hit description =Expressed protein
  Pfam annotation: Domain name=DUF668; Domain location=396-488; Score =147.3; E_value=4.1e-41; Accession=PF05003.3; Description=Protein of unknown function (DUF668)
MGGETMNGSWFSVLWPVSRKSASDNKAVVGVLALEVAGLMLKVVNLWQSLSDAEVLSLREGIVNSVGVKTLVSDDDDYLMELALNEILDNFQSLARSVARLGKKCVDPVYHQFEHFVHNPAQNYFQWSEWEYRWKKMERKVKKMEKFVSAMTQFCQEVEVLAEVEQTFRRMQANPDLHKVKFLEFQKKVMLHRQEVRNLRDMSPWSRSYDYVVRLLARSLFTILERIILVFAINQPPTVQEQNDYQHMNANNLLRSHSFSVMHSSVHPSENDLYGFNSGPVGGRPVSKSGFLVDKGRRKKKQQQALHEPALFRKNLHSESKQLGHIVAFKGCMSAANNSPVIQSCMQTNGGSMRLTDCQLKSFDKMKTVDKLSLSNRIRIYSKLSIKNWLKPVSLTLGDAALALHYANMIVLIERMLSSPHLVDLAARDDLYNMLPTTVTTALRAKLKCHAKSKSSSNAHDANPAAEWSPVLAQILEWLAPLAHNMLSWHSERNFEKEHSVFNANVLLVQTLYFANQAKTEAAIIDLLVGLNYVCRIDTKVGTRDTLDCVSTRSFNGVHLRKNGMYTEFL

SEQ ID NO: 130556 - protein, 484 aa, Glycine max
  Coding DNA Sequence Number=SeqID_13778
  Gene Ontology: Mol. function=protein transporter activity; Cellular component=nuclear pore; Biological process=intracellular protein transport
  Homolog annotation: Hit_ID=Q94KB0; Match level="QueryCoverage=96%, HitCoverage=93%, E-value=1e-117, Identity=48%"; Hit description =Importin alpha 1
  Pfam annotation: Domain name=Arm; Domain location=121-163; Score =52.5; E_value=1.4e-12; Accession=PF00514.13; Description =Armadillobeta-catenin-like repeat
  Pfam annotation: Domain name=Arm; Domain location=165-207; Score =20.4; E_value=0.0063; Accession=PF00514.13; Description =Armadillobeta-catenin-like repeat
  Pfam annotation: Domain name=Arm; Domain location=208-243; Score =18.4; E_value=0.025; Accession=PF00514.13; Description=Armadillobeta- catenin-like repeat
  Pfam annotation: Domain name=Arm; Domain location=245-285; Score =25.1; E_value=0.00025; Accession=PF00514.13; Description =Armadillobeta-catenin-like repeat
  Pfam annotation: Domain name=Arm; Domain location=287-329; Score =23.3; E_value=0.00084; Accession=PF00514.13; Description =Armadillobeta-catenin-like repeat
  Pfam annotation: Domain name=Arm; Domain location=331-374; Score =24.4; E_value=0.00042; Accession=PF00514.13; Description =Armadillobeta-catenin-like repeat
  Pfam annotation: Domain name=Arm; Domain location=376-416; Score =29.2; E_value=1.4e-05; Accession=PF00514.13; Description =Armadillobeta-catenin-like repeat
  Pfam annotation: Domain name=Arm; Domain location=78-119; Score=35.7; E_value=1.6e-07; Accession=PF00514.13; Description=Armadillobeta -catenin-like repeat
  Pfam annotation: Domain name=HEAT; Domain location=127-165; Score =14.0; E_value=0.53; Accession=PF02985.12; Description=HEAT repeat
  Pfam annotation: Domain name=HEAT; Domain location=209-245; Score =14.1; E_value=0.52; Accession=PF02985.12; Description=HEAT repeat
  Pfam annotation: Domain name=HEAT; Domain location=382-418; Score =9.6; E_value=2.9; Accession=PF02985.12; Description=HEAT repeat
  Pfam annotation: Domain name=HEAT; Domain location=84-121; Score=4.5; E_value=12; Accession=PF02985.12; Description=HEAT repeat
  Pfam annotation: Domain name=HEAT_PBS; Domain location=106-143; Score= 2.7; E_value=43; Accession=PF03130.6; Description=PBS lyase HEAT-like repeat
  Pfam annotation: Domain name=HEAT_PBS; Domain location=150-187; Score= 13.5; E_value=0.78; Accession=PF03130.6; Description=PBS lyase HEAT -like repeat
  Pfam annotation: Domain name=HEAT_PBS; Domain location=361-398; Score= 5.8; E_value=16; Accession=PF03130.6; Description=PBS lyase HEAT-like repeat
  Pfam module annotation: Pfam domain module=Arm::Arm::Arm::Arm::Arm::Ar m::Arm::Arm::HEAT::HEAT::HEAT::HEAT::HEAT_PBS::HEAT_PBS::HEAT_PBS; Domain location=121-163::165-207::208-243::245-285::287-329::331 -374::376-416::...
  Pfam module annotation: Domain location=78-119::127-165::209-245::382- 418::84-121::106-143::150-187::361-398
MSLQPGSSSASEKRKRSYHSRTDPYKDTLLSKRRESFAVYSKEELLEDIPVMKQRLWSESAAEQFEGTIHFRKLLANGHPPIDEVIKADVVPRIVEFLESDGLHQLQFEALWVLTNIASGTSQHKRAVVDHGAVPKLVKLLSPTNNYDDVREQAVWVLGNIAFDSPCYSDLILNEHALLPLLSLLNPPSPILSMLRITTWTLSNLVRGKPPVKTLMPVLKTLIHNSDEEVVSDACWALFYISDVSSDTTKTIVEAEFCVKLVDLLTNSSLTVIVPVLRTLGNIVAGDDAQTQLTIDKGLITGLSKLLLISRDKEQIYKETCWTISNITAGNGAQIQAIIDAHIIPVLVAIVIYRKDCEIDLKKEVAWAISNATRGSHDQIRYLVDQRCIQALCDLLAYPNSEIVSNCLEGLENILVVGEVDKDIDRGNSFAERVDKCDGWGMIENLKSHDKKEIKERAARIFKTFWAEDDLVEDTDLQDDLGRG

SEQ ID NO: 130557 - protein, 80 aa, Glycine max
  Coding DNA Sequence Number=SeqID_13779
MKIAFNWERKPMLTNVLLLTVNIGRISSCSSEVSWDDDVNSNSIQEGGALFSLGKGGSANVGGAGRAGTVGWVSGVASNF

SEQ ID NO: 130558 - protein, 33 aa, Glycine max
  Coding DNA Sequence Number=SeqID_13780
MAVVDRIRGTEGTRKDSRKGRMPKTIKEIHHLL

SEQ ID NO: 130559 - protein, 232 aa, Glycine max
  Coding DNA Sequence Number=SeqID_13781
  Gene Ontology: Mol. function=transferase activity; Cellular component= membrane; Biological process=electron transport
  Homolog annotation: Hit_ID=Q9FNI7; Match level="QueryCoverage=98%, HitCoverage=42%, E-value=1e-95, Identity=68%"; Hit description =Glucosyltransferase-like protein
MDRFSSSTILPEAFQGAKDDFTMQLALVWNQIKAPLIVPLLRITVFLCLIMSVMMFIERVYMGIVITLVKLFGRKPEKRYKWEPMKDDIELGNSSYPMVLVQVPMYNEREVYQLSIGAACGLSWPSDRIIIQVLDDSTDPTIKELVQLECQRWASKGVNIKYEVRDNRNGYKAGALKEGMKRSYVKQCDCVAIFDADFQPEPDFLWRTVPFLVHNPELALIQARWKFGNHFF

SEQ ID NO: 130560 - protein, 676 aa, Glycine max
  Coding DNA Sequence Number=SeqID_13782
  Gene Ontology: Mol. function=helicase activity; Cellular component =mitochondrion; Biological process=translation
  Homolog annotation: Hit_ID=Q6Z277; Match level="QueryCoverage=99%, HitCoverage=85%, E-value=1e-104, Identity=27%"; Hit description =Putative fertility restorer homologue
  Pfam annotation: Domain name=PPR; Domain location=127-161; Score =44.9; E_value=2.8e-10; Accession=PF01535.11; Description=PPR repeat
  Pfam annotation: Domain name=PPR; Domain location=162-196; Score =42.6; E_value=1.3e-09; Accession=PF01535.11; Description=PPR repeat
  Pfam annotation: Domain name=PPR; Domain location=22-56; Score=8.4; E_ value=0.75; Accession=PF01535.11; Description=PPR repeat
  Pfam annotation: Domain name=PPR; Domain location=225-259; Score =38.5; E_value=2.2e-08; Accession=PF01535.11; Description=PPR repeat
  Pfam annotation: Domain name=PPR; Domain location=260-294; Score =45.2; E_value=2.3e-10; Accession=PF01535.11; Description=PPR repeat
  Pfam annotation: Domain name=PPR; Domain location=295-329; Score =37.9; E_value=3.4e-08; Accession=PF01535.11; Description=PPR repeat
  Pfam annotation: Domain name=PPR; Domain location=330-364; Score =48.8; E_value=1.8e-11; Accession=PF01535.11; Description=PPR repeat
  Pfam annotation: Domain name=PPR; Domain location=365-399; Score =35.1; E_value=2.4e-07; Accession=PF01535.11; Description=PPR repeat
  Pfam annotation: Domain name=PPR; Domain location=400-434; Score =29.0; E_value=1.6e-05; Accession=PF01535.11; Description=PPR repeat
  Pfam annotation: Domain name=PPR; Domain location=435-469; Score =55.4; E_value=1.9e-13; Accession=PF01535.11; Description=PPR repeat
  Pfam annotation: Domain name=PPR; Domain location=470-504; Score =44.3; E_value=4.3e-10; Accession=PF01535.11; Description=PPR repeat
  Pfam annotation: Domain name=PPR; Domain location=505-538; Score=8.8; E_value=0.67; Accession=PF01535.11; Description=PPR repeat
  Pfam annotation: Domain name=PPR; Domain location=539-573; Score =27.7; E_value=4.2e-05; Accession=PF01535.11; Description=PPR repeat
  Pfam annotation: Domain name=PPR; Domain location=57-91; Score=17.2; E_value=0.06; Accession=PF01535.11; Description=PPR repeat
  Pfam annotation: Domain name=PPR; Domain location=574-608; Score =33.8; E_value=5.8e-07; Accession=PF01535.11; Description=PPR repeat
  Pfam annotation: Domain name=PPR; Domain location=609-643; Score =34.9; E_value=2.8e-07; Accession=PF01535.11; Description=PPR repeat
  Pfam annotation: Domain name=PPR; Domain location=92-126; Score=41.8; E_value=2.4e-09; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=127-161::162-196::22-56::225-259::260-294::295-329::330 -364::365-399::...
  Pfam module annotation: Domain location=400-434::435-469::470 -504::505-538::539-573::57-91::574-608::609-643::92-126
MLDEATDLYSTMRKDGFVPSTRSVNRLLRTLVDSRHFEKTLAVFADVIDSGTRPDAVAYGKAVQAAVMLKDLDKGFELMKSMVKDGMGPSVFAYNLVLGGLCKVRRIKDARKLFDEMIQRNMVPNTVTYNTLIDGYCKVGGIEEALGFKERMKEQNVECNLVTYNSLLNGLCGSGRVDDAREVLLEMEGSGFLPGGFLSFVFDDHSNGAGDDGLFDGKEIRIDERTYCILLNGLCRVGRIEKAEEVLAKLVENGVTPSKISYNILVNAYCQEGDVKKAILTTEQMEERGLEPNRITFNTVISKFCETGEVDHAETWVRRMVEKGVSPTVETYNSLINGYGQKGHFVRCFEFLDEMDKAGIKPNVISYGSLINCLCKDRKLIDAEIVLADMIGRGVSPNAEIYNMLIEASCSLSKLKDAFRFFDEMIQSGIDATLVTYNTLINGLGRNGRVKKAEDLFLQMAGKGCNPDVITYNSLISGYAKSVNTQKCLELYDKMKILGIKPTVGTFHPLIYACRKEGVVTMDKMFQEMLQMDLVPDQFVYNEMIYSYAEDGNVMKAMSLHQQMVDQGVDCDKVTYNSLILAYLRDRRVSEIKHLVDDMKAKGLVPKVDTYNILIKGLCDLKDFNGAYFWYREMVERGLLLNVSMCYQLISGLREEGMLREAQIVSSELSIGGLNN

SEQ ID NO: 130561 - protein, 278 aa, Glycine max
  Coding DNA Sequence Number=SeqID_13783
  Homolog annotation: Hit_ID=Q69TY4; Match level="QueryCoverage=46%, HitCoverage=62%, E-value=2e-49, Identity=70%"; Hit description =Putative thioredoxin peroxidase 1
  Pfam annotation: Domain name=AhpC-TSA; Domain location=26-148; Score =21.4; E_value=8.6e-06; Accession=PF00578.11; Description=AhpCTSA family
  Pfam annotation: Domain name=Redoxin; Domain location=25-171; Score =104.7; E_value=2.7e-28; Accession=PF08534.1; Description=Redoxin
  Pfam module annotation: Pfam domain module=AhpC-TSA::Redoxin; Domain location=26-148::25-171
MKQPLTTSPPPLSSHPKPSLPNSLIFGDKLQEATFSYLDSDGEVKTTTLSDLTNGKKAVLFAVPGAFTPTCSQKHVPGFVEKSGELRAKGVDTIACISVNDAFVMKACNGTFTKAIGVELDLSDKPVGLGVRSRRYALLAEDGVVKLFNLEEGGAFTFRTSSTFFEIISTTCFLKIIGLPRCCSVEQFEYHPEKVTEVIITTTKLNAVSLRKRDRICETQFWNYSLMPKLLARLRYYASVCALKIYYRLFLFGKNWWNFSLTKTINNDIQLGDAESLT

SEQ ID NO: 130562 - protein, 311 aa, Glycine max
  Coding DNA Sequence Number=SeqID_13784
  Gene Ontology: Mol. function=nucleic acid binding; Cellular component= intracellular; Biological process=regulation of transcription, DNA -dependent
  Homolog annotation: Hit_ID=Q2PER8; Match level="QueryCoverage=91%, HitCoverage=91%, E-value=2e-40, Identity=64%"; Hit description =Putative histone deacetylase
VEVKSGESLKVDPGDDKIIHLSNACLGDVTKDKEGLPVALYVKFGNQKLVLGTLSSEAFPQISYDLVFEKEFELSHNWKHGNFDEDIPVSAANGKPEIEVKNGIKPDANEAKQKKIANGEDEDSSESESDDDSSEDQLTANGDIESSEGDDDSDDEEEGDDESDEETPKKIEASNKRGIDSSKKTPVPVKKTKFVTPQKTAIKLCLGDLLVMGSNPETASLHMQGCGIRASEEVVQNLILIASLTVKNVVHVATPHPSKQTGKATANNKQQTPKSGGDYSCKPCNRPSTALSEGLLFARAVTVSVDVSGVG

SEQ ID NO: 130563 - protein, 169 aa, Glycine max
  Coding DNA Sequence Number=SeqID_13785
  Gene Ontology: Mol. function=transferase activity, transferring glycosyl groups; Cellular component=cytoplasm; Biological process =metabolic process
  Homolog annotation: Hit_ID=Q8L5C7; Match level="QueryCoverage=99%, HitCoverage=48%, E-value=1e-68, Identity=72%"; Hit description=UDP -glucuronosyltransferase
IAVMTSEQLIEFAWGLANSNKTFLWVIRPDLVAGENALLPSEFVKQTEKRGLLSSWCSQEQVLTHPAIGGFLTHSGWNSTLESVCGGVPMICWPFFAEQQTNCWFCCKEWGIGLEIEDVERDKIESLVRELMDGEKGKEMKEKALQWKELAKSAAFGPVGSSFANLDNM

SEQ ID NO: 130564 - protein, 70 aa, Glycine max
  Coding DNA Sequence Number=SeqID_13786
MKVGLGEELEEGVVAKNVDEGDLGKMVVGGEVGVGDGKNGEGGAVREIRDEGRGKHEEGALPKASLVSAI

SEQ ID NO: 130565 - protein, 60 aa, Glycine max
  Coding DNA Sequence Number=SeqID_13787
MVVQRCRISTPNGIQLIPETSHSEMAGTKVPYLTPQGIQVEGVNLHGVETVFGGCIRCTW

SEQ ID NO: 130566 - protein, 101 aa, Glycine max
  Coding DNA Sequence Number=SeqID_13788
MVKKITSTLTPLLPLPCVAQAPSLLEYKHDIVVLFYHPIPTWCHRPLGGDITIVDGGARWREGANVTHVGTKAWRHGFEEGKGGRATYSKTIILKYDTLLK

SEQ ID NO: 130567 - protein, 70 aa, Glycine max
  Coding DNA Sequence Number=SeqID_13789
MRCYKMCVVDVPDDNTKENIRFFIWSVVMLKFIKAWVVVHPRISEVFTQFLLRGDSKGSIGNESLSKGLC

SEQ ID NO: 130568 - protein, 95 aa, Glycine max
  Coding DNA Sequence Number=SeqID_13790
MSVDEFLSQVAWPGVQPSPSGGGKASAAQKPAPAEELVPIADDELVPPKLFIFETDPVAQEEAAAPRVSLHLSGPVFESRQYIYQNAQNETLSVV

SEQ ID NO: 130569 - protein, 83 aa, Glycine max
  Coding DNA Sequence Number=SeqID_13791
MAYTHIPDSTSDSPQISASPYQLDLAPYASEPYNAQWNAPGLLRDKHTLRSSRILGEMEVDEPWLGLWLPFELSSRYGIKFSI

SEQ ID NO: 130570 - protein, 61 aa, Glycine max
  Coding DNA Sequence Number=SeqID_13792
MYQKESASNLHINLNTEVSLTDSWHNMCVSPRDRILVKVNNAIEIEHGGSPWFSSNSRYHI

SEQ ID NO: 130571 - protein, 104 aa, Glycine max
  Coding DNA Sequence Number=SeqID_13793
  Gene Ontology: Cellular component=nucleus
  Homolog annotation: Hit_ID=Q1T4K6; Match level="QueryCoverage=67%, HitCoverage=13%, E-value=3e-24, Identity=74%"; Hit description =Unnamed protein product; contains similarity to nuclear protein ZAP gene_id:MQB2.8-related
MELHDLIILSSSFEASQCKILKSSGKSYLAKILHDLEVENGGDAPRIHSMDDYFMTEVGKVEDGEASKSSSSSGNKKPVTKKVMKFCYEPEMEEDVEHNVYSKK

SEQ ID NO: 130572 - protein, 104 aa, Glycine max
  Coding DNA Sequence Number=SeqID_13794
MAVPVRTLALVALLVAINAMVCESRVVRKDLGLDLGGVGIGVGAGVGLGLGGAGSGSGAGSEAGSYAGSHAGSSAGSGSSRAGSEAGSYAGSHAGSGSYGGNGK

SEQ ID NO: 130573 - protein, 48 aa, Glycine max
  Coding DNA Sequence Number=SeqID_13795
MENNMTCRSIIGSKEMKENVKNESKSAQWRLGAAAKSDSRKLIGGFEF

SEQ ID NO: 130574 - protein, 108 aa, Glycine max
  Coding DNA Sequence Number=SeqID_13796
MEMDPEEFTPVAQDESLVIEGEGGNNTQQPMSNSRVRRSWTELEEETLLTILEKMMVAGNKGENGTFKDGTHVEVYKRMKNKISSIFINSKQVVNKMKRWSTKLNDEY

SEQ ID NO: 130575 - protein, 201 aa, Glycine max
  Coding DNA Sequence Number=SeqID_13797
  Subcellular localization annotation: CTP_CleavageSite=53; ConfidenceScore=5.69e-01
MATPPVSPPPPLPPPPADASTSPSTLKRTRKATRLQSLATRPPGVERPVVNVDLSTGKADGPHKKKLRIYLGIVARDKVDVTYDTWKEVLAAQKDLIWEDIQAEFEIPEASNSRTKKKILQTVGECWRQFKSDLTRKWALAADKDGVDDIVCEKYGISNEKWTQFCQTRKDSLWEMCGKRHRPSRSKTLPPTYCLVGVMNI

SEQ ID NO: 130576 - protein, 222 aa, Glycine max
  Coding DNA Sequence Number=SeqID_13798
VAHAKCHPRGLSVIHCGMHKAKLALLAKPLWHQGKGRALLLGLKLKLERRNLHKRLGNLQEGSIDVAVVKEFYANLYSPEDQAPKYARVRRRMIKIDADSLNELLQTPVLIEEGEPLPTYSRFCRLRYNPKEMEASLCIPGKGFVLKAEGQPWKLLRKDLTTLAQTWSIFSFTNLAPTSHTSVTGTDMNIGGLIFGQITIMAQCNSSRLGFPALITALCRSR

SEQ ID NO: 130577 - protein, 65 aa, Glycine max
  Coding DNA Sequence Number=SeqID_13799
MQLPQEPLNKKPRGLAKKGMAETNFVELCGAATCESSHSRILALACIVCWSRPLSREAGRSISPS

SEQ ID NO: 130578 - protein, 218 aa, Glycine max
  Coding DNA Sequence Number=SeqID_13800
  Homolog annotation: Hit_ID=Q45NN3; Match level="QueryCoverage=50%, HitCoverage=60%, E-value=2e-36, Identity=70%"; Hit description =Hydroxyproline-rich glycoprotein-like protein
  Pfam annotation: Domain name=Frigida; Domain location=60-216; Score= -88.6; E_value=0.00059; Accession=PF07899.2; Description=Frigida-like protein
VLDPEVAVKKEKYQVFEELVRGQFGTVFHCFQQRGPPLHQNGGLGGWWHGGGGFRQRGGEKEAAAGEEVIVVFVGEEVAECADPAKKKELDGLRAEMSVALAECVNPMKFVLEAILEVFPVDKRGEKAGHDLGWACVLVLESLIPVVVDPVNGKSRLLVTPTVKEHATEITETWKSSLEEHGDVENVQTLEMPLILGNSSSGSTSQVRKWNMNSTRWE

SEQ ID NO: 130579 - protein, 77 aa, Glycine max
  Coding DNA Sequence Number=SeqID_13801
MTFSNSQPQTTISLWKRILAIIWAISFGTEPPYSSQSASRSPELALTTDSCHFSNPTQQPPLFRRDFGPSAPQQAYD

SEQ ID NO: 130580 - protein, 176 aa, Glycine max
  Coding DNA Sequence Number=SeqID_13802
MTSMMEAMLSMRQMMESNAAAVAATSAAAEADLTHPSTINQTSQPVPDMVGQGGEALGNTGGPHPRDHALGDFEPYPTYAAEGPMFSGMPQSNAARAPQHRPLQPLYFSVGRLPSSMEEREKLDLIEERLRVIEGIDDYLFADMVELCLVPDVVIPPKFKVPNFDKYKGTTCPMNH

SEQ ID NO: 130581 - protein, 117 aa, Glycine max
  Coding DNA Sequence Number=SeqID_13803
  Subcellular localization annotation: CTP_CleavageSite=35; ConfidenceScore=5.25e-01
MVQKACVFPILSLHSSNLVSSAKAIKQQLAKGKINCSAKSGPVATCPSRASEGEAHGCAFLREERCAESPPTFICGKCRENRRKPVKMKILSSGVVFTLEEGISTSHVCLKGQQPIF

SEQ ID NO: 130582 - protein, 349 aa, Glycine max
  Coding DNA Sequence Number=SeqID_13804
MRLVDDGSFKQTTVVDESILYELHQKFGLNTWRDDQLDAVWEKATEENDKLDMGTPSSKVVIAPERPPPSLVAPKETRAMAPSCTTFDETIAPQMKKVEPTPQALPPPFNVTPAGKRKEEEIVTCPPFMYKNLEVAPFSATSDQSIGLKSFFHQLGIIFTLRYPILHPHLPCIKVCTKFHVGLTEQWYAVIKISLDVYGHQAIPLTKDDIFNVRMILMQHGLSDQWPSYPLGIHIHPTITIKFMPDKVVLRFPPLDLWKKKGKMPPYTKPMPHPGLRDNIALHPIPYDWGRCFMRDEATKTVALKQNIQFDQNNIMLFYFKDMYENLCLMSTSEYYKENTSNHKRIVMP

SEQ ID NO: 130583 - protein, 114 aa, Glycine max
  Coding DNA Sequence Number=SeqID_13805
MKVENEREEDKHSSFKRRRKWTWAKEEVEKTHLDLQELEHSTMEEEKKKKKKAKDSLSLSSWPAASSTKGRVLLFYRRKGVEGRNPEYEEPRDLRSNPFQGGGDDAILPPKGIG

SEQ ID NO: 130584 - protein, 62 aa, Glycine max
  Coding DNA Sequence Number=SeqID_13806
MKNLRPEQEEEAIVIKNRSEGTRKERWRQGSLVGFDLRNTEERRRGGDSGNCCQTVAGPCKC

SEQ ID NO: 130585 - protein, 518 aa, Glycine max
  Coding DNA Sequence Number=SeqID_13807
  Gene Ontology: Mol. function=6-phosphofructokinase activity; Cellular component=6-phosphofructokinase complex; Biological process=glycolysis
  Homolog annotation: Hit_ID=Q8VYN6; Match level="QueryCoverage=46%, HitCoverage=45%, E-value=1e-110, Identity=82%"; Hit description =Putative pyrophosphate-fructose-6-phosphate 1-phosphotransferase
  Pfam annotation: Domain name=PFK; Domain location=5-261; Score=-23.1; E_value=1.5e-11; Accession=PF00365.10; Description=Phosphofructokinase
MASIMNVQQIVITLEIYGVKNIVGIPFGYRGFSDKELTEVPLSRKVVQNIHLSGGSLLGVSRGGPGVSDIVDSLEKRGINMLFVLGGNGTHAGANAIHHECRKRRLKVSVIGVPKTIDNDILLMDKTFGFDTAVEEAQRAINSAYIEAHSAYHGIGVVKLMGRSSGFIAMQASLSSGQVDICLIPEVPFNLHGPHGVLSHLKYLLETKGSAVVCVAEGAGQNLLQKTNATDASGNVVFGDIGVYIQQEGLLVSPSVGLLLPTQITKPVSYMSHFDQEDMTILYKYPRALHCKNLVEKAKKERADAKKANAKEKFIHVEVANNWMPHLPLASSRKKKVATPSPVLLLPPLRVTLPSFLRRMGFLLFGSAELQYTKGGGPRASMDYIAHFQVRSWGIAEFWADEFKKANARSQKAQAKLTKANRLWSKLPRQMKVSCSRSRNPGSHWKEALKGKLKKETDSAKTLQNEVKRLHKECLDELKMLQLAKCRLLKDELKSFEEGLANGTRNARGNLRHSRLLE

SEQ ID NO: 130586 - protein, 79 aa, Glycine max
  Coding DNA Sequence Number=SeqID_13808
MAAEWRWKKDDWRCHFKEKMSQEEAHHHRKPWDCINDDGGRMRFDRRNNEGNAREDRIEGVKLNIPPFKGKTYPKAYLE

SEQ ID NO: 130587 - protein, 370 aa, Glycine max
  Coding DNA Sequence Number=SeqID_13809
  Gene Ontology: Mol. function=DNA binding
  Homolog annotation: Hit_ID=Q1S5N2; Match level="QueryCoverage=76%, HitCoverage=72%, E-value=1e-24, Identity=41%"; Hit description=Viral capsid/hemagglutinin protein
  Pfam annotation: Domain name=DUF659; Domain location=18-161; Score =28.8; E_value=1.1e-09; Accession=PF04937.6; Description=Protein of unknown function (DUF 659)
MASGGSNKPTKGQQGGLETAKANGNKIDENLIKKSSQFKDEGVWRRMEKEKEKSKSPKGIVFLKYIDASEICKTSKAIFKMMDEVVAKVREEAIFKMIGEVVEEANYKAAGDLLMHRRKNLYWTACAVHCIDLMLEDFENKLPLHQETIASGAFPLMKVLSMVDSDNQLAMGFIYEEINSAKEKIQTLFNRISESCTPIWEINDARWEHQLHRPLQVVERMVGGIDKIAKIDAQIENSKSKSKSFGSLIAQRTLQTKTPAQWWSLMVHTKKRNHLQKTMNDVVFVMSNSRLNKKKDVRKSKNFKIDDVSSDDEWIVENEANSDLNALDEDILVELGEDANGGGISGASMDDLEVPPIVDDDEGGGDAINE

SEQ ID NO: 130588 - protein, 243 aa, Glycine max
  Coding DNA Sequence Number=SeqID_13810
  Gene Ontology: Mol. function=catalytic activity; Biological process =metabolic process
  Homolog annotation: Hit_ID=Q9M4H5; Match level="QueryCoverage=92%, HitCoverage=74%, E-value=3e-83, Identity=67%"; Hit description =Putative ripening-related protein
MSLYIAVEFNLFDVNAIGYDIDYEEYYSFVHGKLPYENLKPDPVLRNLLLSLPYRKLIFTNSDKVHTIKALERLGLEDCFEGIICFETLNPIQKSTVFYYEDDVKFEGSKSISPTPKNGVESSEIFDIIEHFAQPVPSAVLPETPIICKPSGHAIKLALKMANLNPQRTLFFEDSVRNIQSGKRLGLHTVLVGRSYRVKGADYAMESIHNLKEAVPELWDADIKAQVECPGTEKLAVETSDIV

SEQ ID NO: 130589 - protein, 83 aa, Glycine max
  Coding DNA Sequence Number=SeqID_13811
MERSSHGYDGTGNGHNKPRGFAVFCHTIQGFSKTHMASCWSLMKFHEQSWDENRSSRNAKWGIERMKNEALGSSEHRDNASAT

SEQ ID NO: 130590 - protein, 81 aa, Glycine max
  Coding DNA Sequence Number=SeqID_13812
MTLSSWQNKLDKYFTCKTLVMKGETEVTKAIYKSKGETKDIELVEEEQARIGADPSSETSNKSENYKEEARNATQKHNQRR

SEQ ID NO: 130591 - protein, 358 aa, Glycine max
  Coding DNA Sequence Number=SeqID_13813
  Gene Ontology: Mol. function=protein binding; Cellular component =nucleus; Biological process=regulation of progression through cell cycle
  Homolog annotation: Hit_ID=Q9ZRX9; Match level="QueryCoverage=98%, HitCoverage=94%, E-value=1e-86, Identity=54%"; Hit description =Cyclin D2.1 protein
  Pfam annotation: Domain name=Cyclin_C; Domain location=201-337; Score= 16.0; E_value=0.0022; Accession=PF02984.9; Description=Cyclin, C -terminal domain
  Pfam annotation: Domain name=Cyclin_N; Domain location=67-199; Score =129.1; E_value=1.2e-35; Accession=PF00134.13; Description=Cyclin, N -terminal domain
  Pfam module annotation: Pfam domain module=Cyclin_C::Cyclin_N; Domain location=201-337::67-199
MEGSIDPATSTLLSLENNATCFDEFDCNVADESLSWDHKHLNFNNQCLIKDNHGSEHFWDFSVLSDETVMDLVGRESEHLPHVGYLKRLLSGDLDLSVRNEALDWIWKAHAYYGFGPCSLCLSVNYLDRFLSVYELPRGKSWSIQLLAVACLSIAAKMEEIKVPPFVDLQVGEPKFVFEAKTIQRMELLVLSTLRWQMQASTPFSFLDYFLRKINCDQVIVKSSIMRSVGPILNIIKCINFLEFRPSEIAAAVAISVSREIQAEEIDKALQMQAEETAAACFFIVGKERILKGLELIKDLSLMQDSANLGNNLASFVPQSPIGVLDAACLSSISDELTVGSYRDSSLDTPNSKRRKSD

SEQ ID NO: 130592 - protein, 192 aa, Glycine max
  Coding DNA Sequence Number=SeqID_13814
MQVQPEEKAIVKLLCIPGQDFTHAAAKKRVWIMRTNMTTITQIWMTLLLSNILPSDRNADLPLRKGRAHMTPSGPKEVQQGSGVSSFGYGPLSVLQGARTPLAKSCHRDIGKDRTHKTPSGPGEVQQGPGFPALIMSLCQFYRVPVPPASSSGPLLTGLSSRSTVPPGRRRARHHSSLGMAGSGQQMHRHHL

SEQ ID NO: 130593 - protein, 144 aa, Glycine max
  Coding DNA Sequence Number=SeqID_13815
MYNYYEKGRDLDIESALADFTTYQASYKDIDKGRLELSVEDQKISFDLFEAMKHLDMDDACFEEGEVEQEIASSVSTMILQFPLEKELGHVVDCLVCDEELDDPKDNSDGHLDFEELKKIRTNRKAQSRIKDPSSTFKIYVLGE

SEQ ID NO: 130594 - protein, 214 aa, Glycine max
  Coding DNA Sequence Number=SeqID_13816
MGEIEEVQEWMKADIEAMKEQMDTMMEAMMNMKKIMEVNAAVVAATSAIADMDSTTPSGLNQISHPTSDMVEHACLPTIRLAPNYTPPNVVHTPDEDVNNSTPIPIESQQPQSIHAHEAPQDHNLADFEPYLGYATEGQAVVPPAVVKRGKFDHIEERLRGIEGGGDYAFANMAKLYLVPDVVIPPKFKVPDFDKYKGTTCPRKIGASQKMKSC

SEQ ID NO: 130595 - protein, 132 aa, Glycine max
  Coding DNA Sequence Number=SeqID_13817
MGAELLTPSLGVYAILGGVQLGGKPYGGKACLFFALNEGRPSTSTMVLVAAIATALTSIISFMLIMASIIVAIFSFKASMSAFICSCSSATSHITLICLCVPSNTIVSGWQKGEKVASAQDFGWQSKGEDHF

SEQ ID NO: 130596 - protein, 72 aa, Glycine max
  Coding DNA Sequence Number=SeqID_13818
MAYTPSEGVNNSAPILIESRQPQNDHTHVSQTMGETHEIPYHNLANFEPCLGYATDGQAVGGIPLQITLEEP

SEQ ID NO: 130597 - protein, 124 aa, Glycine max
  Coding DNA Sequence Number=SeqID_13819
  Gene Ontology: Mol. function=RNA-directed DNA polymerase activity; Biological process=RNA-dependent DNA replication
  Homolog annotation: Hit_ID=Q1T518; Match level="QueryCoverage=82%, HitCoverage=27%, E-value=3e-18, Identity=39%"; Hit description =Tetratricopeptide-like helical
MMRFLREFHANGVFPKGANSFFISLIPKVQYSQGLEQYRHIFLVGSNEAIDAAKRKKKKCLFFKVDYEKAYDSFNWDFLRYMMKRLGFSEKWIKWIYGCLQSSRISVLKVNFNKSSFGTIGVDE

SEQ ID NO: 130598 - protein, 76 aa, Glycine max
  Coding DNA Sequence Number=SeqID_13820
MAVLEPLCHWQSAIPCLMALSAISDIVPAIDVVFMACVVAMAEATAAMIMLVATTIVKATITAEVTTMVMGVVAIL

SEQ ID NO: 130599 - protein, 283 aa, Glycine max
  Coding DNA Sequence Number=SeqID_13821
  Gene Ontology: Mol. function=kinase activity
  Homolog annotation: Hit_ID=Q5Z7P9; Match level="QueryCoverage=55%, HitCoverage=31%, E-value=9e-31, Identity=45%"; Hit description=MAP kinase activating protein-like
MAVAAVVHLYVFPAEPYKMGERCIRNVAVMDDYASLGSPLDPEEVQDSQRSTRTWLGAHNNQREKNPMKFTQSVRDVVVGSGEIIVDDMKFTVSHVVEPVERGIAKINKTFHQISENVKRHEQRTRNTKDDCYLVPLRTQMSEFSDVHDTMGEGSVSDSGMSRVPNISKILSEVPAVSPNPLSTYVVVNWALRASHSPEKSTTSMGASCSSFGSAFVRCWCNKATIQLTSQTKKHPDKIFWRCAKWNVLQVLWRLSNPNFVREPSVVGMRPSFDHFEVFGTNR

SEQ ID NO: 130600 - protein, 527 aa, Glycine max
  Coding DNA Sequence Number=SeqID_13822
  Gene Ontology: Mol. function=transferase activity, transferring hexosyl groups; Biological process=carbohydrate biosynthetic process
  Homolog annotation: Hit_ID=Q5BMA4; Match level="QueryCoverage=93%, HitCoverage=77%, E-value=0.0, Identity=74%"; Hit description =Secondary cell wall-related glycosyltransferase family 8
  Pfam annotation: Domain name=Glyco_transf_8; Domain location=250-462; Score=201.9; E_value=1.5e-57; Accession=PF01501.10; Description =Glycosyl transferase family 8
MYALKHASLRRLCLFFLKDWQFICSEHKQPTIINNWKGGFDGIDSHYTSFLNIEWDQISNVLENLKDRDTYHGVGLLNFNDSEIDHWKKLIPEAEHVVLHLNYASSNITWNVLYPEWIDEEEEYEFPTCPTLPRIQVPGKPRLDLIAVKLPCNKSGCWLRDVARLHLQIEAARLAASSKGNHPVHVLLVTDCFPIPNLFTCKELIQREGNAWLYEPNLNTLREKLQLPIGSCELAVPLKAKERPHRQAYATILHSAQMYVCGAITAAQSIRMSGSTRDLVILVDETISEYHRGGLEAAGWKIHTIQRIRNPKAEPEAYNEWNYSKFRLWQLTDYDKIIFIDADLLILRNIDFLFEMSEISAIGNNATLFNSGVMVVEPSNCTFQLLMDHINEIVSYNGGDQGYLNEIFTWWHRIPKHMNFLKHFWEGDEEERKAMKTRLFGADPPILYVIHYLGNKPWLCFRDYDCNWNVDILQEFASNVAHARWWKVHDAMPEKLQNFCLLRSKQKAALEWDRRQAEKGNYSDGDT

SEQ ID NO: 130601 - protein, 168 aa, Glycine max
  Coding DNA Sequence Number=SeqID_13823
  Gene Ontology: Mol. function=kinase activity; Cellular component =integral to membrane
  Homolog annotation: Hit_ID=Q6ESQ4; Match level="QueryCoverage=89%, HitCoverage=31%, E-value=6e-41, Identity=50%"; Hit description =Putative MAP kinase activating protein
  Pfam annotation: Domain name=DUF300; Domain location=14-168; Score= -14.4; E_value=1.3e-11; Accession=PF03619.7; Description=Domain of unknown function
MWHQNLGLDSTGTVSFTVFSASIFVLVALVLSMYLVFEHLAAYNQPEEQKFLIGLILMVPVYALESFLSVLNSDAAFNSEIIRECYEAFALYCFERYLIACLGGEEKTIQFMESMSRTESIIPLLKEAYAYGVVEHPFPLNLFLEDWNLGPEFYQSVKIGIVQYVCMI

SEQ ID NO: 130602 - protein, 87 aa, Glycine max
  Coding DNA Sequence Number=SeqID_13824
MDKFDGLQTFVGDKFDAMELQVDMRFDAMESRITKVEEDVSFIRIVIIKGGDCRQRIKPRRCFDDAKRSHASQRFIQDKAMKDIQDK

SEQ ID NO: 130603 - protein, 69 aa, Glycine max
  Coding DNA Sequence Number=SeqID_13825
MYVRIPHTCWSSRSCLGLDVYIQEYRPYIVDFYVWWTQPTPSYYCFIMLVLKVFISFELHSPSVDDEMS

SEQ ID NO: 130604 - protein, 112 aa, Glycine max
  Coding DNA Sequence Number=SeqID_13826
MVTCWVVESRQREFRWIEVNPYKVWAILKIPPSSTEKEVRGRISHWQVLLLEYDIEYLTQKAVKGHGIGAILISLEKQYTLSTTRLCFDCANNVAEYEACALGLQAVVESKG

SEQ ID NO: 130605 - protein, 432 aa, Glycine max
  Coding DNA Sequence Number=SeqID_13827
  Homolog annotation: Hit_ID=Q1SMK1; Match level="QueryCoverage=16%, HitCoverage=4%, E-value=3e-09, Identity=43%"; Hit description =Integrase, catalytic region; Peptidase aspartic, active site; Ribonuclease H
MALEVTAACPGNLLLHPEVTLLAQASWAQPQNNNLAPQGNSLNYQATSNTHQVAGGFQPTPSSEQVHSKEKLQMLEERLRAIEGCSYDIRDATDLYLVPRWLNFKEDNLNIRSNPLLGHGGVEAMPSKGKSTWLFKENKGGYIPCGSLACKGFSKVERNLKNRRLLGDWMVEDVKTLLKTIFRDMHKFGMIKGSFEEDMGSGLHPSANHIIEECDEFKSILQDLMDKKLLQVGYFVNDVLTIDSSMTFLKPLVIHYTICATYLTPSGPKSFTIQVPKDFSYKDNKAVPWKYDIEVCVKGGDVNQSKNTREEAPDVTNIAGIGGMTQSGRIYTPNKLMVKQRKYEERLKPVMIEPEVNGSLLNVMPRMTLGKLSFGESHMKLSAMVVRAFDGSLRKVIEEISLPIQIGPATFEATVEIEDDLRLSPKLLRLME

SEQ ID NO: 130606 - protein, 105 aa, Glycine max
  Coding DNA Sequence Number=SeqID_13828
  Gene Ontology: Mol. function=ribonuclease H activity; Biological process=DNA integration
MNGVVEATNKNIKKIIQKMVVTYKDCHEMLPFVLHGYRTSIQTSTRATLFSLVYGMEAVLPIKVKIPSLKVLMETELEQGEWVQTHFEQLNLIEEKRLNAIFHGH

SEQ ID NO: 130607 - protein, 133 aa, Glycine max
  Coding DNA Sequence Number=SeqID_13829
  Gene Ontology: Mol. function=nucleic acid binding; Biological process= DNA integration
MVKKEFSGGSLILMNMDGKDLYMWMTSTKLVCTSLTVSIHLTKLNATYAREYMSCVPYAGVVGSLVYAMVCIKPDLAQAINIMNRHMGNLGKEHWQALKRIFKYLKGNTLAHNALSTTEAEYMALVEVAKEGI

SEQ ID NO: 130608 - protein, 73 aa, Glycine max
  Coding DNA Sequence Number=SeqID_13830
VSGFDEEAIAQLLGISGQDFARTTAGRRVSVHVAQLISDAIYQFAGVTPTRHPVDSEKSNRALGFPALITGLC

SEQ ID NO: 130609 - protein, 75 aa, Glycine max
  Coding DNA Sequence Number=SeqID_13831
MSPDFMGQDDKGAEDDVSLRMSTAIVCADNSLGIFACHPTSRVRMTQTVYTDNRLGISTCHPTSWVRMTKVLKTM

SEQ ID NO: 130610 - protein, 58 aa, Glycine max
  Coding DNA Sequence Number=SeqID_13832
MPQPHGINMGLKEHSNRVSLPPRPRLRRIHLGLTFLIQPIQLSNNPYTYEFHDEKSPT

SEQ ID NO: 130611 - protein, 44 aa, Glycine max
  Coding DNA Sequence Number=SeqID_13833
MQFVHVHQKNKYQYISKSEDHNNVNTKYVPDEAGFAGLKISSAQ

SEQ ID NO: 130612 - protein, 59 aa, Glycine max
  Coding DNA Sequence Number=SeqID_13834
  Gene Ontology: Mol. function=ER retention sequence binding; Cellular component=integral to membrane; Biological process=protein retention in ER
  Homolog annotation: Hit_ID=Q1SSF8; Match level="QueryCoverage=92%, HitCoverage=15%, E-value=2e-22, Identity=94%"; Hit description=ER lumen protein retaining receptor
MQIVEPFTAHYVFALGVARFLSCAHWVLQVLDTRGRLLTALGYGLWPSMIFATTTSRGG

SEQ ID NO: 130613 - protein, 80 aa, Glycine max
  Coding DNA Sequence Number=SeqID_13835
EKEGGGCRPARPGELSCFHQKALPFVGTPWKAQIAQQCFLSTSGMSRNFTDCLTMGVKYLEAIKRRLHATKQWSPDKIRV

SEQ ID NO: 130614 - protein, 96 aa, Glycine max
  Coding DNA Sequence Number=SeqID_13836
ATWEYVSSVEGGQQGMVGLYVICGCGELFCTIARPPPSTTCDGVVPRDMSQGSRDLGDIRRAPGSQQIIGTKTTKQGGLCGGWPAVNFECYMGYGL

SEQ ID NO: 130615 - protein, 69 aa, Glycine max
  Coding DNA Sequence Number=SeqID_13837
MRVEELQGIPEYLGIGCSNHMTDHKKRFVNLDEKVKSKIKFVDNSIVSAEGTDKVMIQEDMDNNPSSMM

SEQ ID NO: 130616 - protein, 120 aa, Glycine max
  Coding DNA Sequence Number=SeqID_13838
  Gene Ontology: Mol. function=nucleic acid binding; Biological process= DNA integration
  Homolog annotation: Hit_ID=Q1T010; Match level="QueryCoverage=97%, HitCoverage=10%, E-value=1e-20, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MARSMMKGKEMSRYFWGESHLGEAWSRNKPRASHFKIFGSLCFKHVPKQTRRKPSDHVEQMMLLGYHPTCAYKLYDPRMKKVVISRDVTMDETRCWNWETSDSRSIEKIVSVNLEDDQSI

SEQ ID NO: 130617 - protein, 99 aa, Glycine max
  Coding DNA Sequence Number=SeqID_13839
MIWEGKVQTPFAVVQRAKNGFGEWKTLVLHLQPPNRVLFLVPKRLKLWPFFIAWLNELGLQGVHISVKGPYSAQSHPATILRTCKCRINFYPNSREDYG

SEQ ID NO: 130618 - protein, 396 aa, Glycine max
  Coding DNA Sequence Number=SeqID_13840
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=92%, HitCoverage=31%, E-value=2e-58, Identity=36%"; Hit description =Peptidase S8 and S53, subtilisin, kexin, sedolisin; Integrase, catalytic region; Zinc finger, CCHC-type
MKKKYQGSSQVKRAHLQALRRDFVVLQMKEGESVTDYCSRTTGIANNMQFHGEEMTDASIVEKILCSLTPKFDYVVCSIEESNDIDDLSLDELQSSLLVHEQKMNRRSTMEEHALKASTNTHSNISRGRGRGRGCGDRGNRDFNNNSKDNNDQSQGNDRGRDHDKSKEKGESSNFIKEKQVETILMAVEDAKDSEAEIRYVDTGRSNHISGKTISNVLYVLDLKSNLLSAGQLQEKGYGIFISKGTCEIFDPVRGAIAIIKMNSNRLFPLKIESIHSSLMVKYTVSTWLWHYRYGHLSFSGLKTLEQKNMVIDLPQIITPSQVCEEYVVSKQHRSQFPNGKSWRAKCVLELIHSNICGLINPSFNGDRGEEYCSDEFSTFCVNHGIRKELTWYGAS

SEQ ID NO: 130619 - protein, 138 aa, Glycine max
  Coding DNA Sequence Number=SeqID_13841
MMKQGSGSCTMRENEVAEILVNLPSLIWEFECGCGILQPSWGCKRKRSAIGVDPKARQASSPATPLSFSPSESDENPSTLIRTRTRNVSLKRKREHYVKILQDLTKHNDLIRGEIKNVKRHNEKLKEYNLKLKARKQE

SEQ ID NO: 130620 - protein, 134 aa, Glycine max
  Coding DNA Sequence Number=SeqID_13842
MAGKKGAFVGSIESPPFPRLQYLEFSSRLMESGLLPKDVAKKVYEKKKKVPQKLTSPVKSVAAVKSNTKSVTVKKKSPASPVSSVKKKTTTTNSTSKQSKKRKVKDLSSEDDDDTNSSDDEFILSSVAKRRKMA

SEQ ID NO: 130621 - protein, 106 aa, Glycine max
  Coding DNA Sequence Number=SeqID_13843
  Gene Ontology: Mol. function=nucleic acid binding
LPLKEHLDELNSVLVELRDIDVKIEDEDLTMILLAFLLPSSKNFVSSFSVGKESITLEEVKSNLYSRELRLEVSRNGDEVSASRLSVTDSAKGQKNKKAKKDFVAT

SEQ ID NO: 130622 - protein, 101 aa, Glycine max
  Coding DNA Sequence Number=SeqID_13844
MRKSLQKYVILLDIWGFHGVADNMKFLQIFLVKGKLPGSHIINETSKRVGLRPQKETTPENLAFHRFKQKAQMKLKAETQMKVEEETRTKLLLEAENGKLH

SEQ ID NO: 130623 - protein, 277 aa, Glycine max
  Coding DNA Sequence Number=SeqID_13845
MKIMISIPLMNCDLSGGEHHQDSCYFYSINNFDQRKELAMYDYHEKERTPVLESILADFMTYQASSKDYQRESQWQPDHHNEAEGFLNLDDLLMQFRDLVESMQQAFRRTETQISKLVDNMTNVVARKEEERAEIEMHQESILQVTSIHHQLTNEEEKHEFSSTLEYPCLATIGYVGGKDKGRLELSVEDKKISFDLFEAMKHLDIGDAYFEEEEVEQEIALSASTMVLQSPLEREPSYGIDCLVCDEELDDPKDNCVDHVVFEELEKMRPTEKPKA

SEQ ID NO: 130624 - protein, 219 aa, Glycine max
  Coding DNA Sequence Number=SeqID_13846
KQHALWCPYGTHARARVRSEIEEVQEQMKVDMEAMKEKMTTMMEAMMSMRRMMEVNAATVVATSTTIEVDPTHPPGFNENKHSFPPYRLPPNYTPPNVAHTLDENVDNSAPIPIKSQQPQSDHAYVSQPMGETHEAPQDHNLADLKPHLRYATEGQAVGGVPLPNTLGGPQFRPQPQPLHFAVEKLLPSMVEWEKFDHIEERLRAIEGGRDYAFADMGK

SEQ ID NO: 130625 - protein, 64 aa, Glycine max
  Coding DNA Sequence Number=SeqID_13847
  Subcellular localization annotation: CTP_CleavageSite=47; ConfidenceScore=5.38e-01
MTLRSALMHSSSFFQIIPRAQPRSVVLSGWLAKLSTRLAPSPNALTRAKCKGGAKHNVTISEPI

SEQ ID NO: 130626 - protein, 291 aa, Glycine max
  Coding DNA Sequence Number=SeqID_13848
  Gene Ontology: Mol. function=formate-tetrahydrofolate ligase activity; Cellular component=cytosol; Biological process=folic acid and derivative biosynthetic process
  Homolog annotation: Hit_ID=UPI00003833A7; Match level="QueryCoverage =71%, HitCoverage=54%, E-value=2e-47, Identity=51%"; Hit description =COG2759: Formyltetrahydrofolate synthetase
  Pfam annotation: Domain name=FTHFS; Domain location=82-291; Score= -153.8; E_value=0.00021; Accession=PF01268.9; Description=Formate- -tetrahydrofolate ligase
MAQSLVAGVYDKVVDRESAYEILKQRAEQAAAASQAPAQKEQEGSGFDLGGVLSGKSSRSDSVLESAAKSAARAIGSQLGRAIIRAATLQPIMDVAMKVGLSSQDLHLCGQHMAKLTQATVNRLQAQPAKAKLILVTAINPTPAGEGKTTTTVGLTDALNQAGYHALACLREPSLGPVFGMKGGATGGGYAQVVPMENINLHFTGDFHAISAANNLLAALIDNHIYHGNALGFDQVSWRRCMDMNDRALRRITLENEVHTGFDITVASEVMAIFCLATDLTDLTRRLGRIQ

SEQ ID NO: 130627 - protein, 251 aa, Glycine max
  Coding DNA Sequence Number=SeqID_13849
MVIPKFKVPDFDKYKGTTCPKNHLKMCCQKMGVYAKDEKLLIHFSKESLTGTTATWYTNLEPSRVHSWKDLMIAFVRQYQSNSDMAPDRMQLQKGAQIFQRIRPKVERPGSPSGTPNNGKRDDNHDSRHITVFYYEKWIKVGLKRGKFNHPACMNEKTGANEEGEDEGETHVVTAIPIRPSFPPTRQCHYLANNNPSPYLPPSYPQRSSLNQPQNPPSTQPMLNTTLSENQKGIFQQKKPIGFTPNSGVLC

SEQ ID NO: 130628 - protein, 138 aa, Glycine max
  Coding DNA Sequence Number=SeqID_13850
MTSEASTASSPVLRAYHKQWALDYPGYVQIEYNKEWHVIKLRKNGHHCIGNHVEGLPQPFLPTAALDFVDASTRCMTMQHRIGVRGIWSISMHNAIQYVDDPWHGFLMENHLMGGDEVVFYYRPNQHVWEIILRKEPV

SEQ ID NO: 130629 - protein, 504 aa, Glycine max
  Coding DNA Sequence Number=SeqID_13851
MENMDKHNRRRPDAIENTNYTMLKAICNFVKQDQTESTKDGMDDVKMSATQNTSLNDETLHCLNPKKPLSTPTLRSMKKEAYAKSKANLTNIETIFIPADDDDEFSKPLPLGIKGKFLGQENKTTYSSPKTINISGLHDVNTTDDSSPQEPFMNNYVTGLTAKVKHLLTCIAKHLHTKYCLGLFSDVHVIQGKNNKETLMAPRKLTFPQESCRTSKKPKIDQLSQTSNAQKIQYSKGSSFGKMDTKKASQIFHRPRTNTTRGYTHTIPKDMPCCFKPTVDMNLIFEETQVCAYVFNPNVDPRNKILYRVGNNLGTQQNFQSLCPNKPVREEVAYSQLYRTRSVWCMPPAFAIYIPIVQNSDHWYLMVIDMHEKKHFHLDCDLTSETAYDRKDTIKIMTNVMLSVLEIVFATQDLVIGFHQMDCWDIVEARGIPNCGSSEKSALWVLEWMQMEESFVSLLYGVIEEKAVRIKVAMILLLGTHNQCKGDLIRNAKRTWHDCIHAKH

SEQ ID NO: 130630 - protein, 166 aa, Glycine max
  Coding DNA Sequence Number=SeqID_13852
  Homolog annotation: Hit_ID=Q1RXW3; Match level="QueryCoverage=95%, HitCoverage=23%, E-value=3e-08, Identity=30%"; Hit description=Zinc finger, CCHC-type
  Pfam annotation: Domain name=zf-CCHC; Domain location=94-111; Score =26.8; E_value=3.7e-05; Accession=PF00098.13; Description=Zinc knuckle
MSLATLFGKLQEHEMELMRLNQHEKNDKEKKGIALKASSSTQEGSDKEDSIEIDEDDDLSLFVKRFNKFLRVRVNQRRSNFKSKKRAEDSSSTLKCYECNQPGHQRVDCPIFKKRIEKSKKKVFNEKKSKKAYITWDDNDRDSSKDSENEVINLSLMAKNYESKGE

SEQ ID NO: 130631 - protein, 99 aa, Glycine max
  Coding DNA Sequence Number=SeqID_13853
MTLLLSNILPSDRNANLPLQKYQLVCVVPTWGSHPQRHPVDLKKSNRALGFPALVTGIGRPYRAPVPPSKFMSSWHRACARKTPSGPEEGQQGLGVVKL

SEQ ID NO: 130632 - protein, 101 aa, Glycine max
  Coding DNA Sequence Number=SeqID_13854
MPNIPSIYPLQIGWNNVLYQTKTTSPQINAWCTGTTGNHNNLFQDPYTNCCLYMTMFFSALQGLPNCAMPHVNACGHHMTILRRLGPPLQWNVVVLHNGMN

SEQ ID NO: 130633 - protein, 104 aa, Glycine max
  Coding DNA Sequence Number=SeqID_13855
DRELRGSSNGIIGGYHKWLRVRTQGLDWLPNLKTVRDDEVKASEESDAVQALKTELERARVVEEKFKSIAIKESSRVKGMISEEVKGIITGQRHDLEGRAKGLP

SEQ ID NO: 130634 - protein, 147 aa, Glycine max
  Coding DNA Sequence Number=SeqID_13856
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=6e-11, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHALAFRGLDVLAFIGLHALTFRGLHILTLIGLHALTFRGLDFLAFRGLNVLAFRGLDVLAFRGLHTLTFRGLHALTFRGLDVLTLRGLHAFAFRVLHAFAFKVLHVLAFRGLHVLAFRGLHIYTLREFKVLCP

SEQ ID NO: 130635 - protein, 46 aa, Glycine max
  Coding DNA Sequence Number=SeqID_13857
MDISEPYTKAMRGTLHEPQANLGADQKFSPGTTAKPAGRTMQTTHA

SEQ ID NO: 130636 - protein, 100 aa, Glycine max
  Coding DNA Sequence Number=SeqID_13858
MRNESTKIEFLEPKMRLRSFRILFLKNIRGNIGFIQIEENLSKVYKSHTGKLSQPTLRWEGDVRLTGASSKKGICAESPPTFILRKTSEKPEKTWSTNFR

SEQ ID NO: 130637 - protein, 106 aa, Glycine max
  Coding DNA Sequence Number=SeqID_13859
MKAQRQRHFLFLLIVAEGSGWGGGGNPCGVYPDLSSFTGSGVNPDLSSFTGSGVYPDLSSFTGSGVYPGLSCFTGSGVVQKLYSLYQTICPERFTSSGIRALALDA

SEQ ID NO: 130638 - protein, 210 aa, Glycine max
  Coding DNA Sequence Number=SeqID_13860
  Subcellular localization annotation: CTP_CleavageSite=66; ConfidenceScore=5.17e-01
MRSDCLVQFSILNPFSEPMNCVFVHVSSTFEFGAMRSDCLMQFSILNLFRSPMNCVFIHVTSTFKFGAMRSDCLVQFSILNLFRSPMNCVFIHVSSTFEFGAMRSDCLVQFSILNLFRSPMNCVFVHVSSTFEFGCMRSDCLVQFSILNLFRSPMNCVFVQVSPTFEFGAMRSDCLMQFSILNLFPSPMKWVFVHVFSTFEFGAMHSECL

SEQ ID NO: 130639 - protein, 203 aa, Glycine max
  Coding DNA Sequence Number=SeqID_13861
MGEVEEVQERMKADMEAMKEQMDTMMEAMMSMKKIMEVYAAVVSATSTVAVVDRNPLSGLNQINPLALDMIAQGGKELGSTGGPHFVPIQNKHVFPPYGLPPNYTPPNVAHTPDENERLRAIKGGKDHAFANLEELFLAPNVVFPPKFKVPDFDKYKGTTCPKNHLMETYLRRGEQRRHPLGNKPWKKELRHQENALDKKLGE

SEQ ID NO: 130640 - protein, 122 aa, Glycine max
  Coding DNA Sequence Number=SeqID_13862
MVEHGHGMYYTPATFSQYPSQMYRYPFEGHHTDTSASEHSFGGVAEIHPHFSWPTMTHSQQHDAPIATPNAPLGMQWNVPGAIPYMGDLLGVDLRHRFSVEVDEVEAGRHRGRRNPNHQARR

SEQ ID NO: 130641 - protein, 89 aa, Glycine max
  Coding DNA Sequence Number=SeqID_13863
MAHQRSLGVVDKSGAFAPTYPQLRCGNQTYVILAKVVNVTDRLDFAITVIKRDYNANDRLKFILSLIRRDNDLNDRLKLVKNGRKENRK

SEQ ID NO: 130642 - protein, 110 aa, Glycine max
  Coding DNA Sequence Number=SeqID_13864
  Subcellular localization annotation: CTP_CleavageSite=24; ConfidenceScore=5.08e-01
MAKIHHQAWSTKTYHPMKHTPHTYSQNNSKAPKFLKGRGNIGSKGLSRELIQGRLIWLEAYKNKMPKSSPNMHVKQEVSTRVKPRLLCKQSMRQNTPNKIDDDGSNSHQG

SEQ ID NO: 130643 - protein, 36 aa, Glycine max
  Coding DNA Sequence Number=SeqID_13865
MGALYVPPLAFSSPGPLLDQGKIPKKCAEQNSSIML

SEQ ID NO: 130644 - protein, 100 aa, Glycine max
  Coding DNA Sequence Number=SeqID_13866
EMSPHVMQDGGSSQYCIIIVILQRILLGERAVYAMMLVFPPEFSPLKTILFGNPSQDTVEPLMEALVEDYKDENEINESRQFIGGVLDLEKRINRLDTLT

SEQ ID NO: 130645 - protein, 182 aa, Glycine max
  Coding DNA Sequence Number=SeqID_13867
RWLRGSFPQRDLGVDATAEGTSAAPEFDNHHFRSAEHLQRFEAIKGWSFHRERRVPLRIGVRDMRSWVRGQWIPFDADALSQFLGHCPTVMHTGSGFCPDRCREAGADHAHQHDHLDPDVDDVAAQQCTPLDPDKSNRALGFPALITGLCQSFGVPITPSKVIRPPITRAFIEKYCTPRQAQ

SEQ ID NO: 130646 - protein, 184 aa, Glycine max
  Coding DNA Sequence Number=SeqID_13868
METCPAVEELLQRLMDWGQLEVSERDREEPQICTQSVERKAPPTPKAIVICFTRNMTGPRSEYPPTVPKPTPFSYQSNKAVPWKYTPPAFGEGAATEVDSLSAKVTNITGLSGVTRSGRVFAPPRSAELPSKGKAPMTQESAGVTTPSKEVDPPVVKGAEKKEGLQGKAATLEEAYEFLRLINK

SEQ ID NO: 130647 - protein, 69 aa, Glycine max
  Coding DNA Sequence Number=SeqID_13869
  Subcellular localization annotation: CTP_CleavageSite=44; ConfidenceScore=5.37e-01
GCSPRQANLPFFFYAVMSMALYRPAFSYSNPLKDTRRPCSGIFRLSRVGKGRRFVGRDPSLYLHPSLST

SEQ ID NO: 130648 - protein, 195 aa, Glycine max
  Coding DNA Sequence Number=SeqID_13870
GEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADESWLGVKCHSNPELAGSPRNAVEAQ

SEQ ID NO: 130649 - protein, 208 aa, Glycine max
  Coding DNA Sequence Number=SeqID_13871
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=2e-31, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGPLKESTSCFLVRVKSFGACTYWLAFRGLHVLTFRGLHALAIRGLHVLTFRGLHVLTFRGRHVFTFVGLHALTFRGPHVLTFRGLHALAIRGLHVLTFRGLHAPAIRGLHVLTFRGLHALAIRGLHVLTFRGLHALAIRGPHVLTFVGLHALTFRGSHVLTFRGLHALAIRGLHVLTFRGLHALAIRGLHVLTFVGLHAFTFGGLH

SEQ ID NO: 130650 - protein, 130 aa, Glycine max
  Coding DNA Sequence Number=SeqID_13872
KEEGVETRVVITERAGRAKSVSYLCFPLIFDERYLEPFVAQYVKSRDVPKIKRKQAYAIRENSKAIVSGGSNLTRLGELGGKLLPYFAINRGRNEGGKGSAFLALLILSKLLRKIVSVKKIQAEALPLQL

SEQ ID NO: 130651 - protein, 151 aa, Glycine max
  Coding DNA Sequence Number=SeqID_13873
MGETHEIPHHNLADFEPCIGCATEGQAIGGVPLSNTLEGPRFCPQPQPLYFAVGRVPPAMAENGKLDQIEERLRAVEGGEDYAFADMEDLCLVPDMVIPLKFKVPDFDKYKGTTCPKNHLKVYCRKKGAYAKDEKLLMHFFQESLTGAADT

SEQ ID NO: 130652 - protein, 63 aa, Glycine max
  Coding DNA Sequence Number=SeqID_13874
MRDNEVKASEESDEVQALKAKLERARVVKEKFKAAIVSSNSEEVKGIITGQRHDLEGRAKGLP

SEQ ID NO: 130653 - protein, 523 aa, Glycine max
  Coding DNA Sequence Number=SeqID_13875
  Gene Ontology: Mol. function=structural molecule activity; Cellular component=intermediate filament; Biological process=chitin metabolic process
  Homolog annotation: Hit_ID=UPI00006A17C9; Match level="QueryCoverage =99%, HitCoverage=100%, E-value=3e-62, Identity=30%"; Hit description= UPI00006A17C9 related cluster
  Subcellular localization annotation: CTP_CleavageSite=47; ConfidenceScore=5.76e-01
QRDTRPRLQRTTRPHLQRAPRPRLRRTTRPRLQRTTRPHLQRTARPRLQRATSARFQRTTSPPLQRTTRPHLQRTTRGLHAHAFRGLHIIAFRGLHILAFKGQHILAFRGLHILTFKGLHALTLRGLHALAFTGLHALVFRGLNVLTFKVLCAFISKGLHVLAFRGLHALAFRGLHILAFKGLHALSFRGIHALAFRGLHVLTFRGLHALAFGGLHVLIFRRLHILAFRGLHVLTFIGLHALTSRGLHVLAFRGLHALAFRGLHALAFRGLHVLTFWKVARPHLGYLYPHLQRTARPRLQRATCARFQRTTSPPLQRTTRPHLQRTTRGLHALAFRGLHIVAFRGLHILAFKGQHILAFRGLHILTFRGLHALTLRGLHALAFSGLHALAFRGLNVLTFKVLCAFISKGLHVLAFRGLHALAFRGLLALSFRGIHALAFRGLHVLTFRGLHALAFGGLHVLIFRRLHILAFRGLHVLTFIGLHALTSRGLHVLPFRGLHVLAFRGLHALAFRGLHALAFRGLH

SEQ ID NO: 130654 - protein, 149 aa, Glycine max
  Coding DNA Sequence Number=SeqID_13876
MADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPPTA

SEQ ID NO: 130655 - protein, 91 aa, Glycine max
  Coding DNA Sequence Number=SeqID_13877
MRGSGEFVPFLDTTSRGSEMPQRTFFKKATRTLRWFVYSRDQDRTHMHAYAKDTMRECAQGIIPFEEHIVAVGTTSNNRFSKRKALDEGSL

SEQ ID NO: 130656 - protein, 618 aa, Glycine max
  Coding DNA Sequence Number=SeqID_13878
  Gene Ontology: Mol. function=protein kinase activity; Cellular component=integral to membrane; Biological process=protein amino acid phosphorylation
  Homolog annotation: Hit_ID=Q8LD58; Match level="QueryCoverage=92%, HitCoverage=97%, E-value=1e-151, Identity=49%"; Hit description =Receptor kinase, putative
  Pfam annotation: Domain name=DUF1191; Domain location=73-287; Score= -129.9; E_value=0.077; Accession=PF06697.3; Description=Protein of unknown function (DUF1191)
  Pfam annotation: Domain name=LRRNT_2; Domain location=26-63; Score =35.9; E_value=1.4e-07; Accession=PF08263.3; Description=Leucine rich repeat N-terminal domain
  Pfam annotation: Domain name=LRR_1; Domain location=114-136; Score =11.7; E_value=1.8; Accession=PF00560.23; Description=Leucine Rich Repeat
  Pfam annotation: Domain name=LRR_1; Domain location=138-159; Score =14.1; E_value=0.53; Accession=PF00560.23; Description=Leucine Rich Repeat
  Pfam annotation: Domain name=LRR_1; Domain location=160-182; Score =8.6; E_value=7.2; Accession=PF00560.23; Description=Leucine Rich Repeat
  Pfam annotation: Domain name=LRR_1; Domain location=66-88; Score=5.0; E_value=34; Accession=PF00560.23; Description=Leucine Rich Repeat
  Pfam annotation: Domain name=LRR_1; Domain location=90-112; Score =16.3; E_value=0.11; Accession=PF00560.23; Description=Leucine Rich Repeat
  Pfam annotation: Domain name=Pkinase; Domain location=313-579; Score =74.6; E_value=3.2e-19; Accession=PF00069.15; Description=Protein kinase domain
  Pfam annotation: Domain name=Pkinase_Tyr; Domain location=312-579; Score=62.5; E_value=2.6e-16; Accession=PF07714.7; Description =Protein tyrosine kinase
  Pfam module annotation: Pfam domain module=DUF1191::LRRNT_2::LRR _1::LRR_1::LRR_1::LRR_1::LRR_1::Pkinase::Pkinase_Tyr; Domain location= 73-287::26-63::114-136::138-159::160-182::66-88::90-112::313-579::312- 579
MKSARVKEAILLVFMFSLLSIACSDLASDRAGLLLLRSAVGGRTLLWNSTQTSPCSWTGVVCASGRVIMLRLPAMGLSGSLPSGLGNLTELQTLSLRFNALTGRIPEDFANLKSLRNLYLQGNFFSGEVSDSVFALQNLVRLNLERNNFTGSIPDLDAPPLDQFNVSFNSLTGSIPNRFSRLDRTAFLGNSQLCGRPLQLCPGTEEKKKSKLSGGAIAGIVIGSVVGVLLILLLLFFLCRKRNKKDENETLPPEKRVVEGEVVSREKSNESGGNSGSVEKSEVRSSSGGGGDNKSLVFFGNVSRVFSLDELLRASAEVLGKGTFGTTYKATMEMGASVAVKRLKDVTATEKEFREKIEQVGKMVHHNLVPLRGYFFSRDEKLVVYDYMPMGSLSALLHANGGVGRTPLNWETRSAIALGAARGIAYIHSLGPTSSHGNIKSSNILLTKTFEARVSDFGLAYLALPTSTPNRVSGYCAPEVTDARKISQKADVYSFGIMLLELLTGKAPTHSSLNDEGVDLPRWVQSVIQDEWNTEVFDMELLRYQSVEEEMVKLLQLALECTAQYPDKRPSMDVVASKIEEICHPSLEKEEEKNHDFKDADNGFSQQYHSVDSGVSQA

SEQ ID NO: 130657 - protein, 107 aa, Glycine max
  Coding DNA Sequence Number=SeqID_13879
  Subcellular localization annotation: CTP_CleavageSite=26; ConfidenceScore=5.03e-01
MTHNIAAQPSSADCEPFFFTAYYLPLCPRRPSPSTSTRLIRTPTTISPGDSGRDDLYHIQDHCEKIYHTSTTSSCSDSRRSHRKTITTTTTSSWQNNKSEKYTVGAR

SEQ ID NO: 130658 - protein, 150 aa, Glycine max
  Coding DNA Sequence Number=SeqID_13880
  Homolog annotation: Hit_ID=Q10SS1; Match level="QueryCoverage=36%, HitCoverage=7%, E-value=4e-18, Identity=74%"; Hit description =Expressed protein
MARRVGGVDEFEFKAIGENHNQGRLGVEILVSGFVFEKEDFIRPWEGQNDNLERYNSEHFPSIILVPLVKEAELVEKVVLLGAPIPIMDENWEATRKLGLIRNLTDVKALSERGILFLHVGDNENKDTNSIAEFPLLTKNAVESLRYRAE

SEQ ID NO: 130659 - protein, 250 aa, Glycine max
  Coding DNA Sequence Number=SeqID_13881
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=97%, HitCoverage=14%, E-value=7e-69, Identity=48%"; Hit description =Putative callose synthase catalytic subunit
MQEADRNNNGKAAHSAWRNYDDFNEYFWSRACFELNWPMRPNSPFLRKPKRTKRTGKSSFVEHRTFLHLYRSFHRLWIFLALMFQALTIIAFNHGHINLNTFKTILSIGPSFAIMNFVKTIQIDNEAIFCTAPVPRWLHLPFCQHWKVLQERNSNSSDNSFYFRIYLLVLGVYAAIRLFLALLLKFPACHALSEMSDQFFFQFFKWIYQERYYVGRGLYERMSDYCRYVAFWLVVLAVKFTFAYFLQKLT

SEQ ID NO: 130660 - protein, 76 aa, Glycine max
  Coding DNA Sequence Number=SeqID_13882
METSVVMGIEVATFTSTITPERDDIIAGFVASLTSIHCCRQPPTFLMSSVTSLFHLGVVIFTFVGKTDSAKRLRYE

SEQ ID NO: 130661 - protein, 246 aa, Glycine max
  Coding DNA Sequence Number=SeqID_13883
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI00001623CC; Match level="QueryCoverage =84%, HitCoverage=12%, E-value=3e-75, Identity=67%"; Hit description =ATGSL08 (GLUCAN SYNTHASE-LIKE 8); 1,3-beta-glucan synthase/ transferase, transferring glycosyl groups
MAMPALNNSHGEKETNLHSISSLRKYDRYRVCEQAYSMAQNLDPNSDGRGVLQFKTGLMSVIKQKLVKKDRVRIDRNHDIEHLWKFYQHYKQRHRVDDIQREEQRLQESGTFSSTTLGELKLRSSEMRKIIATLRALVEVLESLSKDADPSGVGGLIMEELRKIKKSSVTLSGELTPYNIIPLEAPSLTNPIRIFPEVKAAISAIRYTDQFPRLPAGLRISGQRDADMFDLLEFVFGFQGTELDSQ

SEQ ID NO: 130662 - protein, 90 aa, Glycine max
  Coding DNA Sequence Number=SeqID_13884
  Homolog annotation: Hit_ID=Q9ZPQ3; Match level="QueryCoverage=72%, HitCoverage=20%, E-value=1e-10, Identity=43%"; Hit description =Ethanol tolerance protein GEKO1
MQITKSAKFIFHQNLFGAITDLFHFVTKNSIEDYWKTRDVVQVMAQLVWKGLGLGGEIGVGNWRRDNDNNKILLGIPGGHYAPRHMGVVL

SEQ ID NO: 130663 - protein, 198 aa, Glycine max
  Coding DNA Sequence Number=SeqID_13885
  Homolog annotation: Hit_ID=Q6CQF3; Match level="QueryCoverage=28%, HitCoverage=59%, E-value=1e-07, Identity=72%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVRRKEADWWDPPPEETLVEARSDPDVQIVRLTRVGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 130664 - protein, 91 aa, Glycine max
  Coding DNA Sequence Number=SeqID_13886
MFSSNKRWWRLRAFSSHGRRTCEPRFALPPKVFHHRGSFCRNPHLHYKEEDVDVIRNQDVDTWSFFEVVGLVVELGYPNNISSDCGGSKII

SEQ ID NO: 130665 - protein, 208 aa, Glycine max
  Coding DNA Sequence Number=SeqID_13887
MYVHRYYSKDLYKMCYENAISPLKGQPHLPKTSYDECLPPNNKRGPRRPKKLRKRKPSKEGPRTKLRKRRKTLVINCGICVKSTYNVIICIVFILLRYPRTTTNVDNATTELETTIVASSAPSSNAKGKGLTATTKVNKGTKTPTKPTPSRVAEKDKVKPYEIIESYMALKETHEAMEKSKIKSMGKGKKIDYLEKVFFCCCSQLMQP

SEQ ID NO: 130666 - protein, 154 aa, Glycine max
  Coding DNA Sequence Number=SeqID_13888
MDDVEASAVVNGEANVMDGHVTGEEAVIEEVVDEHEVGVKAVAEEVVNEQVPDMEEVAVDVQEVLHEQMDGVEIVHNGGSDTKSSDEDEYFICSGVEEDSLHTSLDTENEDDTTDNFKKKFGGGTMMKDLMMGASKATYEVAWVEKMKQIKAVN

SEQ ID NO: 130667 - protein, 177 aa, Glycine max
  Coding DNA Sequence Number=SeqID_13889
FCDVLEGNVQNVQKEGQNGHFGTFSALGPTRKLKDEVTSSPERASSRPLWWACGVLIPSPCVNNVEEKLHDESRLIQRCFDDNKDDDKGDDKKLKGQSKNEFKMFKIESRTLQDSRGKLNSRIKNQDSRIKLPRIKIKIQESREDLIKISMKKFFFQKLSSTWIFLKTCLPKSFYSL

SEQ ID NO: 130668 - protein, 199 aa, Glycine max
  Coding DNA Sequence Number=SeqID_13890
  Homolog annotation: Hit_ID=Q9FGQ9; Match level="QueryCoverage=73%, HitCoverage=77%, E-value=3e-28, Identity=58%"; Hit description =Arabidopsis thaliana genomic DNA, chromosome 5, TAC clone:K14A3
  Pfam annotation: Domain name=DUF581; Domain location=76-134; Score =111.1; E_value=3.2e-30; Accession=PF04570.5; Description=Protein of unknown function (DUF581)
MCSSGSTSAAPTRPCYLEQGHGLASLKHMDACHNRANNFVSRSMTMGYGTSYHRTSLRNNNNNNNNNVSVSSPRSARFYDARFEDQHHPHFLSACFLCKKSLGDNRDIFMYRGDTPFCSEECRQEQIEIDEAKEKNRNLSSSMKALRNKEQRNNNNKSQRRQTRRNKTTRSVRGLLRRRRVSVYRVVTEKTNQQMNERN

SEQ ID NO: 130669 - protein, 112 aa, Glycine max
  Coding DNA Sequence Number=SeqID_13891
  Gene Ontology: Mol. function=coproporphyrinogen oxidase activity; Cellular component=cytoplasm; Biological process=porphyrin biosynthetic process
  Homolog annotation: Hit_ID=Q9FMJ4; Match level="QueryCoverage=84%, HitCoverage=20%, E-value=1e-21, Identity=48%"; Hit description =Oxygen-independent coproporphyrinogen-like protein
MDVVMLSLRTAQGIDLMSLQESFGSSIVLSLLEAYKTYFESGHVVCLDEYRRTVRIDDLNSFLNNTNAEGRVAYIRLSDPEGFLLSNELIAIAFGVIDSWKDMPPYQEAEAT

SEQ ID NO: 130670 - protein, 96 aa, Glycine max
  Coding DNA Sequence Number=SeqID_13892
MWNASESEWVEASDDDEENDDDEDESDNDGSTDEDEDDEEEEEEEAQNASVQVVDAVALIKGVGKNLRRKERRSRIEQIRASLGLSDSQRTPLVIY

SEQ ID NO: 130671 - protein, 357 aa, Glycine max
  Coding DNA Sequence Number=SeqID_13893
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q00WR6; Match level="QueryCoverage=85%, HitCoverage=40%, E-value=6e-68, Identity=45%"; Hit description=[R] KOG0379 Kelch repeat-containing proteins
  Pfam annotation: Domain name=Kelch_1; Domain location=124-175; Score =30.6; E_value=5.6e-06; Accession=PF01344.15; Description=Kelch motif
  Pfam annotation: Domain name=Kelch_1; Domain location=179-249; Score =22.3; E_value=0.0017; Accession=PF01344.15; Description=Kelch motif
  Pfam annotation: Domain name=Kelch_1; Domain location=256-312; Score =24.2; E_value=0.00046; Accession=PF01344.15; Description=Kelch motif
  Pfam annotation: Domain name=Kelch_1; Domain location=317-357; Score =6.1; E_value=0.78; Accession=PF01344.15; Description=Kelch motif
  Pfam annotation: Domain name=Kelch_1; Domain location=68-120; Score =5.3; E_value=0.96; Accession=PF01344.15; Description=Kelch motif
  Pfam annotation: Domain name=Kelch_2; Domain location=124-175; Score =23.2; E_value=0.00092; Accession=PF07646.5; Description=Kelch motif
  Pfam annotation: Domain name=Kelch_2; Domain location=179-249; Score =22.4; E_value=0.0017; Accession=PF07646.5; Description=Kelch motif
  Pfam annotation: Domain name=Kelch_2; Domain location=256-312; Score =24.5; E_value=0.00038; Accession=PF07646.5; Description=Kelch motif
  Pfam annotation: Domain name=Kelch_2; Domain location=317-357; Score =8.6; E_value=2.8; Accession=PF07646.5; Description=Kelch motif
  Pfam annotation: Domain name=Kelch_2; Domain location=68-120; Score =14.5; E_value=0.39; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=124-175::179-249::256-312::317-357::68-120::124 -175::179-249::256-312::317-357::68-120
MGKKTKKPGKGKEKTERKTARAEEKKARRETKKLSPEDDIDAILLSIQKEEAKKKDVQVDDNVPAPSPRSNCSLTVNPLKETELILYGGEFYNGNKTFVYGDLFRYDVEKLEWKLVSSPNSPPPRSAHQAVAWKNYVYIFGGEFTSPNQERFHHYKDFWMLDLKTNQWEQLNLKGCPSPRSGHRMVLYKHKIILFGGFYDTLREGQDGNSTCNPLARETSRNEEGVRYYNDLFVFDLDQFKWQEIKPKPAAMWPTARSGFQLFVYQDDIFLYGGYSKEVSSDKSNSEKGIVHSDMWSLDPKSWEWNKVKKSGMPPGPRAGFSMCVHKRRALLFGGVVDIEVEAYIFKASDWEVISMT

SEQ ID NO: 130672 - protein, 258 aa, Glycine max
  Coding DNA Sequence Number=SeqID_13894
  Gene Ontology: Mol. function=nucleic acid binding; Cellular component= chromatin; Biological process=DNA integration
  Homolog annotation: Hit_ID=Q1S7C5; Match level="QueryCoverage=77%, HitCoverage=17%, E-value=1e-50, Identity=50%"; Hit description =Integrase, catalytic region
  Subcellular localization annotation: CTP_CleavageSite=31; ConfidenceScore=5.32e-01
MSIVLGSEYSQKDPSMTESPTPPSATPSFSSSSAFSHSISEKLTDSNFLLWKQQVEPVIKAHQLHYYLVCPNIPLRYANEADQNSGTVYTVWEIQDQMHLTWLQSTLSSSILLRVLGSVHSFQLWEKIHDHFQKLTRARAHQLRAELRSTTLDSKTVSEFLLRIKALADTLASAEDPITPEQHVDIILEGLPSGNNSVISIIESKFQPMQIEEVEALLAHEMQLEKSQKKLASETASLNLTEIPFTATVVFCSSKCCI

SEQ ID NO: 130673 - protein, 326 aa, Glycine max
  Coding DNA Sequence Number=SeqID_13895
  Gene Ontology: Mol. function=transporter activity; Cellular component= integral to membrane; Biological process=transport
  Homolog annotation: Hit_ID=Q9FGR5; Match level="QueryCoverage=98%, HitCoverage=59%, E-value=1e-116, Identity=62%"; Hit description =Transmembrane transport protein-like
  Pfam annotation: Domain name=DUF983; Domain location=205-283; Score= -30.2; E_value=0.017; Accession=PF06170.3; Description=Protein of unknown function (DUF983)
MGRDLCANGKMEGLRSSWSQMEKALNDVVSKSFVGRYFKLEARKSCFTRELRAAMATFLTMVYIITVNATIIAVSGGTCSVEDCSSPTRPDCKVKPDVGYESCLAKTKSDLVVATAVSGLIGSVAMGLFANLPLGLAPGMGPNAYFAFNLVGFHGTGPLSYQTALAVICVEGIVFLLVSAVGLRGKFAKLIPHSVRLGCAAGIGLFIAFTGLQVGLGVGLIGPDAANLVTITACKVVDPETGACLGGKLQSPKFWLGLVGFLITSYGLMKNVKGSMIYGILFVTLVSWFRHTEVTYFPDTPLGDANYNYFKKVVDFHNMDSTAGVL

SEQ ID NO: 130674 - protein, 254 aa, Glycine max
  Coding DNA Sequence Number=SeqID_13896
  Gene Ontology: Mol. function=coproporphyrinogen oxidase activity; Cellular component=cytoplasm; Biological process=porphyrin biosynthetic process
  Homolog annotation: Hit_ID=Q9FMJ4; Match level="QueryCoverage=99%, HitCoverage=56%, E-value=4e-77, Identity=54%"; Hit description =Oxygen-independent coproporphyrinogen-like protein
  Pfam annotation: Domain name=Radical_SAM; Domain location=57-230; Score=45.0; E_value=2.6e-10; Accession=PF04055.11; Description =Radical SAM superfamily
  Subcellular localization annotation: CTP_CleavageSite=75; ConfidenceScore=5.61e-01
MLKSTFTPIFWVLTPKPKPPKLPSHAITNTFFTSSMPHVRHNAPVNPITPPPASSAYIHLPFCRKRCHYCDFPIVALGSTSALIDDDPRVSNYIHWLCREINATNVDQPDDANTITPLQTVYFGGGTPSLVPPRMVSSVLDTLRTKFGLREDVEISMEMDPGTFDAEKMRGMVAFREELLRACGRAHGLKEVHEAIDVVKLCEVENWSIDLIASLPHQTSDMWEESLRLAIEAQPTHVSVYDLQIEQGTKFGRL

SEQ ID NO: 130675 - protein, 517 aa, Glycine max
  Coding DNA Sequence Number=SeqID_13897
  Gene Ontology: Mol. function=histone acetyltransferase activity; Cellular component=nucleus; Biological process=regulation of transcription, DNA-dependent
  Homolog annotation: Hit_ID=Q93ZR1; Match level="QueryCoverage=99%, HitCoverage=83%, E-value=0.0, Identity=86%"; Hit description =Probable histone acetyltransferase ELO3
  Pfam annotation: Domain name=Acetyltransf_1; Domain location=408-505; Score=24.4; E_value=0.00041; Accession=PF00583.14; Description =Acetyltransferase (GNAT) family
  Pfam annotation: Domain name=Radical_SAM; Domain location=20-232; Score=41.3; E_value=3.3e-09; Accession=PF04055.11; Description =Radical SAM superfamily
  Pfam module annotation: Pfam domain module=Acetyltransf_1::Radical _SAM; Domain location=408-505::20-232
  Subcellular localization annotation: CTP_CleavageSite=38; ConfidenceScore=5.15e-01
PSSAPSPSAPPPESPSSPSCRKPHRCPHIATTGNICVYCPGGPDSDFEYSTQSYTGYEPTSMRAVRARYNPYVQARCRIDQLKRLGHSVDKVEFILMGGTFMSLPADYRDYFIRNLHDALSGHTSANVEEAVAYSEHGATKCIGMTIETRPDYCLGPHLRQMLSYGCTRLEIGVQSTYEDVARDTNRGHTVAAVADCFCLAKDAGFKVVAHMMPDLPNVGVERDMESFREFFESPLFRADGLKIYPTLVIRGTGLYELWKTGRYRNYPPEQLVDIIARILAMVPPWTRVYRVQRDIPMPLVTSGVEKGNLRELALARMEDLGLKCRDVRTREAGIQDIHHQIKPEEVELVRRDYMANQGWETFLSYEDTRQFITGLVPLAHIFPSLIVNQEGRVSTCCSNTAMTLSELSACKQDILVGLLRLRKCGRNTTCPELMGKCSIVRELHVYGTAVPVHGRDADKLQHQGYGTLLMEEAERIACREHRSTKIAVISGVGTRHYYRKLGYELEGPYMVKYLVK

SEQ ID NO: 130676 - protein, 339 aa, Glycine max
  Coding DNA Sequence Number=SeqID_13898
MEGAMLQQYRSKRMQQYRSERIVKIRGFKASRVISEVAVAACKLAAEGSRVAPMEEGLEKRELEGEVVTKVVEVVSAIKNAKHVDQVIRALHSLVTLLFPFDSSLLSDSIDQSYRDQVEVPSAEKRHAWWRAFYRGAAFPTLARFLLLDVASNWLGCFPFMAQKYIYDVFFVRGLVTEVLQILVPFLQLSASDGLDVNAVLSNSESIYYRLLVLCLLENNGVLQLAREFGGSSKLERVTDVQIKMDVSRVAQVVASIPDKARMNSTTSLSSQYPPFSFLHLDSLWAPLIEYHHGSEFLCKHSCIVFTESIQCVLQADCCPTTLPGRRKRDDFARQCRHG

SEQ ID NO: 130677 - protein, 90 aa, Glycine max
  Coding DNA Sequence Number=SeqID_13899
MASDLVNAQRRKVHEIVIIIMQQFTSNRVGNSLSTYTGKGYTCPPPNPTMKTILQADVGQYSKAQGDYVLIMRYQVGIHAQQIEGSISGS

SEQ ID NO: 130678 - protein, 487 aa, Glycine max
  Coding DNA Sequence Number=SeqID_13900
  Gene Ontology: Mol. function=protein serine/threonine phosphatase activity; Cellular component=protein serine/threonine phosphatase complex; Biological process=protein amino acid dephosphorylation
  Homolog annotation: Hit_ID=UPI00005BFE83; Match level="QueryCoverage =68%, HitCoverage=34%, E-value=1e-17, Identity=28%"; Hit description =PREDICTED: similar to CG31285-PA isoform 1
MASCVALALSKIIDPKNPLYLDDSCSGETIDWEFGFTIPKKGNLAASNCGGKGVEGTKISTVSCPEKDSDSPSNKEKSICLKGKKKLLDFNALDPDEIIDPASLNLESDDSDEDADDGASENSYSSSDSSLRPYDLSDDDSDLKRKISQLADVVAALRKSNDADGVERAIDVAEKLIRASPDELKHAARDMTRTLVQVRCSDIALEGAEESTEDKRQRSLVALVVTCPFESLESLNNLLYSPNVDISQRIMILDVMTEAAQELAESKIMKPKHQISSLISVVSDTRPWFLPSSTGTPGAGSWKEISGTGSFRNWSNSYERELPPKPNQVKKGKTRRWSLQSPTQQNQMEYSHNKLPMYAAAFMLPAMEGYDKKRQGVDLLGRDFIVLGKLIYMLGVCMKSVAMHPEASMLAPSLLNMLRSREVCHHQEAYVRRAVLFAAACVLVALHPTYISSTLLEGNAEISTGLEWIRTWALDIAESDTDKECYT

SEQ ID NO: 130679 - protein, 60 aa, Glycine max
  Coding DNA Sequence Number=SeqID_13901
MDEVEERLDRAFARQDWMDTEMTERIRGVNWMRMCVEFMEFNILVNGEGVRTILPRKGLR

SEQ ID NO: 130680 - protein, 211 aa, Glycine max
  Coding DNA Sequence Number=SeqID_13902
  Gene Ontology: Mol. function=cysteine-type peptidase activity; Biological process=proteolysis
  Homolog annotation: Hit_ID=Q6L4B6; Match level="QueryCoverage=66%, HitCoverage=51%, E-value=4e-19, Identity=29%"; Hit description=Ulp1 protease family protein, putative
  Subcellular localization annotation: CTP_CleavageSite=92; ConfidenceScore=5.34e-01
MESGFWSNVPQRLQTKRKSKFNGKGALSTSKAVLSKTKEALSRSNEALSAPKEALSKPKEAHSRPNKAHSRPNKALSTPKKALSTLKEALSRSKEKLNSGDFDIYLKKIWKIFSEDRLRHWVIGASCHFGESLESTTRSRCMLLLDSLEMANPRRLKPKIRRFVLDIYRTGDRPEAKHLISRIPFLVPKMKKDWFTFEDLDRFYERLGSLN

SEQ ID NO: 130681 - protein, 218 aa, Glycine max
  Coding DNA Sequence Number=SeqID_13903
  Homolog annotation: Hit_ID=Q93Y35; Match level="QueryCoverage=40%, HitCoverage=20%, E-value=3e-09, Identity=46%"; Hit description =Probable 26S proteasome non-ATPase regulatory subunit 6
MKFERLAKSLFFFHIDDKEKDLEHLKVTSKTVVVGQKMPCCFIHCSLVLLTWILISMLKAMRKLKDHSWFSNLCHGDSLCEEGGDWERKNWLKVRPASGVAAAIATERHPSATKRVVVARFNVADVAAAIRYRGGVEWRSGAGSEPDFRAATVTLWKFQKCPLMWKSEENPQVDQLLENPQVDQPPRVCIPRSCDPTPASCVRWPRQRVCTALPPCLR

SEQ ID NO: 130682 - protein, 58 aa, Glycine max
  Coding DNA Sequence Number=SeqID_13904
MALQTSRALESVLYSDKGMRLMPMLPYMPLVVARVTSPSTLSASSTLQDLDLPLHLHL

SEQ ID NO: 130683 - protein, 68 aa, Glycine max
  Coding DNA Sequence Number=SeqID_13905
  Subcellular localization annotation: CTP_CleavageSite=65; ConfidenceScore=5.14e-01
MEVQIATRPTWALQNVPPEGGCFWRKQPSSLGRAGKSKLRRFHNVSVGDFAKIFNRSSTFFVVLRSST

SEQ ID NO: 130684 - protein, 685 aa, Glycine max
  Coding DNA Sequence Number=SeqID_13906
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=98%, HitCoverage=98%, E-value=1e-155, Identity=44%"; Hit description =Homeodomain protein HOX3
  Pfam annotation: Domain name=START; Domain location=198-421; Score =143.1; E_value=7.3e-40; Accession=PF01852.10; Description=START domain
MDSSMASVGGSGDEGSDNFNQGRRPSYKRLTSAQTARLEREHLALWEKEMKNQHERADNTALRVENDRIHSKNLLMKKALKNMLCPSCGGAPCQDDREHLMQKMQHENSRLKEEHEKVSSLLARYLEKQMSPPEFQQVFNIPIIGSSSHAPKLENSSLNYEIGGSSSHGPSLYGMQIMDGHDHNLMGSEGIEKTLMLKVAASAMEELVRLIRINEPCWIKSSTQDGQLILQHENYEKMFPRTNNFKGVNLRVEATKDSGIVSINSIQLVDMFLDSDKWINLFPTIVTKAKTIKVLENGLVGSRSGALQLMFEQMHVLSPLVQPREFQFLRYCEQIEEGVWVIADVSFDSFRQKTSFFHSWRHPSGCMIQEMPNGCSMVTWVEHVEVDDKIQTHQLYKDLIGTGIAYGTERWIMELQRIGERFACFYVERIPIQDSGGVINSLEGRRSVMNFCHRMIKVFCESLTMSGNLDFPLLKMENNSGVRVSIRKNRNHLGQPKGVIVVAATSIWLPLHYMKVFEFLTDDRRRAQWDVLCCGNNANKVAHISNGIHPGNCISISRPFIPSENNALILQESFTTPMGSYVVYAPTDVASMISAINGEDSSMLPVLPSGFVISADGEPNAALEAFNSSDIERLGGSLLTVAFQILASSPDGINMPNMESVAAVNSLLTSTILKVKDALNCNNLE

SEQ ID NO: 130685 - protein, 215 aa, Glycine max
  Coding DNA Sequence Number=SeqID_13907
  Gene Ontology: Mol. function=nutrient reservoir activity; Cellular component=apoplast; Biological process=auxin mediated signaling pathway
  Homolog annotation: Hit_ID=Q1S4W4; Match level="QueryCoverage=87%, HitCoverage=87%, E-value=3e-82, Identity=76%"; Hit description=Cupin, putative
  Pfam annotation: Domain name=Cupin_1; Domain location=59-209; Score =162.2; E_value=1.4e-45; Accession=PF00190.13; Description=Cupin
  Pfam annotation: Domain name=Cupin_2; Domain location=94-171; Score =39.1; E_value=1.5e-08; Accession=PF07883.2; Description=Cupin domain
  Pfam module annotation: Pfam domain module=Cupin_1::Cupin_2; Domain location=59-209::94-171
MANLSLLLAVLALSLSVALAADNSALQDFCVADPKGQVLVNGFACKDPKLVEANDFFFSGLHIAGNTTNPNGSKVTPAFATQLPGLNTLGISMARIDYVPWGINPPHTHPRATEVLTVLDGTLEVGFVTSNPENRHFRKVLQKGDVFVFPTGLVHYQRNVGYDNAVAIAALSSQNPGLITVANAVFGATPDIDGDVLVKAFHLDKAIVSYLQSKF

SEQ ID NO: 130686 - protein, 138 aa, Glycine max
  Coding DNA Sequence Number=SeqID_13908
MMSNYKDVKEALLGMQPSVATYPSAGGRRGARGCVFQERKMHGVATNVHLRKTSEKLERCGLRTLIVKGSGVVFTHGEGCFPRSYVSSIAMRKSDLCSSFIRTERWCRNLPFGGRATRDSRDACSTKGIRAESPPTFI

SEQ ID NO: 130687 - protein, 684 aa, Glycine max
  Coding DNA Sequence Number=SeqID_13909
  Gene Ontology: Mol. function=manganese ion binding; Cellular component=nucleus; Biological process=double-strand break repair
  Homolog annotation: Hit_ID=Q1T0L0; Match level="QueryCoverage=100%, HitCoverage=93%, E-value=0.0, Identity=73%"; Hit description=DNA repair exonuclease
  Pfam annotation: Domain name=Metallophos; Domain location=10-264; Score=79.7; E_value=8.9e-21; Accession=PF00149.18; Description =Calcineurin-like phosphoesterase
  Pfam annotation: Domain name=Mre11_DNA_bind; Domain location=265-424; Score=187.9; E_value=2.4e-53; Accession=PF04152.5; Description=Mre11 DNA-binding presumed domain
  Pfam module annotation: Pfam domain module=Metallophos::Mre11_DNA _bind; Domain location=10-264::265-424
MEDAEAANTLRILVATDCHLGYMEKDEVRRHDSFHAFEEICAVAERHRVDFVLLGGDLFHENKPSRSTLVKAIEILRRYCLNDRPVPFQVVSDQTLNFQNASVSPSLLDDTFGHVNYEDPHFNVGLPVFTIHGNHDDPAGVDNLSVVDILSACNLVNYFGKTVLGGSGVGQITIHPILIKKGSTSVALYGLGNIRDERLNRMFQTPHAVQWMRPESQEGCQVSDWFNILVLHQNRVKTNPKNAINEHFLPRFLDFIVWGHEHECLVDPQEVPGMGFHISQPGSSVATSLIDGESKPKHGNQYRPTKIPLMSVRPFEYTEVILKDEPDIDPNDQSSILEHLDKVVDYSGFMTINPQRFGQKYVGKVANPQDILIFSKATKRAKVEGKIDDSERLRPEELNQQNIEALVAESNLNKLAKDSDNVKFEEEDLIVKVGECLEERVKERSVHSKEPTQLTADAQPWKDFQGRSAAGTGSAVSFSDDEDAMPVSSSKPSTRGRKGSSGASQTTTRGRGRGRGRGRGSSTMKQTTIDGALGFRVSQRAENGGMALEAMHVACCHINLQLRLAAQLLLDRERCNMEKEMSASVAAATAIRSGADDDNLASASSDDANKNDVEEIDDSSENESNLPGQKRAASKGRGRGSTQSSKRGRKSDNSSIHRMLVNNDDDDDDDDTDIRKRLNKSQPR

SEQ ID NO: 130688 - protein, 179 aa, Glycine max
  Coding DNA Sequence Number=SeqID_13910
  Homolog annotation: Hit_ID=Q257C6; Match level="QueryCoverage=38%, HitCoverage=38%, E-value=1e-13, Identity=62%"; Hit description =Putative thioredoxin precursor
  Subcellular localization annotation: CTP_CleavageSite=18; ConfidenceScore=5.22e-01
MGIHGKLKFLKTYHNNLSCLSRYVFFAFFSPSSPICALHRYHTVFFPHSHPNPLSSSPPPLLPLSFPSSPLFTTPAPSPPPQLLLMLSLLILRKSSKISSPKSKMTCCTPYSISLRLSVDLALNPPHLHGCAALALIVDGISSVAVTPIHRAKVIAVTSNIDVQEFFVASCLPDSRILC

SEQ ID NO: 130689 - protein, 69 aa, Glycine max
  Coding DNA Sequence Number=SeqID_13911
  Homolog annotation: Hit_ID=Q1T5D4; Match level="QueryCoverage=98%, HitCoverage=7%, E-value=2e-18, Identity=63%"; Hit description =Protein kinase; Zinc finger, RING-type
  Pfam annotation: Domain name=Ank; Domain location=26-58; Score=32.5; E_value=1.5e-06; Accession=PF00023.20; Description=Ankyrin repeat
MSTALWMAAASKKDHESDPSAQHSQHGRTALHTAVKTDDVKLVKVILAAGVDVNIHNVHNGIPLSHSLS

SEQ ID NO: 130690 - protein, 311 aa, Glycine max
  Coding DNA Sequence Number=SeqID_13912
  Gene Ontology: Mol. function=protein kinase activity; Biological process=protein amino acid phosphorylation
  Homolog annotation: Hit_ID=Q1T5D4; Match level="QueryCoverage=96%, HitCoverage=26%, E-value=1e-112, Identity=67%"; Hit description =Protein kinase; Zinc finger, RING-type
  Pfam annotation: Domain name=Ank; Domain location=193-226; Score =32.4; E_value=1.6e-06; Accession=PF00023.20; Description=Ankyrin repeat
  Pfam annotation: Domain name=Ank; Domain location=227-259; Score =23.7; E_value=0.00066; Accession=PF00023.20; Description=Ankyrin repeat
  Pfam annotation: Domain name=Ank; Domain location=262-294; Score =24.1; E_value=0.00051; Accession=PF00023.20; Description=Ankyrin repeat
  Pfam module annotation: Pfam domain module=Ank::Ank::Ank; Domain location=193-226::227-259::262-294
MTPQTHYTAPEAWGQLLKKSLNLFWDDAIGISAESDAWSFGCTLVEMGTGFVPYMDQLIIQFFFFFAFCWAGLSSEEIYQAVVKAKKLLPHYASVVGGGIPSDLWRLIGECLQFKPSKRPSLTAMLAIFLRHSQGMPRSLPASPNNDRVVPCARIRSFSEKPIPSSSIDLLFKAASDYGSNSLSSLLEAQNADEQTALHLACRCGSAELVEAILEYEEANVDVLDKDGDPPLAYALAAGSPECVRSLIKRGANVRPQLRDGFGPSVAHVCAHHGQPECMRELLLAGADPNAVDDEGESILHRAVPKKCWTF

SEQ ID NO: 130691 - protein, 447 aa, Glycine max
  Coding DNA Sequence Number=SeqID_13913
  Gene Ontology: Mol. function=ubiquitin thiolesterase activity; Cellular component=membrane; Biological process=positive regulation of cell proliferation
  Homolog annotation: Hit_ID=Q942M1; Match level="QueryCoverage=97%, HitCoverage=87%, E-value=1e-84, Identity=41%"; Hit description=STAM binding protein(Associated molecule with the SH3 domain of STAM)- like
  Pfam annotation: Domain name=Mov34; Domain location=272-388; Score= -4.2; E_value=0.047; Accession=PF01398.11; Description=Mov34MPNPAD-1 family
MAWSFPLVDDSLVSETIPRHRDYRSSSQGKKEALRKKLLHSVNELEKLKPKVQQKINEFNSRRAYQHNGWEKYHSNDFMDFSPAKKAVIPTTGEFVYQGSRGQQFSSARPVEENMRRLSLSLPCPKEETLSRHSVLGPNGLKGQWRPPASDKGVRYPTIIDLSPVEIPSLQHSLEDGSLNKKDNSISEQHKSDLESILTQSDDCKAKHADEAPSLISFEATEVHAQIEVTRQPSPPPVLAEVKDLVPAVLSHVNEEGCKTEILTSDSIVRAESPLQLHISTSMMESFMKLAKSNTDKNLETCGILAGLLLKSWDIDCYFANTTGLQKNRKFYITALIIPKQEATSSSCQATNEEEIFEVQDKQSLFSLGWIHIMLPEAVAIVMAPTDSSRSHGIFRLTTPGGMSVIRQCQQRGFHPHNQPPDGGPIYDTCTDVYMNPDLKFDVIDLR

SEQ ID NO: 130692 - protein, 193 aa, Glycine max
  Coding DNA Sequence Number=SeqID_13914
  Gene Ontology: Mol. function=adenylosuccinate lyase activity; Cellular component=cytoplasm; Biological process=purine ribonucleotide biosynthetic process
  Homolog annotation: Hit_ID=Q6D4E7; Match level="QueryCoverage=81%, HitCoverage=34%, E-value=4e-79, Identity=91%"; Hit description =Adenylosuccinate lyase
  Pfam annotation: Domain name=ASL_C; Domain location=34-148; Score =299.4; E_value=6.7e-87; Accession=PF08328.2; Description =Adenylosuccinate lyase C-terminal
MPHKVNPIDFENSEGNLGLANAVMQHLASKLPVSRWQRDLTDSTVLRNLGVGVGYALIAYQATLKGISKLEVNRDRLLDELDHNWEVLAEPIQTVMRRYGIEKPYEKLKELTRGKRVDAAGMQAFIDSLELPEAEKVRLKQMTPANYLGRAIQMVDDLNHARHVVAEVPLPVHHSGVLICGLAGVAYTFRHHH

SEQ ID NO: 130693 - protein, 986 aa, Glycine max
  Coding DNA Sequence Number=SeqID_13915
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LIK7; Match level="QueryCoverage=98%, HitCoverage=95%, E-value=0.0, Identity=59%"; Hit description =Putative calcium-transporting ATPase 13, plasma membrane-type (EC 3.6.3.8) (Ca(2+)-ATPase isoform 13)
  Pfam annotation: Domain name=Cation_ATPase_C; Domain location=843 -984; Score=53.0; E_value=9.7e-13; Accession=PF00689.11; Description =Cation transporting ATPase, C-terminus
  Pfam annotation: Domain name=Cation_ATPase_N; Domain location=77-154; Score=48.9; E_value=1.7e-11; Accession=PF00690.16; Description=Cation transporterATPase, N-terminus
  Pfam annotation: Domain name=E1-E2_ATPase; Domain location=169-418; Score=191.3; E_value=2.3e-54; Accession=PF00122.10; Description=E1 -E2 ATPase
  Pfam annotation: Domain name=Hydrolase; Domain location=422-748; Score=65.8; E_value=1.4e-16; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=843-984::77 -154::169-418::422-748
MVRPYAAYPMTCKKRWRMALNAISFVKTLHHLSNKAFHINTPTQLLRSFSYLSIGVAPEEPSFNNVDPKLLSDMVREKSSESLTQLGGVKELAKLLETDVKRGIRDIDNRKRVFGENTFTKPPSKGFLSFVLESFKDPTIIILLVCAVLSLGFGIKQHGWKDGWYDGGSIILAVVLVIVVSSVSNFNQSRQFQKLSAKSDNLGVEVVRGGRRQRVSIFEVVVGDVAYLKIGDQVPADGVFLEGHSLKVDESSMTGESDHVHVNGDTNPFLLSGTKVTDGFAHMLVTCVGMNTAWGAMMGSITREVNEETPLQVRLNKLTSAIGKVGLFVAAIVLVVSMIRYLTGSTRDDFGIREFVRGKTKSEDVMNAVVGIVAAAVTIVVVAIPEGLPLAVTLNLAYSMKKMMRDNAMVRRISACETMGSATTICTDKTGTLTLNEMKVTEVWVGKKEIGGEDRYLAPSLVQLLKQGIGLNTTASVYQPQQTSLPEISGSPTEKALLSWAVVDLGMDNIDEVKQNCEIIHVETFNSAKKRSGILMREKRGNMNMNIHTHWKGAAEMILAMCSNYYDHTGEVIVMDDGERVQIENIVKGMATKSLRCIAFAQKSCEKLEETGLTLLGILGLKDPCRPGVEAAVDSCKNAGVKIKMITGDNVHTARAIASECGILYPNNDELDEEAVVEGFQFRNFSHEERMDKIDRIRVMARSSPFDKLLMVQCLKQKGHVVAVTGDGTNDAPALKEADIGLSMGIQGTEVAKESSDIVILDDNFSSVVTVLRWGRCVYTNIQKFIQFQLTVNVAALVINFVAAVSSGKVPLSAVQLLWVNLIMDTLGALALATEEPTNDLLKMPPVGRVEPLITRVMWRNLISQALYQVLVLLILQFKGRSIFDVSEKVKNTLIFNAFVLCQVFNEFNARKLEKKNIFEGLGKNKLFVAIVGLTVILQLVMVEFLKKFANTERLTWEQWGVCVGIGALSWPIGLLVKCISVGPNK

SEQ ID NO: 130694 - protein, 55 aa, Glycine max
  Coding DNA Sequence Number=SeqID_13916
MCSSETINIAASTQKLDVDNRIALRFYYRIADNILKQEEDGDKDRVHCDITIFTG

SEQ ID NO: 130695 - protein, 54 aa, Glycine max
  Coding DNA Sequence Number=SeqID_13917
MGPKSTPRLMRTLGSSPTSLVQSSWGLLSNALGSFYHYNGNIIFKYEDHQNKIA

SEQ ID NO: 130696 - protein, 116 aa, Glycine max
  Coding DNA Sequence Number=SeqID_13918
  Gene Ontology: Mol. function=transcription regulator activity
  Homolog annotation: Hit_ID=Q1SFF6; Match level="QueryCoverage=68%, HitCoverage=8%, E-value=5e-41, Identity=100%"; Hit description =Lissencephaly type-1-like homology motif; Single-stranded DNA -binding protein, SSDP; WD40-like
  Pfam annotation: Domain name=LisH; Domain location=10-36; Score=34.9; E_value=2.9e-07; Accession=PF08513.1; Description=LisH
MSQTNWEADKMLDVYIHDYLVKRDLKASAQAFQAEGKVSSDPVAIDAPGGFLFEWWSVFWDIFIARTNEKHSEVAASYIEAGSYIAYFFLHGKSESDSCARSSVKKKLCQDELAVD

SEQ ID NO: 130697 - protein, 257 aa, Glycine max
  Coding DNA Sequence Number=SeqID_13919
  Gene Ontology: Mol. function=structural constituent of ribosome; Cellular component=intracellular; Biological process=translation
  Homolog annotation: Hit_ID=Q9ZNS1; Match level="QueryCoverage=73%, HitCoverage=100%, E-value=4e-88, Identity=83%"; Hit description=40S ribosomal protein S7
  Pfam annotation: Domain name=Ribosomal_S7e; Domain location=70-257; Score=306.2; E_value=6.1e-89; Accession=PF01251.8; Description =Ribosomal protein S7e
MLLKSNVLMRFGFKARRRVFISLRNQQGLQFLLLAADLSGLASSQLGLGGFNPLENWKYLGNVLIEMYTSRKKIHKDKDAEPTEFEESVGQALFDLENTNQELKSDLKDLYINSAVQVDVSGNRKAVVIHVPYRLRKGFRKIHVRLVRELEKKFSGKDVILVATRRILRPPKKGSAAQRPRSRTLTAVHEAMLEDVVLPAEIVGKRVRFRIDGSKIMKVYLDPKERNNTEYKLETFAAVYRKLSGKDVVFEYPVSEA

SEQ ID NO: 130698 - protein, 529 aa, Glycine max
  Coding DNA Sequence Number=SeqID_13920
  Gene Ontology: Mol. function=DNA binding; Cellular component=nucleus; Biological process=multicellular organismal development
  Homolog annotation: Hit_ID=Q1SFF6; Match level="QueryCoverage=93%, HitCoverage=50%, E-value=1e-143, Identity=60%"; Hit description =Lissencephaly type-1-like homology motif; Single-stranded DNA -binding protein, SSDP; WD40-like
  Pfam annotation: Domain name=WD40; Domain location=421-459; Score =25.6; E_value=0.00017; Accession=PF00400.22; Description=WD domain, G-beta repeat
  Pfam annotation: Domain name=WD40; Domain location=463-501; Score =46.7; E_value=7.6e-11; Accession=PF00400.22; Description=WD domain, G-beta repeat
  Pfam module annotation: Pfam domain module=WD40::WD40; Domain location=421-459::463-501
MDVDFVSTKFLDFRQVLHGAAGAMSSQVQARSQQLPGSTPDIKSEINPVLNPRAAAPEGSLIAMPGILSTCPYSNVTGSNQGSNNLTLKGWPLTGLEQLRSGLLQQQKPPFIQSPQPFHQLPMLTPQHQQQLMLAQQNLASPSASDDNRRLRMLLNNRNIGVTKDGLSNPVGDIVSNLGSPLQAGGPAFPRSDTDMLMKLKLAQLQHQQQNANPQQQQLQQHTLSNQQSQTSNHSMHQQDKMGGGGGSVNVDGSMSNSFRGNDQVSNMVSSECTFKVSKNQTGRKRKQPASSGPANSSGTANTAGPSPSSAPSTPSTHTPGDVMSMPALPHSGSSSKPLMMFSADGSGTLTSPSNQLWDDKDLELQADVDRFVEDGSLDDNVESFLSHDDTDPRDTVGRCMDEVVQGPWVHPGCCIACFTFSEINSVRASTNKVVCCHFSSDGKLLASGGHDKKAVLWFTDSLKQKATLEEHAYLITDVRFSPSMPRLATSSYDKTVRVWDVENVIRIGFSLPLNCNWSSFTETLYILK

SEQ ID NO: 130699 - protein, 205 aa, Glycine max
  Coding DNA Sequence Number=SeqID_13921
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLELNDLDRSMSFDLINGKRFKLTAYQRHSGLIHEVALQKSHQDAHSRKPTLQSNQGNQLESESEANNQI

SEQ ID NO: 130700 - protein, 148 aa, Glycine max
  Coding DNA Sequence Number=SeqID_13922
  Homolog annotation: Hit_ID=Q1SRN1; Match level="QueryCoverage=40%, HitCoverage=3%, E-value=2e-07, Identity=45%"; Hit description =Integrase, catalytic region
  Subcellular localization annotation: CTP_CleavageSite=40; ConfidenceScore=5.58e-01
MASAINNSDPPPPPPPTSTPVVDSSIPVNVTGNATEIPVSATPIQTVLPMATPIPQPILTTTPTSATGVTPSPQSSTSFSHSISAKLTNSNYLFWCQQVEPVLKVHRLHHFLVNLTIPPRFQTLVDRNLGISSPEYLAWESQDQLLLP

SEQ ID NO: 130701 - protein, 68 aa, Glycine max
  Coding DNA Sequence Number=SeqID_13923
  Homolog annotation: Hit_ID=Q1SFF6; Match level="QueryCoverage=91%, HitCoverage=7%, E-value=2e-19, Identity=74%"; Hit description =Lissencephaly type-1-like homology motif; Single-stranded DNA -binding protein, SSDP; WD40-like
  Pfam annotation: Domain name=WD40; Domain location=30-68; Score=29.3; E_value=1.3e-05; Accession=PF00400.22; Description=WD domain, G-beta repeat
MVSELILDPLNGPPIMSSTHQSLELWNMTENKTMTLSAHEGLIAALAVSTVNGLVASASHDKFVKLWK

SEQ ID NO: 130702 - protein, 700 aa, Glycine max
  Coding DNA Sequence Number=SeqID_13924
  Gene Ontology: Mol. function=metal ion binding
  Homolog annotation: Hit_ID=Q69VQ6; Match level="QueryCoverage=65%, HitCoverage=84%, E-value=1e-103, Identity=48%"; Hit description=Zinc finger (C3HC4-type RING finger)-like protein
  Pfam annotation: Domain name=PHD; Domain location=172-224; Score=7.7; E_value=0.0098; Accession=PF00628.19; Description=PHD-finger
  Pfam annotation: Domain name=VWA; Domain location=364-510; Score=3.5; E_value=0.002; Accession=PF00092.18; Description=von Willebrand factor type A domain
  Pfam annotation: Domain name=zf-C3HC4; Domain location=173-221; Score= 46.3; E_value=1.1e-10; Accession=PF00097.15; Description=Zinc finger, C3HC4 type (RING finger)
  Pfam module annotation: Pfam domain module=PHD::VWA::zf-C3HC4; Domain location=172-224::364-510::173-221
  Subcellular localization annotation: CTP_CleavageSite=71; ConfidenceScore=5.05e-01
MGEGRRRGTSKLREAARKVAVAAAYACGSFSRRKALLDPVSIDTSCSLSATASNSSFVSPSTTKNSSEEVMEETYSCITTNINNELQSKRIAKVVYRGYWHVNAPAHGTLVKPRINSFNADPTLGSFTCHNMHDHTFPSIVVKTSLDKVFEITLKLWELFFSSLGNVHCHNLCAICLDPLSYQSKGSSPGQAIFTAQCSHAFHFACISSNVRHGSVTCPICRAHWTQLPRNLNNNLGPFTSSNQSDPILRILDDSIATFRVHRRSLLRSARYDDDDPVEPDETHESPKLGFSLVPIPPNAPTGYHPALQVTKHASCPCHLSLHPLSCSSSSLLQSPPMQTPYIMCPSSNRAYLSVKLTHERATDLVLVASPNGPHLRLLKQAMALVVFSLRHIDRLAIVTYSSAAARVFPLRRMTSYGKRTALQVIDRLFYMGQSDPVEGLKKGIKILEDRVHKNPESCILHLSDNPTRPYHAVSMELPSTPIHRFHVGFGFGTSSGFVIQEFEEFLAKMLGGIVREIQLRICGAGEEVGSGRVIRIGEIRGGKERRILLDLGDFTHVYVEYSYIEGEIDECVRRTGETVVGVGEHKDDVLENGEETVRDMNTGGGRSSSVESWDFHDPYMARRWAKHLHVETSNSVGSLCNLFVEGIHQREEVVVLKLLLSAYWSLVVNKIVQAQSIVKVKIIALKIVNGKLERGGVAE

SEQ ID NO: 130703 - protein, 576 aa, Glycine max
  Coding DNA Sequence Number=SeqID_13925
  Gene Ontology: Mol. function=binding; Cellular component=nucleus; Biological process=mRNA editing
  Homolog annotation: Hit_ID=Q6K2P5; Match level="QueryCoverage=91%, HitCoverage=73%, E-value=1e-91, Identity=29%"; Hit description =Putative pentatricopeptide (PPR) repeat-containing protein
  Pfam annotation: Domain name=PPR; Domain location=159-193; Score =32.6; E_value=1.4e-06; Accession=PF01535.11; Description=PPR repeat
  Pfam annotation: Domain name=PPR; Domain location=221-255; Score =32.3; E_value=1.7e-06; Accession=PF01535.11; Description=PPR repeat
  Pfam annotation: Domain name=PPR; Domain location=305-339; Score =35.2; E_value=2.3e-07; Accession=PF01535.11; Description=PPR repeat
  Pfam annotation: Domain name=PPR; Domain location=403-437; Score =42.4; E_value=1.6e-09; Accession=PF01535.11; Description=PPR repeat
  Pfam annotation: Domain name=PPR; Domain location=474-508; Score=2.6; E_value=3.7; Accession=PF01535.11; Description=PPR repeat
  Pfam annotation: Domain name=PPR; Domain location=97-131; Score=27.8; E_value=3.8e-05; Accession=PF01535.11; Description=PPR repeat
  Pfam module annotation: Pfam domain module=PPR::PPR::PPR::PPR::PPR::PP R; Domain location=159-193::221-255::305-339::403-437::474-508::97-131
MCVCQHRRRICQPSFRFLRHFKATISTDPEKGLVKNANGVLVSNKGTPLIPKNLSLKPRSSDDALHKRNAEITIHGRPGKLEEAKKLFDEMPQRDDVSYNSMIAFYLKNRDILGAEAVFKAMPHRNIVAESAMIDGYVKVGRLDDVRNVFDSMTHSNAFSWTSLISGYFSCGRIEEALHLFDQVPERNVVFWTSVVLGFACNALMDHARRFFYLMPEKNIIAWTAMVKAYLDNGYFSEAYKLFREMPERNVRSWNIMISGCLRVNRMNEAIDMAAWTAMITACVDDGLMDEVCELFNLMPQKNVGSWNTMIDGYARNDDVGEALRLFVLMLRSCFRSNQTTMTSVVTSCDGMVELMHAHAMVIQLGFEHNTWLTNALIKLYSKSGDLCSARLVFELLKSKDVVSWTAMIVAYSNHGHGHHALQVFTRMLVSGIKPDEITFVGLLSACSHVGLVNQGRRLFVSIKGTYNLNPKAEHYSCLVDILGRAGLVDEAMDVVSTIPPSERDEAVLVALLGVCRLHGDVAIANSIGENLLEIEPSSSGGSHPQIEEIYVLLKQNLQPLMREMGCTPENLLLVD

SEQ ID NO: 130704 - protein, 103 aa, Glycine max
  Coding DNA Sequence Number=SeqID_13926
MTSQCLLQPLPASAATYPGVCLHSKGSLEITVIAMLTSLHEDVTLFLVHQGEGNKISIKSKDTYGGGGHGKMTTVVEETEALLGLMAVAPLPKYQLNQPGYEE

SEQ ID NO: 130705 - protein, 150 aa, Glycine max
  Coding DNA Sequence Number=SeqID_13927
MERRKNKRAREDDGVEIESSFENYNNNIAKKEKNEVEEKDCSKAWDYSHLTMGVFDFPWMKDGVISKSYECLDFEDDSWSSLERQETLFKASGIDFSEEYGLCETPEASMAHIQEAKLVEDMWKPFESNGLELEAEDGDCIWSFLLNKPL

SEQ ID NO: 130706 - protein, 215 aa, Glycine max
  Coding DNA Sequence Number=SeqID_13928
  Gene Ontology: Mol. function=nucleotide binding; Cellular component =membrane; Biological process=small GTPase mediated signal transduction
  Homolog annotation: Hit_ID=P92963; Match level="QueryCoverage=79%, HitCoverage=81%, E-value=8e-94, Identity=100%"; Hit description=Rab2- like protein
  Pfam annotation: Domain name=Arf; Domain location=2-171; Score=-52.6; E_value=1e-05; Accession=PF00025.11; Description=ADP-ribosylation factor family
  Pfam annotation: Domain name=GTP_EFTU; Domain location=13-186; Score=- 76.5; E_value=0.1; Accession=PF00009.17; Description=Elongation factor Tu GTP binding domain
  Pfam annotation: Domain name=MMR_HSR1; Domain location=14-126; Score=- 6.5; E_value=0.0039; Accession=PF01926.13; Description=GTPase of unknown function
  Pfam annotation: Domain name=Miro; Domain location=15-126; Score =50.4; E_value=5.8e-12; Accession=PF08477.3; Description=Miro-like protein
  Pfam annotation: Domain name=Ras; Domain location=20-173; Score =304.4; E_value=2.1e-88; Accession=PF00071.12; Description=Ras family
  Pfam module annotation: Pfam domain module=Arf::GTP_EFTU::MMR _HSR1::Miro::Ras; Domain location=2-171::13-186::14-126::15-126::20 -173
MKVVNLSSELVSSYHCTVLGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLIGNKCDLAHRRAVSTEEGEQFAKEHGLIFMEASAKTAQNVEEAFIKTAATIYKKIQDGVFDVSNESYGIKVGYGGIPGPSGGRDGPSASAGGCCS

SEQ ID NO: 130707 - protein, 343 aa, Glycine max
  Coding DNA Sequence Number=SeqID_13929
  Homolog annotation: Hit_ID=Q9LTT9; Match level="QueryCoverage=26%, HitCoverage=6%, E-value=7e-34, Identity=78%"; Hit description =Arabidopsis thaliana genomic DNA, chromosome 3, P1 clone: MDC11
  Subcellular localization annotation: CTP_CleavageSite=71; ConfidenceScore=5.86e-01
MASSGNPNPQLQQPQQQQNFDFNKLFKAPTTSSPSTSTSPSIPNPSNLNSSPSFPAPSPSTPPPSSYPTPSSSYPPPTGTYPYHHPHFLPYPALHHHQQQHQEHPLILHHLPQMHAPQRPPIFQPSPSSPHLPSSPNPPTGARLMALLGTQNPPSNQEPSLAYSSPSATVPSPVVSDFSVPPNPSGLPSTQPSGSPVNLASPQSTPTRMLSTKMPKGRHLIGEHAVYDIDVRVPGEVQPQLEVTPITKYASDPGLVLGRQIAVNKSYICYGLKLGAIRVLNINTALRYLLRGHTQVCCVAVAYDLIMNAMAAHPFHVWHFPLTLYQLDVFKCPCALDKLAGVV

SEQ ID NO: 130708 - protein, 1023 aa, Glycine max
  Coding DNA Sequence Number=SeqID_13930
  Homolog annotation: Hit_ID=Q9LTT9; Match level="QueryCoverage=99%, HitCoverage=75%, E-value=0.0, Identity=46%"; Hit description =Arabidopsis thaliana genomic DNA, chromosome 3, P1 clone: MDC11
  Pfam annotation: Domain name=WD40; Domain location=1-40; Score=0.0; E_ value=36; Accession=PF00400.22; Description=WD domain, G-beta repeat
  Pfam annotation: Domain name=WD40; Domain location=120-159; Score =27.3; E_value=5.3e-05; Accession=PF00400.22; Description=WD domain, G-beta repeat
  Pfam module annotation: Pfam domain module=WD40::WD40; Domain location=1-40::120-159
MAFFAEDLHLLASIMFIDYFPLEYDRVHSASTDGRIFIWKIKEGPDEDDKPQITGKVILALQILGESESVHPRVCWHPHKQEILMVAIGNRILKIDSMRAGKGETFSAEEPLKCSIDKLIDGVQLVGKHDGNVTELSMCQWMKSRLASASADGTVKIWEERKATPLAVIRPHDGKPVNSVTFLTAPHRPEHIVLITAGPLNQEVKIWVSDNEEGWLLPSDSESWNCIQTLDIRSSSEANPEDAFFNQVVALSRAGLYLLANAKKNTIYAVHIEYGSNPTATRMDYIAEFTVTMPILSLTGTSDSLPDGEHIVQIYCVQTQAIQQYGLNLSQCLPPPLDNVEHEKTESNLSRAFDALDGSMETGNMPQVLSGSSESAPVVSAAMNLPSSDISGLPEASISSDSETKSNDLPPRNGFEHIHTAPPPLPQSPRLSQKLSGLQNSSNNLETSSTSADHSSEQTNLDSSAERRVESEKDMADVPGSGDNLRKDDKVVNNDVSVVSNTSTTYKHPTHLVTPSEIFSNASLSSDTSHTSQGMNVQDVAAHRDAENSEVDVKVVGERGSILENTEYERDRDLHTNVAEKKEKLFYSQASDLGIQMARETYNIEGARQADNIKTIDAPDQSGNSVEEEVQDTRKDLPANISESETVAAAVQSPAPSAKGKRQKGKNSHVSGASSTSPSPFNSTDSSNDQGGNSGGSSMEPALPQLSAMQEMMSQLLSMHKEMQKQMNAMVSAPVTKEGKRLEGSLGRNMEKVVKAHTDALWARLQEENAKQEKLERDRTQQITNLISNYVNKDMVSILEKIIKKEISSIGTTITRSISQVIEKTISSAITESFQKGVGDKALNQLEKSVSSKLEATVARQIQAQFQTSGKQALQEALKTSVEASVVPAFEMSCKAMFEQIDVAFQNGLGKHTTAIQQQFDSTHSPLAMTLRDTINSASSITQTLSGQLADGQRKLLAIATNSKVAADPFVAQINNGLHEMTEDPTKELSRLISEGKFEEAFTGALHRSDVSIVSWLCSQVIG

SEQ ID NO: 130709 - protein, 373 aa, Glycine max
  Coding DNA Sequence Number=SeqID_13931
  Homolog annotation: Hit_ID=Q9ZSJ7; Match level="QueryCoverage=93%, HitCoverage=95%, E-value=7e-73, Identity=44%"; Hit description =Putative type 1 membrane protein
  Subcellular localization annotation: CTP_CleavageSite=75; ConfidenceScore=5.01e-01
MEFRVSVIWSLLLIVSLFSPEIKGEASGSVFFVDSSSNQFLRARSSNDEQPSMLLQEVGAAVSVLLGFAPPSTFSAASSSKLNEVLIPNPFKRPRAVFLLEVNGINGLWPSLGKIVQDNPMFSNSFWSTNSDKVGIQLPDETDVSVVSLDEQLEDWTDKEISDFSSLIGGSYAPDALEPLNGVLTIPLANGASVNLHMSKKAERKFIVGLMSLTHNVQRAIQMHDNLSQSAKGPAELLTGCFNGIKVLQEQYETESIAQHGVELLYATMTKIFSSLQEAYKGQIVGIIYCHVATTQESGKKFDVIFTPHHPYARWLAETNAVNATLPEVVLVRRTLAWVTGIILLISTFMGICYLMNMPLTRDTLLYSNVKLD

SEQ ID NO: 130710 - protein, 260 aa, Glycine max
  Coding DNA Sequence Number=SeqID_13932
  Homolog annotation: Hit_ID=Q6H5Z3; Match level="QueryCoverage=86%, HitCoverage=35%, E-value=6e-42, Identity=42%"; Hit description =Putative pentatricopeptide (PPR) repeat-containing protein
  Pfam annotation: Domain name=PPR; Domain location=198-232; Score =26.3; E_value=0.00011; Accession=PF01535.11; Description=PPR repeat
MRPPHLLHLRRHFATKYTAKITSTTATGRSLAAEVTVPPPLPSDPRGYLLPRRDLICKATQILLSPPSPSTTLSDPFSDLSDYLSSLSLSLTPLEASEILKALKHPSLALRFFQFCPSLNPSFRHESFTYNRLFLILSKSTNPARFDQARSLLHDMDRRAVRGSISTVNILVGFFGAGEDLERCVSLVKKWDLRLNAYTYKCLLQAYLRALDSSTAFRVYLDMIRHGYRLDIFGYNMLLDALAKDEKALGEACMDRLMDI

SEQ ID NO: 130711 - protein, 259 aa, Glycine max
  Coding DNA Sequence Number=SeqID_13933
  Gene Ontology: Mol. function=binding; Cellular component=plastid chromosome; Biological process=positive regulation of transcription, DNA-dependent
  Homolog annotation: Hit_ID=Q6H5Z3; Match level="QueryCoverage=59%, HitCoverage=69%, E-value=7e-56, Identity=37%"; Hit description =Putative pentatricopeptide (PPR) repeat-containing protein
  Pfam annotation: Domain name=PPR; Domain location=24-58; Score=50.6; E_value=5.1e-12; Accession=PF01535.11; Description=PPR repeat
  Pfam annotation: Domain name=PPR; Domain location=59-93; Score=42.9; E_value=1.1e-09; Accession=PF01535.11; Description=PPR repeat
  Pfam annotation: Domain name=PPR; Domain location=94-128; Score=36.8; E_value=7.5e-08; Accession=PF01535.11; Description=PPR repeat
  Pfam module annotation: Pfam domain module=PPR::PPR::PPR; Domain location=24-58::59-93::94-128
AGRVDIAVKFFEELENSDCKPDVISYNSLINCLGKNGDVDEAHMRFKEMQEKGLNPDVVTYSTLIECFGKTDKVEMACRLFDEMLAEECTPNLITYNILLDCLERSGRTAEAVDLYAKLKQQGLTPDSITYAVLERLQSGGHGKLRFRRQNPITGSSLCEGMGEGYCTQPYPCICKEAVSGFESMTNKSPRHNFTAAPGLALNCSFYDYGHRMNLVATRCAASSAVAKACSRTGRLASLLGTNSSFPALGFGTFLLGIP

SEQ ID NO: 130712 - protein, 475 aa, Glycine max
  Coding DNA Sequence Number=SeqID_13934
  Gene Ontology: Mol. function=histidinol dehydrogenase activity; Cellular component=chloroplast; Biological process=amino acid biosynthetic process
  Homolog annotation: Hit_ID=Q9C5U8; Match level="QueryCoverage=94%, HitCoverage=95%, E-value=1e-174, Identity=69%"; Hit description =Histidinol dehydrogenase, chloroplast precursor
  Pfam annotation: Domain name=Histidinol_dh; Domain location=49-466; Score=737.9; E_value=6.5e-219; Accession=PF00815.10; Description =Histidinol dehydrogenase
  Subcellular localization annotation: CTP_CleavageSite=33; ConfidenceScore=5.21e-01
MESALTASNWNRSLIRIRHTRPRFVATRPTAIRCSINSYRLSNLTPSELQSLKSRPRIDFSSIFSVVNPIVDDVHKRGDAAVKEFVSSSFNLIYDLVIVVCGFLTSLLILIHLLRKLSMLPTTIFMHFMLLRSHPRKGVQCKRVARSINSVGLYVPGGTAVLPSTALMLAVPAQIAGCKTIVLANPPTRDGTTCKEVLYCAKKAGVTHILKAGGAQAISAMAWGTETCPKVEKIFGPGNQYVTAAKMILQNSEAMISIDMPAGPSEVLVIADKHAIPSHVAADLLSQAEHGPDSQVVLVIVGDGVDLNAIQEELSKQCESLPRGEFASKALSHSFFVYARDMLEAINFSNLYAPEHLIINVKDAEKWESFIENAGFGGVGMDSCSVFLGPWTPESVGDYASGTNHVLPTYGYARMYGGVSLDSFLKYITVQSLSEEGLRRLGPYVATMAEVEGLEAHKRAVTLRLQDIEARQVSR

SEQ ID NO: 130713 - protein, 597 aa, Glycine max
  Coding DNA Sequence Number=SeqID_13935
  Homolog annotation: Hit_ID=O65310; Match level="QueryCoverage=44%, HitCoverage=61%, E-value=9e-79, Identity=56%"; Hit description =Pollenless3
  Pfam annotation: Domain name=TPR_1; Domain location=191-224; Score =32.5; E_value=1.4e-06; Accession=PF00515.18; Description =Tetratricopeptide repeat
  Pfam annotation: Domain name=TPR_1; Domain location=95-128; Score =3.6; E_value=2; Accession=PF00515.18; Description=Tetratricopeptide repeat
  Pfam annotation: Domain name=TPR_2; Domain location=191-224; Score =26.9; E_value=7.2e-05; Accession=PF07719.7; Description =Tetratricopeptide repeat
  Pfam annotation: Domain name=TPR_2; Domain location=95-128; Score =9.8; E_value=2.4; Accession=PF07719.7; Description=Tetratricopeptide repeat
  Pfam annotation: Domain name=TPR_4; Domain location=191-216; Score =19.6; E_value=0.011; Accession=PF07721.5; Description=Tetratricopepti de repeat
  Pfam module annotation: Pfam domain module=TPR_1::TPR_1::TPR_2::TPR _2::TPR_4; Domain location=191-224::95-128::191-224::95-128::191-216
  Subcellular localization annotation: CTP_CleavageSite=10; ConfidenceScore=5.02e-01
MQFERGSMARCYMTPPPQPPSSWKPPHSQSPSVPFSERKKSPNSANKIDLFHIIHKVPAGDSPYVKAKQVQLVDKDPGRAISLFWAAINARDRVESALKDMALVMKQLNRSDEAIEAIRSFRHLCPSDSRDSLDNILVELYKRSGRIDEEIAMLHHKLKQIEDGLTFVGRTTKQARSQGKKIQITAEQEISRILGNLAWAYLQKGDYKAAEEHYRKALSFEVDRNKQCNLAICLIHMNKIKEAKFLLQAVRTATKNRKMDDSFAKSFERASQMLIEIETSSSSQNAAFSMTTMSQCSPQSFENSIRKSSDRVQSGSESRSETSEGDVPHARRRLYQSPDPSRRDLSVPCTKPKRCSWGFNTGYRREAWGDVNSDYKPSFGTPPNDKHATRMLNSRENGLSSPANGKWRAMTLEDQAILKHEATTATSSDSLHALNTEVAMEFTEKEKSAADDSSYRSILSESHVTVVNGANEFASGKRKPEKKSWADIVEEEQNEEYDFLSGFTNFDDKNGAEVFNDENEDSNIIYPSSWLQNLPEWSNKKLESSDKKDDYASESTILSRNPTARRSLCFNPELIGEKKLTRRSRLQDLMDGEGSHC

SEQ ID NO: 130714 - protein, 54 aa, Glycine max
  Coding DNA Sequence Number=SeqID_13936
MMKYYTTSIQPSMKRENACNGKKITDSQGWGVGSIIRDSDGVVGSSNLVHTKIM

SEQ ID NO: 130715 - protein, 115 aa, Glycine max
  Coding DNA Sequence Number=SeqID_13937
  Homolog annotation: Hit_ID=Q1KL58; Match level="QueryCoverage=95%, HitCoverage=7%, E-value=2e-13, Identity=41%"; Hit description=Dicer -like 2 spliceform 1
  Pfam annotation: Domain name=dsrm; Domain location=45-110; Score =33.1; E_value=9.8e-07; Accession=PF00035.15; Description=Double -stranded RNA binding motif
VLGDIIESLAGAILVDSRFNKEVVWQSIRPLLEPLVTPETLKLHPIRELNELCQKRSYKIVLEDVSRKDGVTNYRMELEADGVIHEYEYTGPALRDTAKKIACKEILNSLKEEEL

SEQ ID NO: 130716 - protein, 126 aa, Glycine max
  Coding DNA Sequence Number=SeqID_13938
  Gene Ontology: Mol. function=glyceraldehyde-3-phosphate dehydrogenase (phosphorylating) activity; Cellular component=cytoplasm; Biological process=glucose metabolic process
  Homolog annotation: Hit_ID=P08735; Match level="QueryCoverage=90%, HitCoverage=34%, E-value=9e-55, Identity=86%"; Hit description =Glyceraldehyde-3-phosphate dehydrogenase, cytosolic 1
  Pfam annotation: Domain name=DapB_N; Domain location=4-74; Score= -36.3; E_value=0.05; Accession=PF01113.11; Description=Dihydrodipicoli nate reductase, N-terminus
  Pfam annotation: Domain name=Gp_dh_N; Domain location=4-123; Score =155.9; E_value=1.1e-43; Accession=PF00044.14; Description =Glyceraldehyde 3-phosphate dehydrogen
  Pfam module annotation: Pfam domain module=DapB_N::Gp_dh_N; Domain location=4-74::4-123
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKVSTSSTACYSY

SEQ ID NO: 130717 - protein, 43 aa, Glycine max
  Coding DNA Sequence Number=SeqID_13939
METSGSHGKMSIPQTIGQIVSERESIVTERNEGCKFTRNKARS

SEQ ID NO: 130718 - protein, 291 aa, Glycine max
  Coding DNA Sequence Number=SeqID_13940
  Homolog annotation: Hit_ID=O24097; Match level="QueryCoverage=98%, HitCoverage=81%, E-value=1e-103, Identity=56%"; Hit description =MtN19 protein precursor
  Pfam annotation: Domain name=SURNod19; Domain location=31-291; Score =367.8; E_value=1.7e-107; Accession=PF07712.3; Description=Stress up -regulated Nod 19
MFNMRFVSQDWVVSCALILLVSCTTYSSASLGKPENNIKTSVFLSPKIELGPGGHIALKSFNAELVDESGKSLPLQETYLHHCGFCQDGPLIQYFGLGSETRGTATDIPDPFGIEVGNPSDIPYGYDEKWLINVHPIDTRGVEDRLGCIECRCDLYNITKDADGNPLSPDYKGGLDCCPDNTTCRLNKGFKGPKRTLYLKYTVKWFSWDNYVVPLKIYILDVTDVLSVSKGVTPMHNCEVEYQVEPCSKGYSSSACIDVRKTSFPMQNGGYVIYGVGHQHVGAIASKLYGQ

SEQ ID NO: 130719 - protein, 455 aa, Glycine max
  Coding DNA Sequence Number=SeqID_13941
  Gene Ontology: Mol. function=motor activity; Cellular component =myosin complex; Biological process=signal transduction
  Homolog annotation: Hit_ID=Q1T0L3; Match level="QueryCoverage=99%, HitCoverage=37%, E-value=0.0, Identity=75%"; Hit description=IQ calmodulin-binding region; Myosin head, motor region; Myosin, N- terminal, SH3-like
  Pfam annotation: Domain name=IQ; Domain location=120-140; Score=25.4; E_value=0.00021; Accession=PF00612.17; Description=IQ calmodulin -binding motif
  Pfam annotation: Domain name=IQ; Domain location=143-163; Score=21.1; E_value=0.004; Accession=PF00612.17; Description=IQ calmodulin -binding motif
  Pfam annotation: Domain name=IQ; Domain location=180-200; Score=26.8; E_value=7.9e-05; Accession=PF00612.17; Description=IQ calmodulin -binding motif
  Pfam module annotation: Pfam domain module=IQ::IQ::IQ; Domain location=120-140::143-163::180-200
MHQLETTTPHFIRCIKPNTKQQPGVYDEDLVLQQLKCCGVLEVVRISRAGYPTRMTHQEFSRRYGFLLSEANTSQDSLSISVAVLQQFNIPPEMYQVGFTKLYLRTGQIGALEDRRKHLLQGILGIQKSFRGYQARRHYHELKNGVTILQSFVRGEIARREYGVMVKSSMTISTENIKEIEAATTLQSVIRGWLVRRHASSLNKSKKSPGNARSRRRSRVKMPEVKDVSGERGQNLPSALAELQRRVIKAEATIEQKEEENAELKEQLKQFERRWIEYEKRMKSMEDMWQKQMASLQMSLAAARKSLASENASSQIARRDVASPFGYDSEDATSVGSRTPRTPGASTPLKYSSSLTEAGAGRDAKGTLTSVSNLMKEFEQRRHTFDDDARALVEVKTGQSANTNSVEELRKLKHSFEGWKKEYKARLRETKARLHKSEMDKSRRRWWGKLSSRAL

SEQ ID NO: 130720 - protein, 74 aa, Glycine max
  Coding DNA Sequence Number=SeqID_13942
  Gene Ontology: Mol. function=glyceraldehyde-3-phosphate dehydrogenase (phosphorylating) activity; Cellular component=cytoplasm; Biological process=glycolysis
  Homolog annotation: Hit_ID=Q53I52; Match level="QueryCoverage=93%, HitCoverage=23%, E-value=2e-26, Identity=78%"; Hit description =Glyceraldehyde-3-phosphate-dehydrogenase
  Pfam annotation: Domain name=Gp_dh_C; Domain location=1-52; Score= -69.4; E_value=0.021; Accession=PF02800.10; Description =Glyceraldehyde 3-phosphate dehydrogen
MEESEGKLKAILGYTEDDVVSTNFVGDSRSSIFYAKAGIALNEKFLKLITWYNNEWGYSNYIVDLIAHIVKMSR

SEQ ID NO: 130721 - protein, 68 aa, Glycine max
  Coding DNA Sequence Number=SeqID_13943
METSGSHGKMSIPQTIGQIVSERESIVTGNFNYRNSIVNLGTKDLYSDRWSCALIADALSHDVYKHEY

SEQ ID NO: 130722 - protein, 40 aa, Glycine max
  Coding DNA Sequence Number=SeqID_13944
MVMCLFKMSMDVSAGTWEKSDSMLPELFLLNSTFNLKQTG

SEQ ID NO: 130723 - protein, 673 aa, Glycine max
  Coding DNA Sequence Number=SeqID_13945
  Gene Ontology: Mol. function=motor activity; Cellular component =myosin complex; Biological process=actin filament-based movement
  Homolog annotation: Hit_ID=Q1T0L3; Match level="QueryCoverage=87%, HitCoverage=51%, E-value=0.0, Identity=72%"; Hit description=IQ calmodulin-binding region; Myosin head, motor region; Myosin, N- terminal, SH3-like
  Pfam annotation: Domain name=Myosin_head; Domain location=194-671; Score=440.2; E_value=2.8e-129; Accession=PF00063.11; Description =Myosin head (motor domain)
MMISASMSSLTRSSLEEMLESLRRRDEEEKPKDLPPALPSRPPSRARLPPGRRSLPNNFKVDGENGVMGHRRKGSFGTKKVKLNVESPYEVKSEEIVSEQSSPRPVFTSNDASAECEAPPPTGELEDDNVVYFIKKATEREVGAGNNTVNFRRGSICFTLKWKREFLSLFCFSKVIKVARSELLPANPDILEGVEDLIQLSYLNEPSVLHNLQSRYSQDMIYSKSGPILIALNPFKDVQIYGDDYISAYRQKLMDRPHVYAMADAAYNEMMRDEANQSIIISGESGSGKTETAKIAMQYLAALGGGCSGIENEVLLTNFILEAFGNAKTSRNDNSSRFSRVVQLALDERSYHIFYQLCAGSSSDLKERLNLRAASEYKYLNQSDCMTIDGVDDAKKFHRLMKALDVIRMCKEDQELVFKMLTAILWLGNISFQDTDNENHIEVVNDEAVTNAALLMGCSSHELMEALSTHKIQAGKDTITKTLTLRQAIDARDALAKFIYASLFGWLVEQVNKSLEVGKRRTGRSISILDIYGFESFQNNSFEQFCINYANERLQQHFNRHLFKLEQEDYELDGIDWTKVDFEDNQVCLDLFEKKPLGLLSLLDEESNFPRASDLTLANKLKQHLHANPCFKGERGRAFSVCHYAGECTQSIAVSSINFMLILSYCSSNVTDN

SEQ ID NO: 130724 - protein, 97 aa, Glycine max
  Coding DNA Sequence Number=SeqID_13946
MAKNRNNKKKRNGVVSMDTTDASVSEQSQAMDTSESGVLNTASGATNIEINHCLVLKLWSLVDLANVAKISIKCLFQLLGKVDSKSIHLVHCKVKLC

SEQ ID NO: 130725 - protein, 110 aa, Glycine max
  Coding DNA Sequence Number=SeqID_13947
  Homolog annotation: Hit_ID=Q9FKM4; Match level="QueryCoverage=94%, HitCoverage=17%, E-value=7e-17, Identity=51%"; Hit description =Arabidopsis thaliana genomic DNA, chromosome 5, P1 clone:MUA2
MPGWCLREWTSTEGQVLTPRILFLVSMAEWIILAMHLLCMVANMEVEAEGHVDLNILVVELLWCHIDTATSHDDYINNLVDDLDALEDIARVVMLCDSDAEDVGVVHEVD

SEQ ID NO: 130726 - protein, 52 aa, Glycine max
  Coding DNA Sequence Number=SeqID_13948
MLRETAKAKSPTKVEKKNQAPTKIIDNVVKFEPDWSIRPRIKPMIDLVKLSN

SEQ ID NO: 130727 - protein, 43 aa, Glycine max
  Coding DNA Sequence Number=SeqID_13949
MEPFVRHFKGNLMDGEIVYLATRTQHCAIREMRTKLARQSDLI

SEQ ID NO: 130728 - protein, 244 aa, Glycine max
  Coding DNA Sequence Number=SeqID_13950
  Gene Ontology: Mol. function=unfolded protein binding; Cellular component=cytoskeleton; Biological process=tubulin folding
  Homolog annotation: Hit_ID=O04350; Match level="QueryCoverage=64%, HitCoverage=97%, E-value=2e-37, Identity=56%"; Hit description =Tubulin-specific chaperone A
  Pfam annotation: Domain name=TBCA; Domain location=90-172; Score =87.5; E_value=4.2e-23; Accession=PF02970.6; Description=Tubulin binding cofactor A
PYPCICKEVVSGFELMTNKSPRHNFTAAPRLALKNFVPHCPEALRYAKISISRKLQERLQALAINKRSVLISDLRGRASLWFRMATTVRSLKIKTSTCKRIVKELHSYEKEVEREAAKTADMKEKGADPYDLKQQENVLAESRMMIPDCRKRLEAALADLKGLLENPPWRVYMAEFWPSAMFPPSAINNTDPVLYRIEFPSSYSFTMLWDKAELEESDEKASPEIDEARNTIVEVEKVFETTED

SEQ ID NO: 130729 - protein, 391 aa, Glycine max
  Coding DNA Sequence Number=SeqID_13951
  Gene Ontology: Mol. function=transporter activity; Cellular component= integral to membrane; Biological process=transport
  Homolog annotation: Hit_ID=Q69HW2; Match level="QueryCoverage=100%, HitCoverage=39%, E-value=1e-171, Identity=74%"; Hit description=OqxB
  Pfam annotation: Domain name=ACR_tran; Domain location=1-391; Score= -449.9; E_value=0.00011; Accession=PF00873.9; Description =AcrBAcrDAcrF family
  Subcellular localization annotation: CTP_CleavageSite=47; ConfidenceScore=5.26e-01
MNTEGVAYSVAFPGLNALQFTNTPNTGTVFFGLKPFSERSRTAAEINAEINAKISKIQQGFGFSIMPPPILGLGQGSGYSLYVQDRAGLGYGALQTAINTLSGAVMQTPGMMFPISSYHANVPQLDVQVYLGSSYVNDFNKFGRTWRVMAQADGDFRDSVQDIANLRTRNDRGEMVPIGSMVNITTTYGPDPVIRYNGYPAADLIGDADPRVLSSAQAMEKLEAMSSQVLPNGMNIEWTDLSYQQATQGNTAFIVFPVAVLLAFLVLAALYESWTLPLAVILIVPVTMLSALVGVWLTGGDNNVFVQVGLVVLMGLACKNAILIVEFARELEMQGKGIVESALEACRLRLRPIVMTSIAFIAGTVPLILGEGAGAEVRGVTGITVFSGMLG

SEQ ID NO: 130730 - protein, 317 aa, Glycine max
  Coding DNA Sequence Number=SeqID_13952
  Homolog annotation: Hit_ID=Q4JLV7; Match level="QueryCoverage=94%, HitCoverage=90%, E-value=6e-39, Identity=39%"; Hit description=Fiber expressed protein
  Pfam annotation: Domain name=DUF761; Domain location=7-304; Score= -17.9; E_value=7e-09; Accession=PF05553.2; Description=Cotton fibre expressed protein
MGYVSVKVVVISTGVLSMAMGLKLTLPLLSHFLLNQAPHLWTLLLTCFTPPYLYIFLNFIILTIVASSKLNNHHHSPPDTTLLPAIYDGPPASVQIPAPAAAVQSDYNAVSSDKYLYETKPTLSYDSVAGGNGSAGYVYDENTPVKAAVNNNDDDDDEAVGVGVLSPSLQRKDSSDFAFADENEKPLVSARFSHRKSVRASPEGGGVGSGEGEEAGNVGEHVEDDKGGESDAFNAASEEGGDVGDDAAGDTVTGLERRRRAGDEEVGDVRGEGEERVGEATEEGAVAESGRVEPPSGSVHQQVQRGYEAAEAGVAET

SEQ ID NO: 130731 - protein, 148 aa, Glycine max
  Coding DNA Sequence Number=SeqID_13953
  Gene Ontology: Cellular component=nucleus
  Pfam annotation: Domain name=Bromo_TP; Domain location=15-90; Score =62.3; E_value=1.6e-15; Accession=PF07524.3; Description=Bromodomain associated
  Subcellular localization annotation: CTP_CleavageSite=59; ConfidenceScore=5.04e-01
DLVGVNDAQVAETPSEFSFAVAKIAVAQVCQSVGFKTFKCNALKTLTNVSTRYLETIVRSAASFANASNRTNSNLFDIINGIHDLCSAQGFPGGSVMHKVNLLRSSALKDIMNFVNLSNKVPFAKPIPFRNVFQERKCGEKLWETFTC

SEQ ID NO: 130732 - protein, 63 aa, Glycine max
  Coding DNA Sequence Number=SeqID_13954
MESVSVARVGAEVVFEDLLSFVLSEGRVGIGNRGSERAGNDDVAKSMLVLEVIDYCKHKSKRN

SEQ ID NO: 130733 - protein, 119 aa, Glycine max
  Coding DNA Sequence Number=SeqID_13955
MSSNKLVSPKLVHLIAVLIPIVGLGAFLLWAGRDIMQGTCPNCGNDFQVFKSSLNDDLQLCPFCGQPFSVVGNEFVKDSVKFSNQSTTFGQAFNNFTRSRNEKDSGKAIDVEAEIKDVD

SEQ ID NO: 130734 - protein, 271 aa, Glycine max
  Coding DNA Sequence Number=SeqID_13956
  Gene Ontology: Cellular component=nucleus
  Homolog annotation: Hit_ID=Q6Z2I7; Match level="QueryCoverage=69%, HitCoverage=38%, E-value=1e-50, Identity=59%"; Hit description=SET domain-containing protein-like
  Pfam annotation: Domain name=SET; Domain location=91-270; Score=44.7; E_value=3.2e-10; Accession=PF00856.18; Description=SET domain
MGLNSLFNRNRDGDGDGTIDFEEFRYFLEAFHGKSRHPSKLGFIGRVGRYLGYGHWEDGYVFAEPVASANMRIDVSVTISAPATRPHQVGNQRRKKFHVAVILLCCRTIFPCASPLSNKTLLCSITWRAKSLHLTEELWAMKLGLKLLQERAKVGSFWWPYISNLPETYTVPIFFSGEDIKNLHYAPILHQREVKRTLVSLTQDKHPFGGQEVDASSLGWAMSAVSSRAFRLYGEKDPNGIRIDIPMMLPLIDMCNHSFNPNARIVQEQDT

SEQ ID NO: 130735 - protein, 277 aa, Glycine max
  Coding DNA Sequence Number=SeqID_13957
  Gene Ontology: Mol. function=transporter activity; Cellular component= integral to membrane; Biological process=transport
  Homolog annotation: Hit_ID=Q9ZU96; Match level="QueryCoverage=97%, HitCoverage=46%, E-value=1e-64, Identity=50%"; Hit description =Expressed protein
  Pfam annotation: Domain name=Ank; Domain location=154-184; Score=0.8; E_value=24; Accession=PF00023.20; Description=Ankyrin repeat
  Pfam annotation: Domain name=Ank; Domain location=188-221; Score =17.6; E_value=0.044; Accession=PF00023.20; Description=Ankyrin repeat
  Pfam annotation: Domain name=Ank; Domain location=222-252; Score =23.2; E_value=0.0009; Accession=PF00023.20; Description=Ankyrin repeat
  Pfam annotation: Domain name=Ank; Domain location=51-85; Score=11.3; E_value=0.72; Accession=PF00023.20; Description=Ankyrin repeat
  Pfam annotation: Domain name=Ank; Domain location=86-152; Score=0.2; E_value=30; Accession=PF00023.20; Description=Ankyrin repeat
  Pfam module annotation: Pfam domain module=Ank::Ank::Ank::Ank::Ank; Domain location=154-184::188-221::222-252::51-85::86-152
MEAKGVRFLAYQSIFSSVGSGDFDGVKKLVEEVKKEEGSSLSDVMSLQNDAGETALYIAAENNLQEMFSFLLSICHFEVVKIRSKADMNAFHVAAKRGNLAPIQKKDNKKAVEVVRTRTKEWKCWGTRSNVNPTDIVRELLNIWPEVCKLCDSSNTSPLYSAAVQDHLDVVDAILDVDVSSMFIVRKNGKTSLHNAARYGVHRIVKTLIARDPGIVCIKDKKGQTALHMAVKGQCTSVVEEILLADPSILNERDKKGNTALHMATRKCRSQVKFTFY

SEQ ID NO: 130736 - protein, 443 aa, Glycine max
  Coding DNA Sequence Number=SeqID_13958
  Gene Ontology: Mol. function=binding; Cellular component=cytoplasm; Biological process=phospholipid metabolic process
  Homolog annotation: Hit_ID=Q10PS3; Match level="QueryCoverage=98%, HitCoverage=56%, E-value=0.0, Identity=76%"; Hit description=HEAT repeat family protein, expressed
  Pfam annotation: Domain name=HEAT; Domain location=100-136; Score =3.6; E_value=15; Accession=PF02985.12; Description=HEAT repeat
  Pfam annotation: Domain name=HEAT; Domain location=141-177; Score =23.9; E_value=0.00058; Accession=PF02985.12; Description=HEAT repeat
  Pfam annotation: Domain name=HEAT; Domain location=18-54; Score=39.5; E_value=1.1e-08; Accession=PF02985.12; Description=HEAT repeat
  Pfam annotation: Domain name=HEAT; Domain location=213-249; Score =5.8; E_value=8.5; Accession=PF02985.12; Description=HEAT repeat
  Pfam annotation: Domain name=HEAT; Domain location=296-332; Score =0.9; E_value=33; Accession=PF02985.12; Description=HEAT repeat
  Pfam annotation: Domain name=HEAT; Domain location=337-373; Score =8.9; E_value=3.5; Accession=PF02985.12; Description=HEAT repeat
  Pfam annotation: Domain name=HEAT; Domain location=59-94; Score=8.5; E_value=3.9; Accession=PF02985.12; Description=HEAT repeat
  Pfam module annotation: Pfam domain module=HEAT::HEAT::HEAT::HEAT::HEA T::HEAT::HEAT; Domain location=100-136::141-177::18-54::213-249::296 -332::337-373::59-94
GGLIGLAAATVGLTSEAAQHLEQIVPPVLNSFSDQDSRVRYYACEALYNIAKVVRGDFIIFFNQIFDALCKLSADSDANVQSAAHLLDRLVKDIVTESDQFSIEEFIPLLRERMNVLNPYVRQFLVGWITVLDSVPDIDMLGFLPDFLDGLFNMLSDSSHEIRQQADSALSEFLQEIKNSPSCASFSTTTLTQKQSFLFIYHFLTRAVLLLKSVDYGRMAEILVQRAGSPDEFTRLTAITWINEFVKLGGDQLVPYYADILGAILPCIADKEEKIRVVARETNEELRALKADPAEAFDVGAILSIARRQLSSELEATRIEALHWISTLLNKYRTEVLEFLNDIFDTLLKALSDPSDEVVLLVLDVHACIAKDPQHFRQLVVFLVHNFRVDNSLLEKRGALIIRRLCVLLNAERVYRELSTILEAESDLDFASIMVQLYKKLFE

SEQ ID NO: 130737 - protein, 242 aa, Glycine max
  Coding DNA Sequence Number=SeqID_13959
  Gene Ontology: Mol. function=structural constituent of nuclear pore; Cellular component=nuclear pore; Biological process=nucleocytoplasmic transport
  Homolog annotation: Hit_ID=Q5Z4E0; Match level="QueryCoverage=92%, HitCoverage=15%, E-value=3e-66, Identity=57%"; Hit description =Putative Nuclear pore complex protein Nup155
MEFPEQHTLLQYYTGPDGRGTVDDISRRLRDGCPSYYKESDYKFFLAVEALERSAMTIDAEDKENLAREAFNSLSKVPESVDLRTVCKRFEDLRFYEAVVRLPLQKAQALDPAGDAYNDDIDATVREQALAQRELCYEIIISALRSLKGDNLQREFGTPIKSTASQSALDPASRKKYICQIVQLGVQSPDRIFHEYLYQAMIDLGLENELLEYGGPDLLPFLQSAGRNSIHEVVYYLFLPNN

SEQ ID NO: 130738 - protein, 129 aa, Glycine max
  Coding DNA Sequence Number=SeqID_13960
  Gene Ontology: Mol. function=GTPase activity; Cellular component =microtubule; Biological process=cell division
  Homolog annotation: Hit_ID=Q1SLG1; Match level="QueryCoverage=50%, HitCoverage=10%, E-value=2e-20, Identity=77%"; Hit description =Dynamin central region; Dynamin; Dynamin GTPase effector
  Pfam annotation: Domain name=Dynamin_N; Domain location=38-127; Score= -43.4; E_value=0.056; Accession=PF00350.13; Description=Dynamin family
MATMTSLIGLINKIQRACTVLGDHGGEGLSLWEALPSVAVVGGQSSGKSSVLESVVGRDFLPRGSGESFSLSYYVLLSFVILRDLFINVVHKELLLIYIDVQEMMPCLLVVTECEMKHHYPKVVTVVVW

SEQ ID NO: 130739 - protein, 508 aa, Glycine max
  Coding DNA Sequence Number=SeqID_13961
  Gene Ontology: Mol. function=microtubule binding; Cellular component =cortical microtubule, transverse to long axis; Biological process =cytoskeleton organization and biogenesis
  Homolog annotation: Hit_ID=Q1SLE1; Match level="QueryCoverage=97%, HitCoverage=73%, E-value=0.0, Identity=76%"; Hit description=Myosin II heavy chain-like
  Pfam annotation: Domain name=Myosin_HC-like; Domain location=81-461; Score=781.4; E_value=5.3e-232; Accession=PF07058.2; Description =Myosin II heavy chain-like
MAAQFAAEATLRRVHAAQKDDDMPPIEAILAPLEAELKLARQEIAKLQDDNKALDRLTKSKEAALIEAEKTVQIALAKASMVDDLQNKNQELIKQIEICQYARHNNVISDIWFHHHLSQEENKILDKMHRLKVAEVEKLTQTVRELEEAVLAGGAAANAVRDYQRKFQEMNEERKTLDRELARAKVTANRVAVVVANEWKDANDKVMPVKQWLEERRFLQGEMQQLRDKLAITERTAKSEAQLKEKYQLRLKVLQESLRETSNSINRGTSEGRCVSNGPSRRQSLGGADNISKLTSNGFLKRSPSTQIRSSVSSSTVLKHAKGTSKSFDGGTRSLERSKILLNGKPPSYSFNQSSEGTKVREEKDKWKGNSDDKPNDFPTVDTDDSVPGVLYDLLQKEVLALRKVGHEKDQSLKDKDDAIELIVAMVVICQMLAKKVDTLTKAMEVEAKKMRREVASMEKEVAAMRVEKEQDTRAKRFSNVKGPVNSAQHQLVSGRYISLGVSVQGQL

SEQ ID NO: 130740 - protein, 526 aa, Glycine max
  Coding DNA Sequence Number=SeqID_13962
  Gene Ontology: Mol. function=metal ion binding
  Homolog annotation: Hit_ID=Q1SLE0; Match level="QueryCoverage=36%, HitCoverage=84%, E-value=2e-91, Identity=76%"; Hit description =Ribosomal protein S5, bacterial and organelle form
  Pfam annotation: Domain name=Ribosomal_S5_C; Domain location=420-493; Score=111.5; E_value=2.4e-30; Accession=PF03719.5; Description =Ribosomal protein S5, C-terminal domain
  Pfam annotation: Domain name=zf-C3HC4; Domain location=254-294; Score= 41.9; E_value=2.2e-09; Accession=PF00097.15; Description=Zinc finger, C3HC4 type (RING finger)
  Pfam module annotation: Pfam domain module=Ribosomal_S5_C::zf-C3HC4; Domain location=420-493::254-294
  Subcellular localization annotation: CTP_CleavageSite=42; ConfidenceScore=5.09e-01
MSSPNSARQPHAPLLLPRPDAAARLPVLALLLGRRGHSVMVRETAARELEERRADWTYSKPVVALDMTWNMAFVVVSAVMLACTVKENPNTPIRWWICGYALQCLLHVALVWLEYRRRNDAPGDEDSAANLDYDDVNDSDEDDVGTSGSSSSTGLTVVFLAFDVFFAIFCVVLACLIGIALCCCLPCIIAILYAVAGQEGASESDLSILPKYRFQMLSNEETPGEGGGGSMIPMETSNGYSVNERTLSPEDAECCICISSYEDGAELHVLPCNHHFHSTCIVKWLKMNATCPLCKYNILKGNEQAETVAVSGCGFGGRGRGGDRGRGWRRTAGRRGEEEEWVPVTKLGRLVKEGKIRSLEQIYLHSLPIKEYQIIDTFVGPTLKDEVMKIMPVQKLSVIPVRRGYWGNKIGKPHNVPFKVTGKCGSVTVRMVPAPRGSGIVAIRVPKKVLQFAGIDGVFTSSRGSTKTLGNFVKATFDCLLKSYGFLTLEFWKETRFSKSPFQEYTDLLAKPTGKALILEEERVEA

SEQ ID NO: 130741 - protein, 978 aa, Glycine max
  Coding DNA Sequence Number=SeqID_13963
  Gene Ontology: Mol. function=structural constituent of nuclear pore; Cellular component=nuclear pore; Biological process=nucleocytoplasmic transport
  Homolog annotation: Hit_ID=Q5Z4E0; Match level="QueryCoverage=90%, HitCoverage=53%, E-value=0.0, Identity=65%"; Hit description =Putative Nuclear pore complex protein Nup155
MVRKVEEKERNEQQLVLVVGKRKCLPATINLRKPPQNPTSPSVLTLLSSILHHETPFSPLFRLFQFALFSVLFIGKATKERERGLLQFHSGMSWEDEIVMRDVTNAGLVVSDRIGREVSSQLDLEEALEASRYASHPYSTHPREEIAGKCGHNYGCGLLKNLDFAVKITVAQCHQWQKAKIPPYKHVIAAYGATIAGLHSQIAYGGWQKICHAIPPWCCHLTTLRLQTFFKTMGVSWPPLVEVVNTWELPPVLIERYNAAGGEGTAFCGIFPEIRRAWASVDNSLFLWRFDKWDGQCPEFSGEEQAICAVGLAKSKPGVFVEAIQYLLVLATPVELILVGVCCSGGADGSDPFAEVTLQPLPEHTIPSDGVTMTCVACTDKGRIFLAGRDGHIYEILYSTGSGWQKRCRKICITAGLGSVISRWVIPNVFNFGAVDPIVEMVFDNERQILYARTEEMKLQVYVLGPNGDGPLKKVAEERNLVNQRDAHYGARQSTGSRVSSRSPKPSIVCISPLSTLESKWLHLVAVLSDGRRMYLSTSPSSGSLTGFNTNHHKPSCLKVVTTRPAPPWGVSGGLTFGAMALAGRPQNEDLSLKVEAAYYSAGTLILSDASPSTMPSLLVLNRDSSTQSSPSGNLGTSTRSSRALRESVSSLPVEGRMLSVADVLPLPDTAATVQSLYSEIEFGGYESSMESCERVSGKLWARGDLATQHILPRRRIVVFSTMGMMEIVFNRPLDIIRRLLESNSPRSVLEDFFNRFGAGEAAAMCLMLAARIVHSENLISNVIAEKAAEAFEDPRVVGMPQLEGSNALSNTRSAAGGFSMGQVVQEAEPVFSGAHEGLCLCSSRLLFPLWELPVMVVKGSLGPSGTLSENGVVVCRLSVGAMQVLEQKLRSLEKFLRSRRNQRRGLYGCVAGLGDLSGSILYGNGSALGVGDRNMVRNLFGAYSRNMESNGGITTNKRQRLPYSPAELAAMEVGLHF

SEQ ID NO: 130742 - protein, 442 aa, Glycine max
  Coding DNA Sequence Number=SeqID_13964
  Gene Ontology: Mol. function=electron carrier activity; Cellular component=plastid chromosome; Biological process=response to cold
  Homolog annotation: Hit_ID=O80572; Match level="QueryCoverage=99%, HitCoverage=87%, E-value=0.0, Identity=77%"; Hit description =Expressed protein
  Pfam annotation: Domain name=mTERF; Domain location=46-393; Score =498.2; E_value=9.7e-147; Accession=PF02536.5; Description=mTERF
MPSVTWGVIQGRKEKLVSRVIIFDYLKGLGIIPDELHDLELPSTVDVMRERVEFLQKLGLTVDDINNYPLMLGCSVRKNMIPVLGYLEKIGIARPKLGGFVKNYPQVLHASVIVELAPVVKFLRGLDVEKDDIGYVLQKYPELLGFKLEGTMSTSVAYLVSIGVNPRDIGPMVTQYPYLLGMRVGTVIKPMIDYLVDLGLPKKVLARMLEKRAYVLGYDLEETVKPNVECLISFGVGRDCLASIIAQYPQILGLPLKAKLSTQQYFFSLKLKVDPEGFARVVENMPQVVSLHQHVIMKPVEFLLGRTIPAQDVASMVVKCPQLVALRVELMKNSYYFFKSEMGRPLQELVEFPEYFTYSLESRIKPRYQRLKSKGIRCSLNWMLNCSDQRFEERLQGHYIETESVGPRFCMGGKLELPGNGLVSDEEEESDDELLYRRTVSL

SEQ ID NO: 130743 - protein, 157 aa, Glycine max
  Coding DNA Sequence Number=SeqID_13965
MRGHNHTICVLQISTAKRRKGGYKAATYTTTQPLKEKLKVSSNRSLSKQEIQSLSGAYRFLKRSSHHQSMANNINNGCRNASYNLIINWGGKDKRKNKVNKEGQKNDAMKTHSLVPLQETIVIACCVLILPVPHFCTNIAFPSFTQDNGEIRKSETM

SEQ ID NO: 130744 - protein, 632 aa, Glycine max
  Coding DNA Sequence Number=SeqID_13966
  Gene Ontology: Mol. function=signal transducer activity; Cellular component=nucleus; Biological process=regulation of transcription, DNA-dependent
  Homolog annotation: Hit_ID=Q1SLG2; Match level="QueryCoverage=99%, HitCoverage=100%, E-value=0.0, Identity=80%"; Hit description=Cyclin- like F-box; Galactose oxidase, central
  Pfam annotation: Domain name=F-box; Domain location=217-265; Score =31.4; E_value=3.1e-06; Accession=PF00646.23; Description=F-box domain
  Pfam annotation: Domain name=Kelch_1; Domain location=312-360; Score =18.6; E_value=0.022; Accession=PF01344.15; Description=Kelch motif
  Pfam annotation: Domain name=Kelch_1; Domain location=364-412; Score =8.4; E_value=0.43; Accession=PF01344.15; Description=Kelch motif
  Pfam annotation: Domain name=Kelch_1; Domain location=417-465; Score =13.6; E_value=0.11; Accession=PF01344.15; Description=Kelch motif
  Pfam annotation: Domain name=Kelch_1; Domain location=470-521; Score =3.2; E_value=1.6; Accession=PF01344.15; Description=Kelch motif
  Pfam annotation: Domain name=Kelch_1; Domain location=536-584; Score =4.1; E_value=1.3; Accession=PF01344.15; Description=Kelch motif
  Pfam annotation: Domain name=Kelch_2; Domain location=312-360; Score =23.7; E_value=0.00067; Accession=PF07646.5; Description=Kelch motif
  Pfam annotation: Domain name=Kelch_2; Domain location=365-412; Score =26.4; E_value=1e-04; Accession=PF07646.5; Description=Kelch motif
  Pfam annotation: Domain name=Kelch_2; Domain location=416-465; Score =9.1; E_value=2.4; Accession=PF07646.5; Description=Kelch motif
  Pfam annotation: Domain name=Kelch_2; Domain location=470-521; Score =11.9; E_value=1; Accession=PF07646.5; Description=Kelch motif
  Pfam annotation: Domain name=Kelch_2; Domain location=536-584; Score =34.3; E_value=4.2e-07; Accession=PF07646.5; Description=Kelch motif
  Pfam annotation: Domain name=PAS; Domain location=50-173; Score=6.2; E_value=0.1; Accession=PF00989.14; Description=PAS domain
  Pfam annotation: Domain name=PAS_3; Domain location=75-176; Score =15.4; E_value=0.0031; Accession=PF08447.1; Description=PAS fold
  Pfam module annotation: Pfam domain module=F-box::Kelch_1::Kelch _1::Kelch_1::Kelch_1::Kelch_1::Kelch_2::Kelch_2::Kelch_2::Kelch _2::Kelch_2::PAS::PAS_3; Domain location=217-265::312-360::364 -412::417-465::470-521::...
  Pfam module annotation: Domain location=536-584::312-360::365 -412::416-465::470-521::536-584::50-173::75-176
MAMPKEKEDVQNSGKRLKCTRNEEEEKEQYEQVEADEEEEEEEDSELPLKLGLFFYPTIPTSFVVSDALEPDFPIIYVNKVFEIATGYRADEALGRNCRFLQYRDRRAQRRHPLVDPVVVSEIRRCLEEGVEFQGELLNFRKDGTPLVNRVRLTLIHDDDGTVTHVIGIQLFSEANIDLNRVSYPVFKETCNQDFDKNGKYTPKSGQSLYSQHQEMCSILQLSDEVLAHNILSRLTPRDVASIGSVCRRVRQLTKNEHVRKMVCQNAWGKEVTGTLELMTKKMGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDTGVLLSDTYLLDLTTDNPIWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRHDSDL

SEQ ID NO: 130745 - protein, 89 aa, Glycine max
  Coding DNA Sequence Number=SeqID_13967
  Gene Ontology: Mol. function=unfolded protein binding; Cellular component=prefoldin complex; Biological process=protein folding
  Homolog annotation: Hit_ID=Q6K3S8; Match level="QueryCoverage=67%, HitCoverage=45%, E-value=1e-14, Identity=67%"; Hit description =Prefoldin-like
  Pfam annotation: Domain name=Prefoldin_2; Domain location=2-88; Score= 14.7; E_value=0.00095; Accession=PF01920.10; Description=Prefoldin subunit
MRKKYTVQLGENELVLKELDLLKDDANVYKLIGPVLVKQDLAEANANVRKRIEYISAELQRDTSLHFAFTWKLCVSVSLTIMALLKRMK

SEQ ID NO: 130746 - protein, 392 aa, Glycine max
  Coding DNA Sequence Number=SeqID_13968
  Gene Ontology: Mol. function=GTPase activity; Cellular component =microtubule; Biological process=cell division
  Homolog annotation: Hit_ID=Q1SLG1; Match level="QueryCoverage=98%, HitCoverage=62%, E-value=0.0, Identity=91%"; Hit description=Dynamin central region; Dynamin; Dynamin GTPase effector
  Pfam annotation: Domain name=Dynamin_M; Domain location=161-392; Score=135.4; E_value=1.5e-37; Accession=PF01031.10; Description =Dynamin central region
  Pfam annotation: Domain name=Dynamin_N; Domain location=1-152; Score =181.7; E_value=1.9e-51; Accession=PF00350.13; Description=Dynamin family
  Pfam annotation: Domain name=MMR_HSR1; Domain location=52-153; Score=- 21.0; E_value=0.083; Accession=PF01926.13; Description=GTPase of unknown function
  Pfam module annotation: Pfam domain module=Dynamin_M::Dynamin_N::MMR _HSR1; Domain location=161-392::1-152::52-153
MVIGIVTRRPLVLQLHKTEEGTHEYAEFLHIPRRRFTDFAAVRKEIADETDRITGKTKQISNIPIHLSIYSPNVVNLTLIDLPGLTKVAVEGQQESIVQDIENMVRSYVEKPNCIILAISPANQDIATSDAIKIAREVDPSGERTFGVVTKLDLMDKGTNAVDVLEGRQYRLQHPWVGIVNRSQADINRNVDMIAARRKEREYFETSPEYGHLAHKMGSEYLAKLLSQHLEQVIRQKIPSIIALINKTIDELNAELDRIGRPIAVDSGAQLYTILEMCRAFDKVFREHLDGGRPGGDRIYGVFDHQLPAALKKLPFDRHLSLKNVQRVVTEADGYQPHLIAPEQGYRRLIEGSIGYFKGPAEASVDAVIFLTLLHFVLICHSVPWSDEITRY

SEQ ID NO: 130747 - protein, 197 aa, Glycine max
  Coding DNA Sequence Number=SeqID_13969
MDNIIHSNWANWRDKTDISSFYFTRFPEDATKKDIWYQFKKWGMTKAVCQHSKIRERDDKKHRTHSRRQSTGGGGNKHQKFRAKVDTRGRVSRTRRITLIGPARYPDGREEMVQRCLDELSWDEGVDIVPKYLGDDMVLLLGLTDARVEQMTKQETMNGSSLFHLLEKWNPKLRTRYRLVWVQCWGIPLIAWDMAQI

SEQ ID NO: 130748 - protein, 36 aa, Glycine max
  Coding DNA Sequence Number=SeqID_13970
MGHRFLAPPGIGMEKSVSCSIAMPTLIVVALLFKRT

SEQ ID NO: 130749 - protein, 47 aa, Glycine max
  Coding DNA Sequence Number=SeqID_13971
  Homolog annotation: Hit_ID=Q8LGU6; Match level="QueryCoverage=95%, HitCoverage=6%, E-value=8e-15, Identity=78%"; Hit description=HOBBIT protein
MAQSRYLFPISCFQMGLLSEAEAALCPANEPSLEVPNGAAGHYLTGC

SEQ ID NO: 130750 - protein, 255 aa, Glycine max
  Coding DNA Sequence Number=SeqID_13972
  Homolog annotation: Hit_ID=Q1S7A9; Match level="QueryCoverage=40%, HitCoverage=14%, E-value=2e-48, Identity=88%"; Hit description =Protein prenyltransferase
  Pfam annotation: Domain name=Suf; Domain location=35-247; Score= -12.1; E_value=1.5e-10; Accession=PF05843.5; Description=Suppressor of forked protein (Suf)
MLRYAYAELEESRGAIQAAKKIYESVMGDGDSATTLSHIQFIRFLRRTEGVEAARKYFLDARKSPSCTYHVYVAYATMAFCLDKDPKMAHNVFEAGLKRFMHEPPHGFHLVFCRVVLSVTMAIVATVLLVFVAWLVGILVKSGNVARKRELENTSALEGGLRIKEKQKWNLQAKRAKNSQTAKSLAAAVMVADYMVAARGALMALEKKLGLTGKEETNPVVLAVTTSAQRNMVHRIRALAGKQKEFSGRRAMSGM

SEQ ID NO: 130751 - protein, 557 aa, Glycine max
  Coding DNA Sequence Number=SeqID_13973
  Homolog annotation: Hit_ID=Q9FK37; Match level="QueryCoverage=70%, HitCoverage=62%, E-value=8e-61, Identity=39%"; Hit description =Arabidopsis thaliana genomic DNA, chromosome 5, P1 clone:MXI22
  Subcellular localization annotation: CTP_CleavageSite=69; ConfidenceScore=5.78e-01
MATAAFKSTTKRIPVGASSADDSASSSSLLHRRSRSLSRPARPSFPSRNDDDSGGDRRTPRGRFVNTVRGSGFPEISLDDLAIEFFESANRGRFGSRTSESEASPADAGAAASQRRGRSVSRKISGVGDDRRSSIGGGGGVRPFSDANSRRRRSVSVVRYQISDSESDLDRSQNSKSRSNLKKTDVGNKLMHKPVASDQRPVLRKSLSQKDLRAYDGYSSHSSVLTDDEGTSAHSNKMGIGKLRSVYAHKKVALTDTDKGSHKAKQKELRHMETEQAVVKPRTSTLSAVDCLLSNNSDAIQAVSSMRRSYETELEKSEKRKQELLAEMVFEEQRGRELSKIVNELVPSKEDNPIQNPSRARKRSNDRSRMSMRLTEEAEKYIEDFISNVEDTDISSVDGERSDASSSIGGLIKPETFNSPPVPRSLPVLTDGVTLPWLQWETNNDASPMTSQNKARMTITPKTENIKVQDQGNNSISSRGSWSPDYLQEYVGKDVYSKLGEGYGYPDQSFSAKSKGLRYDMDDYLKVKSNEDLLIESWKQRRRINSGSLLLCSLRLF

SEQ ID NO: 130752 - protein, 293 aa, Glycine max
  Coding DNA Sequence Number=SeqID_13974
  Gene Ontology: Mol. function=kinase activity
  Homolog annotation: Hit_ID=Q9LYA2; Match level="QueryCoverage=68%, HitCoverage=29%, E-value=2e-24, Identity=36%"; Hit description =Kinase-like protein
FGLTSDQNKGDPGNSETGKDSTNVGGQVEESSQSRPVATEPESHQEGESAASKRQVSPEKLYRAALLRSRFADTILKAQEKALEKDEKRDPEKLRIEREDLERRQKEEKARLQAEAKAAEEAQRKAEAEAAAEAKRKRELEREAARQALQKMEKTVDINENSQFLEDLEMLSAVHDEHLPSFKEETSTDQPQDGLGGIKLQGNPLEQLGLYMKDEDEEEDEEEEDELPPSGAVGPSNDALVRELQRFGASRMCDDGVGRVTLRIRARGYESRCVGHPNANQRVVAGVALGKGK

SEQ ID NO: 130753 - protein, 329 aa, Glycine max
  Coding DNA Sequence Number=SeqID_13975
  Gene Ontology: Mol. function=RNA binding; Cellular component=plastid chromosome
  Homolog annotation: Hit_ID=Q2VY14; Match level="QueryCoverage=69%, HitCoverage=54%, E-value=1e-95, Identity=79%"; Hit description =CONSTANS interacting protein 5
  Subcellular localization annotation: CTP_CleavageSite=64; ConfidenceScore=5.55e-01
MQVLQTSYLFTFPKPLNPSPSHFHHRLPPRPPPFFHRRPLTIPKSFSSDEFPVDETFLENFGPKDKETEDEARRRNWIERGWAPWEEILTPEADFARKSLNEGEEVPLRSPEAIEAFKMLNPNYRKKKREEMGLTEEEFFAKQFEIKGEIPEPLVTTWAGPLVVRLVPPRDWPPRGWRVDQEELAFIREAHKVQARRVRLEEVESGVRTDTDDVGLDRYRVFLKQYKEWVEANKDRLEEESYKQDQDYYPGRRKRGKDYKEGMYELPFYYPGQRDCGRPPVPRKDPGDKPEEEPLLSNHPYVEKGGFPKCLGAPELVVDISKRTIRGEF

SEQ ID NO: 130754 - protein, 322 aa, Glycine max
  Coding DNA Sequence Number=SeqID_13976
  Gene Ontology: Mol. function=kinase activity; Cellular component =nucleus; Biological process=positive regulation of DNA binding
  Homolog annotation: Hit_ID=Q9FGW9; Match level="QueryCoverage=99%, HitCoverage=62%, E-value=1e-57, Identity=46%"; Hit description =Similarity to kinase
  Pfam annotation: Domain name=Bromodomain; Domain location=186-275; Score=118.6; E_value=1.8e-32; Accession=PF00439.15; Description =Bromodomain
MGKSRKYSKGYATGFVPDFRHAVETIDESEGLGSLGRVDMELTALADSCAPKRKRPGLNTCGGDYAGSFNVPFRHFSLSAMSGFERKDLKVRLTWELEQVREFQKKIDGMNSSVVGGLSLFSDIRGCSAGQKRPKLESQHSTMEVSVPPGKKRPVPGHNGPKSKKSMSERLEHAKPAAPVTSYAMLMKSCENVLNRLMSHQFAWVFNDPVDVVKLNIPDYFTVIKHPMDLGTVKKRITSGEYSNPMDFAADVRLTFDNAMFYNPAGNDVHIMAETLSKFFETRWKAIEKKIPVIDCVASEPSRPTRVETEISDRVPPTKKRK

SEQ ID NO: 130755 - protein, 97 aa, Glycine max
  Coding DNA Sequence Number=SeqID_13977
MACGGHRWSWVVEEKFLGCELVSLSGSHTFGTKCDFSRLAQFLSASSLMRQNHSHPVSLPMPPLTSIVLEWALKGMPCLRVSNHGAKECVENRVIWD

SEQ ID NO: 130756 - protein, 67 aa, Glycine max
  Coding DNA Sequence Number=SeqID_13978
MRGVACARQSDLDTRCLLFLSDSVVQTHLGYFLDEWYHIAFESRVGTCDNRELLFHGSKQTAVEYMK

SEQ ID NO: 130757 - protein, 289 aa, Glycine max
  Coding DNA Sequence Number=SeqID_13979
  Gene Ontology: Mol. function=RNA-directed DNA polymerase activity; Cellular component=integral to membrane; Biological process=RNA -dependent DNA replication
  Homolog annotation: Hit_ID=Q1RXD8; Match level="QueryCoverage=96%, HitCoverage=37%, E-value=4e-36, Identity=30%"; Hit description=RNA -directed DNA polymerase
MLQYADNTIFVGEAIATDVFTIKAMLRAFELASGLRVNFYKSCCGALGVVRREVERFAAMLNCRLLSFPFVYLGISIGAIPRKIEMWEPIIQKFSKKLALWEQKFISFAGRACLVESFPHQERGLWMEVLESKYEGWRGLLSEGENNWEPIRWKDQEGDKTRFWHDDWVDDKKLINLFPRLFILSEQKDDLVINMRRWFGGGNSSGVENALCGRIQSSGTDVWLWRKGSICGNFTTNTAYKWISSINRPQEKLDIYSRLWHSKIPIKALFFIWKLLKNRLAQDEMYCPF

SEQ ID NO: 130758 - protein, 253 aa, Glycine max
  Coding DNA Sequence Number=SeqID_13980
MSEIEKVQEQMKADMEAMKEQMATMMEAMMSMKKMMEVNATTVVSASTAIEVDPTRPSSLNQVSPPVSMTFFPPYDLPPNYTPPNVAHAPDEDVDNSTPILIENQQPQFDHAHVSQPIEETHEAPRDHNLVDFEPHLGYATEGQAVGGRVPLAMVERRKFDHIEERLRAIEGGRDYAFADMTELCLVPDVIIPPKFKVPNFDTKVLLGQLDVSSIGACRPRIFFINGFLCFLEDEWQRNGEGRERGDATSRRR

SEQ ID NO: 130759 - protein, 291 aa, Glycine max
  Coding DNA Sequence Number=SeqID_13981
  Gene Ontology: Mol. function=aminopeptidase I activity; Cellular component=vacuole; Biological process=proteolysis
  Homolog annotation: Hit_ID=Q8LF32; Match level="QueryCoverage=70%, HitCoverage=42%, E-value=6e-91, Identity=78%"; Hit description =Aspartyl aminopeptidase-like protein
  Pfam annotation: Domain name=Peptidase_M18; Domain location=14-277; Score=24.6; E_value=2.8e-18; Accession=PF02127.6; Description =Aminopeptidase I zinc metalloprotease (M18)
MGEGCCTQPYPCICKEAVSGFEPMTNKSPRHNFTAAPGLTLTQDTIIQEYICGTEVTRPCHPEHKANPRGGMLWSVGVPVVVIVGFIRALIDATSSDSSLEEESGVRMVALFDHEEVGSNSAQGAGSPVMLNAVTRVTNSFSSNPNLLEKAAQLSYLVSADMAHALHPNYMDKHEANHQPKLHGGLVIKTNASQRYATNVVTSFIFREIASKHKLPVQDFVVRNDMSCGSTIGPILASGVGIRTVDVGAPQLSMHSIREICAVDDVKYSYEHFKAFYQEFSHVDGKMVVDI

SEQ ID NO: 130760 - protein, 43 aa, Glycine max
  Coding DNA Sequence Number=SeqID_13982
MDEDQWMCDSMMSEEVDMNVEIEEHAGIKVEHVDCSDAFNTSL

SEQ ID NO: 130761 - protein, 118 aa, Glycine max
  Coding DNA Sequence Number=SeqID_13983
MNYQYGKPFCGKERRTEQACMMEEERGNYQRRQPSRADGGVKTLFVMRAEPYWWLGEPRQSTPPCFGAEAELNGLMEIAVARRIENATKLLFLCTRRIGSLPAVKIIFSTIQRTSSMF

SEQ ID NO: 130762 - protein, 114 aa, Glycine max
  Coding DNA Sequence Number=SeqID_13984
  Homolog annotation: Hit_ID=Q1T0B9; Match level="QueryCoverage=76%, HitCoverage=20%, E-value=2e-07, Identity=38%"; Hit description=IMP dehydrogenase/GMP reductase
MLMLLALWSSIEDRSYASAAIHDHFIVKFEHGGNNAIEVEVIDEGEVVLEKLPEDGEGKSDLADVEEAVDEDGEGDVARGGVRLLLGAEENRGGEALHLREGGEDSIERKGSAS

SEQ ID NO: 130763 - protein, 204 aa, Glycine max
  Coding DNA Sequence Number=SeqID_13985
  Gene Ontology: Mol. function=phosphotransferase activity, phosphate group as acceptor; Cellular component=mitochondrial inner membrane; Biological process=nucleobase, nucleoside, nucleotide and nucleic acid metabolic process
  Homolog annotation: Hit_ID=Q08480; Match level="QueryCoverage=88%, HitCoverage=81%, E-value=1e-61, Identity=61%"; Hit description =Adenylate kinase B
  Pfam annotation: Domain name=ADK; Domain location=5-172; Score=130.8; E_value=3.7e-36; Accession=PF00406.12; Description=Adenylate kinase
  Pfam annotation: Domain name=ADK_lid; Domain location=96-143; Score =44.2; E_value=4.3e-10; Accession=PF05191.4; Description=Adenylate kinase, active site lid
  Pfam module annotation: Pfam domain module=ADK::ADK_lid; Domain location=5-172::96-143
MKHRPPGSGKGTQSPSIRDEYCLCHLATSDMLRAAVTAKTPSGIKAKEAMDNMKQFRNHHVKKLDEILEKQGNKVDKVLNFAIYDAILEERITGHWICPSTGKTYHTKFAPPKVPGVDDMVISLGALLVEVAVTGEPLIQRKDDPATVLKSRLEAFHKQTEPVIDYYSKKGIVAYLPLRNLPKRLFCTFVKADFDINEIGGVDF

SEQ ID NO: 130764 - protein, 749 aa, Glycine max
  Coding DNA Sequence Number=SeqID_13986
  Gene Ontology: Mol. function=protein kinase activity; Cellular component=mitochondrion; Biological process=protein amino acid phosphorylation
  Homolog annotation: Hit_ID=Q1T0C2; Match level="QueryCoverage=96%, HitCoverage=95%, E-value=0.0, Identity=73%"; Hit description=Protein kinase
  Pfam annotation: Domain name=LRR_1; Domain location=107-129; Score =3.8; E_value=55; Accession=PF00560.23; Description=Leucine Rich Repeat
  Pfam annotation: Domain name=LRR_1; Domain location=131-153; Score =13.1; E_value=1; Accession=PF00560.23; Description=Leucine Rich Repeat
  Pfam annotation: Domain name=LRR_1; Domain location=155-176; Score =12.4; E_value=1.3; Accession=PF00560.23; Description=Leucine Rich Repeat
  Pfam annotation: Domain name=LRR_1; Domain location=179-202; Score =9.9; E_value=4; Accession=PF00560.23; Description=Leucine Rich Repeat
  Pfam annotation: Domain name=LRR_1; Domain location=203-224; Score =14.7; E_value=0.34; Accession=PF00560.23; Description=Leucine Rich Repeat
  Pfam annotation: Domain name=LRR_1; Domain location=226-245; Score =9.0; E_value=5.9; Accession=PF00560.23; Description=Leucine Rich Repeat
  Pfam annotation: Domain name=LRR_1; Domain location=247-269; Score =13.5; E_value=0.79; Accession=PF00560.23; Description=Leucine Rich Repeat
  Pfam annotation: Domain name=LRR_1; Domain location=271-293; Score =14.8; E_value=0.32; Accession=PF00560.23; Description=Leucine Rich Repeat
  Pfam annotation: Domain name=LRR_1; Domain location=295-317; Score =9.1; E_value=5.5; Accession=PF00560.23; Description=Leucine Rich Repeat
  Pfam annotation: Domain name=LRR_1; Domain location=319-341; Score =10.4; E_value=3.2; Accession=PF00560.23; Description=Leucine Rich Repeat
  Pfam annotation: Domain name=Pkinase; Domain location=472-736; Score=- 16.3; E_value=1.4e-07; Accession=PF00069.15; Description=Protein kinase domain
  Pfam annotation: Domain name=Pkinase_Tyr; Domain location=472-736; Score=-73.8; E_value=6.1e-08; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=107-129::131-153::155-176::179-202::203-224::226 -245::247-269::...
  Pfam module annotation: Domain location=271-293::295-317::319 -341::472-736::472-736
MKSKGAGCSAQLQSSQTQVLLQLKKHLEYPKQLEIWRDRWTDLCSISSPGQVNVTCKDNFVTELTILGDDKPTTKGRDFDGFAIPNQTLSESFSMDSLVATLARLTSLRVLNLVSLGMWGPLPDRIHRLYALEHLDLSSNYLYGSIPPKICTMENLQTLRLVDNFFNGTIPSLFNSSSHLTVLSLKSNRLKGPFPPSILSVTTLTEIDMSSNQISGSLEDLSVLSSLEELDLRENRLESKLPAMPKGLISLYLSRNSFSGEIPKHYGQLNRLEKLDVSFNSLTGTAPSELFSLPNISYLNLASNMLNGPLQNHLRCSSQLRFVDISYNRFVGGLPSSLNTTKSEKIVVKSDGNCLSGSVQHQHAVSYCTEAHVKKKSYRVGIFVGLIVGILFIIVVLALTIIITCKRYFPWGVSEQHLLHKTVQDSSYAAGLSSELVTNARYVSEAEKLGREDLPTCRSYSLEELKEATNNFDNSTFMGENIYGKLYRGKLESGIQVVIRSLPLSKKYSIRNFKLRLDLLAKLRHPHLVSLLGHCIDGVVGENNEANVFLIYEYVSNGTFQTYLSGDSPGKVFNWSERLSVLINVAKAVHFLHTGMIPGFFKNRLKTNNILLNENWMAKLSDYGLSIISEETDACGVKGESSDSWQMKMLEDDVYSFGFILLEALVGPSLSAKREANVLNVMASFNSQDGWKQVVDPVLQATCSKESLLVVISITNKCISSESWSRPSIEDVLWNLQYASQIQGTADGG

SEQ ID NO: 130765 - protein, 233 aa, Glycine max
  Coding DNA Sequence Number=SeqID_13987
  Gene Ontology: Mol. function=protein serine/threonine kinase activity; Cellular component=membrane; Biological process=protein amino acid phosphorylation
  Homolog annotation: Hit_ID=Q9LK35; Match level="QueryCoverage=88%, HitCoverage=24%, E-value=2e-66, Identity=63%"; Hit description =Receptor-protein kinase-like protein
  Pfam annotation: Domain name=Pkinase; Domain location=2-195; Score= -38.3; E_value=2.8e-06; Accession=PF00069.15; Description=Protein kinase domain
  Pfam annotation: Domain name=Pkinase_Tyr; Domain location=1-195; Score=-73.8; E_value=6.1e-08; Accession=PF07714.7; Description =Protein tyrosine kinase
  Pfam module annotation: Pfam domain module=Pkinase::Pkinase_Tyr; Domain location=2-195::1-195
MANGPLSKWFYEQCESPLSWKQRLEICIGAAKGLHYLHTSSVEGIIHRDVKTANILLDENFVAKVADFGISKKGSSLDESLVVTSVKGTFGYIDPEYFRTSHLTEKSDVYSFGVVLIEVISGRPALDHGLPTEKINVATWAMNSEVKGQLHQIMDPNIVGKARVSSLNKVWEVAKRCLAENRINRPPIGFVLCCLEDALHLELSNIADEENSFLNCEMQDNVRSESELVAVLP

SEQ ID NO: 130766 - protein, 77 aa, Glycine max
  Coding DNA Sequence Number=SeqID_13988
MKKNIKEKEVGVSRVVREGYTREEKLEEDNSLVGREMMRGQHMPLDHGLHQNGFRRKTPQTTKSKVAKIIFIIQINL

SEQ ID NO: 130767 - protein, 300 aa, Glycine max
  Coding DNA Sequence Number=SeqID_13989
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q1T0A8; Match level="QueryCoverage=87%, HitCoverage=99%, E-value=1e-116, Identity=81%"; Hit description =Peptidase T1A, proteasome beta-subunit
  Pfam annotation: Domain name=Proteasome; Domain location=87-262; Score=156.5; E_value=7.1e-44; Accession=PF00227.16; Description =Proteasome A-type and B-type
MAYIGANLDDGATVGIRDAEHEEEGIKAPVTKSAIMKLDTTGLESFPTLLAPQNDVVGELSAAPSFDLPNSNDFDGFVKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGDLKALDSLLDLVHHMLMVYWTAVEEAAELARRAIYHATFRDGASGGVASVYYVGPNGWKKLSGDDVGELHYHYYPVTPSTVEQEMVEATGA

SEQ ID NO: 130768 - protein, 170 aa, Glycine max
  Coding DNA Sequence Number=SeqID_13990
  Gene Ontology: Mol. function=RNA-directed DNA polymerase activity; Cellular component=extracellular region; Biological process=RNA -dependent DNA replication
  Pfam annotation: Domain name=RnaseH; Domain location=34-163; Score= -32.9; E_value=0.067; Accession=PF00075.14; Description=RNase H
  Subcellular localization annotation: CTP_CleavageSite=38; ConfidenceScore=5.08e-01
MQFVNQWKNSNTINHQQQSSPETTMLTTWSPPSRNQVECNVDAAIFEDVKQFGAGLCLRDEKGNFLKAFTATTTGVPTPREAEAWALHQAINWTHHLGMQNVIFELDCKLVVDNMVNNKKGSTEFHAILHRCRAILSNSPNSRMSFEKRQANLITHNLARASRFYVNSCF

SEQ ID NO: 130769 - protein, 90 aa, Glycine max
  Coding DNA Sequence Number=SeqID_13991
MGRNCIGCSPGIAESEAESVVGLGRRESVRRESERDVRADIPTRKSENPLQFEGFYKLEGAPPRSRSIAGNGVLFIRFVKYLSYRVLYYG

SEQ ID NO: 130770 - protein, 426 aa, Glycine max
  Coding DNA Sequence Number=SeqID_13992
  Gene Ontology: Mol. function=protein serine/threonine kinase activity; Cellular component=membrane; Biological process=protein amino acid phosphorylation
  Homolog annotation: Hit_ID=Q9LK35; Match level="QueryCoverage=99%, HitCoverage=50%, E-value=0.0, Identity=77%"; Hit description =Receptor-protein kinase-like protein
  Pfam annotation: Domain name=APH; Domain location=88-263; Score= -14.7; E_value=0.064; Accession=PF01636.13; Description =Phosphotransferase enzyme family
  Pfam annotation: Domain name=Pkinase; Domain location=85-355; Score =134.2; E_value=3.5e-37; Accession=PF00069.15; Description=Protein kinase domain
  Pfam annotation: Domain name=Pkinase_Tyr; Domain location=85-355; Score=137.3; E_value=4.1e-38; Accession=PF07714.7; Description =Protein tyrosine kinase
  Pfam module annotation: Pfam domain module=APH::Pkinase::Pkinase_Tyr; Domain location=88-263::85-355::85-355
  Subcellular localization annotation: CTP_CleavageSite=80; ConfidenceScore=5.25e-01
GSSVGAMAAIALAGLCYCCLGRFKSKSTQQGHSWLPLPLYGNSQTMTKMSTTSQKSATASIISLASSNLGRLFTFQEILDATNKFDEKLLLGVGGFGRVYKGTLEDGTNVAVKRGNPRSEQGLAEFRTEIEMLSKLRHRHLVSLIGYCDERSEMILVYEYMANGPLRSHLYGTDLPPLSWKQRLEICIGAARGLHYLHTGASQSIIHRDVKTTNILLDDNFVAKVADFGLSKTGPALDQTHVSTAVKGSFGYLDPEYFRRQQLTEKSDVYSFGVVLMEVLCTRPALNPVLPREQVNIAEWAMSWQKKGMLDQIMDQNLAGKVNPASLKKFGETAEKCLAEYGVDRPSMGDVLWNLEYALQLQETSSALMEPEDNSTNHITGIQLTRLEPFDNTVSMIDGGNFFTDDDAEDAATSAVFSQLVNPRGR

SEQ ID NO: 130771 - protein, 146 aa, Glycine max
  Coding DNA Sequence Number=SeqID_13993
  Homolog annotation: Hit_ID=Q9FG54; Match level="QueryCoverage=69%, HitCoverage=31%, E-value=6e-08, Identity=31%"; Hit description=Root cap protein 2-like protein
MAVSRSNGLIFVMFFAIFVMHINAETQTCTNRRSPCFLKKIQCAAECPSKSPTNLKAKVCYPLCNTQCKNCNQTAMALDLHAWTPTLLVQMEVLFKFYGLSSRLKEFLAGLISQFSESSKARCGNASVRGEDNIDHITYFIRRNIT

SEQ ID NO: 130772 - protein, 847 aa, Glycine max
  Coding DNA Sequence Number=SeqID_13994
  Gene Ontology: Mol. function=protein binding; Cellular component =membrane; Biological process=defense response
  Homolog annotation: Hit_ID=Q19PN1; Match level="QueryCoverage=97%, HitCoverage=53%, E-value=1e-138, Identity=38%"; Hit description=NBS -LRR type disease resistance protein
  Pfam annotation: Domain name=LRR_1; Domain location=392-414; Score =0.4; E_value=2.4e+02; Accession=PF00560.23; Description=Leucine Rich Repeat
  Pfam annotation: Domain name=LRR_1; Domain location=416-439; Score =11.9; E_value=1.7; Accession=PF00560.23; Description=Leucine Rich Repeat
  Pfam annotation: Domain name=LRR_1; Domain location=441-462; Score =12.5; E_value=1.3; Accession=PF00560.23; Description=Leucine Rich Repeat
  Pfam annotation: Domain name=LRR_1; Domain location=464-485; Score =6.3; E_value=19; Accession=PF00560.23; Description=Leucine Rich Repeat
  Pfam annotation: Domain name=LRR_1; Domain location=487-508; Score =11.8; E_value=1.8; Accession=PF00560.23; Description=Leucine Rich Repeat
  Pfam annotation: Domain name=LRR_1; Domain location=510-534; Score =1.5; E_value=1.5e+02; Accession=PF00560.23; Description=Leucine Rich Repeat
  Pfam annotation: Domain name=LRR_1; Domain location=633-654; Score =2.1; E_value=1.1e+02; Accession=PF00560.23; Description=Leucine Rich Repeat
  Pfam annotation: Domain name=LRR_1; Domain location=723-747; Score =1.6; E_value=1.4e+02; Accession=PF00560.23; Description=Leucine Rich Repeat
  Pfam annotation: Domain name=LRR_1; Domain location=749-770; Score =1.5; E_value=1.5e+02; Accession=PF00560.23; Description=Leucine Rich Repeat
  Pfam annotation: Domain name=LRR_1; Domain location=794-813; Score =1.4; E_value=1.5e+02; Accession=PF00560.23; Description=Leucine Rich Repeat
  Pfam annotation: Domain name=MMR_HSR1; Domain location=19-122; Score=- 18.4; E_value=0.048; Accession=PF01926.13; Description=GTPase of unknown function
  Pfam annotation: Domain name=NACHT; Domain location=19-167; Score= -30.7; E_value=0.014; Accession=PF05729.3; Description=NACHT domain
  Pfam annotation: Domain name=NB-ARC; Domain location=1-281; Score =193.3; E_value=5.6e-55; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::MMR_HSR1::NACHT::NB -ARC; Domain location=392-414::416-439::441-462::464-485::487 -508::510-534::633-654::...
  Pfam module annotation: Domain location=723-747::749-770::794-813::19- 122::19-167::1-281
MFQKNVAKIWDWLMNDGELIIGVYGMGGVGKTSMLMHIHNMLLTRVTNFDSVFWVTLSQSFSIHKLQCDVAKIVGLDISKESDERKRAARLSWTLMRRKRCVLFLDDVWSYFPLEKVGIPVREGLKLVLTSRSLEVCRRMNCQNNVKVEPLAKEEAWTLFLDNLGQQTTLSPEVTKVARSVAKECAGLPLAIITMARSMRGVEEICEWRHALEELRNTEIRLEEMEMEVLRVLQFSYDHLNDNMLQKCFLCCALYPEDFEIDRDVLIESFVDEGLVNGMKSLEAMFDEGQTILNKLENSCLLGKVENYVGGKKCMGLQDASSHIAISMMKRGCQCVAPIDNVEGYYVGSQLVKMHDLVRAMAINVIKVNYHFLVKAGLQLTEIPDEVEWNEDLEKVSLMCNWIHEIPTGISPRCPKLRTLILKHNESLTSISDSFFVHMSSLQVLDLSFTDIEVLPKSVADLNTLTALLLTSCKRLKHMPSLAKLQTLIRLDLSFTAITEIPQDLETLVNLKWLNLYAKNLVSTGKEIAKLIHLQFLILHWWSRKIKVKVEHISCLGKLETFAGNLYNMQHFNAYVKTMHEYGPRSYLLQLDSEESPGKSPWYFFAEVCFSKDVIISNCKIRTGVTPLMLPSDIQRLKVERCHDIRSLCDILSLKNATSLKRCEIADCDGQEYLFSLCCSSSCCTSLHNIESVELYNLKNLHTLCKENEAVAQTLPPPGAFTCLKYFCIYHCPIIKKLLTPGLLAYLQNLEEIIVHNCKSMEEIISVDGIDYESSGGNKYCVANRDAVKVTHPKLVSLSLKHLPELRSICRGLMICESLQNFRIFKCPKLIRLPETATPVQTLYDCF

SEQ ID NO: 130773 - protein, 119 aa, Glycine max
  Coding DNA Sequence Number=SeqID_13995
  Homolog annotation: Hit_ID=Q9FL72; Match level="QueryCoverage=99%, HitCoverage=42%, E-value=6e-45, Identity=71%"; Hit description =Arabidopsis thaliana genomic DNA, chromosome 5, P1 clone:MDK4
  Pfam annotation: Domain name=DUF1223; Domain location=1-105; Score= -74.4; E_value=8.7e-05; Accession=PF06764.2; Description=Protein of unknown function (DUF1223)
ATFNKPTPTSLEVTLVGALRTKVDNLGVDVMVALYETGLVTDCPRGENKGRVLSNDYVVRKLEKLCTVKDYPAKKTMSGTATFSLWDTFNSSRCGMAVFVQNSSHQIFGSQNFQLPDDL

SEQ ID NO: 130774 - protein, 274 aa, Glycine max
  Coding DNA Sequence Number=SeqID_13996
  Gene Ontology: Mol. function=structural molecule activity; Biological process=response to gibberellin stimulus
  Homolog annotation: Hit_ID=Q9LVV9; Match level="QueryCoverage=98%, HitCoverage=98%, E-value=9e-76, Identity=52%"; Hit description =Membrane associated protein
  Pfam annotation: Domain name=Motile_Sperm; Domain location=50-159; Score=88.9; E_value=1.6e-23; Accession=PF00635.16; Description=MSP (Major sperm protein) domain
  Subcellular localization annotation: CTP_CleavageSite=70; ConfidenceScore=5.70e-01
MAVAVAGRQKPSSDASLFTLCPFWSSRNATQRSTKTVSSVARSLLRPRRKLRLDPSSYLYFPYEPGKQVRSAVRLKNTSKSHVAFKFQTTAPKSCYMRPPGGTLAPGESLIATVFKFVEQPENNEKLSDQKHKVKFKIMSLKVKEGVDYVPELTKLGITGKSLGLQICKLGRLNFDEQKDLVTMERILRVVFIDPERQSSVSQTSLQIVLVQVYGVLEKLKRQLAEADAAVEARKKPPVEAGPRVAAEGLVIDEWKERREKYLARQQVQAVDSV

SEQ ID NO: 130775 - protein, 108 aa, Glycine max
  Coding DNA Sequence Number=SeqID_13997
MGGNKEEQLACPRKPVEDSPREEEARRIEKKQHDRHLNTTGREQCFHESGSVDFESSHKMSRRCKKQLDQGSANDKWPAIVTKQTTNGQQQHNADLEKVRRDKNGSND

SEQ ID NO: 130776 - protein, 74 aa, Glycine max
  Coding DNA Sequence Number=SeqID_13998
MEIGSISAPRGTMGQNIGFKIWWLEEQGGGHSSSIFQLQQNPPYMVGIFVLDKHLRCFPAKSETAFPSTCTRAG

SEQ ID NO: 130777 - protein, 153 aa, Glycine max
  Coding DNA Sequence Number=SeqID_13999
  Gene Ontology: Mol. function=glutathione peroxidase activity; Cellular component=mitochondrion; Biological process=response to oxidative stress
  Homolog annotation: Hit_ID=Q8L5Q6; Match level="QueryCoverage=75%, HitCoverage=69%, E-value=1e-57, Identity=89%"; Hit description =Putative phospholipid hydroperoxide glutathione peroxidase
  Pfam annotation: Domain name=GSHPx; Domain location=12-94; Score =106.6; E_value=7.1e-29; Accession=PF00255.10; Description =Glutathione peroxidase
MAKTCLRWIGLEDQQRFHGLTQTNYKELNVLYEKYKNQGFEILAFPCNQFAGQEPGNNEEIQEVVCTRFKAEFPIFDKVEVNGKNAVPLYKFLKEKKGGIFGDGIKWNFTKFLVNKEGKVVDRYAPTTSPLKIEDIGNLSGVFEGQVAICIIN

SEQ ID NO: 130778 - protein, 464 aa, Glycine max
  Coding DNA Sequence Number=SeqID_14000
  Gene Ontology: Mol. function=carbon-nitrogen ligase activity, with glutamine as amido-N-donor; Cellular component=intracellular; Biological process=translation
  Homolog annotation: Hit_ID=Q9FV81; Match level="QueryCoverage=100%, HitCoverage=88%, E-value=1e-166, Identity=59%"; Hit description=Glu -tRNA(Gln) amidotransferase subunit B
  Pfam annotation: Domain name=GatB; Domain location=282-349; Score =102.6; E_value=1.2e-27; Accession=PF01162.10; Description=PET112 family, C terminal region
  Pfam annotation: Domain name=GatB_N; Domain location=67-286; Score =376.1; E_value=5.3e-110; Accession=PF02934.6; Description=PET112 family, N terminal region
  Pfam annotation: Domain name=GatB_Yqey; Domain location=378-462; Score=23.0; E_value=4.7e-06; Accession=PF02637.8; Description =GatBYqey domain
  Pfam module annotation: Pfam domain module=GatB::GatB_N::GatB_Yqey; Domain location=282-349::67-286::378-462
  Subcellular localization annotation: CTP_CleavageSite=52; ConfidenceScore=5.58e-01
MASSIFRSLQVHPFMLYPTTFLRRRNGVFHLTTKATQSQTDTQQRQPQTKVSSSNSTQSKKLDKIPKDYEAIIGIETHVQLSTLTKAFCGCPYSYGSSPNSSICPICMGLPGALPVLNSKIIDFAVKLGLALNCNLAFKSKFDRKQYFYPDLPKGYQISQFDVPIATAGFLDVDIPVEFGGGHKRFGITRVHMEEDAGKLLHAENGNYSQVDLNRAGVPLLEIVSEPDMRNGIEAAEYAAELQRLVRYLGVSNGNMQEGSLRCDVNVSIRPIGQSKFGTKRTITMRKKEGLADYRYFPEPDLPAVILSQEYVDGIKNSLPELPEIKRRRYEQMGLSMQDVLFLANDKNQIVSLKYKLIKADYELTTCLQITGCNQIAEFFDATLAKGADSKLVANWIMSDIAAFMKNEKLTINEIKLTPEELSELIASIKGGTISGKIGKEILFELLAKGGTVKELIQKKDLVQ

SEQ ID NO: 130779 - protein, 521 aa, Glycine max
  Coding DNA Sequence Number=SeqID_14001
  Gene Ontology: Mol. function=RNA-directed DNA polymerase activity; Biological process=RNA-dependent DNA replication
  Pfam annotation: Domain name=Exo_endo_phos; Domain location=1-212; Score=32.6; E_value=1.4e-06; Accession=PF03372.13; Description =EndonucleaseExonucleasephosphatase family
  Pfam module annotation: Pfam domain module=Exo_endo_phos::RVT_1; Domain location=1-212::343-520
MGVTCGTERDKIIDRIRAMEKPIRRMVKKEQIDLLCIQETKMEQIEKTMCQALWGNSEVSWKMQPASNTAGGVWIQEAQKVHIVSIYSPCDIHNKRALWDTVRQMKNSNPGGLWCILGDFNNIRTPSERLGACQRGVDDRNIKEFNEWIADLEVEEVPSVGRKFTWFRPNGSAKSKLDKIFVSADWFTKWPESTQFILDRNFSDHCPFLLKSKHVDWGPKPFKILDCWLQDRSFRKIVQECWANNQQRGWGGGGGVVLKEKIKRLKGRLKAAISPRIADPEKATGGDLWIVAQSHESLLRQKSIGQQQNDILMGRFHEDEIKRAIWDCGSEKSPCPDGLNFKFINEFWQVIDPQNLNEYRPISLIGCMYKIVAKILAKRLKKVLPAIIDERQSAFIGGKHLLHSVIIANEAVEEGKRSASISVLVNGSPSSEFIPQRGLRQGDPLAPLLFNIVAEALNGLMREAVQKNIFRGFLVGTNNVEVSILQYADDTIFFGEASMENVKAIKDILRSFELVSGLKIN

SEQ ID NO: 130780 - protein, 154 aa, Glycine max
  Coding DNA Sequence Number=SeqID_14002
  Homolog annotation: Hit_ID=Q2QNB5; Match level="QueryCoverage=42%, HitCoverage=9%, E-value=2e-26, Identity=80%"; Hit description =Suppressor of forked protein containing protein, expressed
MDERADIASGPVWMEYIAFLKSLPAINAQEESHRMTTMRKVYQKAIVTPTHHIEQLWKDYENFENSVSRQLLFFVGIRLEYFKGMQFDDKSQLTITTVTAHSFISILVSSFMASASIPPPPPPPVNGGTPLGSVLERVIGKIEKRKTATQELPL

SEQ ID NO: 130781 - protein, 124 aa, Glycine max
  Coding DNA Sequence Number=SeqID_14003
  Gene Ontology: Mol. function=transferase activity; Cellular component= intracellular; Biological process=mRNA processing
  Homolog annotation: Hit_ID=Q1S7A9; Match level="QueryCoverage=78%, HitCoverage=13%, E-value=2e-31, Identity=70%"; Hit description =Protein prenyltransferase
MDKPSGGDKYNVETAEILANEAQHLPVAEATPIYEQLLLLFPTAAKFWRQYVEAHMAANNDDATKQIFSRCLLNCLQIPLWYIVCIILFMALAAGGREGEVSGKRMGYKLTACRVAVFLFDQPK

SEQ ID NO: 130782 - protein, 59 aa, Glycine max
  Coding DNA Sequence Number=SeqID_14004
  Homolog annotation: Hit_ID=Q1S7A9; Match level="QueryCoverage=55%, HitCoverage=4%, E-value=5e-10, Identity=87%"; Hit description =Protein prenyltransferase
MDEVKRCYIRFIRKVNDKKGMEGQEETRKAFDFMLNYVAIETLVKRRLIRGPSGNWNSG

SEQ ID NO: 130783 - protein, 194 aa, Glycine max
  Coding DNA Sequence Number=SeqID_14005
  Homolog annotation: Hit_ID=Q1SF96; Match level="QueryCoverage=88%, HitCoverage=28%, E-value=9e-37, Identity=42%"; Hit description =Membrane attack complex component/perforin/complement C9
MSGAHKDVGDTEDTPIWSEEINDGRFFEAINGKKFYHVCTAPVKYDPRWSSDKDVAFIVTGAQLHVKKHESRSVLHLRLLFSKVSNCAVVKSSWTQGSSGLSQRSGIFSVISTSISGKDQNQKKPVVVLDSSVFPTGPPVPVQTQKLLKFIDTSQLCKGPQDSPGHWLITGARLVLDKRKICLWAKFSLLNTGS

SEQ ID NO: 130784 - protein, 57 aa, Glycine max
  Coding DNA Sequence Number=SeqID_14006
MGRCRQQRAHDGATASGDDAGDCARAENTNIRSSDARHIITTEKGNEEDRRKKIRGY

SEQ ID NO: 130785 - protein, 252 aa, Glycine max
  Coding DNA Sequence Number=SeqID_14007
  Homolog annotation: Hit_ID=Q1SF96; Match level="QueryCoverage=89%, HitCoverage=37%, E-value=2e-56, Identity=45%"; Hit description =Membrane attack complex component/perforin/complement C9
  Pfam annotation: Domain name=MACPF; Domain location=3-174; Score=7.7; E_value=3.7e-06; Accession=PF01823.10; Description=MACPerforin domain
MEDFQRSFLSRLLTMHPNGENFIRFIENFGTHILVGLGIGGKDLVLVKQDVSSNLDPSELKKHLDELGNQIFNGTCNFLPKSKEQKYKAPQAFDVFGPQIVAFDSSTSVCAKDGITVICAKRGGDTQVRDHSEWLLTVPKKPDAVDFSFIPITSLLKGTPGKGFLSHAINLYLRYKPPMSDLPYFLDYQSHKLWAPIHNDLPLSPATNRTNLSPSLSFDLMGPKLYVNTSKVTVGKRPITGMRLFLEGMKCN

SEQ ID NO: 130786 - protein, 74 aa, Glycine max
  Coding DNA Sequence Number=SeqID_14008
MEAEEGFQGLKSEGIKRKKRKRCRGATESRPRSFLTTFLVLRSSCDRRAPPCYIAHSSSPFIIGDLVFLCKVQS

SEQ ID NO: 130787 - protein, 127 aa, Glycine max
  Coding DNA Sequence Number=SeqID_14009
MRFSSLIQDKNPRIQDANIKKISSVLGREFQIETAKGLAKKFKQKCLFQEIYSLRGHKKAKTDGPKRLSPRKKMSKIATNVYWRKTLEKPKRRRFADFENEGSGVGYARESLLTFNPLKISCGTNDL

SEQ ID NO: 130788 - protein, 69 aa, Glycine max
  Coding DNA Sequence Number=SeqID_14010
SSHTHVQGQHLFNVETTRGRNAELRLKGSGKGGELGGDDGIPEMVGFGGRVAGAIEVPREGRLRTVLDL

SEQ ID NO: 130789 - protein, 82 aa, Glycine max
  Coding DNA Sequence Number=SeqID_14011
MCRTSNFCLNNLGSQNSGVQCCLPMSEFTSSSPQISASLHQLDLAAYVSGSYNAQWNVPEILHDKNMLYSSRILRKMEVEEP

SEQ ID NO: 130790 - protein, 683 aa, Glycine max
  Coding DNA Sequence Number=SeqID_14012
  Homolog annotation: Hit_ID=Q93Y73; Match level="QueryCoverage=49%, HitCoverage=93%, E-value=1e-137, Identity=71%"; Hit description =Putative dehydrogenase
  Pfam annotation: Domain name=Semialdhyde_dh; Domain location=358-473; Score=167.9; E_value=2.6e-47; Accession=PF01118.15; Description =Semialdehyde dehydrogenase, NAD binding domain
  Pfam annotation: Domain name=Semialdhyde_dhC; Domain location=499 -669; Score=147.9; E_value=2.7e-41; Accession=PF02774.9; Description =Semialdehyde dehydrogenase, dimerisation domain
  Pfam module annotation: Pfam domain module=Semialdhyde_dh::Semialdhyde _dhC; Domain location=358-473::499-669
MTVKTSDTCSSRRRSQLVCKRMPGADKPVRARQRMRKEKIPHQAPFAIQAAQLLGRAIGAGLFAITPAGERGMCCKAIKLGNARDPSWSGGGATSKLPYWTRKCWRGWPPLIPQAWTDLGPSFIEHVAANPLEAQHQEREIEKCTAASEEVHPSTAAEEVHPSTAAEVQKVRRECDSVELQYLSKDSLLNSLEVNETPIEEQSRDADVPCPHVINNNDPDLMEKDLTSVPRNDYHRPSLMERNSTTPISEWNDSIDGLEGGTSDHAIRCHLPSPKGTKVSPLTKYKPTKITRSRKTKRWSQLEEETRKTAVDKFGRGKWKLMLDSNKDIFKERTEVDLNDKWRSMTRIRMSLQENGPSIAVVGVTGAVGQEFLSVLSDRDFPYSSIKMLASKRSAGRRITFEDRDYVVEELTAESFDGVDIALFSAGGSISKYFGPIAVDRGTVVVDNSSAFRMDENVPLVIPEVNPEAMQNIKAGTGKGALIANPNCSTIICLMAATPLHRRAKAASGAGAAAMEELQLQTREVLEGKPPTCKIFNRQYAFNLFSHNASVLSNGYNEEEMKMVKETRKIWNNKDVKVTATCIRVPVMRAHAESVNLQFETPLDEDTARDILKNAPGVVVIDDRESNHFPTPLEVSNKDDVAVGRIRQDLSQDGNQGLDIFVCGDQIRKGAALNAIQIAEMLL

SEQ ID NO: 130791 - protein, 500 aa, Glycine max
  Coding DNA Sequence Number=SeqID_14013
  Homolog annotation: Hit_ID=Q7EY72; Match level="QueryCoverage=94%, HitCoverage=98%, E-value=1e-148, Identity=55%"; Hit description =Putative myrosinase
MGVSSNSKESMELCIFDLRRGQHEGQELDKILFFFPAGLPFSKQLSVIGLSEGLITFTRIFSPDSACEVIEAERHSHVFYEAEPDIWIVIVVEKCNDSEPIWRVDALRKLLKEIHSLFFMFHGSIRAMLEKEPGGGLTRRHLYTFIMDYLRDFLVGKKFILPSFRDCLKERGTVQMLTIGREAAIEVQSLVRVLESSAGNTPWLTPHALSSGTSSWSYLLKGSAASNVVTESNMAHPSTMSESFYGSSDISSGEDNHYHVVRPLQSDKWSKGKDGYLVTDLWGAEVGTWVFATPTVWLQQTEEKMYLCVYQHRSLTLMLLIPVSSIPNGEQGVSAVRQQVIENASLKILKVEEKLSKGWGGENAYHVSGYRYLLVDGDRNVSRASPETKVTTLTKESLLAMNKLRQEVESEKSRAKLDSRNCEKDLEMCIRAKNNAWVISRVTRGKELYMVLEKANETLLYASDAAEKFSDRYSSADYEEFGNNNKFPLPNFANLSIPNP

SEQ ID NO: 130792 - protein, 100 aa, Glycine max
  Coding DNA Sequence Number=SeqID_14014
  Gene Ontology: Mol. function=monooxygenase activity; Cellular component=membrane; Biological process=electron transport
  Homolog annotation: Hit_ID=Q1SB83; Match level="QueryCoverage=70%, HitCoverage=17%, E-value=1e-17, Identity=67%"; Hit description=E -class P450, group I
  Subcellular localization annotation: CTP_CleavageSite=61; ConfidenceScore=5.07e-01
MGFQGVELQRASKHFMAFGGGMRFWVGTNFTKVATHQRRKHPPNSGFIVSKWFSRPDHGRRSEETAGTRIYHYKLETKTPQERLIYGRNLGLTFLRNTRR

SEQ ID NO: 130793 - protein, 655 aa, Glycine max
  Coding DNA Sequence Number=SeqID_14015
  Gene Ontology: Cellular component=endoplasmic reticulum
  Homolog annotation: Hit_ID=Q2PGG6; Match level="QueryCoverage=91%, HitCoverage=92%, E-value=0.0, Identity=58%"; Hit description =Generative cell specific-1
MALRSAITLIIIFILSSFYVVGIQIISKSKLEKCEKNSNSDDNLNCTTKIVLNMAVPSGSSGGEASIVAELVEVEENSSRKMQTLRIPPVITVNKTSAYALYQLTYIRDVPYKPEEYYVKTRKCEPDAGANVVKTCERQAILRDEEGHIIEYTQPICCPCGPQRRMPSSCGNFCKCFDVATFFDKLTKGKANTAHCVRFPGDWFHVFGIGRRTLGFSVRIQVKSGTKVSEVVVGPENRTVISDDKFLRVNLIGDFVGYTNIPSFEDFYLVVPRQGSPAQPQDLGRNISMWMLLERVRFTLDGIECNKIGVSYEAFNQQPNFCASPFWTCLHNQLWNFRESAGSYSFSIGITEVLNTNLVLELSANDVEYVYQRSPGKIISVSVPTFEALTQFGVATITTKNTGEVEASYSLTFNCSRDITLMEEQFLIMKPNEVTTQSCKIYPSTDQASKYFCAAVLKDSAYNEVDRAECQFATTATVLDNDTQGMPFQPPEASINSFFDSIESIWNKIWTSITEFITGKTLLVVLWLLHQKGLFDPLYDWWEDILGADEQIIMDKRKFKIDKGHHHIHDNKHHKQEHRHSNYSAENRRRTTYEHMHKHSERNSDYFDDLHHVHKEMHKYGHKKQNMDNVQHIVDHPVHHKHRKKRDSSKGELKR

SEQ ID NO: 130794 - protein, 279 aa, Glycine max
  Coding DNA Sequence Number=SeqID_14016
  Gene Ontology: Mol. function=RNA-directed DNA polymerase activity; Biological process=RNA-dependent DNA replication
  Homolog annotation: Hit_ID=Q1T251; Match level="QueryCoverage=63%, HitCoverage=62%, E-value=6e-13, Identity=30%"; Hit description =Multicopper oxidase, copper-binding site
MVKGAQWWCDTLTSCEIFEKEHRWFQSGLGRGVRGGNNVSFWEAKWLGDKKSKNIREAGDWCRGVWSWHFSWRQLWLQWEILIVQQMDEALKGWEPKVGGKDGWVWKNNAAKIFIVKEVYASLITDRFGDVCSFFNQIWNLPVPSKVKGLLWRVGHKIQTKDNLRRMIILQDGTSLNWVFYNLGMEFAKYLLFECCFCHQIWQRCYVWLGKIRVLHVEGKEHFSQHFRILPGAKARCVEGTVSVEVIWSLWKHQNHIIFNEASLDARELLDSIKYQAWS

SEQ ID NO: 130795 - protein, 79 aa, Glycine max
  Coding DNA Sequence Number=SeqID_14017
  Gene Ontology: Mol. function=nucleoside-triphosphatase activity; Cellular component=membrane
  Homolog annotation: Hit_ID=Q1T099; Match level="QueryCoverage=77%, HitCoverage=9%, E-value=7e-25, Identity=88%"; Hit description=AAA ATPase; DEAD/DEAH box helicase, N-terminal
AAAVSEGRPAPALSGSGDIRSLNMEDFKYAHQQVCASVSSESINMTELQQWNELYGEGGSRLCAGLITLAGLEAELFRL

SEQ ID NO: 130796 - protein, 417 aa, Glycine max
  Coding DNA Sequence Number=SeqID_14018
  Gene Ontology: Mol. function=RNA-directed DNA polymerase activity; Biological process=DNA integration
MASSSMVPFQVPMLNKSNHDNWSIKMKALLSAQDVWEIVEKGHTEPKNEGSLSQTQRHSLRDSRKRDKKPLYLIYQGLDNDAFEMLSRRFRKQSRRKKLQTSYKGANPANKNEVVVEIKEEDEIGGPMTTTTTSKKEAQQRAPSKNRVEEKTNYVEEKSKEGDTLLMTSTGNERSEGNRCRNVALGDESKVEVKGKGLELLFKKEMVRELSCNVGKQFKKSFPKESNLRAKKLLELIHTDGGPIKTSSLDKKSLEALLVCTIPNEKRSKLDGKSEKYVFIDYDSNSKGYKLYNPNSGKTIINGIEKSWIELAREEPTNPPIPPKANTQEYEISKECRTLKEKLKDIRQDWCKNYNQRTSIDYDEVFAPIARLENTLEKKSTLNNLKATKSKKKKTRIESQERQLHPAKKIGVTKSSL

SEQ ID NO: 130797 - protein, 98 aa, Glycine max
  Coding DNA Sequence Number=SeqID_14019
MVTINRSKVREGYQVKRGKSFKCEVEGILESAIGLTAPLKTKRGMSNNLKVVHSGTKEFKIASNKRDLFLGFSEHQERLHKKLALEEGRIFAANEQLS

SEQ ID NO: 130798 - protein, 107 aa, Glycine max
  Coding DNA Sequence Number=SeqID_14020
  Subcellular localization annotation: CTP_CleavageSite=45; ConfidenceScore=5.18e-01
MTSVVTFNTCRKLVMDIPSIASSCLWALCINRNPNGALQSCLMVMASFRNAAINVFRVINSKKATITAFTNPLHTLRLLYRSKQRGFLELDLVLGKWVEAGQHSLLG

SEQ ID NO: 130799 - protein, 194 aa, Glycine max
  Coding DNA Sequence Number=SeqID_14021
  Gene Ontology: Mol. function=ion channel activity; Cellular component= integral to membrane; Biological process=hypersensitive response
  Homolog annotation: Hit_ID=Q94AS9; Match level="QueryCoverage=98%, HitCoverage=27%, E-value=2e-98, Identity=89%"; Hit description =Cyclic nucleotide-gated ion channel 4
  Pfam annotation: Domain name=cNMP_binding; Domain location=15-113; Score=36.2; E_value=1.1e-07; Accession=PF00027.19; Description =Cyclic nucleotide-binding domain
MDDLVLENICDRVKSLVFTKGETITKEGDPVQRMLFVVRGHLQSSQVLRDGVKSFCMLGPGNFSGDELLSWCLRRPFIERLPPSSCTLVTLETTEAFGLEAQDVKYVTQHFRYTFVNEKVKRSARYYSPAWRTWAAVAIQLAWRRYQHRLTLTSLSFIRPRRPLSRSTSMEEDRLRLYTAMLTSPKPNQDDFDF

SEQ ID NO: 130800 - protein, 101 aa, Glycine max
  Coding DNA Sequence Number=SeqID_14022
  Gene Ontology: Mol. function=microtubule motor activity; Cellular component=microtubule associated complex; Biological process =microtubule-based process
  Homolog annotation: Hit_ID=Q94DT1; Match level="QueryCoverage=72%, HitCoverage=68%, E-value=4e-12, Identity=51%"; Hit description =Putative dynein light chain
  Pfam annotation: Domain name=Dynein_light; Domain location=8-97; Score=18.1; E_value=1.8e-05; Accession=PF01221.9; Description=Dynein light chain type 1
MIYLYFTMLEGKAVIGETDMLQTMQQDALNLASKALDFFDVTEATDIARFIKKASKYLQSPSVEFDRTHGPGWQCIVGTDFAWLSCSLGVLLLHRYRKITS

SEQ ID NO: 130801 - protein, 155 aa, Glycine max
  Coding DNA Sequence Number=SeqID_14023
  Gene Ontology: Mol. function=structural constituent of ribosome; Cellular component=intracellular; Biological process=translation
  Homolog annotation: Hit_ID=Q9FL72; Match level="QueryCoverage=100%, HitCoverage=57%, E-value=3e-40, Identity=48%"; Hit description =Arabidopsis thaliana genomic DNA, chromosome 5, P1 clone:MDK4
  Pfam annotation: Domain name=DUF1223; Domain location=23-155; Score =65.6; E_value=1.6e-16; Accession=PF06764.2; Description=Protein of unknown function (DUF1223)
MAPRLLSCFRNKHAGGCSHHDEGCGASSEESAAGAREAAGEGPVLVEMFTSQGCATSPAADLVLSRLGRGDFQLEVPVVLLAFHVDYWDYVGWKDPFGSSQWTVRQKAYVEALGLDTLFTPQVVVQGQAHLEGNDDNALISAITSAPRFPAPTFQ

SEQ ID NO: 130802 - protein, 134 aa, Glycine max
  Coding DNA Sequence Number=SeqID_14024
MAHTNAMNSIPPNRIPMREEEVNRFKELQEIFDKFFKLLFGVIAFKISPMGEALFIAHPNVMMLLVLMIVLYFSLWLLGTMLPKNTSIMSWVGIFALTAYYCYQVLYALVVSAISDTINQLIDGYWTQSTRLPV

SEQ ID NO: 130803 - protein, 33 aa, Glycine max
  Coding DNA Sequence Number=SeqID_14025
MAVTLYDLSSSSGLKKLDEYLLPRSYITGIRNA

SEQ ID NO: 130804 - protein, 411 aa, Glycine max
  Coding DNA Sequence Number=SeqID_14026
  Gene Ontology: Mol. function=ion channel activity; Cellular component= integral to membrane; Biological process=hypersensitive response
  Homolog annotation: Hit_ID=Q1T0K9; Match level="QueryCoverage=89%, HitCoverage=63%, E-value=1e-107, Identity=68%"; Hit description=IQ calmodulin-binding region; Cyclic nucleotide-binding
MATSDHPVQESRFSRMHYFSTDDDQDEDDDDTDLDFVDDSNVSPAEEEEPKKSDILGGENFNRRREFRVVLDPRGKWVQEWNRVFLLVCATGLFVDPLFFYALSISDTCMCLFVDGWLVITVTALRCMTDALHVWNMWLEFKMAKRSSSFIGRDTNASGGGGGGGGGYALRYLKAKRGFFFDLFVILPIPQAAGACWYLLGLQRAAKCLEEQCAKTTGCGLRTLCCKEPIYYGGINIVRDKTRLLWAQNREARSTCLDSADNYDYGVYEWSVQLVTNDSRLEKILFPIFWGLMTLSTFGNLESTPERLEVIFNIIVLTSGLLLVTMLIGNIKVFLHSTTSKKQAMLLRMRNIEWWMSKRRLPQGFRQRVRNYERMRWAATRGVDECQMIKNLPEGLRRDIKYHLCLDLVRQ

SEQ ID NO: 130805 - protein, 115 aa, Glycine max
  Coding DNA Sequence Number=SeqID_14027
  Gene Ontology: Mol. function=translation elongation factor activity; Cellular component=eukaryotic translation elongation factor 1 complex; Biological process=translational elongation
  Homolog annotation: Hit_ID=Q6SZ89; Match level="QueryCoverage=99%, HitCoverage=47%, E-value=2e-23, Identity=55%"; Hit description =Translational elongation factor 1 subunit Bbeta
YQATKDDLTVYAALPTAPSDEYGNVSRWYKHIDALLRISGVTGEGSGVIVEGSLVAEPVATPPAADTKASVFLMAAVAEDDDDDDVDLFGEETEEEKKAAEERAAAVKASTKKKE

SEQ ID NO: 130806 - protein, 533 aa, Glycine max
  Coding DNA Sequence Number=SeqID_14028
  Gene Ontology: Mol. function=transcription coactivator activity; Cellular component=nucleus; Biological process=regulation of transcription from RNA polymerase II promoter
  Homolog annotation: Hit_ID=Q1T094; Match level="QueryCoverage=99%, HitCoverage=99%, E-value=1e-167, Identity=59%"; Hit description =SWIB/MDM2
  Pfam annotation: Domain name=SWIB; Domain location=315-390; Score =72.8; E_value=1.1e-18; Accession=PF02201.9; Description=SWIBMDM2 domain
  Subcellular localization annotation: CTP_CleavageSite=68; ConfidenceScore=5.03e-01
MNNQAKNIATSSLFGHSGMAPQPQPHHPNPIQQWNHPNPLLSQSQSHPQTQFHGLFQFSEPQSQVFAQAQYAQAQLQSQAARAHPQVPQTQPFAHLHNVKTNTANGVSSLGTGSAKRATLKPPLRSHNSLNMNQSTPFKATKLTPAVLQKKQIPEKVAALLPESALYTQLLDFEAQVDASLARRKIDIQETKLPPHVQKTLRVYVFNTFSNHAKMDADNRKADDESWWSLKIIGRILEDGVDSMSGISQGSSPSYPKFSAFFKKITILLDQSLYPDNHVTVWDSARSPTQQDGFEVKRKGNKEFTAVIAIEMNYTPDKFMVSPPLSKLLGIEVETRPRIIATLSNYVKSRKLQIPNDPSFFICDPSLQMVFGEEKMDFTMVSQKLAQHLTQPQPIHMEHNIKLSGHSPAVSACYDIQVDVPFPLEKDMSTFLAGFESQKEIEAYDEAIRTSLKKIQEHHRRRAFFLSFSQSPAEFIDTLIASQSKDLKLVAGDASHNVQKELPSEFFNQPWVEDAVIRYLNRKSAGSDAHGHN

SEQ ID NO: 130807 - protein, 152 aa, Glycine max
  Coding DNA Sequence Number=SeqID_14029
  Homolog annotation: Hit_ID=Q8RZK0; Match level="QueryCoverage=34%, HitCoverage=18%, E-value=1e-17, Identity=81%"; Hit description=Beta 1,3-glucanase-like
  Pfam annotation: Domain name=X8; Domain location=90-152; Score=54.1; E_value=4.6e-13; Accession=PF07983.3; Description=X8 domain
  Subcellular localization annotation: CTP_CleavageSite=57; ConfidenceScore=5.32e-01
MMTKSKAQKSRTLHDNKDDDLKNQRMSSRTLQGSRGNLISRIKNQVSRFKFQESRSRFKTKDSRIKRRLNQDKLFKENKGGHIPCGSLLVKGFLQDTALQVALDYACGYGGADYSAIQPGASCYNPNTVRDHASYAFNDYYQKNPTPISLKA

SEQ ID NO: 130808 - protein, 80 aa, Glycine max
  Coding DNA Sequence Number=SeqID_14030
MGTSLEVSRARSGSEERCISSSDSGKGFVKGATLVLLQLRVNNFEWKRLLRVHSFLTVGAHIYSGSRNDTFREDIAEVTI

SEQ ID NO: 130809 - protein, 228 aa, Glycine max
  Coding DNA Sequence Number=SeqID_14031
  Gene Ontology: Mol. function=voltage-gated ion-selective channel activity; Cellular component=mitochondrial outer membrane; Biological process=anion transport
  Homolog annotation: Hit_ID=Q1W0X2; Match level="QueryCoverage=83%, HitCoverage=81%, E-value=7e-65, Identity=64%"; Hit description =Mitochondrial import receptor-like protein
MATLIPPPPPPPPPPAAAADPKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQYVVYGVPLSLPIPMLVFCCASLASFTHHNSFSCLLVQLTNEPHMSHAMINFDYKGKDYRTQFQLGNGALLGASYIQLLVRFCQLYIAVQENA

SEQ ID NO: 130810 - protein, 195 aa, Glycine max
  Coding DNA Sequence Number=SeqID_14032
  Gene Ontology: Mol. function=structural constituent of ribosome; Cellular component=intracellular; Biological process=translation
  Homolog annotation: Hit_ID=Q1STC9; Match level="QueryCoverage=64%, HitCoverage=88%, E-value=1e-63, Identity=95%"; Hit description =Ribosomal protein S9
  Pfam annotation: Domain name=Ribosomal_S9; Domain location=23-155; Score=258.0; E_value=2e-74; Accession=PF00380.9; Description =Ribosomal protein S9S16
MAQPAAAAAATGAAVIEQVQCFGRKKTAVAVTYCKRGRGLIKINGCPIELVEPEILRFKAFEPILLLGRHRFAGVDMRIRVKGGGHTSQIYAIRQSIAKALVAYYQKYVDEQSKKEIKDILVRYDRTLLVADPRRCEPKKFGGRGARASASIAVKHFVLLYNEAIWCFDYCDAAQNHGRGCNILGQYLLQWSGLG

SEQ ID NO: 130811 - protein, 339 aa, Glycine max
  Coding DNA Sequence Number=SeqID_14033
  Gene Ontology: Mol. function=two-component sensor activity; Cellular component=membrane; Biological process=signal transduction
  Homolog annotation: Hit_ID=Q1SIR1; Match level="QueryCoverage=82%, HitCoverage=36%, E-value=1e-141, Identity=89%"; Hit description =Histidine kinase A, N-terminal
MASPGTAVKLCLGDQLIIGLNLETGSLHMQRLYIILRFSSRLIKKSISSAYDVIRQTHLQNPGSSTGGSTDVMDVDNSSGYSSFIDLPKELFQMLACTGPYLYRDTVLLQKVCRVLRGYYLSALELVSHGNGVLNPQLQVPGNPHLHLKEARLRVEDALGACLLPSLQLIPANPAVGQEIWELLSLLPYEVRYRLYGEWEKDDERIPMLLSARQTAKLDTRRILKRLAKENLKQLGRMVAKLAHANPMTVLRTIVHQIEAYRDMITPVVDAFKYLTQLEYDILEYVVIERLALGGRDKLKDDGLNLSDWLQSLASFWGHLLQINLSKCRITGHSSILCP

SEQ ID NO: 130812 - protein, 886 aa, Glycine max
  Coding DNA Sequence Number=SeqID_14034
  Gene Ontology: Mol. function=two-component sensor activity; Cellular component=membrane; Biological process=signal transduction
  Homolog annotation: Hit_ID=Q1SE03; Match level="QueryCoverage=99%, HitCoverage=78%, E-value=0.0, Identity=71%"; Hit description=F5A9.21, related
MLPSKAWNSLSPDLYATFWGLTLYDLYVPKNRYESEIAKLHANLKSLEELSDNSSSAITKRKKEKERIQESLDRLISELHKHEENVASVRRRLSHEKDKWLSSCPDTLKINMEFLQRCIFPRCTFSMPDAVYCAMFVHTLHSLGTPFFNTVNHIDVLICKTLQPMICCCTEYEAGRLGRFLYETLKIAYYWKCLESTEYMEIRNALIMLTKISSVFPVTRKSGINLEKRVAKIKSDEREDLKVLATGVAAALAARKPSWVTDEEFGMGYLELKPAPSVTKSSAGNSATVQSGINLNVSQTESASGKHVDSGNIVKDQAMRTKTADGRSERTESITVTKSDTGHIKLKSSSMVNGLDAQSSLAPSSVQSGTSKSMENPKQVEESINRASDEHGTRTTELRTSAKRSVPAGSLSKPSKQDPVKEDGRSGKPVARTSGSSSSDKELQTHALEGRYTGTTNVPSSNGNTISGSTKGSNPPVKISLDGPGNESKAEVGVAKSSDIRASMVKDDGNDITDNPRGASSRVVHSPRYENTGVTSKSNDKVQKRASSAEEPDRLGKRRKGDVELRDFETEVRFSEREKMMDPRFADDKSGPEEHGLYRAGDKPLERAKDKGNERYERDHRERMDRLDKSRGDDFVAEKPRDRSIERYGRERSVERMQERGSDRSFNRLPEKAKDERNKDDRNKLRYNDASVEKSHGDDRFHGQSLPPPPPLPPNVVPQSVGAGRRDEDVDRRYGATRHSQRLSPRHEEKERRRSEETVVSQDDAKRRKEDDFRDRKREEIKVEEREREREKANILKEELDLNAASKRRKPKREHLPTGEPGEYSPVAHPPSSAGIGMSLAYDGRDRGDRKGPIMQHPSYVDESSLRIHGKEVASKLNRRDSDPYP

SEQ ID NO: 130813 - protein, 248 aa, Glycine max
  Coding DNA Sequence Number=SeqID_14035
  Gene Ontology: Mol. function=two-component sensor activity; Cellular component=membrane; Biological process=signal transduction
  Homolog annotation: Hit_ID=Q1SIR1; Match level="QueryCoverage=99%, HitCoverage=32%, E-value=1e-125, Identity=89%"; Hit description =Histidine kinase A, N-terminal
EEFLGEAELIKIKAQELKGKEVRVNTRILYQQTKFNLLREESEGYAKLVTLLCRDSEAPTQKSSAATIGIIKSLIGHFDLDPNRVFDIVLECFELQPDDDVFIELIPIFPKSHASQILGFKFQYYQRMEVNSPVPFGLYRLTALLVKQDFIDLDSIYAHLLPRDDEAFEHYNTFSSKRLDEANKIGRINLAATGKDLMDDEKQGDVTIDLFAAIDMETDAIEERTTELQSSQTLGLLTGFLSVDDWYA

SEQ ID NO: 130814 - protein, 302 aa, Glycine max
  Coding DNA Sequence Number=SeqID_14036
  Gene Ontology: Mol. function=phospholipid binding
  Homolog annotation: Hit_ID=Q1SDZ7; Match level="QueryCoverage=58%, HitCoverage=49%, E-value=1e-55, Identity=55%"; Hit description =Phosphoinositide-binding clathrin adaptor, N-terminal
  Pfam annotation: Domain name=ANTH; Domain location=27-259; Score= -6.1; E_value=8.6e-08; Accession=PF07651.6; Description=ANTH domain
LHPPFVDNFLVPKIKHTATNYLCSWDSIFKATTNHLSLFPSHLNLIDDKERKQEHVHELCKDCFSNFTLRFGTSRCWRVALKCLILLHRLLRSVPGNSALWTEILWTRSKALISLNPCHFKDDSSFSYQEEEEANMAEMGRVLEMLPQLQSLIDRVMECYPVGVAAPSFIVQGAMKLIIRDSFVCYTKFRREIVAVLDNLLEMPYRNCIAAFNIYKKAAAQTNELYEWCKAKGLCEGQVELRRDVVHIKGEEEKPLIELEFLFYHREFDMEQHSFDANEGHYHENANDTWRMAVYNPFSEPY

SEQ ID NO: 130815 - protein, 38 aa, Glycine max
  Coding DNA Sequence Number=SeqID_14037
MVVCGLVQCRHCPYVLEAMTALAELGSTAKDIISFIPQ

SEQ ID NO: 130816 - protein, 160 aa, Glycine max
  Coding DNA Sequence Number=SeqID_14038
  Gene Ontology: Mol. function=phosphoethanolamine N-methyltransferase activity; Biological process=phospholipid biosynthetic process
  Homolog annotation: Hit_ID=Q9M571; Match level="QueryCoverage=77%, HitCoverage=35%, E-value=4e-30, Identity=48%"; Hit description =Phosphoethanolamine N-methyltransferase
MAENFDAEVVGIDLSINMISLAIERAIGLNYAVEFDCADCYKRTYPENTFDVIYTRDTMLHVKMLEDAGFDDIIAESRTDQFVKMLQQELDALENKKDDFIRDFSKLDSLLSGRLQLDCGKMEGKAYIPGVRIESRCGACSLPRKIEMLYCYHMPCSSYI

SEQ ID NO: 130817 - protein, 213 aa, Glycine max
  Coding DNA Sequence Number=SeqID_14039
MGEVEEIQEKMKADMEAIKEKMATMMEAMMSVKKIMEANAVAIAATSVVAKVNPTSPSGLKQMNHPTSNMVGKDLGSTDDPMMCKFKTSTPSRHMVCLPNYTPPNVVYIPNEDVNNSTPILIKSQQPQSDHAHVSRPMEETHEIPHHDLANFEPCLRYAAEGQAVGGIPLQNTLEGPQYHPQPQPSRSTAVKNPHDYGRNGKVGSSRGKAQGH

SEQ ID NO: 130818 - protein, 143 aa, Glycine max
  Coding DNA Sequence Number=SeqID_14040
  Gene Ontology: Mol. function=cyclopropane-fatty-acyl-phospholipid synthase activity; Biological process=lipid biosynthetic process
  Homolog annotation: Hit_ID=Q1SS99; Match level="QueryCoverage=92%, HitCoverage=36%, E-value=4e-43, Identity=69%"; Hit description=SAM (And some other nucleotide) binding motif
MLDIYSLENLVSTNLEIQRENTTLLTTGNPDFTQRWNLFLMEMEPFLDGDGTFIFNKVFKECHMSDNTGSSCKCIGAYVRNKKNQNQDRVEYSYKSILRSERMYGPGFVSTGGLETTKEFVTKLGLKPGQKVLDVWLWWCWGR

SEQ ID NO: 130819 - protein, 128 aa, Glycine max
  Coding DNA Sequence Number=SeqID_14041
MVRALPTTHGRPIGDQVQSQSRTHLVAHDPGNLNKTSTSSEGSPTSQNIYDIPFILEPLARPRHISCPAVLQALSQNPNSPQTLTQGENVNPCPQKKTKKRQFPIKESEESKKRKFPIKEWEKAKTQK

SEQ ID NO: 130820 - protein, 482 aa, Glycine max
  Coding DNA Sequence Number=SeqID_14042
  Gene Ontology: Mol. function=protein binding; Cellular component =integral to membrane; Biological process=defense response to fungus
  Homolog annotation: Hit_ID=Q949G9; Match level="QueryCoverage=94%, HitCoverage=86%, E-value=8e-54, Identity=28%"; Hit description =HcrVf1 protein
  Pfam annotation: Domain name=LRRNT_2; Domain location=27-67; Score =51.0; E_value=3.9e-12; Accession=PF08263.3; Description=Leucine rich repeat N-terminal domain
  Pfam annotation: Domain name=LRR_1; Domain location=120-144; Score =9.5; E_value=4.7; Accession=PF00560.23; Description=Leucine Rich Repeat
  Pfam annotation: Domain name=LRR_1; Domain location=147-169; Score =14.1; E_value=0.49; Accession=PF00560.23; Description=Leucine Rich Repeat
  Pfam annotation: Domain name=LRR_1; Domain location=195-218; Score =13.0; E_value=1; Accession=PF00560.23; Description=Leucine Rich Repeat
  Pfam annotation: Domain name=LRR_1; Domain location=220-242; Score =8.1; E_value=8.7; Accession=PF00560.23; Description=Leucine Rich Repeat
  Pfam annotation: Domain name=LRR_1; Domain location=244-265; Score =4.5; E_value=42; Accession=PF00560.23; Description=Leucine Rich Repeat
  Pfam annotation: Domain name=LRR_1; Domain location=295-316; Score =12.8; E_value=1.1; Accession=PF00560.23; Description=Leucine Rich Repeat
  Pfam annotation: Domain name=LRR_1; Domain location=321-343; Score =5.2; E_value=30; Accession=PF00560.23; Description=Leucine Rich Repeat
  Pfam annotation: Domain name=LRR_1; Domain location=345-370; Score =3.5; E_value=64; Accession=PF00560.23; Description=Leucine Rich Repeat
  Pfam annotation: Domain name=LRR_1; Domain location=372-394; Score =10.1; E_value=3.6; Accession=PF00560.23; Description=Leucine Rich Repeat
  Pfam annotation: Domain name=LRR_1; Domain location=396-418; Score =13.1; E_value=1; Accession=PF00560.23; Description=Leucine Rich Repeat
  Pfam annotation: Domain name=LRR_1; Domain location=420-442; Score =20.9; E_value=0.0047; Accession=PF00560.23; Description=Leucine Rich Repeat
  Pfam annotation: Domain name=LRR_1; Domain location=444-466; Score =15.5; E_value=0.19; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=27-67::120-144::147-169::195-218::220-242::244 -265::295-316::...
  Pfam module annotation: Domain location=321-343::345-370::372 -394::396-418::420-442::444-466
MNSSSIYILVFLHLWLCSLPCRESVCIPSERETLLKFKNNLNDPSNRLWSWNHNNTNCCHWYGVLCHNVTSHLLQLHLNTSPSAFEYDYYNGFYHRFDEEAYRRWSFGGEISPCLADLKHLNYLDLSGNRFLGEGMSIPSFLGTITSLTHLNLSDTGFYGKIPPQIGNLSDLVYLDLSSVVANGSVPSQIGNLSKLRYLDLSDNYFEGMANPSFLCAMTSLTHLDLSNAGFMGKILSQIWNLSNLVYLDLTYAANGTIPSQIGNLSNLVYLGLGGDSDVEALFAENVEWLSSMWKLEYLDLSNANLSKAFHWLHTLQSLPSLTHLYLYQCTLPHYNEPSLLNLSSLQTLHLSFTRYSPAISFVPKWIFKLKKLVSLQLLDNGIQGPIPGGIRNLTLLQNLDLSFNSFSSSIPDALGNLTSLVELDLSGNQLEGNIPTSLGNLTSLVEIDLSYSQLEGNIPTSLGNLCNLRVIDLSYLKLNQQ

SEQ ID NO: 130821 - protein, 53 aa, Glycine max
  Coding DNA Sequence Number=SeqID_14043
MVEIKLTMIDMVLEKASNNIIATIILTEKAYSRQDHPRAQSRNANSAILLLLC

SEQ ID NO: 130822 - protein, 126 aa, Glycine max
  Coding DNA Sequence Number=SeqID_14044
  Gene Ontology: Mol. function=lipid binding; Cellular component =anchored to membrane; Biological process=lipid transport
  Homolog annotation: Hit_ID=Q6Z387; Match level="QueryCoverage=77%, HitCoverage=53%, E-value=6e-21, Identity=45%"; Hit description=Lipid transfer protein-like
  Pfam annotation: Domain name=Tryp_alpha_amyl; Domain location=34-111; Score=25.1; E_value=0.00025; Accession=PF00234.12; Description =Protease inhibitorseed storageLTP f
MDSNACLPHLLVFAITLVLVSHAMGDSAQDKQRCAESLTGVATCLPYLGGDTKARTADCCSGLTQAMKTNKKCVCVILKDRDDPDLGLKINMTIAAGLPSLCKTPDNFSQCSGGNSGFEDQGLQKG

SEQ ID NO: 130823 - protein, 55 aa, Glycine max
  Coding DNA Sequence Number=SeqID_14045
MTMMMGMMMTMKGMVLIWTVAMPMYKHFMLCGRLPSTCHRTRFFKVDCLLQNTIS

SEQ ID NO: 130824 - protein, 1520 aa, Glycine max
  Coding DNA Sequence Number=SeqID_14046
  Gene Ontology: Mol. function=RNA-directed DNA polymerase activity; Cellular component=chromatin; Biological process=chromatin assembly or disassembly
  Pfam annotation: Domain name=Chromo; Domain location=1410-1455; Score= 18.4; E_value=0.0067; Accession=PF00385.14; Description='chromo' (CHRromatin Organisation MOdifier
  Pfam annotation: Domain name=RVP_2; Domain location=337-468; Score= -36.0; E_value=0.00064; Accession=PF08284.2; Description=Retroviral aspartyl protease
  Pfam annotation: Domain name=rve; Domain location=1104-1260; Score =107.4; E_value=4.3e-29; Accession=PF00665.16; Description=Integrase core domain
  Pfam annotation: Domain name=zf-H2C2; Domain location=1045-1086; Score=29.4; E_value=1.2e-05; Accession=PF09337.1; Description=His(2)- Cys(2) zinc finger
  Pfam module annotation: Pfam domain module=Chromo::RVP_2::RVT _1::Retrotrans_gag::rve::zf-H2C2; Domain location=1410-1455::337 -468::590-759::97-187::1104-1260::1045-1086
MTHPSSSDKIEELLVRLTTQQLTLSSKIDDFISHITPLFSPASHMPSSLPRPFPVPAQHHRLKLDVPRFDGTDALGWIFKINQYFEYHGTPEYDRLTIASFYMEGRALAWFQWMTSNGQFTSWPVFLQALQNRFAPSQYEDPTGTLCKLMQKGSVASYLSEFEDLANRVVGIPPAFLLSCFISGLTPEIRREVQAHQPLTLSQAAGLARLQEEKLGDLRPPPSTMRSRPPSLSSSSFSPRPQPLSPLFPSPSAIRPPPPQPSPTQPFKRLTSEEIASRRERGLCFSCDEKYHRGHRCASRVFLFIAEGDAAPDPPHIAPLDPTLEPDPDPTEAHDPHPAQLSLNSMAGHLAPETLRFVASIADVEVVLLVDGGSTHNFIQQQLVEKLGLPSISTTPLRVMVGNGQQLSCSCMCQAIAINIQNNTFIVDLYILPISGANVVLGVQWLKALGPVLTDYNTLSMQFFSDGRIIKLQGDLDAKLHLLTPVQLRRLSRTQGDALFYHITLLSNSTPSLPQEFPAPIQDLLLRFEALFTTPSTLPPARATDHHIHLIPQATPVNVRPYRYPHYQKQEIEQQVDAMLQKGLIQPSTSPFSSPVLLVKKHDGSWRFCVDYRALNALTIRDRFPIPTIDELLDELGGACYFSKLDLLQGYHQIRMNPEDIPKTAFRTHHGHYEFKVMPFGLCNAPSSFQATMNSIFQPYLRRFIIVFFDDILIYSTSMDAHLQHLEITFKVLLTHQFALKLSKCTFAQRQVEYLGHLVSFNGVEPLTDKIEAVRQWPSPRTTKALRSFLGLAGFYRRFIKGYATIAAPLVKATTLDPFQWTDVTQAAFDQLKLALSSAPVLALPDFHLPFTIETDASGVGLGAVLSQKGHPIAYFSKPFSAKMLRSSTYVRELYAITAAVKKWRQYLLGHRFVILTDHRSLKELLTQVVQTPEQHMYLARLMGYDYEIHYRSGASNQAADALSRVPDPDSSLALMLSVPCLTFMDELRSQLDQHSDYVHRRQDIANHPAKHPGFSVVNNLILHRHRIWLPRDIPIIPTLLIEFHATPTRGHSGIAKTIARVSENFYWSGLREDVATFVANCRDCQSTKYETKKLAGLLCPLPVPHRPWEDLSLDFIVGLPPYKGHTIILVVVDRFSKGVHLGMLPTAHTAFMVATLFLDMVVKIHGVPRSLVSDRDPLFLSKFWQELFRRSGTHLRMSSAYHPQSDGQTEVINRIIEQYLRSFVHRRPRIWGRLLPWAEWSHNTSWNSATGATPYEVTFGRKPFNFPEYLAGDSNIDAVDTLLCDREETFLMIRKKLLKAQILMKEKADKHRRDVVFSPGQWVLLRLRPHRQTSARENPTISGKLAKRYYGPFQVLEAIGKVAYRLQLPPDAKIHPIFHVSMLKPFKGDPNDPVANPLPISFHDDHPLVQPAAILASRPSSVSGWDVLVQWHGLSPDETSWEDWSTLCRDYHLEDKVLSQGPRGDTGGNIAEGDNQQNEVQQAMQINNQQDKVQQAISENKEQRPKRRVERPTYLKDYI

SEQ ID NO: 130825 - protein, 205 aa, Glycine max
  Coding DNA Sequence Number=SeqID_14047
  Homolog annotation: Hit_ID=Q1SD82; Match level="QueryCoverage=33%, HitCoverage=24%, E-value=3e-07, Identity=39%"; Hit description=P -type trefoil
MEQTIWGHLPVLVRANSKESIEYILQALWRTRKTGLGTTDRCIIQEMLQLQNESDLDPNTSKEDIPKLFPSEVLPELQKLLTLLLHKFQREWQEDVMKDQNIVPRLKAMTWNMANLDKESADPAAVINLKLQNDGQFHSGEQDVKFKLATDSIDMMLKAMHCIRDQFSTVGPCCVMLTKKIEEEMKRMLAMLMVFAYNRDKFALY

SEQ ID NO: 130826 - protein, 68 aa, Glycine max
  Coding DNA Sequence Number=SeqID_14048
MVGLVGESIDSTHDLTFTGFGNGYISEEINVDLDKVLKVCGGVGETQILFLSFTVPLKRDEYIRPSVW

SEQ ID NO: 130827 - protein, 200 aa, Glycine max
  Coding DNA Sequence Number=SeqID_14049
  Homolog annotation: Hit_ID=Q9FK31; Match level="QueryCoverage=54%, HitCoverage=44%, E-value=8e-26, Identity=54%"; Hit description =Arabidopsis thaliana genomic DNA, chromosome 5, P1 clone:MXI22
MAGVLCDSDARVVRVIEYSCHYSAMPMFEKTQNRRLSRMSNSGDANVTTEEQEAEAEQQSEEWETMARAWLCSFPEPKEVSMAEVEAWIDSNLASLPEGLRSMPRPDLCHRLISFQNCMRLPNQEREVNQLDLPHARFQRTDQWIPVYSWLETLDKEDVVKSKEISDWLTDNPKGVEQPDKDSSLKVQKDVAMKHPAPPP

SEQ ID NO: 130828 - protein, 105 aa, Glycine max
  Coding DNA Sequence Number=SeqID_14050
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=100%, HitCoverage=20%, E-value=2e-44, Identity=79%"; Hit description =Glycerol-3-phosphate acyltransferase 6
MVPRIKCEPLPRNKLLSPIIFHEGRLVQRPTPLMALLTFLWMPIGIILSILRVYLNIPLPERLAWYNYKLLGIRVIRKGIPPPPAKKGQSGVLFVCNHRTVLDPV

SEQ ID NO: 130829 - protein, 897 aa, Glycine max
  Coding DNA Sequence Number=SeqID_14051
  Gene Ontology: Mol. function=protein serine/threonine kinase activity; Cellular component=integral to membrane; Biological process=protein amino acid phosphorylation
  Homolog annotation: Hit_ID=Q1SE05; Match level="QueryCoverage=96%, HitCoverage=95%, E-value=0.0, Identity=69%"; Hit description =Serine/threonine protein kinase, active site
  Pfam annotation: Domain name=LRRNT_2; Domain location=29-65; Score =5.6; E_value=0.22; Accession=PF08263.3; Description=Leucine rich repeat N-terminal domain
  Pfam annotation: Domain name=LRRNT_2; Domain location=331-371; Score =5.2; E_value=0.24; Accession=PF08263.3; Description=Leucine rich repeat N-terminal domain
  Pfam annotation: Domain name=LRR_1; Domain location=114-136; Score =14.6; E_value=0.37; Accession=PF00560.23; Description=Leucine Rich Repeat
  Pfam annotation: Domain name=LRR_1; Domain location=138-161; Score =7.6; E_value=11; Accession=PF00560.23; Description=Leucine Rich Repeat
  Pfam annotation: Domain name=LRR_1; Domain location=190-212; Score =7.5; E_value=11; Accession=PF00560.23; Description=Leucine Rich Repeat
  Pfam annotation: Domain name=LRR_1; Domain location=213-235; Score =0.5; E_value=2.3e+02; Accession=PF00560.23; Description=Leucine Rich Repeat
  Pfam annotation: Domain name=LRR_1; Domain location=240-261; Score =8.7; E_value=6.6; Accession=PF00560.23; Description=Leucine Rich Repeat
  Pfam annotation: Domain name=LRR_1; Domain location=263-285; Score =11.3; E_value=2.2; Accession=PF00560.23; Description=Leucine Rich Repeat
  Pfam annotation: Domain name=LRR_1; Domain location=287-308; Score =3.8; E_value=56; Accession=PF00560.23; Description=Leucine Rich Repeat
  Pfam annotation: Domain name=LRR_1; Domain location=374-396; Score =3.9; E_value=53; Accession=PF00560.23; Description=Leucine Rich Repeat
  Pfam annotation: Domain name=LRR_1; Domain location=398-420; Score =10.5; E_value=3.1; Accession=PF00560.23; Description=Leucine Rich Repeat
  Pfam annotation: Domain name=LRR_1; Domain location=422-443; Score =6.0; E_value=21; Accession=PF00560.23; Description=Leucine Rich Repeat
  Pfam annotation: Domain name=LRR_1; Domain location=69-91; Score=4.2; E_value=46; Accession=PF00560.23; Description=Leucine Rich Repeat
  Pfam annotation: Domain name=LRR_1; Domain location=93-112; Score =0.4; E_value=2.4e+02; Accession=PF00560.23; Description=Leucine Rich Repeat
  Pfam annotation: Domain name=Pkinase; Domain location=557-834; Score =153.8; E_value=4.4e-43; Accession=PF00069.15; Description=Protein kinase domain
  Pfam annotation: Domain name=Pkinase_Tyr; Domain location=557-834; Score=149.1; E_value=1.1e-41; Accession=PF07714.7; Description =Protein tyrosine kinase
  Pfam module annotation: Pfam domain module=LRRNT_2::LRRNT_2::LRR _1::LRR_1::LRR_1::LRR_1::LRR_1::LRR_1::LRR_1::LRR_1::LRR_1::LRR _1::LRR_1::LRR_1::Pkinase::Pkinase_Tyr; Domain location=29-65::331 -371::114-136::138-161::...
  Pfam module annotation: Domain location=190-212::213-235::240 -261::263-285::287-308::374-396::398-420::422-443::69-91::93-112::557- 834::557-834
MVKHAQLGFEGSFIFYLVLVLSFLVISTRCQDAEVMGILKIMINAPISFQWTNPDVCKWRHVTCDSSKRVTAIQIGSQNLQGSLPKELVKLTSLERFECQFNSLTGPFPYLSKSLQKLVIHDNKFSFIPNDFFKGMSHLQEVRIDDNPFSQWHIHDTLRDCVALHTFSAQSVGLVGTIPNFFGKDGPFPGLVLLALSDNFLEGALPTSLSDSSIENLLVNGQNSLSKLNGTLVVLQNMKSLRQIWANGNSFTGPIPDLSHHDQLSDVNLRDNQLTGVVPPSLISLPSLKFVNLTNNFLQGSSPIFKYGVGVDNSMDKGKNQYCTDVPGQPCSPLVNSLLSIVEPMGYPLKFAQNWQGDDPCANKWTGIICSGGNISVINFQNMGLSGTICPCFAKFTSVTKLLLANNGFIGTIPNELTSLPLLQELDVSNNHLYGKVPLFRKDVVLKLAGNPDIGKDKPTSSSFIDNGSNHNTAIIIGIVVVAVIILISGVLILVKFKRKWEHERKTQNPPVIMVPSRRYGDGTTSALLSPMGSVYQVEDHNMLISVQVLRNVTNNFSEKNILGKGGFGTVYKGELHDGTKIAVKRMQSAGLVDEKGLSEFTAEIAVLTKVRHINLVSLLGFCLDGSERLLVYEHMPQGALSKHLINWKSEGLKPLEWKTRLGIALDVARGVEYLHGLAQQIFIHRDLKPSNILLGDDMRAKVSDFGLVRLAPEGKTSFQTKLAGTFGYMAPEYAATGRLTTKVDVYSFGVILMEMITGRKALDDNQPEENVHLVTWFRKMLLNKNSFQTTIDPTIEVDAETLVNINIVAELAGHCCAREPYQRPDMSHVVNVLSPLVEVWKPSETNVDDIYGIDYDMTLPEALQRWKDFEGSSTTLELTSPSSSVLLNGNNTKSST

SEQ ID NO: 130830 - protein, 265 aa, Glycine max
  Coding DNA Sequence Number=SeqID_14052
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=95%, HitCoverage=24%, E-value=1e-109, Identity=78%"; Hit description =CHASE; Lantibiotic regulatory protein
  Pfam annotation: Domain name=Response_reg; Domain location=110-245; Score=103.2; E_value=7.6e-28; Accession=PF00072.14; Description =Response regulator receiver domain
LFQPDIIFVEKDSWVCVEDGIFNVWQLDWKQNRHIFKIPQMILLATNIGNDEFDKAKAAGFSDTVIMKPLRASMVAACLQQVLGTGKKRQHGKDMNPNGSTFVRSLLCGKKILVVDDNVVNRRVAAGALKNFGADVTCAESGKTALEMLQLPHNFDACFMDIQMPEMDGFEATRQIRMMETKANEQQMNGECGEGNGWKDKKYHIPILAMTADVIHATYDECVKCGMDGYVSKPFEEENLYQAVAKFFNPKPTSIQQNARTGKAT

SEQ ID NO: 130831 - protein, 103 aa, Glycine max
  Coding DNA Sequence Number=SeqID_14053
  Pfam annotation: Domain name=Dehydrin; Domain location=10-100; Score=- 18.4; E_value=0.0064; Accession=PF00257.10; Description=Dehydrin
MVVVATWLWEKQYEATFNQYGAVPVSKDPIQKEKETNGDTTGIAVDGGGVAGSTQVIAEEDYDHRRTTTTTTTTTAVDNHPHKKGIIEKIKEKLPGTHHHNNK

SEQ ID NO: 130832 - protein, 710 aa, Glycine max
  Coding DNA Sequence Number=SeqID_14054
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=99%, HitCoverage=74%, E-value=0.0, Identity=81%"; Hit description=CHASE; Lantibiotic regulatory protein
  Pfam annotation: Domain name=CHASE; Domain location=110-313; Score =281.6; E_value=1.5e-81; Accession=PF03924.4; Description=CHASE domain
  Pfam annotation: Domain name=HATPase_c; Domain location=454-637; Score=130.5; E_value=4.6e-36; Accession=PF02518.16; Description =Histidine kinase-, DNA gyrase B-, and HSP90-like ATPase
  Pfam annotation: Domain name=HisKA; Domain location=342-407; Score =92.7; E_value=1.1e-24; Accession=PF00512.15; Description=His Kinase A (phosphoacceptor) domain
  Pfam module annotation: Pfam domain module=CHASE::HATPase_c::HisKA; Domain location=110-313::454-637::342-407
MGLGLKMKSLRHHPMALKIHEQAGSKRKYTFIQAHRAWLPKFLMLWILLMALIGCFIFSKMDADTKVRRKEVLGSLCDQRARMLQDQFSVSVNHVHALAILVSTFHYYRTPSAIDQETFAEYTARTAFERPLLSGVAYAQRVVNSERETFEKQHGWVIKTMEREPSLVRDEYAPVIFVQETLSYLESIDMMSGEEDRENILRARATGKAVLTSPFRLLGSHHLGVVLTFPVYKSKLPPKPTMEERIKATAGYVGGSFDVESLVENLLGQLAGHQAILVNVYDITNSTDHLIMYGNQNEEGDMSLVHEMGYILYGAGNHIVKVEDDFHQMEELKVRAEAAHVAKSQFLATVSHEIRTPMNGILGMLGLLLKTELSSTQRDYAQTAQACGKALIALINEVLDRAKIEAGKLELEAVPFDIRSILDDVLSLFSEKSRNKGLELAVFVSDKVPDIVMGDPGRFRQIVTNLVGNSVKFTERGHVFVKVHLSENRMSTMNGKIEKFLNGGLDEPVHMSGGYNSKTLSGYEAADERNSWDNFKHLIADEEFFYDASVKRVASESYEQVTLMVSVEDTGIGIPFSAQDRIFMPFVQADSSTSRHYGGTGIGLSISKCLVELMGGEISFISQPQVGSTFSFTADFGTIKKNAITDMKKHNLEDLPSNFRGLKAIVVDGKPVRAAVTRYHLKRLGIQAKVANSFNKAVSLCGKNGCLTSG

SEQ ID NO: 130833 - protein, 131 aa, Glycine max
  Coding DNA Sequence Number=SeqID_14055
  Pfam annotation: Domain name=DUF896; Domain location=39-87; Score= -24.7; E_value=0.083; Accession=PF05979.3; Description=Bacterial protein of unknown function (DUF896)
MNLDFRITEYDPIETWKEKLKSFKGSLKDWNRLHFGNIHKKIARILKNVNELDKKEEEGGLSVEELEARKDMQEDFWRNVVFSESIYIQTKIMIQGRVCKKIFEGMRKNLTRGVDVDGMRKEESLIVKEEA

SEQ ID NO: 130834 - protein, 266 aa, Glycine max
  Coding DNA Sequence Number=SeqID_14056
  Gene Ontology: Mol. function=peptidase activity; Biological process =cell redox homeostasis
  Homolog annotation: Hit_ID=Q10QF4; Match level="QueryCoverage=62%, HitCoverage=67%, E-value=7e-75, Identity=77%"; Hit description =UPF0326 protein hag1, putative, expressed
  Pfam annotation: Domain name=DUF862; Domain location=41-173; Score =224.9; E_value=1.8e-64; Accession=PF05903.5; Description=Eukaryotic protein of unknown function (DUF862)
MKLKSKKGWKSIVPLRLKGKSATHFLLFRKVNSAGYGPGKTPVYLNVYDMTPMNGYVYWAGLGIHHSGVEVHGVEYAFGAHDYPTSGVFEVEPHQCPGFKFRKSIFIGTTSLDSTQVREFMERQSARYNGDTYHLIVKNCNHFCKDICYKLTGKSIPKWVNRLARLVCLDGGNGEKERECKVFLQHEFGRKVTSLIETFNFHQALTLGKPSANQVSFCSICNCILPVKREGFEVKREGFEVASIACPQSQSVKNTFPHLHCFYSHP

SEQ ID NO: 130835 - protein, 264 aa, Glycine max
  Coding DNA Sequence Number=SeqID_14057
  Homolog annotation: Hit_ID=Q2HSW3; Match level="QueryCoverage=28%, HitCoverage=72%, E-value=3e-20, Identity=70%"; Hit description =Sec61beta
  Pfam annotation: Domain name=Sec61_beta; Domain location=212-256; Score=79.0; E_value=1.4e-20; Accession=PF03911.7; Description =Sec61beta family
MDSPLLENIDNSTTNVEEKKTLNSVVKKLNSGPAILTSICQYSFGALTQTFAGLVGDLELAAVSVENSVVAGLAFGVMLKLSVMGERKKMECLGSRSSLISRALLFLIHHSLSLFNTRFSTALISSQTLSLHFSLTPPILYHKAATLFPSFFIFASWPKVLNPPLQQPRDQHQQAWLPAVSPPPLPACAVATTSMHHRRLGSRNSSTSTVIGGGNNNILRFYTDDAPGLKISPTVVLVMSFCFIGFTALHVFGKLYRSKSGGAV

SEQ ID NO: 130836 - protein, 114 aa, Glycine max
  Coding DNA Sequence Number=SeqID_14058
  Gene Ontology: Mol. function=monooxygenase activity; Biological process=electron transport
  Homolog annotation: Hit_ID=Q1S220; Match level="QueryCoverage=63%, HitCoverage=13%, E-value=2e-13, Identity=52%"; Hit description=E -class P450, group I
MFYKWEDENKGVDEFEIEVSKDLHDLTSDSTKTMFYKVAFPSNYEEGKEIFYLLEQHYHLVSLANRSVYLPGFSSACLVGPTDEIDMARISCHGPMLLMTATPQYGMQIIFRRL

SEQ ID NO: 130837 - protein, 500 aa, Glycine max
  Coding DNA Sequence Number=SeqID_14059
  Gene Ontology: Mol. function=carboxypeptidase activity
  Homolog annotation: Hit_ID=Q1SIS3; Match level="QueryCoverage=86%, HitCoverage=95%, E-value=1e-150, Identity=65%"; Hit description =Peptidase M14, carboxypeptidase A
MASSSRHSPQFTPILEEREFDDLSGHDIISHSRSSHPPTPIVHKHTKSNHNNHKKKRSDSEEDGSVSCNKCRPHSRDKIFILPLDHSSTNNSHKPSSLLASPNGIFRSLVSKLTRKSPMSSSSSQDPLPPSREEQWKMAVAELSHKLLHATRKRDEALLEASRLMHSMSELEKKLNKLELYCHTLKSGLEQCTNNNITTSPTSLFKSQTLEQDTVIQHFLVSVSEARSSVRLLSRSLTMQLRHMGSKVYEKVSFLLQPYDIKISFSKSPTRSLLFYLEALLNRTFYEDFETIGFQKNACNMILNPKERCEASYESFNMVHGLTWEEVLSKGTRHFSEEFSRFCDRKMSEIVAMLGWNRAWPEALLQAFFGASKSVWKVHLLANSLHPSLPIFRVEKGVRFDSVYMEDMGGGGGDKATSNLVPALVRIMLAPGFYVYGSAVKCKVLCSIKQCWCCCMLGLGWFHGGGTTISRFWVKGSISTIMGSIQSARVVMTVESMKNA

SEQ ID NO: 130838 - protein, 101 aa, Glycine max
  Coding DNA Sequence Number=SeqID_14060
MAKPAWPVSPVLIAKPVEGLPPLTPTFALNAYLTYIASQNGENISTTSFASGSGENTTCPRHLRFASGVAKPAPHHSSPRPVSPACMASHVCRQHAWWSPL

SEQ ID NO: 130839 - protein, 97 aa, Glycine max
  Coding DNA Sequence Number=SeqID_14061
MSLPEKIVSLFFSIGSIFNKAEHCVDTRGKAILTEGWAEMDSLHSHIPVTINCIHECRNFPTAENTDLGWTDLREFYELRNLLDKQFSGVSFHAPLA

SEQ ID NO: 130840 - protein, 114 aa, Glycine max
  Coding DNA Sequence Number=SeqID_14062
MELELWKQVSSRILNGSGNFGRISHSNESAKVIRVHRGNMVFEDQDLQRREKEGTSNNHATSSLRIAGSSGSIFRRNLSGKWASKPSSLCYLLFAPLALFALLVLHRFLLLAPS

SEQ ID NO: 130841 - protein, 118 aa, Glycine max
  Coding DNA Sequence Number=SeqID_14063
  Homolog annotation: Hit_ID=O04180; Match level="QueryCoverage=52%, HitCoverage=28%, E-value=5e-07, Identity=43%"; Hit description=Pge1 protein
MSERADMDYENAESCGANEPHVDCSDAFKTSQMFECREDVLRWARSVAHENRFVVVILRSDTNTGSRGRSTFVLIGCERSGEYKCRKKNLSEETLRLGNVGVPSSFIASQWLEEKAGW

SEQ ID NO: 130842 - protein, 261 aa, Glycine max
  Coding DNA Sequence Number=SeqID_14064
  Gene Ontology: Mol. function=metal ion binding
  Homolog annotation: Hit_ID=Q9C9T6; Match level="QueryCoverage=93%, HitCoverage=64%, E-value=2e-25, Identity=35%"; Hit description =Putative RING zinc finger protein; 69105-67310
TNTTTPTVAEHIKWRRPRNQFNHHHHHHHHPISETDPNPQIPSIIQSTRCKSTISSLLLSTFSNNTSNNATAHSKKKSNFSASTFRGLGCTAGSSQQVSVPAVIRSSADWQGKKTRKKKHKRSNRSSKNKTFHGGVLEGSNPECVDFQDVWCGPGIGFSTDAAAAASVDCVVARKNVSSARGKIDVDKITHRERSSYVGRRTETFTFLDSTDPDIFTPRSASDSYGTATYYRHVRDPSSDGFAEVASNIHDLHVLAVATKL

SEQ ID NO: 130843 - protein, 274 aa, Glycine max
  Coding DNA Sequence Number=SeqID_14065
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=6e-21, Identity=37%"; Hit description= UPI00006A17C9 related cluster
LHVLALRGLHVLTIRGLHALTSRGLHVLALRGLHAITLGLHVLTIRGLHALTSRGLHVLALRGLHTLTLGLYVLTIRGLHALTSRGLHVLALRGLHALTLEGYTPSPWVLVTLTVERTTRPRLERTTRPFHQRVARPHLQRTTCPRLERTTRPRQQRAAFPHLEEDYTSSPTEGCTPLTSKGLHVLTVKGSCAFTFVGLHTLTFRGLRVLTFRTSSFLLTVPGPPPNIGGRPTVQAQLEREAITQLLCIPGQDFTCAVAKRRVRIMRTNMTTLT

SEQ ID NO: 130844 - protein, 454 aa, Glycine max
  Coding DNA Sequence Number=SeqID_14066
  Gene Ontology: Mol. function=hydrogen ion transporting ATP synthase activity, rotational mechanism; Cellular component=integral to membrane; Biological process=ATP synthesis coupled proton transport
  Homolog annotation: Hit_ID=Q9FA44; Match level="QueryCoverage=93%, HitCoverage=84%, E-value=0.0, Identity=80%"; Hit description=TctA
  Pfam annotation: Domain name=DUF112; Domain location=1-391; Score =603.8; E_value=1.5e-178; Accession=PF01970.7; Description=Integral membrane protein DUF112
  Pfam annotation: Domain name=MFS_1; Domain location=31-428; Score= -51.7; E_value=0.073; Accession=PF07690.6; Description=Major Facilitator Superfamily
  Pfam module annotation: Pfam domain module=DUF112::MFS_1; Domain location=1-391::31-428
MPLAFALHLPAESALILLATVYIGCEYGGRISSILLNVPGDAGAIMTALDGYPMAQQGKAGVALSISAVSSFIGSTIAIIGIILFAPMLANWSLAFGPAEYFALMVFAIACLGSMMSHNPLKSFLAALIGLGMATVGVDANTGVYRFTFDSVHLSDGIQFVVVVIGLFSVSEILLMLESTSSGQKMVRASGRMLFNMKEAAQATGATLRSSFIGFFVGVLPGAGATIASAIAYMSEKKISGSDQFGKGDIRGVAAPEAANNASACGSFIPMLTLGIPGSGTTAVMVGALTLYNITPGPAMFTEQPDIVWGLIAALLIGNVMLLIMNIPMINIFARMLTIPLWFLVPAIAAISAVGVYAVHSTTFDLLLMVGLGIFGYILRKMDFPMSPLILGFVLGEMLEQNLRRALSISNGNLPILWESLICKVLLVLAVAVLVVPPLWKRWRRKRMKLAAAE

SEQ ID NO: 130845 - protein, 758 aa, Glycine max
  Coding DNA Sequence Number=SeqID_14067
  Gene Ontology: Biological process=cell cycle
  Homolog annotation: Hit_ID=Q8H0H5; Match level="QueryCoverage=87%, HitCoverage=90%, E-value=0.0, Identity=56%"; Hit description =Hypothetical protein A20
MKEFEKRKASRNSQTKGSRRTERRENKLHQDNSSKTLNEKGTESKTPQDSRPTANNFISDSNAASENSETYENVIIHYVDDVNRSEEALAEMKVNETVANENKNEVADDRSSDLEKEQKEGNEEVSDTETVKDSVSSQGDSFTNEDERTEKALKDPKSKVKVNPSESNRGSKERSDRKTNKFQSKVSNSNQKKPMNSNKGHSKVTNKNTSSANSKTVKVPVNVSSESPEGVDEKPVQEVKELVNDESSNGAQSVGSEDESRETVNDEENDEHEDNAAAELKIEEMELRIEKLEEELREVAALEVSLYSIAPEHGSSTHKVHTPARRLSRLYIHACKHWTQKRRATIAKNTVSGLVLVAKSCGNDVSRLTFWFSNTIVLREIISQAFGNSCQASPLKRLVESNAAGKRNDGKSMALKWKGSSNGKPGNGFMPLVEDWQETGTFTFALERVESWIFSRIVESVWWQALTPYMHSPVGDSSNKPIGKLMGPALGDHNQGNFSINLWRNAFQDAFQRLCPVRAGGHECGCLPVLARMVMEQCIARLDVAMFNALLRESALEIPTDPISDPIVNSKVLPIPAGDLSFGSGAQLKNSVPCGIDLVLVAMSKVGNWSRWLTDMFGMDAEDCLQEDQENSENDEKQGGDGEPKSFVLLNDLSDLLMLPKDMLIDRNIRQEVCPTIILSLIIRVLCNFTPDEFCPDPVPGTVLEALNAETIIERRLSAESARSFPYVAAPVVYMAPSSANVAEKVAETEGKSHLARN

SEQ ID NO: 130846 - protein, 41 aa, Glycine max
  Coding DNA Sequence Number=SeqID_14068
MEGNYAIKLWKRFWKGADIKKYLNMLLHPPRYTARYTEKEC

SEQ ID NO: 130847 - protein, 130 aa, Glycine max
  Coding DNA Sequence Number=SeqID_14069
MREILMKGERERERKERIFLFDLVEGEGKGESPSVFAYKDFSTAKWEASVGMSIHDNNSLGLFGETQKRKQQGHIYDIESIRFRGYNAITNFNIRLFYNIEAILKGQTEPGKRSKYILKLKWLKDSVRWI

SEQ ID NO: 130848 - protein, 215 aa, Glycine max
  Coding DNA Sequence Number=SeqID_14070
  Homolog annotation: Hit_ID=Q6AVI7; Match level="QueryCoverage=32%, HitCoverage=15%, E-value=4e-14, Identity=51%"; Hit description =Putative glycine rich protein
MMLTRTQERGCCLTYDYVIDDVTDLLGEKDLDSISVLRGLLVSRPADSSFSHKNALHRCVEHAKLWLAQDREHMGFVSSFLGIFGFAVGIPLGLLVGFFLFVYSETKHVKDPVVRPISELGPNALQELLPEIPLWVYDDDDDDVIVLLILFLHVIQKHDSTDIIFAEYIGKYQIKAIDFDELSLGTLPPSVCGKIGSFPPKTQKYAHFRMKIEDY

SEQ ID NO: 130849 - protein, 128 aa, Glycine max
  Coding DNA Sequence Number=SeqID_14071
  Gene Ontology: Mol. function=transferase activity, transferring glycosyl groups; Cellular component=chloroplast; Biological process =biosynthetic process
  Homolog annotation: Hit_ID=Q6DW75; Match level="QueryCoverage=62%, HitCoverage=17%, E-value=3e-37, Identity=91%"; Hit description =Digalactosyldiacylglycerol synthase 2, chloroplast
MQFSRDKRSILAVGDISEIIPDKVADIVVLEEPEHLTWYHHGKRWKTKFRLVIGIIHTNYLEYVKREKNGTMQAFLLKGISHKANFYIGCPNNRCRMSKFNIDHLTVVVFQRLRVTTTRDNRCRKSLF

SEQ ID NO: 130850 - protein, 128 aa, Glycine max
  Coding DNA Sequence Number=SeqID_14072
  Homolog annotation: Hit_ID=Q9C9T8; Match level="QueryCoverage=34%, HitCoverage=10%, E-value=5e-07, Identity=61%"; Hit description =Putative UDP-N-acetylglucosamine--N-acetylmuramyl-(Pentapeptide)- ...
  Homolog annotation: Hit description=pyrophosphoryl-undecaprenol N -acetylglucosamine transferase; 62395- 63952 (Putative UDP-N -acetylglucosamine--N-acetylmuramyl- (Pentapeptide)-pyrophosphoryl -undecaprenol N-acetylglucosamine transferase)
MPVGWITSAEIYFEVQNTVEDDGRQIPEVLLLNHKEFRAMGRIKTITGQDWLTLYRIIMGPRTIPSPNFSEGNQFRNASLMADVAGVTVITEDELDSSTLAIAIEKINKFKHSLTPTIFHRFCLKSET

SEQ ID NO: 130851 - protein, 66 aa, Glycine max
  Coding DNA Sequence Number=SeqID_14073
MWQEYEGDQWGPDPRRKRTAKGRPVSTRILRWTKTKMNEQVEKNVDFAGNMKRKKGSRGAKPDFRE

SEQ ID NO: 130852 - protein, 85 aa, Glycine max
  Coding DNA Sequence Number=SeqID_14074
MEKLKDLIKQVAPTGVPPNGIHGSQLVRRLFFRQPGHSKYSKNLIEYDITEWKNDEDVLKVLAQSNYWKRFCTIEIWAIFSKPVI

SEQ ID NO: 130853 - protein, 624 aa, Glycine max
  Coding DNA Sequence Number=SeqID_14075
  Homolog annotation: Hit_ID=Q69KD5; Match level="QueryCoverage=30%, HitCoverage=49%, E-value=6e-46, Identity=48%"; Hit description =Ribosomal protein-like
ENGETKRNQGEGKRTKTETRPWPETRHATVMETRDATMAGNATMAGDETMVGDPTMCFIVDANEECGHGGEEEDREKERKKIERRRGGSFWSENFQNPPQYVMCPPPPPTNENSQNPPQYIMYPPPPHMWYMHPSSNVEPPTSGSSQNPQIYSQPSTPTNLNTCYRPSLSNIVLPSNEIESLVGVDGIQLDEGDENSGGKKVVPHSRSRKMIHPLVQKFNGCYKQADKHRRSGSSEKDVLADAHMIYSQDIGKKFEVEHGWLLLKDQPKFDSEFMSKCSKRTKVSTSGNYLSSSNPETPIEVEEYDTLSPMSRPIGQKAAKRKNKGKECPNTLDLSSIESVMKDKNMNTSKLIQLKEAQEKRLQEQERRMEYEILMKDTSNMSEQQHKDHEKANNNYMATPLGVAKEEEWYIIIVKKVIIDCSMTIFQKILCTQRFNFGEGLSPLQKCTTAIRILAYGSPTDNVDEYVRIGETTAVECLERFVLGICTIFGNKYLRRPNNEDIERLLQMGATRGFPDGIYPDFVTFVKTISMPQGEKRKLFAQRQESARKDVERAFGVLQSRFAIIRGPSRFWDASKMKNIIYACIILHNMIVEDEPMSKRLQEDWARAAEESPRILMNLGVDF

SEQ ID NO: 130854 - protein, 129 aa, Glycine max
  Coding DNA Sequence Number=SeqID_14076
MSTQRIRGRDEYQEAEHDFENMSIFSASDLRGEVNLHFPKPCKRLKALLERQIEERKESMEAKPPWKRKPEWRRKRERRRHFKEKMSLEEAHHHRRPWIRAWRKKEMNEGKGREEHEILCSKRALKSEV

SEQ ID NO: 130855 - protein, 211 aa, Glycine max
  Coding DNA Sequence Number=SeqID_14077
MKIAKQLVIAMQNIGAPAELMFLIGSYGDTQSDEDILEMLEQFNERGTYVHEVISPAFRWEPGNAELMEMALAALTARPKGFIESKANGTDCFILKGFYLNGLVEGDELYTAPPAPVLRVPDEMHHKQSPHGESSLWAMGWNECLAEVKRLNTQPSPPEAYEIARELLALRNAFSVPDCWEIAGQIFATEEEALSYGFIGKPEPLYSKPEA

SEQ ID NO: 130856 - protein, 79 aa, Glycine max
  Coding DNA Sequence Number=SeqID_14078
MQSQLQSQIHSQGLALPLEPEVGVEEVKDVEALVPVPTTEVILVVQALNTFLAWLTHLVKRLSEQATVSPAKLADGPDP

SEQ ID NO: 130857 - protein, 131 aa, Glycine max
  Coding DNA Sequence Number=SeqID_14079
MDEKTKKKLEEVAQSRSTNIVIDPPSPIRRHVKWKMTHIKKIGQMMSEAAKQIADKIDLLEEQASQGSFIAHICQDVLAIAIGLPEHPGRVRVAGAGVTIKQYFGLAPRTSCTSSSRAREELEQLTQQIKD

SEQ ID NO: 130858 - protein, 131 aa, Glycine max
  Coding DNA Sequence Number=SeqID_14080
MYNGSGFCPDRCREAGADHAHQYDHLDTDVDDVAAQQCMPPTRHPLDLDKSNRALGFPTLITGLCQSFGVPVIPSKVIRPPITRAFIEKYCTPRQAQGDAPQAADAPPPPHQADPAGSLGMERYLQHLVRQ

SEQ ID NO: 130859 - protein, 45 aa, Glycine max
  Coding DNA Sequence Number=SeqID_14081
MQAPELYAESGITIFALQLGAKNKPMYGAGRSMQDMLDSGTGLPL

SEQ ID NO: 130860 - protein, 103 aa, Glycine max
  Coding DNA Sequence Number=SeqID_14082
MLILSEYWTPKTVVNNPSEFNIHREVESKPKAINIPCLKKQIAGAGSLDIQTFLKFQLKITVKTSAKARGNWKGGLVPSLEEFESRSKGSTTLRDIGLRSTPN

SEQ ID NO: 130861 - protein, 109 aa, Glycine max
  Coding DNA Sequence Number=SeqID_14083
MVGIPQSFRFQFRACRYITGLNQISELKVIVVCICYELLFSISSISIYYGTQSDNRRNEERKRERRCHFKEKMSLEEAHHHRRPWIRAWRKKEMNEGRRSEEHEILCSK

SEQ ID NO: 130862 - protein, 97 aa, Glycine max
  Coding DNA Sequence Number=SeqID_14084
MPTSAPTSRRTSSPYFVVRVEGDDGRVGGRRGGRGGCRRAGGRQRRRRGYEGRRTWRHGCGGSWRGGLRVVQDLRVRERRSLWKLLGHRGGRSVQRN

SEQ ID NO: 130863 - protein, 170 aa, Glycine max
  Coding DNA Sequence Number=SeqID_14085
LRIANETLWQSRLEEADISRKGAVIRIANETVLQSLPEDADILEKVLRIGNETYSQSRPEDADISGKGAEEADISGKGVGDDSRPEDAYISREGADENSRPKDADIYGKGAADISWKAADDDVSHSMLSGFESYQEQMRLFRNVGRKTLTSSGKSRLEDAYISREGADDN

SEQ ID NO: 130864 - protein, 163 aa, Glycine max
  Coding DNA Sequence Number=SeqID_14086
  Subcellular localization annotation: CTP_CleavageSite=50; ConfidenceScore=5.16e-01
MSYFIFQVFYFNKQTTWILDNTHNDTVMVNCLHNLINQFSKSSIFPTKVLSFLRRSLIRGRPLLQPQSYAAVSFLRRPLLQPQSLGNKTPHHTVSPNATKKRKSHKESYIKGTDTFPFGTVTSRNPIFFSRLQAEVTQRLTSAKESSSKPGLQSHEDLAKKLQ

SEQ ID NO: 130865 - protein, 41 aa, Glycine max
  Coding DNA Sequence Number=SeqID_14087
MWQANTSFPPTYLDNRNNPVYTGCSLTAGNPITCKEISGRM

SEQ ID NO: 130866 - protein, 162 aa, Glycine max
  Coding DNA Sequence Number=SeqID_14088
  Gene Ontology: Mol. function=transcription factor activity; Cellular component=intracellular; Biological process=regulation of transcription, DNA-dependent
  Homolog annotation: Hit_ID=Q5NRH6; Match level="QueryCoverage=82%, HitCoverage=79%, E-value=9e-40, Identity=60%"; Hit description=MarR family transcriptional regulator
  Pfam annotation: Domain name=MarR; Domain location=50-122; Score =60.9; E_value=4.1e-15; Accession=PF01047.13; Description=MarR family
MTDHVDFVVAQWASAMPELDASSMAIFGRMLRLMKLLAKKRAEALAPFGFRDGEFDVLATLRRAGAPYRLSPTQLYKSLLVTSGAMTNRLNRLEEEGLIARVADADDKRSTLVMLTPAGLAKIDQALQVHTQTQNALLATLDDRQQQQLAALLRQLLQTAEQ

SEQ ID NO: 130867 - protein, 116 aa, Glycine max
  Coding DNA Sequence Number=SeqID_14089
MEIECESYLTCYWHVCFTGFCGGAEFASGDGGHRTAVPATAARCRAQCHAAEPADDAAGHYDGAGGAGRTAAAAQAGATMLTASALLAGCGIGLIQALMPALIKRHFASRAYTLMA

SEQ ID NO: 130868 - protein, 97 aa, Glycine max
  Coding DNA Sequence Number=SeqID_14090
  Homolog annotation: Hit_ID=O48534; Match level="QueryCoverage=81%, HitCoverage=3%, E-value=1e-29, Identity=78%"; Hit description =Putative ATP-dependent RNA helicase
MWLQTRKHSPICNKDELSYYYIAHGFISTYNEHLKPTMGDIELCQLFLFNEEFKYVRVRQDEKMGLAKLLDYVPIPIKESLEEPSAKINVLLQAYIS

SEQ ID NO: 130869 - protein, 180 aa, Glycine max
  Coding DNA Sequence Number=SeqID_14091
MGSSQKPSLKKRFYQVQIQSLEVTSLRKLGQLMGQLQRQAFRKAYGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMLP

SEQ ID NO: 130870 - protein, 76 aa, Glycine max
  Coding DNA Sequence Number=SeqID_14092
  Subcellular localization annotation: CTP_CleavageSite=36; ConfidenceScore=5.72e-01
VSSPGQATPAQNGLKRGRGKVSAPKTLPPPPSFKKKAMGITNFAAPRSPFFTFLIPFFSIIHLQQGMALGLGCILR

SEQ ID NO: 130871 - protein, 437 aa, Glycine max
  Coding DNA Sequence Number=SeqID_14093
  Gene Ontology: Mol. function=nucleoside-triphosphatase activity; Cellular component=membrane; Biological process=transport
  Homolog annotation: Hit_ID=Q5PE81; Match level="QueryCoverage=65%, HitCoverage=91%, E-value=1e-111, Identity=72%"; Hit description=ABC transporter ATP-binding protein
  Pfam annotation: Domain name=ABC_tran; Domain location=177-361; Score= 198.3; E_value=1.8e-56; Accession=PF00005.17; Description=ABC transporter
  Subcellular localization annotation: CTP_CleavageSite=45; ConfidenceScore=5.02e-01
GGALRFVDRAVGRVDAPFSATGQNWHFRNRPGAGANRTGAICVIAAGTRGGDRAATGTTRGAGKRNRNGNERLPAFSPGSVTVGAAGPVAQPAGGQRTDCRYGGGSGVDRRGRLRRFGVSGAAQQRAGFGAAGRHSDDCVGGSRGCREKRMIEFDGVNKAFAGQPAVKDLNLHLREGAFSVLIGTSGSGKSTTLKMINQLVEQDSGVIRFAGEDIRRQPLLALRRRMGYAIQSIGLFPHWTVAQNIATVPQLQKWPRAKITERVDELMALLGLEPLLRDRYPHQLSGGQQQRVGVARALAANPEVLLMDEPFGALDPVTREALQQEMLRIHRLFGRTIVLVTHDIDEALRLADHLVLMDGGEVVQQGEPLQMLLEPKNAFVETFFGRSELGVRLLSLRGVGDYLRRDERLAGDALNVSMTLREALSQFVAHRRDVLP

SEQ ID NO: 130872 - protein, 86 aa, Glycine max
  Coding DNA Sequence Number=SeqID_14094
MSGFTHDSPQISASPHQLDLAPYASEPYHAQWNAPGLLRDKHTLRLSRISRRNGGFLAAKFTSWLVFLVCSKGGVRHWKCGRQTLW

SEQ ID NO: 130873 - protein, 80 aa, Glycine max
  Coding DNA Sequence Number=SeqID_14095
MVDDNDDTAGVLHDDTAGVIHDDNQLRETKLKGTTVLSSTTMPIKPVVDIIFGKNVIEIKRIFTKMPPPVKQQRFSDHRP

SEQ ID NO: 130874 - protein, 407 aa, Glycine max
  Coding DNA Sequence Number=SeqID_14096
  Gene Ontology: Mol. function=RNA-directed DNA polymerase activity; Biological process=RNA-dependent DNA replication
MEMCNLVRSAFTTGTFPPQLVETLVVPMPKVDNPTSMKEQKASEGYWKPIKVSDGGPEISHLFFVDDYLLFTKASCSQVRLVKEVLDAFHKAFGLKVNVQKPRFFTSIIHFHHTIDLAKYLGFPLLKGRTKTLNQAGRVTLASAILTTIPTYTMQNLWLSEANIALLGEHIWSLHHHEDKLWVRVLKDKCMMCLMVLSGEVWGVGRVFSSHGKRLLESKTETTTWTSQTSGGLRILVYMVSRNKEALKSKEWTLWYTVNQIKKTQAIITTHTTTTPASTSSMREITWSLPSTNAIKLNLDGSSLGNPGPSGYGVLLQNSQGEWLQGFKGFWGHATNLYAKFIALLKGVQLAWDRGDRHVICKNSKLGIGLPLSSTLFAKGTSVQTCLPRWDPQSMTLWLFLSLARNS

SEQ ID NO: 130875 - protein, 286 aa, Glycine max
  Coding DNA Sequence Number=SeqID_14097
  Gene Ontology: Mol. function=RNA-directed DNA polymerase activity; Cellular component=chromatin; Biological process=chromatin assembly or disassembly
  Pfam annotation: Domain name=Chromo; Domain location=204-252; Score =12.8; E_value=0.03; Accession=PF00385.14; Description='chromo' (CHRromatin Organisation MOdifier
  Pfam annotation: Domain name=zf-H2C2; Domain location=36-77; Score =7.1; E_value=0.041; Accession=PF09337.1; Description=His(2)-Cys(2) zinc finger
  Pfam module annotation: Pfam domain module=Chromo::zf-H2C2; Domain location=204-252::36-77
MHRLDYTVSTDLILHKNRIWLPNGIQFIQTLLIEFHSTPTGGHMGVKKTLARLRENFTWANMQNDVRQFVAACLDCQHTKYEAKKSAGLLYPLPVPSQLWEDLSMDFIVGLPPYRGNTTILVVVDKFSKGVHLGLLSPSYIALIVASLFMEIVGQVAYKLQLPEGSRIHPVFHCSALKPYHQPSSSSDSPIALPPHDIDNKPIIAPLVFLGTRWEQDQGKQRLKVLVQWEGLHLDDTTWEHWASLQNTYHLEDKVLLDGLGDDRPSTEIAKGSSGRPKRRTTIPTP

SEQ ID NO: 130876 - protein, 370 aa, Glycine max
  Coding DNA Sequence Number=SeqID_14098
  Gene Ontology: Mol. function=RNA-directed DNA polymerase activity; Biological process=RNA-dependent DNA replication
MNGSGSGNEPPDDGGGSNVSFHGKKLASIEYEDGNPFKPMVHIEDLVFEGLCAPWQDALVVKLLGKHIAYPFLKGKLTRMWKLRPGFDMLNIGNGYFHAQTVRSLISRKTVRRSWMVLDHNLTVQTWTPDFISPTTKIEKTMVWIHFSGLNLFYYDESVFLALAASVGKPIRAYINTKDVRAPSDLFILWVLRSFDTGMPLNSDNTRVSSSESQTFHVGSDVTTTSPIADDNVAREQGAALPIAPTPSIVACPGPVPTVCPGTQVNNGKLGGCESPLAVVACRLPDLFKKESERGHKNAGENNLPMTENIIYSCHIRSSCQVLRNTWWFPPKRYFEWGDTRSRMHRGVITPFDRHQELALGLWFGVYKGS

SEQ ID NO: 130877 - protein, 305 aa, Glycine max
  Coding DNA Sequence Number=SeqID_14099
  Gene Ontology: Mol. function=glycerophosphodiester phosphodiesterase activity; Cellular component=cytoplasm; Biological process=glycerol metabolic process
  Homolog annotation: Hit_ID=Q84WI7; Match level="QueryCoverage=99%, HitCoverage=81%, E-value=1e-101, Identity=62%"; Hit description =Expressed protein
  Pfam annotation: Domain name=GDPD; Domain location=51-303; Score =88.5; E_value=2.1e-23; Accession=PF03009.8; Description =Glycerophosphoryl diester phosphodiesterase family
MALKAVHVTDVPSLDLVPENASLALCSSRFPNGLEMCRSGLEIPKFVVIGHRGNGMNVLQSSDRRMRAIKENTIMSFNAAATFPLDFIEFDVQVTRDDCPVIFHDDLILTEENGTVFGKRITELSLSEFLSYGPQREDEKEGNVLLRKKDGKIMQWDVEQDDPLCTLQEAFVKVEPTLGFNIELKFDDHIVYEQDYLVHVLQTILKVVFDYAKDRPIIFSTFQPDAAMLIRKLQTNYPVSVFVTNGGCDIYEDVRRNSLEEAMKLCLENGLEGIVSEIKGIFRYPGAVTQIKESKLSLLSYWKIK

SEQ ID NO: 130878 - protein, 133 aa, Glycine max
  Coding DNA Sequence Number=SeqID_14100
KRGYGLRRSYMSSVGGGQQGMVGLCAICGCGKLVVHHRPTATSTTCDGVVPGDMSRGSGDLGDVRRAPGSQQIKGTKTTKQGGLWWLASCESCVIYGLWPLVIDYQGLENEVVEASGNRLPVCVIDYTEEWVT

SEQ ID NO: 130879 - protein, 84 aa, Glycine max
  Coding DNA Sequence Number=SeqID_14101
MEELINKTPLSPKNISNVITSAWRLLNRISSPHPITVILLPRTGFAIITVTHHPYSTITHHPYSTITHHPSMDPIKTAQNYGCT

SEQ ID NO: 130880 - protein, 61 aa, Glycine max
  Coding DNA Sequence Number=SeqID_14102
MMEDDDAAIEVRNHVSPEPEVEDAGVRLKKQPDLIDHLDTLGDILRGHKFQFLIITLHIYV

SEQ ID NO: 130881 - protein, 74 aa, Glycine max
  Coding DNA Sequence Number=SeqID_14103
MTLLLSNILPSDRNANLPLQKYQLVCVVPTWGSHPQDTQWTRKSPTGPWGFQLWLRASISPTGCPYPPGKVMSS

SEQ ID NO: 130882 - protein, 126 aa, Glycine max
  Coding DNA Sequence Number=SeqID_14104
IAPTRHPVDPEKSNRALGFPALVTGLYQSYRVPVPPRQGYVIIGIAPARHPVDPKKSNRVLELSSSNYGSLSVLRRRNTTAALGWPVAGNRHTATTSRVNLSSSAKRLERCLRHMADQQATKSKAK

SEQ ID NO: 130883 - protein, 138 aa, Glycine max
  Coding DNA Sequence Number=SeqID_14105
  Gene Ontology: Mol. function=nucleic acid binding; Biological process= DNA integration
  Homolog annotation: Hit_ID=Q1S9T9; Match level="QueryCoverage=85%, HitCoverage=8%, E-value=2e-17, Identity=38%"; Hit description =Peptidase S8 and S53, subtilisin, kexin, sedolisin; Integrase, catalytic region; Zinc finger, CCHC-type
MTILVKTNQVVEIQEPKQSQLEVEFLGGVTNSREVPIQNEREPTAKSKSESLTNYMLATDKEKKQAKPTQRYGFAKLIAFALNLAKDIEQHEPLTYVGAMKSSQKREWMQAMVEEIQSLESNQTWELVDRPRNNWVVA

SEQ ID NO: 130884 - protein, 118 aa, Glycine max
  Coding DNA Sequence Number=SeqID_14106
  Subcellular localization annotation: CTP_CleavageSite=26; ConfidenceScore=5.40e-01
MASVCTHLRLGMCSCTFSCAPSFGSSSSTKKRKLSNKANVGSRNKKFKNDDDDEVWKIKKVLEKSNIGTMRRLILRREMEEEFVLPVLGDDADSRDGFLQEVMYSLAIGLKILLQEGI

SEQ ID NO: 130885 - protein, 59 aa, Glycine max
  Coding DNA Sequence Number=SeqID_14107
MVGAFSQNIVTLTGLPMILLSESDLTNPWCARNVTTHSLRVVVFGSCDDLELVFGGADE

SEQ ID NO: 130886 - protein, 127 aa, Glycine max
  Coding DNA Sequence Number=SeqID_14108
MDNIRFTAPFRVQKNLLQVPFTYHRQWLHNYPKYVLFHYDGEIHFIRVRTLGTKCFFADGLNDFRRAHNLHESVILRLVAGDKNTTFTVHIDGLAHHHSNLKPIIYRRRYIFTVDITDDMLQQNLPL

SEQ ID NO: 130887 - protein, 323 aa, Glycine max
  Coding DNA Sequence Number=SeqID_14109
  Gene Ontology: Cellular component=integral to membrane; Biological process=cytochrome complex assembly
  Homolog annotation: Hit_ID=Q3KEH4; Match level="QueryCoverage=40%, HitCoverage=32%, E-value=2e-24, Identity=40%"; Hit description =Cytochrome c biogenesis protein, transmembrane region precursor
  Pfam annotation: Domain name=DsbD; Domain location=147-306; Score= -47.4; E_value=0.0021; Accession=PF02683.6; Description=Cytochrome C biogenesis protein transmembrane region
  Pfam annotation: Domain name=HATPase_c; Domain location=3-112; Score =103.7; E_value=5.6e-28; Accession=PF02518.16; Description=Histidine kinase-, DNA gyrase B-, and HSP90-like ATPase
  Pfam module annotation: Pfam domain module=DsbD::HATPase_c; Domain location=147-306::3-112
MTLQPQALRRIMSNLIDNGLKYAEKVEISLSYPPNGDVIIHVVDDGPGIPEGELTAVLQPFYRLEQSRNRDTGGTGLGLAIAAQLAGQMQGSLTLHNLQQGGLEARINPYTKPPFHGHIRHTVACCNADVATSATLRRRMIMAVVIAFLAGMLTLLSPCTLPVIPLVFASVSGRKGQLILLLFGMGLMFTAVSLLATAAGGWLVNLTIVGRWLALGFLVVVAISLLSTRVAGWLGSPAVALGNQLNQQSYRYGSGLASVFAGLAIGLLWAPCAGPRMRADVAAIGVVRRAADFPFARWSGDKWAVTPTGWRGNVGRSGINRQR

SEQ ID NO: 130888 - protein, 98 aa, Glycine max
  Coding DNA Sequence Number=SeqID_14110
KEVEQAIDVDQQQQQQHGNKAKGLLCLKHPDDETSPDSNNSNNGSRKKLKLTKDQSASSEDIFKLHSTLNPVFIFLYPSFLTILLQIWMLIVNFMEIN

SEQ ID NO: 130889 - protein, 295 aa, Glycine max
  Coding DNA Sequence Number=SeqID_14111
GSIDVAIVKEFYTNLYVLEDKSPKQVRVQGHLIKFDANSLNTFLETPMVVEKGESLPSYSRFARLRPDPQELATQLCIPRRGFVLDAEVLLWKLLRKDLTTLAQTWSVLSYSNLAPTSHTSYLNLDRAKLVYGLVMKMNMNLGSLISSQISFIAQSNSSRLRFPALITALCKARGVTSDSLTFETLSPSINLAYIKKNCWNLDEPSVTFPGTQKSRTRRFEAPSLSAASVPPTPAPFTFALPSTPAAPVLPEPTSELAPDHAEFAECGLVAASYKRGGVCSEGGLAGVQPSPLGG

SEQ ID NO: 130890 - protein, 96 aa, Glycine max
  Coding DNA Sequence Number=SeqID_14112
MVEIIGSLKEEWRREVEEDNRRSLEIMKNDLKEVIKIKLSQMASPNSPPVEAPDPQVLVVEEGTRLVALGKVFDNATSIHNVPYADDVLRVNVITI

SEQ ID NO: 130891 - protein, 65 aa, Glycine max
  Coding DNA Sequence Number=SeqID_14113
  Homolog annotation: Hit_ID=Q9SUI2; Match level="QueryCoverage=59%, HitCoverage=5%, E-value=6e-08, Identity=69%"; Hit description =Phosphatidylinositol-4-phosphate 5-kinase 7 (EC 2.7.1.68) (AtPIP5K7) ...
  Homolog annotation: Hit description=(1-phosphatidylinositol-4 -phosphate kinase 7) (PtdIns(4)P-5-kinase 7)
MGGSIIYQHFVTCFALRDAQKQGEQLIIPNGLLLVAHEPSFVNTALGPHIRGNTLRAYSIGKFPN

SEQ ID NO: 130892 - protein, 113 aa, Glycine max
  Coding DNA Sequence Number=SeqID_14114
  Homolog annotation: Hit_ID=Q8ZPB1; Match level="QueryCoverage=100%, HitCoverage=25%, E-value=5e-39, Identity=74%"; Hit description =Putative cytoplasmic protein
MDNFLTRDAIRTLFSQAMSAMYQQEVPQYGTLTQLVTAVNERTLEAQPALKNRLAAADELSRLGVERHGAIRVGTAAELSTLRQMFAVMGMEPVGYYDLSQAGVPVHSTAFRP

SEQ ID NO: 130893 - protein, 156 aa, Glycine max
  Coding DNA Sequence Number=SeqID_14115
  Gene Ontology: Mol. function=transporter activity; Cellular component= integral to membrane; Biological process=transport
  Homolog annotation: Hit_ID=Q2XIZ3; Match level="QueryCoverage=80%, HitCoverage=27%, E-value=2e-33, Identity=53%"; Hit description=4 -hydroxybenzoate transporter PcaK
MSVTEAAIVTAMYQPGGTVGSLFAGWLMDRINANLALAIIYFCGGIAIVALGFSPAQVGLMSAIAFCSGFCFNGANTGMNALSASYYPTHARATGSSWMHGVGRIGAIISAFVGAELLSLGWSFSQIFLLLALPAALTTLMLVLKCLFGDQPRATE

SEQ ID NO: 130894 - protein, 550 aa, Glycine max
  Coding DNA Sequence Number=SeqID_14116
  Homolog annotation: Hit_ID=Q393D8; Match level="QueryCoverage=89%, HitCoverage=92%, E-value=1e-129, Identity=50%"; Hit description =Membrane protein
  Pfam annotation: Domain name=OPT; Domain location=42-546; Score=15.8; E_value=2e-10; Accession=PF03169.6; Description=OPT oligopeptide transporter protein
  Subcellular localization annotation: CTP_CleavageSite=31; ConfidenceScore=5.12e-01
MTPAVPNNGTVAANYRRALFPACGRKYSGIPSMKSNNPLKEVGTLLVMALLSVVGAIIGVQLITTLGVTPNTSIIGALIAMLLARIPLQMFQRYRSVHTQNLAQTVISSATFGAANCLLMPIAVPYVMGQPQLILPMFCGVAAAMLLDAYLLYRLFDTKVFPAANAWPPGVAAAEAIKAGDRGGKQAWLLVVGVGVGIAGSMLKIPMAAFGTAFIGNIWALSMFGVGLLLRAYAEPVAGFDINAHFIPHGVMVGAGLVALIQVAQVIRSRRADSAGYTQPDSAVSKALGLGAVGYIAIAAFLALVGGLFSEMSLPMLALFVIYAAFAAFVHELIVGIAAMHSGWFPAFAVALITLIVGILIGFPPLALCILTGFTAATGPAFADMGFDLKAGFILRGYGEDLRQELLGRRIQLFAALIAFLIAIPVVYLSYHSYFLQDLIPPVARVYAKTIEAGAQPGIAWSLLIWAIPGAVVQLIGGPKRQLGVLLATGLLINNALAGWAVLVGIALRVAILRRWGDRGRTPMEIMAAGFIAGDALYNFFSSIFSSKGK

SEQ ID NO: 130895 - protein, 146 aa, Glycine max
  Coding DNA Sequence Number=SeqID_14117
  Gene Ontology: Mol. function=DNA binding; Biological process =regulation of transcription, DNA-dependent
  Homolog annotation: Hit_ID=Q89Q85; Match level="QueryCoverage=94%, HitCoverage=53%, E-value=1e-15, Identity=35%"; Hit description =Transcriptional regulatory protein
  Pfam annotation: Domain name=IclR; Domain location=12-136; Score =44.1; E_value=4.8e-10; Accession=PF01614.9; Description=Bacterial transcriptional regulator
MVMRMFPGRHFLQVVTPAGYRSPAAETSVGRAILARESDEQVRARYAGGYRAASPNAPQTLDALLQKLQQVRRQGWSLARNETLNGISSLATALVNKHGSETVGLCLSFPSQGEEQPFVPEVLAELTAVSRQLAEKYGDDYWQQIN

SEQ ID NO: 130896 - protein, 346 aa, Glycine max
  Coding DNA Sequence Number=SeqID_14118
  Gene Ontology: Mol. function=type I protein secretor activity; Cellular component=1-2nm peptidoglycan-based cell wall; Biological process=protein transport
  Homolog annotation: Hit_ID=Q54417; Match level="QueryCoverage=100%, HitCoverage=78%, E-value=1e-158, Identity=88%"; Hit description =Metalloprotease transporter
  Pfam annotation: Domain name=HlyD; Domain location=62-346; Score =204.8; E_value=2e-58; Accession=PF00529.10; Description=HlyD family secretion protein
MSNQSVIPGDIDALSRQFDEGRHLRLGGWLVLLGFGGFLLWGLLAPLDKGVPVSGSVVVAGNRKAVQHPSGGVVSQIQVHEGDRVSAGQVLLLMDTVDSRTQRDALRSQQLNNAAQRARLQAERDGLQAIAFPALLQARREEPEVMSLMLLQQQLFTSRRAALQSELAAIAESIAGSQAMLEGIRQSYASKQRQKAMLQEQLSGMRKLAAQGYVARNRLLDLEGQYAQIDGQASEDTGNIGRLGRQILELKLRAIQRREEYQKEVSSQLAEVRMKLDELDNRLAKAEADLGHTQVKAPVAGTVVGLSVFTEGGVIGAGQQLMEIVPSDRGLQVEARIPVELIDKVQ

SEQ ID NO: 130897 - protein, 114 aa, Glycine max
  Coding DNA Sequence Number=SeqID_14119
MWLSMIRPHLPTAVQAKSCPGVHINWAMASSSKPSAWDPPAPYPRAHVVDSFFGGLDVGIEFHDYILVELSHGGHEWCPMPVSYLLLEHSGIGVRQTLGRCWGLLQWHPFWTSL

SEQ ID NO: 130898 - protein, 110 aa, Glycine max
  Coding DNA Sequence Number=SeqID_14120
MALGLGCGPKHLGKPHCPRSLAIHPQKCAHQVLDLVCAYMVAIFECVDGLRELGRWLQRSFLQRGPERMPLKKAPAPPQSLTDTNSGVLSTNSASRPSGDSHSSERGESS

SEQ ID NO: 130899 - protein, 34 aa, Glycine max
  Coding DNA Sequence Number=SeqID_14121
MAYFPDVCFIIERIINLCRAIMRMHNMVAYEAAQ

SEQ ID NO: 130900 - protein, 59 aa, Glycine max
  Coding DNA Sequence Number=SeqID_14122
MQHVTSQQAANHKGQHQQSQDPSPFPWPTPEQFGATVAWPGDEPDLQTGAGVLGDEVEA

SEQ ID NO: 130901 - protein, 167 aa, Glycine max
  Coding DNA Sequence Number=SeqID_14123
SEGEVKHRRKKRMARDSVLTRVATGAAVGGAIGGAVSVNFGTGVLHAGAVYGTYDAIRYKAPSNSPLTSSFNPFRKYPKIFRTCTIQGALVELTLLLLSFLERSCEAHCHRENVKLSKLFEKRPCSSSLPNNMILSTDFPLGIDVQGVCIPMIGGLVNAVNNSALLG

SEQ ID NO: 130902 - protein, 50 aa, Glycine max
  Coding DNA Sequence Number=SeqID_14124
MKGGGCAAACPGELTNHRNAIVRKYSRSGKVHHNEMTKIESDNIEFRSIT

SEQ ID NO: 130903 - protein, 55 aa, Glycine max
  Coding DNA Sequence Number=SeqID_14125
MNKNEKEMSEKSVAYNKDWKRKLVHCLKEDFLVLEVNHPRSTIGFEATIASPNFE

SEQ ID NO: 130904 - protein, 80 aa, Glycine max
  Coding DNA Sequence Number=SeqID_14126
MVGIATDQRIMACEMDVNFLKRLARISRMVDSGSRSQFNLAWYYLLLHLKFNHVNILPASPIISSLMLIGVQNTNKNDFG

SEQ ID NO: 130905 - protein, 79 aa, Glycine max
  Coding DNA Sequence Number=SeqID_14127
MNIDYYKQGIDELIGEFIETIENIKNIQKDKELIVDVVEKVANDWHVQKQTGLGDDGYEKEFEQLLLEQQPHDRDSNQV

SEQ ID NO: 130906 - protein, 761 aa, Glycine max
  Coding DNA Sequence Number=SeqID_14128
  Gene Ontology: Mol. function=transferase activity, transferring glycosyl groups; Cellular component=cytoplasm; Biological process =carbohydrate metabolic process
  Homolog annotation: Hit_ID=Q575Z7; Match level="QueryCoverage=96%, HitCoverage=98%, E-value=0.0, Identity=64%"; Hit description =Alkaline alpha galactosidase 2
  Pfam annotation: Domain name=Raffinose_syn; Domain location=7-726; Score=1410.6; E_value=0; Accession=PF05691.3; Description=Raffinose synthase or seed imbibition protein Sip1
MTIKPVVRVSEGKLVVKERTILTGMPENVVETSTVEGMFLGVDFEKEDSRQVVSLGTLKDVRFMACFRFKLWWMAQKMGDRGRDIPLETQFLLVETKDGSHLESDNDKNQNQIVYTVFLPLVEGSFRACLQGDSNDQLQLCLESGDVDIKTSSFTHALFISAGTDPFATIHHAFRSVRNHLKTFRLRHEKKLPGIVDCFGWCTWDAFYQEVTQEGVEAGIQSLAGGGTPPKFVIIDDGWQSVGGDDKNSNSLQRLTGIKENAKFQKKEEPELGIKNIVEIAKKKHSVKNVYVWHAITGYWGGVRPGVKEMEEYGSVMKYPNVSSGVTENEPTWKVDPLAVQGLGLVNPKKVFTFYDQLHSYLASAGVDGVKVDVQCILETLGAGLGGRVELTRNYHQALDASISRNFPDNGCIACMSHNTDALYCSKQTAVVRASDDFYPRDPVSHTIHVASVAYNSVFLGEIMLPDWDMFHSLHPAAEYHASARAISGGPIYVSDAPGKHNFDLLKKLVLPDGSILRARLPGRPTKDCLFTDPARDGVSLLKIWNMNKLGGVLGVYNCQGAAWSATERKNAFHSTDYSGGDAITGYVRACDVHLIAEAADDAHDWNGDCALYSHHSGQLIVLPHNVALPVSLKVLEHEVYAVAPIKKVLGGGYSFAPLGLVNMFNAGAAVEGLVFEEDGLVRLEIKGCGKFGAYSSARPTKCLLGNHELLDFDYDADSGLLTFNIDHLPQEGHWDRIDKERVFNNFHFVRFHELPVMEFR

SEQ ID NO: 130907 - protein, 850 aa, Glycine max
  Coding DNA Sequence Number=SeqID_14129
  Homolog annotation: Hit_ID=UPI0000E49153; Match level="QueryCoverage =32%, HitCoverage=39%, E-value=1e-10, Identity=22%"; Hit description =PREDICTED: similar to telomeric protein RIF1, partial
MSEEIQEIHSLIYSDDKFNKSSGYSALFQFQQHSCANPFSLQSLAHSSQSIISSIVSDISNDHDEEISTQALKCLGFMLYHPSVVSILRGVWCLSVQQLGASFLDTHFPSLLRAIVHALDNPMGSLSTTFEATQAVMKLSGQLSEQMKGSSHIWAPPIYRRLISTDKRGRDASERCLLKIRSTVIPPSLDLSKVIVKDMKIKLLNGMKDLLDNGMKIQAIHAWGWFVRMLGSYASRNRHLVNDMLKIPERTFTDLDPQIQIATQVAWEGLIDALVHCPTFVSEKSKSAEENSLEKQHSLGRKKCDDQANGFLKSIKLIMTPLIGIMSSKCDISVHSSCLNTWCYLLHKLDISINEPSVIKMVLEPILKAIFQNGPNSNSICLWNLGLDLLSDSISQKCMDVFYQSTGPGVKLDVESPSTDYDGIMQCLNSLLKFIKKVCEDLCSDVDENYDVYCTSIQFIDATTKELGPSILGSPLYKFSLDLKYIEDMQSVDHKKHLKFLGVGCISYMDKVSPLIYLIALYFHMMVQLTKKSHQSDHISQGMCEYFKFIFCSSDLLENLLTSIDLLYRHVRPIYLSIWISLAQSLNYCVSDANCKSLQEALSDSTVYSSICHLLIYPIVAHSEVPRMTLSNNSASLDKYPVSQERKRGFELVIQTWKSLYGSLSALGFGCSSATNFSGDLCMLLSNCLDENGGMVESGTDLESACKDVDHGILHLSGNFLICILEQIQTLELVSELDRSKFDCDSKILCCIKNCLKFVAKYMNLLRIKMVRDPLPGFVGTSRLYSALACSISCLHWKQDILHFLEPVIFHVLDCRMFPAHCFNGYQIWECRMKEQTTNFNFCGQKFLAA

SEQ ID NO: 130908 - protein, 141 aa, Glycine max
  Coding DNA Sequence Number=SeqID_14130
MGKVEEVQEQMKSDMEAMKEKMATMMEAMMSMKKIMEANAVAVAATSAIAKYEWPHDVQIQNKHAFPPYGSPPKEDVNNSSPILIESQQPQSDHAHVSQPMGETHEMPHHNLADFEPYLGYATEGKGSGPLKEAEIMPLLT

SEQ ID NO: 130909 - protein, 153 aa, Glycine max
  Coding DNA Sequence Number=SeqID_14131
LFLRPYQVTWDATVFGVFNPYFPLYIKHEDLSEIAYGGQCLSISVLQLWILHLTETSMRAGSSDIYGFLEPQSIQRFGQSQFETESYIKSWMQSSKRDVYLGAYLNGPNNYLKGIINSLNQRLQLGGLSSSVIDKKEVLSAAIMSCTRCPPSF

SEQ ID NO: 130910 - protein, 87 aa, Glycine max
  Coding DNA Sequence Number=SeqID_14132
HQNVALDNKTGDSTMLKMGDLAKVVIKQDMKGIRHKYGFNNNEREKAQKKRVVDDETVDKHQLDEHQERLRKKFALEEGRIFAANEQ

SEQ ID NO: 130911 - protein, 77 aa, Glycine max
  Coding DNA Sequence Number=SeqID_14133
  Subcellular localization annotation: CTP_CleavageSite=43; ConfidenceScore=5.03e-01
MFAYSTLTGMWVQAIGLFAQATCAPEFGLPRPFNQRLLVLHVGGVAESSTTRDPWSLNPFLEIRRREEEASRKRGRL

SEQ ID NO: 130912 - protein, 83 aa, Glycine max
  Coding DNA Sequence Number=SeqID_14134
MAKVYALWNTKNCFEVYRVIQNKLHWINKGKQWVIANGRQVIFWKGYMETEELVKGNDISVTYAKAYAHGNFTSLMPVERPNK

SEQ ID NO: 130913 - protein, 45 aa, Glycine max
  Coding DNA Sequence Number=SeqID_14135
MAGYMLAIAVGMDRGTRFHFQLLKVYKGVQSCGTKDWYAWSLKVD

SEQ ID NO: 130914 - protein, 196 aa, Glycine max
  Coding DNA Sequence Number=SeqID_14136
MASCGWNSACRGDGGHGDGGIPCTIVTSTAGDLSSFTDCQEFGHGYAISRSNSDKILEDDSRLSILWGDGKYGRSSRENSGGPFDDALAYSSHPHSDFGNAWDQHHLKDQHNKMDGVNGFRIDPRSDRENSLDDWKPLKWTRFGSLSSRGSNSREVKAKLLPKSVAANESHSGEAAVCETSSVPFEDTTSRKKPRL

SEQ ID NO: 130915 - protein, 214 aa, Glycine max
  Coding DNA Sequence Number=SeqID_14137
MWLRVLNNLRFWDSWFHDSKCISSHTGSEVQEAADCLGADCVPRYVEMKHMELAYRDINHIGHNLVKGSTWKLAYMEAHGTPSNFRQRFPPSSARLDHKKLRFTVFTSMVDALTSSTTVALRGCFLTAPPQATSATSSTKKKKRHKEDAQAMKKKTQEEEAGRRRSRKKKKQEGDPKEEEAEAQTQGRERGAPSSTHKETQATKDPKTRTKTSK

SEQ ID NO: 130916 - protein, 171 aa, Glycine max
  Coding DNA Sequence Number=SeqID_14138
  Subcellular localization annotation: CTP_CleavageSite=48; ConfidenceScore=5.77e-01
MATPPNSPPPPSESATPSSLSTSKKTSKTTRLRLLATRPVGVGRPMVNVDLVTRNVDGPHRKKLSTYLGIVAHDKLMKEKQKKHLEEATQFGSTETVVDPPSPIRRHVKQKMARTKKTGQMTFQAAKEIADKIIYHFPLLVGSFVAHGRQDVLTAAIGRPEHLDRVRAVGA

SEQ ID NO: 130917 - protein, 276 aa, Glycine max
  Coding DNA Sequence Number=SeqID_14139
MCNTCRTWALLGEAGSCVACASCPTYVNCPQTCRAVGRGAWNATLPPGHAVRSTSCVLRIEAFDKAFDEGVKAVYGPRWESNVRLSLEAIQMLIWIYGPIISLEVERFPPHRYVNLHKTVDEGMPTSSPPYWTVHPSADCCQPLAFVALPHAIAPSPQCSFGVAEKYVSVMAAGGRLEPSKGAHDTSGGTWPNWALGLHTSALRWAFVKRAGGETCKIKDSDTQVHRRVAHVLKCVLDVLRVQWNLVFIGLKLSCGFLFVGAIIAFVDNSQLLDNS

SEQ ID NO: 130918 - protein, 199 aa, Glycine max
  Coding DNA Sequence Number=SeqID_14140
  Homolog annotation: Hit_ID=Q1T192; Match level="QueryCoverage=36%, HitCoverage=13%, E-value=6e-12, Identity=46%"; Hit description =Polynucleotidyl transferase, Ribonuclease H fold
MEPAKPYPTATEGTQVMSIDKRSPYQALTVFQPSLDDEFDIDLQDDTSDRDPKPIVNLQLRPKPVCSSVGTSLIMSIGTSPMCYTKLWICLLGSYLTCKESILGACPKDAYPLPSINMLVDGASGFQVLRKPELAGRKYKPRGPMKAQFMADILAEFSGNDTTTPDWWNLYVDSASNVKGSRAGIILEGPNNITLEQSP

SEQ ID NO: 130919 - protein, 312 aa, Glycine max
  Coding DNA Sequence Number=SeqID_14141
KVEIYHTEFDDFKTELERRNLHKRLINLADGTIDLALVKEFYANLYSSEDPSPKQARVRGHLVKIDGDSLITFLETLVVLEEGKTLPIYSRPSREDSQEGSDYLGLGVECSLLHQLGPYISYIRPYCGQSQVDLWPGVVFDNLTFERLSPAINLAYIRKNCWNINDLTVAFWGARRAMVRPPDMPSSSTAPAPTLASTSAAPLVPAHVDSQRFEAMLQSGSSSRIHPISGDASFETTIPEPFTLHPEAGEEQARPETVATPKRSLEGTSEPPTPVEGLSSPQPTVDPSIPVLDIPEDQTTPVLALNTSPLAT

SEQ ID NO: 130920 - protein, 116 aa, Glycine max
  Coding DNA Sequence Number=SeqID_14142
  Gene Ontology: Mol. function=RNA-directed DNA polymerase activity; Cellular component=intracellular; Biological process=RNA-dependent DNA replication
MGEERRKVVKEEVGKFLHANLIREVKFSTWLANVVMVKKANDKWQICTNYTDLKRACPKDVYPIPNIHSFLDAYFGYNQIRMHPPDEEKRAFITEEANFCYKVMPFDLKNAGATYQ

SEQ ID NO: 130921 - protein, 183 aa, Glycine max
  Coding DNA Sequence Number=SeqID_14143
CLFEVLGVILPLTVFQCALLEHLNVAHSQLHPNMSKKLFDFSSNVFLHFKDHFFKVLATDVMADGMPLMFNRDGDPCFPFYWQCDPTMFKSYDEDLLTLVGGDPLATLASKCLILSMLVIGGGSSVKQVGPAAKVAPSAPSFVLAKRKKNDATGSLGRKESKASISLRALRQAARLMPIAGHL

SEQ ID NO: 130922 - protein, 229 aa, Glycine max
  Coding DNA Sequence Number=SeqID_14144
MACKMEGITTETDELAKVVVDLEARLKDSESRLEESKLRAARERDKSKELEEELLFYKKKVMEEHENGFNKAIRQAEFFGKDLDLGLFDLFKDVKGCVLLDEEEIVAEEEVVDDEQGAEEKQDLIDVKVLSPIWWGFLLLCGASQLMLVRSMFDLPLVLSNGKVVVRVVQLGPLMVVIVVAASEQTKGKGLAKGELGVCRALDLGCVCPGFCQARGATSRLTKDESWIL

SEQ ID NO: 130923 - protein, 230 aa, Glycine max
  Coding DNA Sequence Number=SeqID_14145
  Subcellular localization annotation: CTP_CleavageSite=51; ConfidenceScore=5.35e-01
MDWEVISIGSSSSKDTHCGASNNESSYSEMVRASRKTGSCSGDVRVSPHVRRSNSVGSLSSTLAITGYEWGRDEVLKYKSSLTSTRSVATLQCQVKLASPEDSCKCQFKDLGLILPLTAFQCALLGHFNVASSQLHPNSWSMVKAFEILCPFFNIRPCVSVLLFFFQMKLTGKICWVSLNNVSKKLSEFDSNIFFYSNVLATNIVADGLPLLFNREGEPHFLFYWQSDPT

SEQ ID NO: 130924 - protein, 199 aa, Glycine max
  Coding DNA Sequence Number=SeqID_14146
  Gene Ontology: Mol. function=ATPase activity, coupled to transmembrane movement of substances; Cellular component=integral to membrane; Biological process=transport
  Homolog annotation: Hit_ID=Q4UVH3; Match level="QueryCoverage=84%, HitCoverage=30%, E-value=6e-53, Identity=61%"; Hit description=ABC transporter ATP-binding protein
  Pfam annotation: Domain name=ABC_tran; Domain location=88-194; Score=- 31.1; E_value=9.7e-05; Accession=PF00005.17; Description=ABC transporter
MAAGLVFLTVSLIQLWAGMGLAWQSLQSGRIAADRLQAIVEQATTVEDPAAPQPVPQAARVHWDDVHFQWPGAVRPVLSGLRQTLAPGERIAIRGDSGSGKTTLSSLQLRLWDPQQGRITYGGIDLRDFSQADWHRQLAWLPQNAPVFAGTVDENLRLGDPDASDAALPRRGYRTCAAAGPFRVAGRAQPVDDHPRRPA

SEQ ID NO: 130925 - protein, 121 aa, Glycine max
  Coding DNA Sequence Number=SeqID_14147
MEANNEFIIVMHADRDYIVLPHQCFRQWRHELGPLIFINGIKGGVFTCLLDNQGDRARLTHGINDNRLFYDAVESVVMHLTYMGNNCFIFILTIHVDENEKNDGNQMMHARLSKSRVYVDL

SEQ ID NO: 130926 - protein, 52 aa, Glycine max
  Coding DNA Sequence Number=SeqID_14148
DQWVPMNPKRIKVIPEWPTPPSVRKIWGFHDLTNFYKKVLRKKAQIFKNLGI

SEQ ID NO: 130927 - protein, 88 aa, Glycine max
  Coding DNA Sequence Number=SeqID_14149
  Subcellular localization annotation: CTP_CleavageSite=63; ConfidenceScore=5.25e-01
MQVGSATFIIRVIKHSGIGSADSKILQVASRFQDVKTSLVTSAFCSLCLHALLSATSLFQDVKASLVTSAFCSPCLHALAAASSISYS

SEQ ID NO: 130928 - protein, 174 aa, Glycine max
  Coding DNA Sequence Number=SeqID_14150
GVRDMRSWVRGQWIPFDADALSQFLGDPLVLEEGQECEYSQRRNRADGFDEEAIAQLLCIPGQDFARTAAGRRVRIMRTSMTTLTQMHPLDLDKSNKALGFPALITGLCQSFRVPVTPSKVIRPPITRAFIEKYCTPRQAQGDAPQPADALPPPHQADPAGSFGMEQYLQHPGL

SEQ ID NO: 130929 - protein, 151 aa, Glycine max
  Coding DNA Sequence Number=SeqID_14151
MRGAPTEESLSPFLVRDFGAQSFKVIQRVHKAWEGPLRKDKEVKGIRNSIIGGYHEWLKVRTRGLDWLSKLKIIKEESFEAPEEDEEVQALKTELGKARLAKEKFRLVATYVRKKCVGLQEENAATARALEQETKRARKEEHGRDKFRGAL

SEQ ID NO: 130930 - protein, 44 aa, Glycine max
  Coding DNA Sequence Number=SeqID_14152
MVERGNFDHIEERMRVIEGGGDYPFADMVELCLVPNVIILPKFK

SEQ ID NO: 130931 - protein, 390 aa, Glycine max
  Coding DNA Sequence Number=SeqID_14153
  Homolog annotation: Hit_ID=O23305; Match level="QueryCoverage=72%, HitCoverage=64%, E-value=1e-19, Identity=30%"; Hit description=FHA domain-containing protein At4g14490
  Pfam annotation: Domain name=FHA; Domain location=11-78; Score=52.6; E_value=1.4e-12; Accession=PF00498.16; Description=FHA domain
ETLEFKPGAAVRIGRVVKGNTLPIKDLGISSKHLTISTESNKWTLRDLDSSNGTVLDGSQIPPHTPFTLQHDSIIKIGELTSIHVIFVPREQQQQQQELAVLPRRNPTRRGRTEPAPTESVPPRGRGRPRDLKSKVQIQIQSVEENDASVVDAESERVGPSSRVARKTNRGRSVVKEDWSVVVENLDAPEGKTQSVEEKNASVVEAEGEGVSPPARVTRKVNRGRSVVRVCDDDDVPVEKVEEQKSTRNLSLIEISDSSVGNSDAPLVEEPKKTRMTRNSKKVPGVTTGNVEKKTKRGVAEKRELEEEGEDLNGVKETCDGRKEGNLPNLKRRRRGATEKRELEKEGEDGNVVKEACDGREEGNLNGDDRNWHDLKGRERELEKEGVDGN

SEQ ID NO: 130932 - protein, 70 aa, Glycine max
  Coding DNA Sequence Number=SeqID_14154
MTGEELVDTRPSPRPKVSKDLGASTSRYWAHDRQVIVLRPAQDVKEALPGGSLVPFKFLLVSYSPMFLKS

SEQ ID NO: 130933 - protein, 85 aa, Glycine max
  Coding DNA Sequence Number=SeqID_14155
  Gene Ontology: Mol. function=nucleic acid binding
  Homolog annotation: Hit_ID=Q1SIY6; Match level="QueryCoverage=53%, HitCoverage=4%, E-value=1e-10, Identity=67%"; Hit description =Integrase, catalytic region; Zinc finger, CCHC-type
MESYLEGLDLWEAAEEDYIVHLLPENPIIAQIKNHKERKTKKANVRVHPERFTKERLGRTKQSKSKVGLKMLESVEDAREEWVFV

SEQ ID NO: 130934 - protein, 176 aa, Glycine max
  Coding DNA Sequence Number=SeqID_14156
  Gene Ontology: Mol. function=phospholipid binding; Cellular component= coated pit; Biological process=endocytosis
  Homolog annotation: Hit_ID=Q8LF20; Match level="QueryCoverage=74%, HitCoverage=19%, E-value=5e-44, Identity=71%"; Hit description =Putative clathrin assembly protein At2g25430
MKLFKHILNIYETNTSNLSRQKADLAGEFDPLLLNGMYDQGAVRQHVSTTQLSGGSASSVALPGLGKSANPVLALPAPNGTVQAVGPQDPFAASLMVPPPSYVQIADMERKQHLLVQEQQLWQQYGRDGMQGQLGLSRVAGAPGYYAPAPQPVMPYGMPQFGGIGQPGGYYPAPYY

SEQ ID NO: 130935 - protein, 84 aa, Glycine max
  Coding DNA Sequence Number=SeqID_14157
MNDMMSMDASYSITETTKDKDNKSEAQIKHQGFHQVQCTNLDQTMLNESDNLAQDDTIDEGWQEVVPKGRSLTAHKSASSTSPT

SEQ ID NO: 130936 - protein, 92 aa, Glycine max
  Coding DNA Sequence Number=SeqID_14158
  Gene Ontology: Mol. function=hydrolase activity; Biological process =aromatic compound metabolic process
  Homolog annotation: Hit_ID=Q1S6D2; Match level="QueryCoverage=98%, HitCoverage=27%, E-value=9e-33, Identity=82%"; Hit description =Alpha/beta hydrolase fold
MKRLTCTGYLIWQAVDLDLLYFKLQEKLTSKVLSVKYQQDLQPRDKYLPQSVAEQFQKGNPAQIQLKLIEGAGHMPQEDWPEKVVDAFRMFF

SEQ ID NO: 130937 - protein, 78 aa, Glycine max
  Coding DNA Sequence Number=SeqID_14159
MWDRHRLKGALKPGVFIPKVYTPKSLSGPLLPDSMDPIIIFIAHLPVRVSLFYENASTMWDRHMLQRALKSGVSTPKV

SEQ ID NO: 130938 - protein, 106 aa, Glycine max
  Coding DNA Sequence Number=SeqID_14160
MNNACQTLIRGLATHGRLYNERGERKTIKREKRDIITRTYGSNLWTYIYRTKQDIAILGKPMMCQAFKRAFTNFLQWKMMLEQLAIVCMGILNLTENGLQRKDNRL

SEQ ID NO: 130939 - protein, 558 aa, Glycine max
  Coding DNA Sequence Number=SeqID_14161
  Gene Ontology: Mol. function=RNA-directed DNA polymerase activity; Cellular component=chromatin; Biological process=chromatin assembly or disassembly
  Pfam annotation: Domain name=Ras; Domain location=461-555; Score= -95.4; E_value=0.04; Accession=PF00071.12; Description=Ras family
MATCGCSMILREQGGDYQKSPSDECILDDCQAGGEVLPKRLRMAQTGSWTRMGLAQVVGNNGEAVAKKVLAPFIYLRRDRKQSSYIHQGTKELRDEGFAEKGKGGLFKLFESYLSLSRPPEWLNGGDLDQGSYCGRIASNEPAIESMSLKGAAIYEDVIEEDDDEVTEVNVVDGVPGQRGGSLVAEEVFEYENTAMWKYKASFCVGHYPPSLVMVPFPDKVSPIEDELLFNEIMGAPTVGQKNQMVPDVNWVARYMSGFPGGITHAHSVRLSCLVSGASMLVVAVEETKIRVSIMVWCEVELEGVAKCVIAASIDGPKSKASEPALPDGSPTLFVLGWGKAGLQGLEENRSGGKLIIACHPLKPSKGPTLHVERGNGETVLLRSAMGWCCRRRRKQQRNTMKELINLQSHGMHGFAEDNESITDRPSYVKLASRARTSRISRKKKKDKDKHQARLLYDSRKIALPHFPSNIVVEDYVPTVFDNFNANVVIDGSTVNLGLWDTAGKYFLKMFPSMSLKHDPNPSGELLLMQKLEEVGSSIKRIQSLFEEQQSNITESID

SEQ ID NO: 130940 - protein, 80 aa, Glycine max
  Coding DNA Sequence Number=SeqID_14162
MTKASYSKIKRGQSREGRQGSSDQGVHRRDEGVSQTPYATVSFFLLFSLVIHCRSICVSANMTLAPGIIMRCYSTYLFSV

SEQ ID NO: 130941 - protein, 115 aa, Glycine max
  Coding DNA Sequence Number=SeqID_14163
  Gene Ontology: Mol. function=RNA-directed DNA polymerase activity; Biological process=RNA-dependent DNA replication
MHVADIPKTTFRTHHGHYEFKVMSFGGVPWASCLSEGSGTSSFEGGRHSSMASPSFDQSSVELLGPHWILSQGRNGRGPISTGTPPFLFPQTLHPEAPSCLDVCMRTVCDHDEGK

SEQ ID NO: 130942 - protein, 221 aa, Glycine max
  Coding DNA Sequence Number=SeqID_14164
MAAAVNQTKAERNVIKSWPSKEKRKELKSLLLHPSVWESESLPEEVCFLLANVPAEIFELEKSEKARMKHMEHEKKLKEDEQKQLSMKRLKQSQKMEENGKFHIEAFAVGAAQSEEGMKGLNNALEHEDNGKGLKQHFELEMNDKITKVTFEKGENEACERDQGKEKLSEICGGYRKGNRLKDVGDGMGGSSCVYMMCGWSLQPMSEDAERSSSCMPNRPC

SEQ ID NO: 130943 - protein, 1478 aa, Glycine max
  Coding DNA Sequence Number=SeqID_14165
  Gene Ontology: Mol. function=RNA-directed DNA polymerase activity; Cellular component=chromatin; Biological process=chromatin assembly or disassembly
  Pfam annotation: Domain name=Chromo; Domain location=1373-1421; Score= 19.5; E_value=0.0048; Accession=PF00385.14; Description='chromo' (CHRromatin Organisation MOdifier
  Pfam annotation: Domain name=RVP_2; Domain location=360-468; Score= -37.3; E_value=0.0008; Accession=PF08284.2; Description=Retroviral aspartyl protease
  Pfam annotation: Domain name=rve; Domain location=1070-1226; Score =96.8; E_value=6.3e-26; Accession=PF00665.16; Description=Integrase core domain
  Pfam annotation: Domain name=zf-H2C2; Domain location=1011-1052; Score=11.8; E_value=0.0097; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1373-1421::360 -468::594-757::103-193::1070-1226::1011-1052
MADHTTRKTTTDKLEEAITRLSTCQSTLTDKYVELSDKVDTILDHLRLKETTQNPPPPNSQFNQRNPVKLDIPRYDGRDPLGWIFKISQLFKYQNTPEEERITVASFYLDGVALSWYQWMFRNGFIMSWSGFLQALESRFAPTFYDDPKGALFKLTQRGNVNEYLTEFERLANQVIGLPPPFLLSCFISGLMPEIRWEVLALQPISLPQAIALAKLQEDKLRDRSVATHPNLPPSSSTSRSNSLAQSSSFPPSSSHQRSKPPFVQSTPEEMAFRREKGLCYNCDDKWNPGHRCKGGILLLITDNPVTEEETHEASLDSMTTSEEVLLDQSQLISDDPHPHISLHALSGLPSSDTFRLSGIIKHARITVLIDSGSTHNFLQPRIAQFLHLPTQKTSPLQVHVGNGSVLDCNQVCPNTQLSIQGNSFDVTFHLLLISGADAVLGIAWLKQLGPIITDYTSFVMRFNHLGQAVELHADIAIGPEAASTTQVKRLIRTGSTSALLHLRILPTHQTKPPTTHLLHPISAINTLLSRYQKLFQTPNHLPPPRDVVHCINIHPATAPVNVRPYRYPHFQKTEIEKQVSNLLSAGLIRPSTSPYSSPVLLVKKKDGTWRLCVDFRSLNAVTVRDRFPIPTIDELLDELGQASWFSKLDLRQGFHQILMHELDIEKTVFCAHHGHYEYLVMPFGLCNAPSTFQAAMNSLLTPFLCRFATVFFDDILVYSDSLPSHILHLEAILQTLLQGQYYLKQAKWHIVSGKGVEPEPSKVRDILDWPKPTTVKDLHAFLGLMGFYRKFIRNYAAIAAPLTTLLCKDAFEWSLTSQAAFDALKSAVTTTPVLALPNFAEPFVVETDASGIAMGAVLTQRGHPLAFFSKLFGPRMTHASTYIRELHAIVAAVRKWRQYLLGRSFTILTNHKSLRELMTQIIQTPEQHYYLSKLLGFDYNIQYKAGATNKVADALSQIPSTTGQLMILSIPHLDFIDELRQTLQQSPEFQGRIWLNRGNPYIPAILLENHATPLGGHLGVAKTTHRLESNFFWSGLRQDTKRFVKECKICQQTKSTTRRLAGLLQPLPIPAGIWEDLSMDFITHLPSSHGFTVILVIVDRYSKGVHLGALPTGFSAFKVTFLFLELVCKHHRFPRSIVSDRDPVFLSSFWKELFRLPGTRLRMSTVYYPQTDGQTEVMNCVLEQYLRSFIHSQQTSWYRYLALAEWSYNTSLHSNSGLTPFEVIYGKSPPAIPHYIPGMTTNKAVDSLVQTRQRIHTKLQHRLLKAQEAMKRYVDTKREDITFTPRQWVYVKLKPFRQHSITGTNHSKLSKRYFGPFQVTARIGEVAYKLQLLEDSRIHPVFHYSLLRPHHGPPPSVSTPWPLQVVSQCPVPRPLCILDSKLDTSTSPPTQLVLTQWVGQPPEDTTWEPWLDLQETYHLEDKVVSGGGGIDSSRDPRGEDSNSDSHEPSPQMNRDEPEPARPARIAHKPTYLNDYVT

SEQ ID NO: 130944 - protein, 243 aa, Glycine max
  Coding DNA Sequence Number=SeqID_14166
  Gene Ontology: Mol. function=RNA-directed DNA polymerase activity; Cellular component=intracellular; Biological process=RNA-dependent DNA replication
MAKSTLDQLFYQGPPMRRSGVVVKAFDGSRKSVIGEVDLPITIGPFVFQITFQVMDIQAAYSCLLGRPWIHEAGAVTSTLHQKLKFVRNGRLITVSGEEALLVSHLSAFSFIGADETEGTSFQGLTVEGKKPEKNEVSFATWKSAQKVVQEGTGVGWGKVVQLLESKNREGLGFASSAGSATNSVGSSSITSTFCSAGFINDSPEANAVLEDVPEEIVLAFVTPGKLVRNWDAVDIPSVVHAS

SEQ ID NO: 130945 - protein, 247 aa, Glycine max
  Coding DNA Sequence Number=SeqID_14167
  Homolog annotation: Hit_ID=Q1SKD7; Match level="QueryCoverage=66%, HitCoverage=42%, E-value=5e-08, Identity=25%"; Hit description =Ankyrin
KLLPERNVVVYYTEFDKFKEELERRHWDEKLTDFADGCIDIAIVKEFYMNLYDPKDKSPKQVRVRGHLVKFDKDTLNTFLKTPVVLEEGENLCTYSMFALLRPNPQELAAKLCIPGRGFKLNADGQSLKILRKNMTTLARTWSVLSFSNLIPTSHTSDVTLDRAKLIYGIIMKMDMNAGYLISHQISLIAQHDTSRLGFPALIIVLCKAIRVQSDSRSLENFSQEPNLLLLEGVGPPQPRNLSQSSQ

SEQ ID NO: 130946 - protein, 87 aa, Glycine max
  Coding DNA Sequence Number=SeqID_14168
GTSFVAQVEGRSTWVVILRTRKGTSVVDQFKWRDYHLEDKVILQGPKDDGKPEAALGVIATESKSRVQKEEKPKRKTLKPSYLNDYV

SEQ ID NO: 130947 - protein, 58 aa, Glycine max
  Coding DNA Sequence Number=SeqID_14169
MEMYPLTWIGLEMKQRRCRQAVHTQQKYTLSQGSQRQKLKHAHVTFEFKTQALSLASR

SEQ ID NO: 130948 - protein, 87 aa, Glycine max
  Coding DNA Sequence Number=SeqID_14170
MTETVCTDNHLGISSHHLTSQVRMTNTNCTDNRLGISVRHLTSWVRMTEGAEDEKTMFVSACYRTLSLTDSERVFIRITTWVSPPAT

SEQ ID NO: 130949 - protein, 67 aa, Glycine max
  Coding DNA Sequence Number=SeqID_14171
EASWLWKVKILCWIFLVAFYSSMPLPCSRRCMPFLGSFNSGNWSDSDDLDRTGLSCRTITRNWGAII

SEQ ID NO: 130950 - protein, 99 aa, Glycine max
  Coding DNA Sequence Number=SeqID_14172
  Gene Ontology: Cellular component=membrane
  Homolog annotation: Hit_ID=Q5TKG1; Match level="QueryCoverage=78%, HitCoverage=10%, E-value=5e-25, Identity=62%"; Hit description =Putative early-responsive to dehydration stress protein
IINVYAQQYESGGAFWPDVHGRVVMGLIISQILLMGLLTTRGTDKSTLVLIAQPILTFWFHRYCKGRFESAFVKFPLRGWLSNLEVCIHMWVGRYLLLE

SEQ ID NO: 130951 - protein, 98 aa, Glycine max
  Coding DNA Sequence Number=SeqID_14173
  Gene Ontology: Mol. function=oxidoreductase activity; Cellular component=integral to membrane; Biological process=cytochrome complex assembly
  Homolog annotation: Hit_ID=Q2NUY1; Match level="QueryCoverage=98%, HitCoverage=14%, E-value=5e-37, Identity=72%"; Hit description =Suppressor for copper-sensitivity B
MGEITCKIRTGGLREIELERKIRQDADVATGGQRQRAGQRALRGRIEHDGQRNVAFVAMRGEAADVKARWHWPRPAGVDIRRLPADFRRDAAFARRAP

SEQ ID NO: 130952 - protein, 352 aa, Glycine max
  Coding DNA Sequence Number=SeqID_14174
  Gene Ontology: Mol. function=oxidoreductase activity; Cellular component=integral to membrane; Biological process=cytochrome complex assembly
  Homolog annotation: Hit_ID=Q2NUY1; Match level="QueryCoverage=99%, HitCoverage=54%, E-value=1e-53, Identity=55%"; Hit description =Suppressor for copper-sensitivity B
MGKIPADSGLTDQLDASFVDGTLQIRAQRQQGWQQPELFFDYPQGSMLAAPQISVQGEMLTARVAVTDEWGEAAPDLRGKALSLVIADAAAVFSLCRKRHAVVGSAAGAARRADSQPDALCAAGAGDQTEQSGAAAGTDATPDASAVSRVQRRHSVLFPAAGAADDCATAKRSGAGLGHSVPEQRLSAGDGAGDVPVQRQSVRSAAFPPAFRPDHPAGDARRCRSGRAFWPGGLCHAAGDAVQRTVSWHRCRLCADRAAAAAVAAVCRARRRHESAVAAGCGPAGHGALPAASGALDAASAHAAGAADAAGDAVAGDAADSPLGQHCHHSAGGHPAAGADGLANRTPRAAAG

SEQ ID NO: 130953 - protein, 102 aa, Glycine max
  Coding DNA Sequence Number=SeqID_14175
MAEKTKKKLEEVAQSGSTKGVINPPSPIRRHVEWKMALTKKTKQMTSEAAKEIAEKIASQGSFVPHGRQDVVTAAIGRPEHPGRMRAAGADVTIKQYFGSAP

SEQ ID NO: 130954 - protein, 90 aa, Glycine max
  Coding DNA Sequence Number=SeqID_14176
IDGDPVLRETRIWATWEYVSSVGGGQPGMSGTWRYVAGVRRPWGRQASSWQSTDKRKTRPQSKEACGGWPAEAKMVSGNRLPRGVIDYQA

SEQ ID NO: 130955 - protein, 109 aa, Glycine max
  Coding DNA Sequence Number=SeqID_14177
MEHFLEQVAWPEAQLPLVRVNEAALPEPTHVQVDPEPADPQSPVVNPPSSPEREVVPPSPLLIVIFDASSDEAAAPPDSPAGETADPSTSPVGGIVDLSYSSSGEASSH

SEQ ID NO: 130956 - protein, 468 aa, Glycine max
  Coding DNA Sequence Number=SeqID_14178
  Homolog annotation: Hit_ID=Q7W2I4; Match level="QueryCoverage=43%, HitCoverage=39%, E-value=2e-95, Identity=90%"; Hit description =Putative membrane protein. Also similar to BP3051, 42.886% identity (43.776% ungapped) in 492 aa overlap
HLADREQGDHHHHEIDAIGQVHGVEGIAVYARVRIHADHRDRQADHRRQHTLDGLLAEQAGEAAEGEDHQHEVLGRPERQCPFRQQRRQQDNAHHRHDGAEERRPCRQRQGHVGQALARQRIAVQRGHDGAGLARHVQQDRGDAAAVFRADVHRRQQDQRGLGRQVHGEGNRDQHRHAVDRPQARQHADHGAEKRTDRGHQDDHVQHLVEQHVEESAHDDAANRTLDPAAAEQAADEDRHQRGGDDETQPLEQERIRGGEHHHQRDAAVGAGGVRLDRVAALVGQAQTAQADDQRQQQREGARAHRFIGERRFDAPPRPGHEGRQRKRRDAQDSIVHDQLSVGRRTGRRKPAPASGWEPAAQVGQFGVLLDLLLHVGIEVGAGLVEGEQSLLFAQLGELGRRGDAIEGVDPELVVGIGHLGTDVEAADDGPDDVVALLFRGGHRAQLARQALVVEDRQHADGSAAFEH

SEQ ID NO: 130957 - protein, 56 aa, Glycine max
  Coding DNA Sequence Number=SeqID_14179
MTNANCPQESLHSVSNGNLSCLYRILHSIEASFMMMNQVDSRSFDNDKDDDKKPKE

SEQ ID NO: 130958 - protein, 79 aa, Glycine max
  Coding DNA Sequence Number=SeqID_14180
  Pfam annotation: Domain name=Transposase_23; Domain location=11-71; Score=-9.6; E_value=0.013; Accession=PF03017.5; Description =TNP1ENSPM transposase
MGDSDMCGLYIKANPTCLGALGRVYEGSTVVHNTLLLPGQVKVGVEEVKDPDAPVPIPTDEVSLVGQAIHTFLSWPTHQ

SEQ ID NO: 130959 - protein, 66 aa, Glycine max
  Coding DNA Sequence Number=SeqID_14181
MLGSSEPTEFESQSVSVTGDHDPFLRIPLTPTKRVSSDELDNERKNFQISPAEVSSNKLAKHSQPE

SEQ ID NO: 130960 - protein, 60 aa, Glycine max
  Coding DNA Sequence Number=SeqID_14182
MAFVDNWVVGKEMGCYWLSNDIVGPTLILSLVKTISSKLEGINEALGLNLELGLDLKRAV

SEQ ID NO: 130961 - protein, 86 aa, Glycine max
  Coding DNA Sequence Number=SeqID_14183
MTIICLRMSSGSPPLDDKRRRMTIICLCVPSDTIVSEWRKGVRNDHNFSPHVTRPQGQYDRRAQNDHNLSLRTIGHDRIGMAKGAE

SEQ ID NO: 130962 - protein, 239 aa, Glycine max
  Coding DNA Sequence Number=SeqID_14184
MIESFQQQQQMSVLELYVEKDVAGGSMFHAANSVTSCGRNVSHYESELPKNISNLHVDEDDDDDDDDYLASNSYVEESFDEDDSDDGISHTDDEVTDIVEPVSIVHPSEGVPEIQNPFWNDASHYNNINWSHPDEEDICGLDMPTTFNVGQELYVGMDFDSKDAVKNALKQYVMKGCEGDSGIGCCIPNCLNTLSGWCHSITWKQISGTTAYHARLPTKQTGGNSDITVDGYDSHTNCI

SEQ ID NO: 130963 - protein, 227 aa, Glycine max
  Coding DNA Sequence Number=SeqID_14185
  Gene Ontology: Mol. function=cysteine-type endopeptidase activity; Biological process=proteolysis
  Homolog annotation: Hit_ID=Q1XUT8; Match level="QueryCoverage=54%, HitCoverage=31%, E-value=8e-50, Identity=72%"; Hit description =Aminopeptidase C (Bleomycin hydrolase) precursor
MNDLTDIIDNALQKGYTVAWATDVSEKGFSWKNGVAYVPEKPFEEMTDQEKSTMFVGPKPELKVTEEERQKAFDNWQTTDDHGMHIVGLVKDQNGKEYYIVKNSWGTTNDYHGYLYASKEFAQTKGVKFVDGLSWKQVKERAQAENKFIFVELFATWCGPCQYMSNEIFPLEQSPTMPISKNGMPMRVRFPMNTIFNPFPHFLSLIPMGKWYTGLSEQVMPQNSSVM

SEQ ID NO: 130964 - protein, 234 aa, Glycine max
  Coding DNA Sequence Number=SeqID_14186
  Gene Ontology: Mol. function=DNA binding
  Homolog annotation: Hit_ID=Q1S0F5; Match level="QueryCoverage=94%, HitCoverage=48%, E-value=4e-23, Identity=35%"; Hit description=IMP dehydrogenase/GMP reductase
SPWRPLPPSSLEVLHLWGLLINTHGGRVGRDPGIPSGRKETELDRGKQVENGVVGVPRKCLEAKARVLASQNEWAPFMDILALLIFGVVLFPNVDGLVDRAAIDVFLAFYDRKESPVVAILADLYDTFDRRCEKNNARIVFCTPAFYVWLVSHFFRQEMRHVCPLEGHCSCIEKKKANWDRLLASKEGASVNWFPRWKEGRTGILISCGKFPNVPLMGTRGCINYNIVLAIRQL

SEQ ID NO: 130965 - protein, 310 aa, Glycine max
  Coding DNA Sequence Number=SeqID_14187
  Homolog annotation: Hit_ID=Q6D2A1; Match level="QueryCoverage=32%, HitCoverage=74%, E-value=5e-41, Identity=85%"; Hit description =Protein psiE homolog
  Subcellular localization annotation: CTP_CleavageSite=57; ConfidenceScore=5.24e-01
MVKVFCTGRYPCFSARYSGDAGKNSSVNSSGLPDRRSRERRPHRSSIWPGSIKSRLSVEEENSICSGPFSVLSGTTVRPISQGSLSPHSTISRSQKRVSAGKNAASCGISSAVMNASRSSCTVTCWQCCSKRRVIESSSSSQSSSGGESNGEEAGSQCSARNWRSASCDIRTSPRDTSACATLASREELLAFQAVTVGQPQRHHQNQNGRRVAQCIERIFMVDNDQTNNRRDPDIDEVAQRKVITGLKVLHNQRDKLEIEKVDHNAFDQQIRGRLLTGAEQHIRQVNGLFTEKHHQNNGQNHQANVQYPL

SEQ ID NO: 130966 - protein, 144 aa, Glycine max
  Coding DNA Sequence Number=SeqID_14188
  Gene Ontology: Mol. function=4-hydroxybenzoate octaprenyltransferase activity; Cellular component=integral to membrane; Biological process=ubiquinone biosynthetic process
  Homolog annotation: Hit_ID=Q2NR07; Match level="QueryCoverage=100%, HitCoverage=49%, E-value=7e-39, Identity=59%"; Hit description=4 -hydroxybenzoate octaprenyltransferase
  Pfam annotation: Domain name=UbiA; Domain location=9-144; Score= -37.0; E_value=0.0098; Accession=PF01040.9; Description=UbiA prenyltransferase family
MRIDKPIGTLLLLWPTLWALWLSGMAIPPLSVLLVFVLGVFVMRAAGCVINDYADRNVDGHVKRTAARPLASGAVTEKEAKLLFAGLGLLAFLLVLTMNRMTILLSFGGLALAWVYPFMKRYTHLPQVVLGAAFGWAIPMGWAA

SEQ ID NO: 130967 - protein, 79 aa, Glycine max
  Coding DNA Sequence Number=SeqID_14189
MARTRGLGRAIGRFVGRDRAADEDAGDVPERRRPTASARRLRVHQMTTEGRDMAEDVADLTDDVPEQPTEAPEMRADAQ

SEQ ID NO: 130968 - protein, 99 aa, Glycine max
  Coding DNA Sequence Number=SeqID_14190
MEQNFAQVQKNACVWLAVESLVQNEFWMFASISQRSKCRLIHYRLPLERIDGDPVLRETRIWATWEYVSSVGGGQQGMVGLCAHCGCEKLVVHHRPTVT

SEQ ID NO: 130969 - protein, 67 aa, Glycine max
  Coding DNA Sequence Number=SeqID_14191
MDGGWAKAFAGVPDWKVGGPHKTSLGNDIQGAPKNRGGMESWRTVLGNDIRGVPRLEGGGLMNSARQ

SEQ ID NO: 130970 - protein, 236 aa, Glycine max
  Coding DNA Sequence Number=SeqID_14192
  Homolog annotation: Hit_ID=Q1T493; Match level="QueryCoverage=84%, HitCoverage=36%, E-value=4e-25, Identity=30%"; Hit description =Nucleic acid-binding, OB-fold, subgroup
  Pfam annotation: Domain name=Rep_fac-A_C; Domain location=92-222; Score=-37.9; E_value=0.00039; Accession=PF08646.1; Description =Replication factor-A C terminal domain
MHRVRSYPASVSNSFKASKLLINDPILEIQEFKDRLLDLGVEVSRVSLPGDQASSQVPGGSQLSSKDSFLSKAEAKTILEINAISEDVVCVTVGTISKIVMDNHSWCYPACAQCHRKTDIQTGPFTCGCGKDNDQPVLRYRVEIMVTQNNESGKFLLWDCEYAEFIGQTADDVNRVKIEDGDLDLNASPQALDKLLGHVLAFKARIQSRFKNAVVLRYSKDLDLINAVLEMLPDSE

SEQ ID NO: 130971 - protein, 298 aa, Glycine max
  Coding DNA Sequence Number=SeqID_14193
LVGYQPNLVSRQFGLSQIRPKSLFEDPQDVIRGANLSEKTFKKFLKISLDENYNLHPFEFNHSHFCTMGFVTWWERYYSTRSVGDTTNMISRLESGFVQPTVENIRSSLQARGKAPMTKRSAETPRADMRPKKPTGEEEERPLIRKRKLPTTSTKFAEQTEAGNSQAQMPKKKKKVKQVEPEPSVAVEGGEPAKKKKKKTKSSKEQGDHQPVDVQPPSTDIDGTEVKAAPSIAEMGNPVEQPNSPREQPTVEVQQNVSAEEIPSCARTSPAPEADAVNVEEWGEGQGIGSSSPHGWAE

SEQ ID NO: 130972 - protein, 106 aa, Glycine max
  Coding DNA Sequence Number=SeqID_14194
MAYKDRNGRSLTLFRHYQSPLIIQRQASPMVCGDNDGQTNIVICFPCRETQCLLTKATEVSPAIPRQASPIAYGGRHDYPFYYFQGTKAFADAPDVFYALSFDRFC

SEQ ID NO: 130973 - protein, 66 aa, Glycine max
  Coding DNA Sequence Number=SeqID_14195
  Homolog annotation: Hit_ID=Q9M0V3; Match level="QueryCoverage=64%, HitCoverage=3%, E-value=2e-16, Identity=90%"; Hit description=DNA damage-binding protein 1a
MEELQHLNSSALMVKHKIIFLLQLKDTNFVFFNGIPRRVSLLHGMCEEAPILSFGVDLLMSTIVFV

SEQ ID NO: 130974 - protein, 81 aa, Glycine max
  Coding DNA Sequence Number=SeqID_14196
MTKARQKGVRKVNESTPKNDEERMKNVEERLKTFAKSPTETLRKRLSLDFHHGTNFFSLILSDSELPGGLNEISLHFSPYL

SEQ ID NO: 130975 - protein, 112 aa, Glycine max
  Coding DNA Sequence Number=SeqID_14197
  Homolog annotation: Hit_ID=Q9LW83; Match level="QueryCoverage=37%, HitCoverage=5%, E-value=5e-12, Identity=73%"; Hit description =Receptor kinase 1
MEFTNEAKLMAKLQHTNLIKLLGFCIQRDERILIYEYMPNKSLDFYLFVWLLFYLLSSEFSNFKTFGLWYMFMKTSIFPVDMWGPEYEAGKVKNGFLQSGYVLVKSRMQRLL

SEQ ID NO: 130976 - protein, 187 aa, Glycine max
  Coding DNA Sequence Number=SeqID_14198
  Gene Ontology: Mol. function=oxidoreductase activity; Cellular component=cytosol; Biological process=metabolic process
  Homolog annotation: Hit_ID=Q2HVK7; Match level="QueryCoverage=98%, HitCoverage=62%, E-value=2e-62, Identity=64%"; Hit description=Short- chain dehydrogenase/reductase SDR
MKRGEISDWNIIVRQNYELAEECVEVNFFGAERVTEALLPLLQLSTSPRIVNVSSRIGVLKNIPNEWARGVFGDIEKLTNKKLHVVLREFLKDYKEGSLESKNWPPVLSGYTMSKTALNSYTRMLAKKFPRFRINCLCPDFVKTDINHNVGFLTIDEGAECPARLALLPDNGPSGLFFLREEVLSFV

SEQ ID NO: 130977 - protein, 71 aa, Glycine max
  Coding DNA Sequence Number=SeqID_14199
MTEACQKGVRKVNETRIKVHETNGDHHGKIGEELATKLAQASFVEEESGRPKWACFQNVTETHGLRNNTSF

SEQ ID NO: 130978 - protein, 195 aa, Glycine max
  Coding DNA Sequence Number=SeqID_14200
MEAMKEQMATMMEAMMSMTKMMEVNTTIVVAASTTIEVDPTHPPGFNQVNHPASDMVGQGGKALGSVSSPYFVQVQNKHSFPPYGLPPNYTPPNVAHASDENVDSSTPILIVSQQPLSGQAQVPQPMGETHEVPRDHTLADSKPCLGYATEGQTFGGIPLPNTLGALSITHNHNPYILRWEECLLLCRIGRTLIR

SEQ ID NO: 130979 - protein, 167 aa, Glycine max
  Coding DNA Sequence Number=SeqID_14201
  Subcellular localization annotation: CTP_CleavageSite=20; ConfidenceScore=5.39e-01
MDRLTTMMNALLSAQNSQAAAAAVEQPLVSTTPLSTVTSPPLFLPPGCTWGMPPPVCGSPQPAVSEVPLPFAQQSAPVPQPGTSFPQAAMTYSAPLIHTIQQEVEPIFQAENVVAFDKMEELQERFDGMQREVEALRGRDLFGKDACELCLVPNVTIPHKFKVPDFE

SEQ ID NO: 130980 - protein, 75 aa, Glycine max
  Coding DNA Sequence Number=SeqID_14202
  Subcellular localization annotation: CTP_CleavageSite=42; ConfidenceScore=5.33e-01
MTTSLWIMDRAGYFSQIHFNLRLNPATPFFLFFSCFGGNRLSSSTGGEGEGFMFYLEDDLNLVICEARSQLLNTM

SEQ ID NO: 130981 - protein, 80 aa, Glycine max
  Coding DNA Sequence Number=SeqID_14203
  Gene Ontology: Mol. function=cysteine-type peptidase activity; Cellular component=cytoplasm; Biological process=fucose metabolic process
MGMEYQKIHACPNDYILYRHELEEIHKCPRCGVPLYKVKDDDECSSDDNSKKGPRQRWCGIFRSFQGLSDCLLMEMTQKT

SEQ ID NO: 130982 - protein, 119 aa, Glycine max
  Coding DNA Sequence Number=SeqID_14204
  Gene Ontology: Mol. function=oxidoreductase activity; Cellular component=cytosol; Biological process=metabolic process
  Homolog annotation: Hit_ID=Q2HVK7; Match level="QueryCoverage=90%, HitCoverage=37%, E-value=3e-39, Identity=77%"; Hit description=Short- chain dehydrogenase/reductase SDR
  Pfam annotation: Domain name=adh_short; Domain location=7-118; Score=- 33.6; E_value=0.0009; Accession=PF00106.15; Description=short chain dehydrogenase
MGEEAKRYAVVTGANKGIGYGICKKLALNGVVVVLTARNEKRGLDAVERLKEFGLSDLLVFHQLDVTDPPSVASLTQFIKTRFGRLDILVNNAGVPGGIVNGENVLRRFTFYHCGDHDN

SEQ ID NO: 130983 - protein, 189 aa, Glycine max
  Coding DNA Sequence Number=SeqID_14205
  Gene Ontology: Mol. function=acetolactate synthase activity; Cellular component=chloroplast; Biological process=branched chain family amino acid biosynthetic process
  Homolog annotation: Hit_ID=Q8CZQ3; Match level="QueryCoverage=69%, HitCoverage=22%, E-value=3e-57, Identity=85%"; Hit description =Acetolactate synthase III, large subunit
  Pfam annotation: Domain name=TPP_enzyme_N; Domain location=62-189; Score=201.0; E_value=2.7e-57; Accession=PF02776.8; Description =Thiamine pyrophosphate enzyme, N-term
QIVMWKRDLRVNHARNAAGFSAVMVIDLLSKESTQGQMRAARRIAFAGAAGSQAWRQKMEMLSGAEMVVRSLIDQGVKQVFGYPGGAVLDIYDALQTVGGIDHVLVRHEQGAVHMADGLARATGEVGVVLVTSGPGATNAITGIATAYMDSIPLVILSGQVPSSLIGYDAFQECDMVGISRPVVKHSFL

SEQ ID NO: 130984 - protein, 98 aa, Glycine max
  Coding DNA Sequence Number=SeqID_14206
MARSVSAPCPYSRDLYGRELTRHLVITPKSPVESPTVATYPSAGGRRVTRGMRVPRKEYARSRHQRLFEENVGKTGKDAIYELLSDRFGSCIYARGRC

SEQ ID NO: 130985 - protein, 129 aa, Glycine max
  Coding DNA Sequence Number=SeqID_14207
MDSERFQVSILGDGFPSKALLEEMHQQFFIFRVCPHLPTVHLQVVLGASSPLVLIEIKHLEFRRCHTLISSGDLCSMTCDHSLVLVRPIWALQKIPPEGGCFWRKQPCSPGRAELAWASWAATTSPILL

SEQ ID NO: 130986 - protein, 146 aa, Glycine max
  Coding DNA Sequence Number=SeqID_14208
  Homolog annotation: Hit_ID=Q6K272; Match level="QueryCoverage=30%, HitCoverage=5%, E-value=2e-07, Identity=55%"; Hit description =Putative Cnot10 protein
MESRDLPSSSPSSTANRDASSATDAEDGVFTVAVALAKDAALHFQSGKFAECVEVLNQLLQKKQGDPKLVSTCRCSVASVAVDLNVHRLFSWFWMSMQRHWRCVMCGTSRNVGRKEKFVGLVEETAAVDLTWKFDCQKGFSAHFSG

SEQ ID NO: 130987 - protein, 339 aa, Glycine max
  Coding DNA Sequence Number=SeqID_14209
  Gene Ontology: Mol. function=microtubule motor activity; Cellular component=microtubule associated complex; Biological process =microtubule-based movement
  Homolog annotation: Hit_ID=Q2HT07; Match level="QueryCoverage=57%, HitCoverage=12%, E-value=1e-52, Identity=60%"; Hit description =Kinesin, motor region; Prefoldin
KKDYDIALVGAFRREKDKEMELQALRDEIQASMKLVRQREDEIQSLKMRLRFREAGIKRLETVASEKISAETHLLKEKEEHLKEIEVLRAQEDRNNEATRFAMENLQLKEEIRRHVLLIQLKYFFVAFFLFMCMQKLKSFCMEGEREQMSEQIMVLENKLLEALDWKFMHETDLKKNSDLMIEDVHNDGNLISKQAIQNQPLGWGGYALKCKLQNLKHRLKSWSRDICGDLGSKVKQTQNRSLQGRHSIFYMYGRLNAPRHFGNDNRNYLPSSVFMEQTPYEISAHGSSRLHPTALFNSKMMIRSSSGWDKDLYNCQSYQRSFCSPNLTGHAKFDAEAP

SEQ ID NO: 130988 - protein, 166 aa, Glycine max
  Coding DNA Sequence Number=SeqID_14210
MFVHRNNANTATLAEVAETLQYIVSPHGRNTWTVDNLVPYVEKITILSKEQVRIIEPVSHGPASERQFPAQEFHILQSNVETQGIGRRREAVEAEEYSQQMVDRGHGMYYTPPTFSQYPSQMYQYPFEGHHIDTFASEHSFGGVAETHPHFSWPTMTPSQQHDVPI

SEQ ID NO: 130989 - protein, 142 aa, Glycine max
  Coding DNA Sequence Number=SeqID_14211
LAKRGPSPLTFDDKDMEMPIILDHGDLLLLKAFINKKEVCQLLVDIGSYADIMFYDFFRNLSIQQLELLLYIEDLLGFSGHHNEICKVSRNLREGISNQNHRHHVHYGEAIIILQHDIGQTNLECPESCDFDISSSHEVPQQ

SEQ ID NO: 130990 - protein, 169 aa, Glycine max
  Coding DNA Sequence Number=SeqID_14212
  Gene Ontology: Mol. function=RNA-directed DNA polymerase activity; Cellular component=intracellular; Biological process=RNA-dependent DNA replication
MDALTSFLKENADIFSWKPINMPDIDPHLFYHKLVVNPSVKLYCLKDLYLFPDLDKLVGRSFGYQYLSFMDAYSGYNQILLHLERQIGQNLEVYVDDMIVKSNTPEQHIVDLAETFAQLQKYNMRLNTKKYVFGVSVGKFLGYMSERVIELNPDKCWTILEIQSPNVVK

SEQ ID NO: 130991 - protein, 141 aa, Glycine max
  Coding DNA Sequence Number=SeqID_14213
MHKNERDGEWKNGLKQQLHKAGPIVISRFMIISAAFIIQAVKNVVATSRTMVCTIYQPSIDIFETDILPENTGIAKSIEAAGSTMSDTMSRTSCPKILELLKALKLQDPRCRIRCPGHLARKYWTYKSVISLTDYCAVSKR

SEQ ID NO: 130992 - protein, 141 aa, Glycine max
  Coding DNA Sequence Number=SeqID_14214
  Gene Ontology: Mol. function=transition metal ion binding; Cellular component=cytoplasm; Biological process=proteolysis
  Pfam annotation: Domain name=Transposase_21; Domain location=79-141; Score=-119.3; E_value=0.0002; Accession=PF02992.5; Description =Transposase family tnp2
MGMEYQQIHACPNDCILYRHEFQEMSKCPICGTSRYKVKDEEENNFDENSNKGPPAKVLWYLPIIPRSKRLFANEDDVKDLTWHANGRISDGMVHHPTDCSQWNKIDGLYLDFRKEPRNLRLGLANDGMNPYGTLSTQHSS

SEQ ID NO: 130993 - protein, 218 aa, Glycine max
  Coding DNA Sequence Number=SeqID_14215
  Homolog annotation: Hit_ID=Q06763; Match level="QueryCoverage=41%, HitCoverage=59%, E-value=2e-36, Identity=85%"; Hit description=ADR11 protein
MDFWHLTSLEGARVTRRRRLATSHKELKGKWDINVEVEKLQFKSGAKTHRSFNLNKPLKHGAALVRNRVTQTNVNQPSKKIHTGTKFERVNGARSLRRRLWWWAWSVPSLPWCGWWVNNWNWRENTWGLHYWWKNNGRNINGRDGDWWLNNGCFGCLWCFTRLVLFGGFATVATTENGSGGREKDHAEEEIKCVCVCLRGERKGSLARESTGLGCLTG

SEQ ID NO: 130994 - protein, 73 aa, Glycine max
  Coding DNA Sequence Number=SeqID_14216
MLLNSNVIHIHVRVVMLVRMIRTRLFAAAWVKSCPGMHTRCVIASLSGCARIVGRPPISGGGPGTDKRKLLAP

SEQ ID NO: 130995 - protein, 169 aa, Glycine max
  Coding DNA Sequence Number=SeqID_14217
MPISPCRWIAPTRHPVDPKKSNRALGFPALVMGLCQSYRVPVPPARSCHRDIGIAPTRHPVDPKKSNRALGFPPLVTGLCQSYRVPVPPARSCHRDIGIASARHPVDPKKSNRVLELPSSNYESLKVIRPPTNRAFIKKYCVPRQAQGETPQQPGDGRQRATDAPPSPL

SEQ ID NO: 130996 - protein, 222 aa, Glycine max
  Coding DNA Sequence Number=SeqID_14218
  Gene Ontology: Mol. function=protein kinase activity; Cellular component=integral to membrane; Biological process=protein amino acid phosphorylation
  Homolog annotation: Hit_ID=Q949V3; Match level="QueryCoverage=76%, HitCoverage=28%, E-value=3e-52, Identity=64%"; Hit description =Putative receptor protein kinase
GVHGCNGFPQRSLFPENDSPGKRDKLLGMEPLRRLLETVKLTNFNVMLGRLPEKELFSRKRPVRRVRLLRENGIAPEKLLEESSRRVKRVEVAEGGEVGEVGGDGAHEGVGAEAEDTEAREAGDCVGGDGAHKASAGEVEGSNEGAVRVALDSEPGAGRTGGVPLDPVRVRVGSALTRSLGCTRATKIKIINIMWKWNAIWKRRRLAMFFLVLVASVVVAGK

SEQ ID NO: 130997 - protein, 89 aa, Glycine max
  Coding DNA Sequence Number=SeqID_14219
  Subcellular localization annotation: CTP_CleavageSite=42; ConfidenceScore=5.05e-01
MGLRSGIVLSDGQMPGRIQRQRQIEVNGNAATVCCAMSFPAVATYPSAGGRRVTCGCVFQERNAHGVATNVYLRKTSEKLEKMRSTNFK

SEQ ID NO: 130998 - protein, 475 aa, Glycine max
  Coding DNA Sequence Number=SeqID_14220
  Gene Ontology: Mol. function=transferase activity; Cellular component= proton-transporting two-sector ATPase complex; Biological process =positive regulation of cell proliferation
  Homolog annotation: Hit_ID=UPI00005DC2B3; Match level="QueryCoverage =99%, HitCoverage=64%, E-value=1e-125, Identity=50%"; Hit description= ATMAK10; acetyltransferase
MKRPQGRGLELARKHIASCISEIDYIRKSSEFLRANAHGMSEQNIDNTTASGCQPIGFDASLNCRLSAPTPPRSIKILSLEKALEYFMKLLQDLDVICSYSLDPSLEAALLFVIKFQKSQPDLVARAHLQDGKLYGRDPMFSMITRAAGLPEVTENHDIQKNEFMVQLGQLVINLLKILCTNAAWQRRKLGKMLQDWRVTYVQLEMAFKGEFAEASKTSNNKKICFKIYQHILAWVEEQTYWIAFRFLNLGFELELYSVHDYCMVYWYIYVVLIKLAEKKHLRMAMSSDSAKKKTKKKRDSFKDGEMDYQIPAAVLFLQSQIYLAEGLSMMFAALRNERRIVPLQSPFNTEHEIFIQQFELLQKACVPDHISYVTFKESTMHANFSRQVFTCLFPLQTLAICDHFKEAQKIAKEVKSSFANDPDTMAELRRVEQVAERNSIALNVCRAGALDPKLKTFFTFCHHPFYATAIVKRS

SEQ ID NO: 130999 - protein, 212 aa, Glycine max
  Coding DNA Sequence Number=SeqID_14221
  Gene Ontology: Mol. function=serine-type peptidase activity; Biological process=metabolic process
  Homolog annotation: Hit_ID=UPI0000E5DAF5; Match level="QueryCoverage =46%, HitCoverage=70%, E-value=3e-47, Identity=89%"; Hit description =transcriptional regulator, HxlR family
  Pfam annotation: Domain name=DUF24; Domain location=31-106; Score =49.0; E_value=1.6e-11; Accession=PF01638.8; Description =Transcriptional regulator
MDRDEILQYSQAVCQGLKDDDDGLRREVLAHAGSRWSLGIVNTLGVYGRLRHAEIGRRMHGVTQRMLTHTLRQLERDGLVIRHDFSEIPPRVEYELSDTDYHDLAGYVHGAKIIHFALTRAPIDNINDVVYETVKKTRSVRQLHMSFLVPRTKILKPAIIYFPGGGFMTAEHNKFMEMRMALAEAGFVVAAAEYRTIPDTFPAPMIDAKAAV

SEQ ID NO: 131000 - protein, 41 aa, Glycine max
  Coding DNA Sequence Number=SeqID_14222
MEEFETQVACPGDQPSSSRGGGAFVAQEPDTEEPPALAPTP

SEQ ID NO: 131001 - protein, 74 aa, Glycine max
  Coding DNA Sequence Number=SeqID_14223
MDALEHGVKHLRGARSGICRGAGGITGIRVDEEGGTVEEKGVGASDAKVDGASDLLRLAFLGPLKVTVGSSRFQ

SEQ ID NO: 131002 - protein, 172 aa, Glycine max
  Coding DNA Sequence Number=SeqID_14224
  Gene Ontology: Mol. function=phospholipase C activity; Cellular component=membrane; Biological process=intracellular signaling cascade
  Homolog annotation: Hit_ID=Q9LT86; Match level="QueryCoverage=64%, HitCoverage=27%, E-value=7e-42, Identity=69%"; Hit description=MAP3K protein kinase-like protein
  Subcellular localization annotation: CTP_CleavageSite=63; ConfidenceScore=5.37e-01
MVNGNVVLRMQFADGNGGMKAGSCPNRAESPSMNTTSRSLVLVNFFRDLPDVTKSCKDNSAPLLSMVNTCYEAAGKRWPNFIAVDFYKRSDGGGAPDAIDVANGHLVCGCENMASCKANMTFGVCQLPEAEATPPRAAAAARDTSFGIRNCKPVYLLWSFATTVFGGMLVSL

SEQ ID NO: 131003 - protein, 369 aa, Glycine max
  Coding DNA Sequence Number=SeqID_14225
  Gene Ontology: Mol. function=beta-1,4-mannosylglycoprotein 4-beta-N -acetylglucosaminyltransferase activity; Cellular component=membrane; Biological process=protein amino acid N-linked glycosylation
  Homolog annotation: Hit_ID=Q9SKF0; Match level="QueryCoverage=80%, HitCoverage=83%, E-value=1e-128, Identity=72%"; Hit description =Putative N-acetylglucosaminyltransferase
  Pfam annotation: Domain name=Glyco_transf_17; Domain location=12-368; Score=583.5; E_value=2e-172; Accession=PF04724.4; Description =Glycosyltransferase family 17
  Subcellular localization annotation: CTP_CleavageSite=54; ConfidenceScore=5.70e-01
MDFSLPFPPPNPVSSSPSATSLRYFFFFFAFYSHFSPSEFAFGVKQNAFFTIPRGEHGLSESDCQTGEIQNVSMEHLCRLHGWSLRSKPRRIFDAVIFSNELDMLEIRWHELSPYVSKFVILESNTTFTGIPKRLFFALNRERFSFAKQKIVHDIYPGRIAVPGSHEDPFVLESKQRGAMNALLRRAGISNGDILLMSDTDEIPSPHTLKLLQWCDGIPPIMHLELRNYMYSFEFPVDYSSWRATAHVYGPRSQYRHSRQTDVIFSDAGWHCSFCFQYISEFVFKMTAYSHADRVKRKYFLSHSRIQDIICKGDDLCDMLPEEYSFQELIKKMGSIPRSASAVHLPAYLIENADKFKFLLPGGCLRPPE

SEQ ID NO: 131004 - protein, 336 aa, Glycine max
  Coding DNA Sequence Number=SeqID_14226
  Gene Ontology: Mol. function=transferase activity; Cellular component= membrane; Biological process=metabolic process
  Homolog annotation: Hit_ID=Q1SG26; Match level="QueryCoverage=99%, HitCoverage=87%, E-value=1e-160, Identity=79%"; Hit description =Exostosin-like
  Pfam annotation: Domain name=Exostosin; Domain location=7-299; Score =201.7; E_value=1.7e-57; Accession=PF03016.6; Description=Exostosin family
MLKRFKVWTYKEGELPLAHEGPMSSIYGIEGHLIAQIDNRTGPFLARYPDEAHVFMLPISVTQIVRYVYNPLTTYSRDQLMRITVDYTNIIAHRYPYWNRTKGADHFLASCHDWAPDISREESGRELFKNIIRVLCNANTSEGFKPEKDVPMPEMNLQGFKLSSPIPGFDLNNRSILAFFAGGAHGRIRKILLEHWKDKDEEVQVHEYLPKGVDYQGLMGQSKFCLCPSGYEVASPRIVESINIGCVPVIVSDYYQLPFSDVLDWSKFSLHIPSRRIAEIKTILKNVPHAKYLKLQKRVMKVQRHFELNRPAKPFDVFHMILHSIWLRRLNIRLHH

SEQ ID NO: 131005 - protein, 69 aa, Glycine max
  Coding DNA Sequence Number=SeqID_14227
MLNYGPIGTLKIMKMWLELLLGAISWLCPLPTSTTSASRNSKDKDHTTLSWSIQLCNTTQFTCGLKLRV

SEQ ID NO: 131006 - protein, 169 aa, Glycine max
  Coding DNA Sequence Number=SeqID_14228
  Gene Ontology: Mol. function=transferase activity; Cellular component= membrane; Biological process=metabolic process
  Homolog annotation: Hit_ID=Q1SG18; Match level="QueryCoverage=92%, HitCoverage=37%, E-value=9e-71, Identity=76%"; Hit description =Exostosin-like
  Pfam annotation: Domain name=Exostosin; Domain location=1-128; Score=- 27.9; E_value=1.6e-07; Accession=PF03016.6; Description=Exostosin family
MATLNSSRTSSGEHGDIRKILLNHWKGKDNDIQVHEYLPKGKNYTQLMGQSKFCLCPSGYEVASPRVVEAIHAGCVPVLISSSYSPPFTDVLNWSQFSVEIPVEKISEIKTILQSISRNRYLRLHMNVLRVRRHFMLNRPAKPFDLMHMILHSIWLRRLNLRLIGSTSS

SEQ ID NO: 131007 - protein, 90 aa, Glycine max
  Coding DNA Sequence Number=SeqID_14229
  Homolog annotation: Hit_ID=Q5YDB5; Match level="QueryCoverage=42%, HitCoverage=5%, E-value=8e-11, Identity=82%"; Hit description=C -terminal domain phosphatase-like 2
MLNLRCLAIVFDLDEKLIVANTMKSFEDRIEALRGWLLRGSHSSPTSSSPASTTLAFQVSGFRQRRGRDGHRNCRHKASDGGLQTPFCFA

SEQ ID NO: 131008 - protein, 123 aa, Glycine max
  Coding DNA Sequence Number=SeqID_14230
  Gene Ontology: Mol. function=transferase activity; Cellular component= membrane
  Homolog annotation: Hit_ID=Q1SG18; Match level="QueryCoverage=99%, HitCoverage=29%, E-value=4e-50, Identity=70%"; Hit description =Exostosin-like
SHEEMLKRFKVWVYEEGEQPLVHDGPANDIYSIEGQFIDEIDNDAKWSHFRAEHPDQAQVFFLPFSIANVVHYVYKPIRKHSDYEPIRLQRLVEDYIGVIANKYPYWNRSEGADHFLLSCHDW

SEQ ID NO: 131009 - protein, 340 aa, Glycine max
  Coding DNA Sequence Number=SeqID_14231
  Gene Ontology: Mol. function=transferase activity; Cellular component= membrane; Biological process=metabolic process
  Homolog annotation: Hit_ID=Q1SF57; Match level="QueryCoverage=98%, HitCoverage=71%, E-value=1e-155, Identity=77%"; Hit description =Exostosin-like
  Pfam annotation: Domain name=Exostosin; Domain location=18-301; Score= 219.1; E_value=9.6e-63; Accession=PF03016.6; Description=Exostosin family
MMKRLKVWAYKEGEQPLVHDGPVNNKYSIEGQFIDEMDMASMSPFKATHPEQAHLFLLPYSVSKVIRYVYKPRRSRSDYDPDRLQRLVADYINILANRYPYWNRSKGADHFLVSCHDWGPRISDANPELFKYFIRALCNANTSEGFQPNRDVSIPEVYLPSGKLGPPNMGQHPNNRTILAFFAGGAHGKIRKKLLKRWKNKDKEVQVHEYLPKGQDYTKLMGLSKFCLCPSGHEVASPRVVEAIYAGCVPVIICDNYSLPFIDVLNWRKFSMEIAVERMPEIKTILQSVSKDKYLELYSNVRRVRRHFVINRPAKPFDLIHMILHSLWLRRLNFKLTASH

SEQ ID NO: 131010 - protein, 348 aa, Glycine max
  Coding DNA Sequence Number=SeqID_14232
  Gene Ontology: Mol. function=transferase activity; Cellular component= membrane; Biological process=metabolic process
  Homolog annotation: Hit_ID=Q1SG18; Match level="QueryCoverage=98%, HitCoverage=82%, E-value=1e-175, Identity=83%"; Hit description =Exostosin-like
  Pfam annotation: Domain name=Exostosin; Domain location=15-309; Score= 216.1; E_value=8.2e-62; Accession=PF03016.6; Description=Exostosin family
MKSRSHMEMVKRFKVWVYEEGEQPLVHYGPVNDIYAIEGQFIDEIDNSKRSPFKARNPDEAHAFFLPLSVVNVVHYVYKPYMSQNDYSRDRLQRLVEDYIGVVADKYPYWNRSNGADHFLLSCHDWAPEISHANPDLFKNFIRVLCNANNSEGFQPKRDVSIPEVYLPVGKLGPPNLGQHPMNRTILAFFSGGAHGDIRKLLLKHWKDKDNHVQVHEYLPKGQNYTELMGLSKFCLCPSGYEVASPRVVEAINAGCVPVIISENYSLPFSDVLNWSQFSIQISVENISDIKTILQNVTQKKYKKLHRNVRRVQRHFVMNRPAKPFDLMHMILHSIWLRRLNFRVMASH

SEQ ID NO: 131011 - protein, 58 aa, Glycine max
  Coding DNA Sequence Number=SeqID_14233
MEKSNGSNIEAVEHREYNMACALNLKSRALYSEPCTSITINIYFSASLFKRKNGILLA

SEQ ID NO: 131012 - protein, 349 aa, Glycine max
  Coding DNA Sequence Number=SeqID_14234
  Gene Ontology: Mol. function=receptor activity; Cellular component =integral to membrane; Biological process=response to sucrose stimulus
  Homolog annotation: Hit_ID=Q1SF60; Match level="QueryCoverage=98%, HitCoverage=99%, E-value=1e-149, Identity=72%"; Hit description=Hly -III related proteins
  Pfam annotation: Domain name=HlyIII; Domain location=80-330; Score =165.8; E_value=1.1e-46; Accession=PF03006.10; Description=Haemolysin- III related
MNYIQTKCVVKRKGKETAAETETLCFTKSKDNNNMCDRHSGKRYPLLSFWELPEYMKDNEYILRYYRANWPFKQALFSLFRWHNETLNVWTCPFNWVFTLSWIDPRQFNEAYSGGSLGTLYQGTTLLFDLNHQTPLTIELQSTALVIARWPFFVFLGGSMFCLLSSSMCHLFCCHSRDLNLFLWRMDYVGIVVMIITSFFPQIYYVFLCEPHWQIIYLAGITAMGLFTIATMLSPTLSTSKYRAFRAMLFCSMGLFGIVPAIHACFVNWSNPRRNITLAYEIGMALSYLTGTLFYVTRIPERWKPGWFDLAGHSHQIFHALVVVGALAHYAATLQMLEWRDSFGCDTVL

SEQ ID NO: 131013 - protein, 77 aa, Glycine max
  Coding DNA Sequence Number=SeqID_14235
MESPFVATYPSAKGRGEKSKVRLPKRKMCGSHHRRLFEENVIRKNKESSLRRARARLSELKLSVEAMSSPKQLVSSP

SEQ ID NO: 131014 - protein, 545 aa, Glycine max
  Coding DNA Sequence Number=SeqID_14236
  Gene Ontology: Mol. function=protein serine/threonine kinase activity; Cellular component=membrane; Biological process=protein amino acid phosphorylation
  Homolog annotation: Hit_ID=Q1SF63; Match level="QueryCoverage=97%, HitCoverage=97%, E-value=0.0, Identity=73%"; Hit description=Protein kinase
  Pfam annotation: Domain name=APH; Domain location=215-452; Score= -1.5; E_value=0.0071; Accession=PF01636.13; Description =Phosphotransferase enzyme family
  Pfam annotation: Domain name=Pkinase; Domain location=213-533; Score =124.4; E_value=3.2e-34; Accession=PF00069.15; Description=Protein kinase domain
  Pfam annotation: Domain name=Pkinase_Tyr; Domain location=213-531; Score=90.9; E_value=3.9e-24; Accession=PF07714.7; Description =Protein tyrosine kinase
  Pfam module annotation: Pfam domain module=APH::Pkinase::Pkinase_Tyr; Domain location=215-452::213-533::213-531
MAITVLFLVLLLQLWTVFGSEVVLQSRDCDSDWVAHSYSSHGQDLFYINGNVVNKVAFCEALQLYIAKGCDVKDYFGSVKCVVDDSFVNLPLKAGRKLLKDLSNESTPRGDSNPVSSKVVVIGAGGALLVCCAVLCPCFYAKRRKATSHAVLAKDPNSMDSVSSFEASTNDKIPASPLRVPPSPSRFSMSPKLTRLKSLHLNLNQVTRATQNFSETLQIGEGGFGTVYKAKLEDGRVVAVKRAKKEHFDSLRTEFSSEIELLAKIDHRNLVKLLGYIDKGNERLLITEFVPNGTLREHLDGMRGKILDFNQRLEIAIDVAHGLTYLHLYAGLLCVVCLPKQSIDPTLCSSSDHWYLFNIFQCNQPYVRGISSERVREKQIIHRDVKSSNILLTESMRAKVADFGFARLGPVNTDQTHISTKVKGTVGYLDPEYMKTYQLTPKSDVYSFGILLLEIVTGRRPVELKKTVEERVTLRWAFRKYNEGSVVELVDPLMEEAVNGDVLMKMFDLAFQCAAPIRTDRPDMKSVGEQLWAIRADYLKSARRE

SEQ ID NO: 131015 - protein, 197 aa, Glycine max
  Coding DNA Sequence Number=SeqID_14237
  Homolog annotation: Hit_ID=Q1RTJ9; Match level="QueryCoverage=94%, HitCoverage=58%, E-value=3e-16, Identity=33%"; Hit description =Cyclin-like F-box; F-box protein interaction domain
MSDPYFIKLHLSKFAAKDDLEHLQLMKNVCLGSIPEIHMESCDVSSLFHSLQIETFLFDFENMPGYHLVGSCNGLHCGVSEIPEGYRVCFWNKATRVISRESPTLSFSLGIGRRKMFGFGYDPSSDKYKVVAIALTMLSLDVFEKTEMKVYGAGDSSWRNLKGFPVLWTLPKVDGVYLSGTLNWVVITGKETIHSEI

SEQ ID NO: 131016 - protein, 70 aa, Glycine max
  Coding DNA Sequence Number=SeqID_14238
MAFLGETSSQTIMNSRLAFIFRNGTVIHNECGVYFQSSGAVPIIHNSLRLNNNEVVDEIHYRRPVEDTEQ

SEQ ID NO: 131017 - protein, 65 aa, Glycine max
  Coding DNA Sequence Number=SeqID_14239
MATGQRGEFGDGFETDIENLIPDPELEFGYREKPDLDQLKFSPSKSERIRGGSHRFGPVVVMPSC

SEQ ID NO: 131018 - protein, 95 aa, Glycine max
  Coding DNA Sequence Number=SeqID_14240
  Homolog annotation: Hit_ID=Q1SF66; Match level="QueryCoverage=90%, HitCoverage=15%, E-value=3e-40, Identity=91%"; Hit description=C2
MELEMQWDGNPSIILDIKTLLGVALPVQVKNIGFTGVFRLIFKPLVDEFPGFGAVSYSLRQKKKLDFTLKVIGGDISAIPGLYDAIEVWTTPIFC

SEQ ID NO: 131019 - protein, 348 aa, Glycine max
  Coding DNA Sequence Number=SeqID_14241
  Gene Ontology: Mol. function=calcium ion binding; Cellular component =integral to membrane; Biological process=calcium-mediated signaling
  Homolog annotation: Hit_ID=Q1SF66; Match level="QueryCoverage=99%, HitCoverage=54%, E-value=1e-141, Identity=67%"; Hit description=C2
  Pfam annotation: Domain name=C2; Domain location=10-94; Score=108.4; E_value=2.1e-29; Accession=PF00168.20; Description=C2 domain
  Pfam annotation: Domain name=C2; Domain location=188-283; Score=97.6; E_value=3.8e-26; Accession=PF00168.20; Description=C2 domain
  Pfam module annotation: Pfam domain module=C2::C2; Domain location=10- 94::188-283
DLELKPEGILEVKLVQAKELTNKDIIGKSDPYAVVYIRPLRERMKKSKTINNDLNPIWNEHFEFVVEDVSTQHVTVKVYDSEGLQSSELIGCAQLQLSELQPGKVKDVWLKLVKDLEIQRDTKNRGQVHLELLYCPFGMENSFTNPFAPNYSMTSLEKVLKNANGVESNGNENAVTQKKKEVIIRGVLSVTVISAEDLPATDFMGKSDPFVVLTLKKAETKNKTRVVNDSLNPVWNQTFDFVVEDGLHDMLIVEVWDHDTFGKSKGQKKDLSCSNNAHVANRVGRKGKMEMVKRKITRERTSRLYGQMHIDAYQGNTGRGIQRTFCARWSQIWLFEFASQVDAATNFP

SEQ ID NO: 131020 - protein, 188 aa, Glycine max
  Coding DNA Sequence Number=SeqID_14242
  Gene Ontology: Mol. function=hydrolase activity; Cellular component =extracellular space; Biological process=biological_process
  Homolog annotation: Hit_ID=Q6YGT9; Match level="QueryCoverage=89%, HitCoverage=33%, E-value=2e-91, Identity=92%"; Hit description =Purple acid phosphatase-like protein
MVESSILVFLGLKNLSFITVKYTPQYMWLKEELKRVEREKTPWLIVLMHVPLYNSNGAHYMEGESMRSVFESWFIEYKVDVIFAGHVHAYERSYRYSNVDYNITGGNRYPLPNKSAPVYITVGDGGNQEGLASRFLDPQPEYSAFREASYGHSTLEIKNRTHAIYHWNRNDDGKKVPTDSFVLHNQYW

SEQ ID NO: 131021 - protein, 139 aa, Glycine max
  Coding DNA Sequence Number=SeqID_14243
  Homolog annotation: Hit_ID=Q84P56; Match level="QueryCoverage=30%, HitCoverage=12%, E-value=5e-12, Identity=73%"; Hit description =TGB12K interacting protein 2
EDPSLKHILEEIETGGPAAMMRYWNDEEVLRKLGQTMGVSLINVCFRDENLRADRQLEFTQLDMEMTFTPYEDMLTLNEELIRKDEGCEWIEYLFGWQWASLTKSDERQDENHEGRLQDKELAVLPGEKKNDLQRMRRK

SEQ ID NO: 131022 - protein, 404 aa, Glycine max
  Coding DNA Sequence Number=SeqID_14244
  Gene Ontology: Mol. function=ubiquitin thiolesterase activity; Cellular component=intracellular; Biological process=ubiquitin -dependent protein catabolic process
  Homolog annotation: Hit_ID=Q1RTH1; Match level="QueryCoverage=59%, HitCoverage=66%, E-value=8e-86, Identity=66%"; Hit description =Peptidase C19, ubiquitin carboxyl-terminal hydrolase 2; Zinc finger, FYVE/PHD-type
  Pfam annotation: Domain name=UCH; Domain location=103-388; Score =146.4; E_value=7.8e-41; Accession=PF00443.19; Description=Ubiquitin carboxyl-terminal hydrolase
MPPGHQIAVDVDRAELFCCACHDQVYDRDFDAAVVIAQTAASTLGGDPPPPIPSPQPENLRKKRRVDYRPWAPDLRERALIGSCSVPIAGAGTVADLSPDLPRGLRGLNNLGNTCFMNSVLQALLHTPPLRNYFLSDRHNRYFCQKKNNGDVDGALKRSGGNNGNKNARTCLACDMDAMFSSVFSGDRAPYSPAKFLYRSVYGDGVWWQHAANLATYEQQDAHEFFISMLDGIHEKVEKELTIAQAIRANFQPQPAVVMVLAATFLLHEFKPKLWNIYPDGMLEEIYKSRKIGFPFSLDMSPYLSSTILRNRFGNRIFPFDGDEPDASDELCSEFELFAVVTHSGKLDAGHYVTYLRLSNQWYKCDDAWVTQVDENIVRAAQCYMMFYVQKMLYYKATDKQVAS

SEQ ID NO: 131023 - protein, 794 aa, Glycine max
  Coding DNA Sequence Number=SeqID_14245
  Gene Ontology: Mol. function=protein translocase activity; Cellular component=chloroplast outer membrane; Biological process =intracellular protein transport
  Homolog annotation: Hit_ID=Q1RTE9; Match level="QueryCoverage=98%, HitCoverage=95%, E-value=0.0, Identity=74%"; Hit description=AIG1
  Pfam annotation: Domain name=AIG1; Domain location=171-371; Score =19.9; E_value=3e-12; Accession=PF04548.7; Description=AIG1 family
  Pfam annotation: Domain name=MMR_HSR1; Domain location=171-273; Score= 31.8; E_value=1.2e-06; Accession=PF01926.13; Description=GTPase of unknown function
  Pfam annotation: Domain name=Miro; Domain location=172-350; Score= -10.0; E_value=0.052; Accession=PF08477.3; Description=Miro-like protein
  Pfam module annotation: Pfam domain module=AIG1::MMR_HSR1::Miro; Domain location=171-371::171-273::172-350
  Subcellular localization annotation: CTP_CleavageSite=45; ConfidenceScore=5.01e-01
MKGVRDWVFSQILSKSLVSPSPLSASNSLYAGEHRNGDVNEQDHSASSVSSPIPSDSSNSSYGDQSNQHSSSLQLVSDTEIYQYQHNTNGRRKDTLAKVEELQVKFFRLLQRLGQSRENFLVAKVLYRMHLASLIRAKESDLKRVNHSSSRARAIASEQEATGMPQLDFCCRILVLGKTGVGKSATINSIFGQAKTTTGAFQPATNCIQEVVGNVNGLNLTFIDTPGFLPSSTNNMKRNKRVMLSIKRFIRKSSPDIVLFFERLDFINAGYVDFPLLKLVTEVFGSAIWFNTIIVMTHSSSAIPEGPDGYTFNYESYISYCTNIVQQHIQQAVFDSKVENPVLLVENHSRCPQNIMGEKILPNGQVWRSQLLLFCICTKVLGDVNSLLKFQNSVELGPLNSPRIPSMPHLLSSLLRHRLVSNLSGTDDEIEEILLSDKKEEDEYDQLPSIRVLTKSQFEKLPEPLKKDYLDEMDYRETLYLKKQLKEDYQRRKEKLLSTDKKFLNGDNPDDQQAPTEPVLLPDMAVPASFDSDCHSHRYRCLVSDDQLLVRPVLDLQGWDHDVGFDGINLETTTEIKKNVYASVVGQMNKNKQDFSIQSECTAAYVDPLGPTYSMGVDVQSSGKDFICTVHSNTKLKNIKHNIADCGVSLTSFVKKYYVGAKLEDTVFVGKRLKFVLNAGRMEGAGQMAYGGSFEANLRGEDYPVRNDNVSLTMTVLSFNKEMVLSGSLQSEFRLSRSSKASVSANLNSRKMGQICIKISSSEHLQIASVAILSIWKFLSRRKETKNLVKEVMD

SEQ ID NO: 131024 - protein, 263 aa, Glycine max
  Coding DNA Sequence Number=SeqID_14246
  Gene Ontology: Mol. function=metal ion binding; Biological process =ubiquitin cycle
  Homolog annotation: Hit_ID=Q2QXX4; Match level="QueryCoverage=30%, HitCoverage=35%, E-value=2e-09, Identity=38%"; Hit description=Zinc finger, C3HC4 type family protein, expressed
  Pfam annotation: Domain name=zf-C3HC4; Domain location=205-254; Score= 41.2; E_value=3.6e-09; Accession=PF00097.15; Description=Zinc finger, C3HC4 type (RING finger)
MNPMMIEPANISSSSSFNINPKIVEERMGPYHIRVINEQVVKPNPRDTLRFDVTVTLRQFSIYDWRLRLIRTSTLLETSTSISFQSLFEDNQDFLLSVLSNPECSHYFIPRSFDQISRNIVSVVQRALEVQSSPSSAESADFECEGFPLTLDIFVDTLEEVDEGRLALIEEESIQQEVAMIPASNEAIHSLQAFTDPLFLKTEKCNICMDEFYAQEGNEDDVKLLSSSSMPCGHVFHHQCIVKWLQTSHTCPLCRYPMPSVHD

SEQ ID NO: 131025 - protein, 135 aa, Glycine max
  Coding DNA Sequence Number=SeqID_14247
  Gene Ontology: Mol. function=aspartate-tRNA ligase activity; Cellular component=cytoplasm; Biological process=tRNA aminoacylation for protein translation
  Homolog annotation: Hit_ID=O81892; Match level="QueryCoverage=99%, HitCoverage=21%, E-value=2e-53, Identity=71%"; Hit description =Putative aspartate--tRNA ligase
  Pfam annotation: Domain name=tRNA-synt_2; Domain location=1-135; Score=-152.5; E_value=2e-05; Accession=PF00152.11; Description=tRNA synthetases class II (D, K and N)
MDPTTRGNLLRRCSTGPSDLILFAVGHHTSVNKTLDRLRVYVAHDLGLVDHGRHSVLWITNFPMFEWNDPEQRLEALHHPFIAPNPEDMNDLASARALAYDMVYNGVEIDGGSLRIYKCDIQQKVLEIVGISMEH

SEQ ID NO: 131026 - protein, 279 aa, Glycine max
  Coding DNA Sequence Number=SeqID_14248
MRRSVSGVHTWEICRPSNKMRPILVLWHTHLQLGQRIPFFNRSRTTCRQRSMSSVWCGPKMYEESSCYDPDAMMAEGAEDCFPQMVSESEAVMSATPTQTHTHNTFAYSYSCGEDAANANGPIAMEHPQQNPYNYSNTQFVEELYSNQQFTYHTPTPDLLDLLHLPNPIPGDNRTNVSSVSYDPYLHLNLQQQQQPTLRELLPHMPALRNDFPFGGAAGGDDIQDFGNGLVDFTQQEVGKRRGGKRTKQFTSTTTERQRRVDLSSKFDALKELIPNPSK

SEQ ID NO: 131027 - protein, 94 aa, Glycine max
  Coding DNA Sequence Number=SeqID_14249
MDIDYAIRKDEPPAITDERSLADVALYERWERSNRLSVMFIKTKISAGIRGSVDQHEKVRDLLKAIDDQFITSDKTLASIMIMKFSSLRFTSVT

SEQ ID NO: 131028 - protein, 43 aa, Glycine max
  Coding DNA Sequence Number=SeqID_14250
MAGLDSNKEGSPEKRQSKLRWADRIEKFWVCTHDQVQAYSNRL

SEQ ID NO: 131029 - protein, 46 aa, Glycine max
  Coding DNA Sequence Number=SeqID_14251
MEEEPFDGVLLSSMEFLKIQWCNVATAVMLRIQNHSKPIIIQTSYL

SEQ ID NO: 131030 - protein, 77 aa, Glycine max
  Coding DNA Sequence Number=SeqID_14252
MKLCGRQRYPSGYPYKHSFTIRKTQSMIACRDNRCLLHPLSIATNELVDTWRFTSSSVLSVSQTREGRRRYPKWLFV

SEQ ID NO: 131031 - protein, 60 aa, Glycine max
  Coding DNA Sequence Number=SeqID_14253
MTASTDEDVNLCVSTGSLAAIDKGCRRRRYLRTSPDFTGRDERKCGRQCKSQRVNGLIGF

SEQ ID NO: 131032 - protein, 183 aa, Glycine max
  Coding DNA Sequence Number=SeqID_14254
  Homolog annotation: Hit_ID=Q1SSE9; Match level="QueryCoverage=63%, HitCoverage=9%, E-value=2e-45, Identity=67%"; Hit description=N-6 Adenine-specific DNA methylase
MNLIGEGKFGEVYKGLLQHGILVAIKKRRGLASQEFFHEVIRMNNVLIAGDEFQVGSNGMLDDWEENLAVITANRTKVDEANFESYSDSARLYLIGANHWKCPRTYASPEAIQRTELYEYSKVVGNSQFTLHPFQPYKLIYAFMLAEVGKVSDSLKYCQALLKSLKTGCAGKPRIVEAISSIS

SEQ ID NO: 131033 - protein, 136 aa, Glycine max
  Coding DNA Sequence Number=SeqID_14255
  Subcellular localization annotation: CTP_CleavageSite=54; ConfidenceScore=5.31e-01
MNTPRPRISSSSRFLNSSPSLTSPPSLCILSPSELHFFQESEHVIMRETIVRTRSGAVLEVVLRSPGMSFDVMGVENEGKKKREKLKAMPPQITLLPSLALRLIFPLTTKVNHQSGGGSTTALWWGFDRGAVAAQV

SEQ ID NO: 131034 - protein, 677 aa, Glycine max
  Coding DNA Sequence Number=SeqID_14256
  Gene Ontology: Mol. function=Rab GTPase activator activity; Cellular component=intracellular; Biological process=regulation of Rab GTPase activity
  Homolog annotation: Hit_ID=Q5SMT0; Match level="QueryCoverage=70%, HitCoverage=76%, E-value=1e-123, Identity=46%"; Hit description =GTPase activating protein-like
  Pfam annotation: Domain name=TBC; Domain location=485-662; Score= -61.1; E_value=0.0032; Accession=PF00566.9; Description=TBC domain
MDMKRGIISGNAAASIRVRSGGEGKGRRRRKESSRIQELRTLGRWTPKETQSIARKRNPYIAAVYFGCFNHPTVQILRSEFRNRVEDKRVTNVTFLSILFIFPHHGFFLRYEDIPLFLSHSFQFSAKSPMLESELHDLSDDADYAASQQQGSASVMLRSDSAKQSSPRNGAEIVFSKDNVAIHPTQFASERISGRLKLIKQSSSLFMVIAAHSSEARLSDKDRNLYTIRAVPFTDIRSIRRHNPALGWQYVIVVLSSGVKEFLATIKQHVLLVRSEEDANVFLVNDFQNTLQRTLSSLEMPRAVPLACGPSNTSVDESILIENQERADNGANDGRFSVNQFHGRPRHKVDPARDLSIQVLEKFSLVTRFARETTSQLFGENQSNGFSPIDRRTHIQTNLDHPKSSNVEENTSVESPVVLDSQEFDNLSLVWGKPRQPPLGSEEPQGWWFNPTSTKGMAYEEFIKWNAFLDSEGRVTDSEALRKRVFYGGLDHELQNESISSAQAKRFTKFRERKGLIEKDVVRTDRSLAFYEGDDNPNVNVLRDILLTYSFYNFDLGYCQGMSDLLSPILFVMDNESEAFWCFVALMERLGPNFNRDQNGMHSQLFALSKQMDFDTLLKFINELSGHIDLDATLRDAEALCICAGENGAARIPPGTPPSLPHEDGSFYAQQEQDEIL

SEQ ID NO: 131035 - protein, 110 aa, Glycine max
  Coding DNA Sequence Number=SeqID_14257
MALLLIGVSRGSVVPLPLLPFASLLHHLLEKVLQDCGNDIDSAIRSLNQLRLGGAPPPPSLDSTLIASDTAPPQFQGEAKCDAEVAGSDDPVAGLNYPTNGAEWVELFVN

SEQ ID NO: 131036 - protein, 316 aa, Glycine max
  Coding DNA Sequence Number=SeqID_14258
  Gene Ontology: Mol. function=protein serine/threonine kinase activity; Cellular component=chloroplast; Biological process=protein amino acid phosphorylation
  Homolog annotation: Hit_ID=Q5VRF2; Match level="QueryCoverage=89%, HitCoverage=70%, E-value=1e-115, Identity=72%"; Hit description =Putative serine/threonine protein kinase
  Pfam annotation: Domain name=Pkinase; Domain location=108-316; Score =42.2; E_value=4.5e-11; Accession=PF00069.15; Description=Protein kinase domain
  Pfam annotation: Domain name=Pkinase_Tyr; Domain location=108-316; Score=19.4; E_value=1.2e-13; Accession=PF07714.7; Description =Protein tyrosine kinase
  Pfam module annotation: Pfam domain module=Pkinase::Pkinase_Tyr; Domain location=108-316::108-316
MNMKVVVVSMENEKKKCGCWAVLKRGVRGACKPSSASRDSPNTIPRTSLVYDAATETRYLNASNRELCPPNEARLSSDNPDPPSQENKVPCQLLQFTFQELKAATGNFRPDSILGEGGFGYVFKGWIEEDGTAPAKPGSGITVAVKSLKPDGLQGHREWVAEVDFLGQLHHPNLVKLIGYCIEDDQRLLVYEFMTRGSLENHLFRRTVPLPWSNRIKIALGAAKGLAFLHNGPEPVIYRDFKTSNILLDTEYNAKLSDFGLAKAGPQGDKTHVSTRVVGTYGYAAPEYVMTGKNVAVGSLKGQENSLVSNAAQELL

SEQ ID NO: 131037 - protein, 229 aa, Glycine max
  Coding DNA Sequence Number=SeqID_14259
  Gene Ontology: Mol. function=calcium ion binding; Cellular component =flagellin-based flagellum; Biological process=ciliary or flagellar motility
  Homolog annotation: Hit_ID=O22845; Match level="QueryCoverage=65%, HitCoverage=67%, E-value=6e-37, Identity=50%"; Hit description =Putative calcium binding protein
  Pfam annotation: Domain name=efhand; Domain location=109-137; Score =29.6; E_value=1.1e-05; Accession=PF00036.22; Description=EF hand
  Pfam annotation: Domain name=efhand; Domain location=156-184; Score =39.1; E_value=1.5e-08; Accession=PF00036.22; Description=EF hand
  Pfam annotation: Domain name=efhand; Domain location=194-222; Score =37.4; E_value=4.9e-08; Accession=PF00036.22; Description=EF hand
  Pfam annotation: Domain name=efhand; Domain location=73-101; Score =38.3; E_value=2.6e-08; Accession=PF00036.22; Description=EF hand
  Pfam annotation: Domain name=efhand_like; Domain location=73-148; Score=-9.7; E_value=0.068; Accession=PF09279.1; Description =Phosphoinositide-specific phospholipas
  Pfam module annotation: Pfam domain module=efhand::efhand::efhand::efh and::efhand_like; Domain location=109-137::156-184::194-222::73 -101::73-148
  Subcellular localization annotation: CTP_CleavageSite=52; ConfidenceScore=5.24e-01
MDLSTLLLAVLFIAGLINIFFYVPTTKIGAWLQTFLFPNNNACNKTKTNLVPSSSSSPTTKVESTGSQKKKEELRKVFSTFDKNGDGFITKQELRESLRNIRIFMTEQEVDDIVVKYDSNGDGLIDFEEFCLLTSECVGVDHEKEGDGVIENEEVDLKEAFDVFDKDNDGLISVEELALVLTSLGLREGRKIEECKEMIKKVDMDGDGMVNFNEFKRMMMNGGKFFFNA

SEQ ID NO: 131038 - protein, 275 aa, Glycine max
  Coding DNA Sequence Number=SeqID_14260
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=P52559; Match level="QueryCoverage=100%, HitCoverage=75%, E-value=1e-118, Identity=81%"; Hit description =Phosphoribosylaminoimidazole carboxylase ATPase subunit
  Pfam annotation: Domain name=ATP-grasp; Domain location=107-275; Score=180.5; E_value=4e-51; Accession=PF02222.12; Description=ATP -grasp domain
  Pfam annotation: Domain name=Dala_Dala_lig_C; Domain location=107 -271; Score=-119.6; E_value=0.079; Accession=PF07478.3; Description=D- ala D-ala ligase C-terminus
  Pfam annotation: Domain name=GARS_A; Domain location=105-266; Score= -89.0; E_value=0.00023; Accession=PF01071.10; Description =Phosphoribosylglycinamide synthetase,
  Pfam module annotation: Pfam domain module=ATP-grasp::Dala_Dala_lig _C::GARS_A; Domain location=107-275::107-271::105-266
MNTSVLKPGATIGIIGGGQLGRMLAMAAARLGFQTVILEPQVDCPAAQVANRQIVAVYDDPKALAELAAASDVITYEFENVPVSAADRLAETALVLPPPAALEVSQDRFAEKQFLNESDIETAPWRLVDDEESLIAALGALGERGILKTRRLGYDGKGQVRLTSLDESEAHKAILAINRAPAILESFVDFEREVSVIAARDRSGNVAIFDIAENVHKDGILATSTVPAAISENTAEAARKAATKLLNALDYIGVLGLEFFVLKDGTLLANEFAPR

SEQ ID NO: 131039 - protein, 215 aa, Glycine max
  Coding DNA Sequence Number=SeqID_14261
  Gene Ontology: Mol. function=protein serine/threonine kinase activity; Cellular component=beta-catenin destruction complex; Biological process=protein amino acid phosphorylation
  Homolog annotation: Hit_ID=P43289; Match level="QueryCoverage=99%, HitCoverage=49%, E-value=1e-110, Identity=87%"; Hit description =Shaggy-related protein kinase gamma
  Pfam annotation: Domain name=Pkinase; Domain location=1-152; Score= -16.8; E_value=1.5e-07; Accession=PF00069.15; Description=Protein kinase domain
VNPHTHQVKICDFGSAKVLVKGEPNISYICSRYYRAPELIFGATEYTTAIDIWSVGCVLAELMLGQPLFPGESGVDQLVEIIKVLGTPTREEIKCMNPNYTEFKFPQIKAHPWHKIFHKRMPPEAVDLVSRLLQYSPNLRCTALDTLTHPFFDELRDPNTRLPNGRFLPPLFNFKSHVLADVLAARVPELKGVPVEILVKLIPEHARKQCPFLGL

SEQ ID NO: 131040 - protein, 145 aa, Glycine max
  Coding DNA Sequence Number=SeqID_14262
MESSNVKNKSSGKRKMSSEDTRSYFAWNLEIERVLADVLRDQRNLGNKVIPNWDDIVDLCAKDRATGLGAENALDVDDIMSKETNEEEAIHSASFDLEGSSSATRKNIRPSKSGEKEGMISSMKEVVESLKEFVEVTKKKMENKK

SEQ ID NO: 131041 - protein, 192 aa, Glycine max
  Coding DNA Sequence Number=SeqID_14263
  Gene Ontology: Mol. function=glucose-6-phosphate 1-dehydrogenase activity; Cellular component=chloroplast; Biological process =carbohydrate metabolic process
  Homolog annotation: Hit_ID=Q93ZW0; Match level="QueryCoverage=75%, HitCoverage=26%, E-value=2e-22, Identity=39%"; Hit description =Glucose-6-phosphate 1-dehydrogenase 4, chloroplast precursor
  Subcellular localization annotation: CTP_CleavageSite=57; ConfidenceScore=5.72e-01
MSVSFSSTSVSFSESSFAFQRPAPAHLCSNSLTVASNNFHSATGGGRLVLNVGGTCLCRKFRGLKLWLLERLSFQFQPPKQPKNRNHHFRNNLENEKGSVSDSSSNLRVPDDKVTPVESLSLLQTGLSGTPVDVGRKPSLCIAVIGATGELAKRKIFPALFALYYSGFLPEDWTYASGPITSSSTGLITTLA

SEQ ID NO: 131042 - protein, 416 aa, Glycine max
  Coding DNA Sequence Number=SeqID_14264
  Gene Ontology: Mol. function=hydrolase activity, acting on ester bonds; Cellular component=cellular_component; Biological process =lipid metabolic process
  Homolog annotation: Hit_ID=Q5ZDS5; Match level="QueryCoverage=92%, HitCoverage=76%, E-value=1e-83, Identity=43%"; Hit description =Putative early nodule-specific protein ENOD8
  Pfam annotation: Domain name=Lipase_GDSL; Domain location=34-398; Score=232.5; E_value=8.9e-67; Accession=PF00657.12; Description=GDSL- like LipaseAcylhydrolase
MMGCGGAISVSLLLLLLSCFTEIALAGCDKAPVLFVFGDSNSDTGGLASGLGFPINPPNGRNFFHRSTGRLSDGRLLIDLLYSNLGTFHLPSCTLSSLPSDSDQFDIEQPRVTEIEGQMPHLWLVTTCDYEVGGGLSLNASLLVPYLDALSGTSFTNGANFAVVGSSTLPKYVPFSLNIQVMQFRRFKARSLELVTAGARNLINDEGFRDALYLIDIGQNDLADSFAKNLSYAQVIKKIPAVITEIENAVKNLYNDGARKFWVHNTGPLGCLPKILALAQKKDLDSLGCLSSYNSAARLFNEELLHSTQKLRSELKDATLVYVDIYTIKYDLITNAAKYGFSNPLMVCCGYGGPPYNFDVRVTCGQPGYQVCDEGARYVSWDGIHQTEAANTLIASKILSMAYSTPRTPFDFFCHQ

SEQ ID NO: 131043 - protein, 146 aa, Glycine max
  Coding DNA Sequence Number=SeqID_14265
MEGEERRKRKIENEEENEEQKMEKFFALIKRTKDVRDRFCKEKLTDTKKIDGERAAAVSTIWNPKFQPEDFIDSGETAKRNNIINIVSGHDHAAVPSEKELIIEKKQDLQEATTATPAAAQDNEEKDKAIFVALDHDFDPKVVVVH

SEQ ID NO: 131044 - protein, 155 aa, Glycine max
  Coding DNA Sequence Number=SeqID_14266
  Homolog annotation: Hit_ID=UPI000044A741; Match level="QueryCoverage =47%, HitCoverage=18%, E-value=1e-09, Identity=53%"; Hit description =PREDICTED: similar to Ac1147, partial
PDIVRIDRLRALSDSMGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 131045 - protein, 105 aa, Glycine max
  Coding DNA Sequence Number=SeqID_14267
MPEVEREHCRAIRKVLQHAGRQKRDYCVIRKVSRHYGKKNSFEAGLLLEEATQLGVLGDNLLPLFPINRRKGVVPNIPNPLGYAFQLFWVKKIVSVKKIQAKVLP

SEQ ID NO: 131046 - protein, 357 aa, Glycine max
  Coding DNA Sequence Number=SeqID_14268
  Gene Ontology: Mol. function=glutamate synthase (NADPH) activity; Cellular component=membrane; Biological process=nitrogen compound metabolic process
  Homolog annotation: Hit_ID=Q1GXP0; Match level="QueryCoverage=98%, HitCoverage=19%, E-value=1e-126, Identity=65%"; Hit description =Glutamate synthase
  Pfam annotation: Domain name=GXGXG; Domain location=1-120; Score =25.2; E_value=2.4e-08; Accession=PF01493.9; Description=GXGXG motif
  Subcellular localization annotation: CTP_CleavageSite=42; ConfidenceScore=5.10e-01
MSPGGGAQDSDGNVLIGNFALFGSTGGRLFVQGQAGDRFAVRNSGATAVVEGVGDFCCEYMTNGAILNLGTFGKGFGNGMSGGFAYQYDPYRSLAAHAAGDSVLFGSIADEDEMAQVHKQAVLTMLHWHLEATQSPRAAWLLENWETECQHFVYVMPRSLLLYQDGGEILKAKTRKDLLEELSTSLAAHQVAKFKSAWRAGKTIADGAVPAYGATDTQEMFVLLNNYTVLSFAQQLALGKLPKGTAVEDAAVEKAVRNLLMTEDFALVSKLQRHARAAIENYSDDELASLIAAKRMSDYKAALTQRNIRSMDSLATYGWIIYQDACNREVLGHLPDFEELFARAALPEIAAAVGKLS

SEQ ID NO: 131047 - protein, 357 aa, Glycine max
  Coding DNA Sequence Number=SeqID_14269
  Gene Ontology: Mol. function=electron carrier activity; Cellular component=endoplasmic reticulum; Biological process=electron transport
  Homolog annotation: Hit_ID=Q1GXP1; Match level="QueryCoverage=100%, HitCoverage=61%, E-value=1e-107, Identity=56%"; Hit description =Flavodoxin/nitric oxide synthase
  Pfam annotation: Domain name=FAD_binding_1; Domain location=213-356; Score=-23.7; E_value=1.8e-06; Accession=PF00667.10; Description=FAD binding domain
  Pfam annotation: Domain name=Flavodoxin_1; Domain location=53-184; Score=146.0; E_value=1e-40; Accession=PF00258.15; Description =Flavodoxin
  Pfam module annotation: Pfam domain module=FAD_binding_1::Flavodoxin _1; Domain location=213-356::53-184
MKIPYIPEDAPFNGEQKYWLAGFLAGLHSRLLVLEDKQTAPAAGASATTQLHILFGSQTGNAEALAQTAAKAARAKGLVPVVQALGEVDLDVFATMRHVLIVTSTYGEGEMPDNAQLFWQAISASTAPRLEQMHFAVLAIGDTGYDGFCQAGKFIDMRLEQLGAKRVVDRIDCDIDYEEPSSEWIGSAMPQFAASAGSSGTVLESAPEAPVIPGSNKQNPYAAALVTNKRLSGEQSAKDIRHFEFDLSDSGLKYEAGDALGVIPVNDAGLVSLLLSELKADYETPVPGFDRNLGDLLTYQFEISEPSRKLIEWVGQHTTNQELLHVLQHDDKDTLANWLWGKDTLDLLQLELKRSLS

SEQ ID NO: 131048 - protein, 74 aa, Glycine max
  Coding DNA Sequence Number=SeqID_14270
MTIRGGDGGTASSSGEKGGFTTGDCGLAGSEFTCTGTKVSELWISYPTVTDRGVGVDDEGMSSVLALFLDSICN

SEQ ID NO: 131049 - protein, 153 aa, Glycine max
  Coding DNA Sequence Number=SeqID_14271
  Gene Ontology: Mol. function=double-stranded RNA binding; Cellular component=intracellular; Biological process=metabolic process
  Homolog annotation: Hit_ID=Q9C5Q8; Match level="QueryCoverage=73%, HitCoverage=11%, E-value=9e-39, Identity=65%"; Hit description =CORYMBOSA2
MDEDQACLFGDVALSSFRPRILIVSTPNFEYNVVLQKSNPPTQEQEESDEKTLLQSCKFRNHDHKFEWTREQFTQWACDLAARHNYNVEFSGVGGSADVEPGYASQIAVFKRDWKLEDDVIGLPVFLKADKQDRLWMLGEKRKRIYRFRQGTD

SEQ ID NO: 131050 - protein, 268 aa, Glycine max
  Coding DNA Sequence Number=SeqID_14272
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9ZPL8; Match level="QueryCoverage=68%, HitCoverage=79%, E-value=2e-30, Identity=40%"; Hit description =Protein phosphatase type 2C
  Pfam annotation: Domain name=PP2C; Domain location=68-263; Score= -19.7; E_value=8.4e-05; Accession=PF00481.12; Description=Protein phosphatase 2C
QPEDNFTIEENYNENKDKNDVGDNTDAEKANDDDDDVVDDHQEEAKYLPEDDGPTATEEQHYKGPVTKDADEKNKPPTRHFIHGYHLIQGQMNQHRNLDGYDLGLYAIFEGHSVHAVKKACKAMDDEILESIADSRGGSTAVAAILINGVKLLVVNVGDSRAISCKNGRAKPHTVDHEPEKEKDLIESRGGFVSKKPVRECSQSGWPISNGMSIWRWKTEGAHYGRTIRKIDEDTEFIILASDGLWKVRGYCMYLMITDEDTLAEVEH

SEQ ID NO: 131051 - protein, 646 aa, Glycine max
  Coding DNA Sequence Number=SeqID_14273
  Gene Ontology: Mol. function=methyltransferase activity; Cellular component=intracellular; Biological process=metabolic process
  Homolog annotation: Hit_ID=Q9C5Q8; Match level="QueryCoverage=99%, HitCoverage=77%, E-value=3e-91, Identity=47%"; Hit description =CORYMBOSA2
  Pfam annotation: Domain name=dsrm; Domain location=7-63; Score=28.6; E_value=2.2e-05; Accession=PF00035.15; Description=Double-stranded RNA binding motif
ACYVVEEVKELPQTECPGLSIPQMGPCLYRCTLQLPELSVVSGTFKKKKDAEQSAAEIAIEKLGICTEAIDPTPQEAQESLVSRIAYIFSEKFVVCDHPLSGHIRATLLRKGDLCGSIPISVIAFYDAKLFSLCKCINPEVESNPFLVISYIMNATANLHQFLATSERHLWIRRLSPYPQDIIESLMKENGSQECIQVTAVHIPSSVEQSIEAVTLHISSREYYLDIIAYELGFEDASNVLISRNLGKASSETRLFFTASKSYLLDLSSKFPNGKETLYLKGSLNVRASYFAGQDITGDAILASIGYTRKSRDLFYEDVTVRLYYRQCSHLSCHQDSPQEQTGGVLFPGIYFVAESDENVIECVNGDCYKKQNDAIQNASLKVLSWLNMCFRSMILPFEQLYETADNFNIQIYFKNIIRDILAGQSTHNGQLNGIQCNNLVESIYMNSSCDMLGNIVHSLKIEGPYSGVCPSNGSLPCIRYSVSLAVEGENLKEVIEVCDEFEFEVGIGAVVSYVEDVVMQMSVGQCAYFSSNLLTTELIFASAGDSVKMLASLSSKDCCMEYEISLIRVAEPPEERMEQALFSPPLSKQRVEFAVQQILESHATTLIDFGCGSGSLLEALLNYPTSLKKMAGVDISQKGLSRAAK

SEQ ID NO: 131052 - protein, 392 aa, Glycine max
  Coding DNA Sequence Number=SeqID_14274
  Gene Ontology: Mol. function=protein binding; Cellular component =cellulose and pectin-containing cell wall; Biological process =protein amino acid phosphorylation
  Homolog annotation: Hit_ID=Q9ZT98; Match level="QueryCoverage=97%, HitCoverage=96%, E-value=1e-153, Identity=70%"; Hit description =Putative leucine-rich repeat protein
  Pfam annotation: Domain name=LRRNT_2; Domain location=24-65; Score =46.0; E_value=1.2e-10; Accession=PF08263.3; Description=Leucine rich repeat N-terminal domain
  Pfam annotation: Domain name=LRR_1; Domain location=121-143; Score =14.6; E_value=0.37; Accession=PF00560.23; Description=Leucine Rich Repeat
  Pfam annotation: Domain name=LRR_1; Domain location=145-167; Score =19.4; E_value=0.013; Accession=PF00560.23; Description=Leucine Rich Repeat
  Pfam annotation: Domain name=LRR_1; Domain location=169-190; Score =11.8; E_value=1.8; Accession=PF00560.23; Description=Leucine Rich Repeat
  Pfam annotation: Domain name=LRR_1; Domain location=192-212; Score =9.9; E_value=4; Accession=PF00560.23; Description=Leucine Rich Repeat
  Pfam annotation: Domain name=LRR_1; Domain location=215-237; Score =13.2; E_value=0.95; Accession=PF00560.23; Description=Leucine Rich Repeat
  Pfam annotation: Domain name=LRR_1; Domain location=239-261; Score =11.5; E_value=2; Accession=PF00560.23; Description=Leucine Rich Repeat
  Pfam annotation: Domain name=LRR_1; Domain location=262-283; Score =6.8; E_value=15; Accession=PF00560.23; Description=Leucine Rich Repeat
  Pfam annotation: Domain name=LRR_1; Domain location=284-303; Score =6.7; E_value=16; Accession=PF00560.23; Description=Leucine Rich Repeat
  Pfam annotation: Domain name=LRR_1; Domain location=305-328; Score =13.1; E_value=1; Accession=PF00560.23; Description=Leucine Rich Repeat
  Pfam annotation: Domain name=LRR_1; Domain location=332-362; Score =6.6; E_value=17; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1; Domain location =24-65::121-143::145-167::169-190::192-212::215-237::239-261::262 -283::284-303::305-328::332-362
MDDVVAFCTLLFVCFLHSVRGILDPNDFLALQSIRKSLHDVPGSNFFSSWDFTADPCNFAGVFCADDKVIALNLGDPRAGSPGLTGKLDPSISKLSALADFTVVPGRIYGPLPQSLSQLKNLRFLGVSRNFISGEIPAGLGQLRNLRTIDLSYNQLSGAIPPSIGKMPQLTNLFLCHNRLSGSVPSFASAYSLTHLELKHNILSGSLAQDSLPASLQYLSLSWNRFTGPVDGLLTRLNRLNFLDLSLNQFTGPIPAQIFTFPLTNLQLERNQFSGPIQPFNEVMIQTVDLSYNRLSGEVSPMLANVQNLYLNNNGFTGQVPGSFVERLLAAGIQILYLQHNFLTGIAISPTAEIPVSSTLCLQYNCMVPPVQTACPFNAGRRKIRPPQQCNR

SEQ ID NO: 131053 - protein, 664 aa, Glycine max
  Coding DNA Sequence Number=SeqID_14275
  Gene Ontology: Mol. function=histone lysine N-methyltransferase activity (H3-K4 specific); Cellular component=nucleolus; Biological process=regulation of transcription, DNA-dependent
  Homolog annotation: Hit_ID=Q1S808; Match level="QueryCoverage=99%, HitCoverage=100%, E-value=1e-134, Identity=44%"; Hit description =Plus-3
  Pfam annotation: Domain name=Plus-3; Domain location=281-390; Score =126.8; E_value=6e-35; Accession=PF03126.8; Description=Plus-3 domain
MADLENMLLEAAGRTSSPVSKRPKPKNSKAKREGGAGAAFSDGGSDSRDENSDEGAGKKPQRYSSHVPLKKRLDMNKRGNNNNDRGGAELEDGVPDPDRDGGSSEESDVGSDLYKDEDDKQKLANMTELEREMILSDRATKKCEKEFKKKMRVKRENKKANAKTTTTNTTTANSSHHPSSVKVRSSARHAERTASKGDVLSELRAKRKKQQVLEPRDKLRNALGTGSSSKQKPGITASPSSSSQSESAFRSDSERDSSDDGGLGDSDDDKSMHESKMPTFENIRDITIRRSKLVKWLNEPFFDELIVGCFVRIGIGKLENVPVYRLCIVQRVDGGDPNKHYKVENRVTHKYLVCVWGSDNSAKKFQMAVVSDSAPLEKEFRQWVREHERTCSQMPSKMSVLEKKEAIRRTSKYVYSAATVKQMLEEKKSVPSRPLNVAVEKDRLKNLLEVAKSKNDEAEMDRILKKLVELEASRRTWENDAKAVRLAEMNRKNRVENFKMLSEQKQFNTNLKAGEEGVDPFSRRWTRSRNYYGKEAEKNEDKREKDGEVSKVGEKEQEKGGVTTKVGVEVTELALQAAANAGKLIDTNAPVDGGTELHMLHDFDLPISLAELKSFGGPQGLKNGFLARKQKIEATVGLQVSEKDGSRHALTLSISDYKRRRGLL

SEQ ID NO: 131054 - protein, 37 aa, Glycine max
  Coding DNA Sequence Number=SeqID_14276
MVDDQNSHFKMADMCPMQLEAIASGLQWHRPQVPVIS

SEQ ID NO: 131055 - protein, 64 aa, Glycine max
  Coding DNA Sequence Number=SeqID_14277
  Gene Ontology: Mol. function=protein binding; Biological process=two -component signal transduction system (phosphorelay)
  Homolog annotation: Hit_ID=Q659H9; Match level="QueryCoverage=95%, HitCoverage=40%, E-value=6e-14, Identity=59%"; Hit description =Putative histidine-containing phosphotransfer protein 1
MDVSQLQRKHRDHQTAMLREGFLEDQFNQLQKLQDESSPYFVMEVVTMFFGDSEKLLNSIALVL

SEQ ID NO: 131056 - protein, 652 aa, Glycine max
  Coding DNA Sequence Number=SeqID_14278
  Gene Ontology: Mol. function=hydrolase activity, acting on glycosyl bonds; Cellular component=membrane; Biological process=metabolic process
  Homolog annotation: Hit_ID=Q84JL5; Match level="QueryCoverage=86%, HitCoverage=89%, E-value=0.0, Identity=68%"; Hit description =Putative alkaline/neutral invertase
  Pfam annotation: Domain name=GDE_C; Domain location=215-603; Score= -219.9; E_value=0.0052; Accession=PF06202.4; Description=Amylo-alpha -1,6-glucosidase
  Pfam annotation: Domain name=Invertase_neut; Domain location=161-630; Score=1206.9; E_value=0; Accession=PF04853.3; Description=Plant neutral invertase
  Pfam module annotation: Pfam domain module=GDE_C::Invertase_neut; Domain location=215-603::161-630
MKPSPKILIGYKNSSFLARCHHTLAMSMSNYSNSCDINIYRNTMQCPFHMREFGRIMHGNHQVFGLPSSSFGQSRSLSLSSTKRDASSIAGVDLNFKARDFSGSVGTRVDDNNGEMAYVKGGMNVKPIVVESVEEESRLEVGEEDENKENSGGVKNADEAENVQEETEAEKEAWRLLQEALVTYCDSPVGTVAANDSDSEQPLNYDQVFIRDFIPSALAFLLKGEKDIVKNFLLHTLQLQSWEKTVDCYSPGQGLMPASFKVKTLKLDHEKTEVLDPDFGESAIGRVAPVDSGLWWIMLLRAYGKITGDYGLQERLDVQTGLRMILNLCLTDGFDMFPSLLVTDGSCMIDRRMGIHGHPLEIQALFYSALRSAREMVTEDENSKNLVGEINNRLSALSFHIREYYWLDMRKINEIYRYKTEEYSLDATNKFNIYPDQIPTWLMDWIPEEGGYLLGNLQPAHMDFRFFMLGNLWSIVSSLGTPRQNNAILNLIDAKWGDLVGEMPLKICYPALEHHEWRIITGCDPKNTPWSYHNGGSWPTLLWQFTLACMKMERTELAEKAIALAEKRLPRDSWPEYYDTRSARFVGKQARLYQTWTLAGFLASKMLLKNPKLASLLCWDEDLEILETCVCLLHKSGRIKCSRDVAKSQILV

SEQ ID NO: 131057 - protein, 121 aa, Glycine max
  Coding DNA Sequence Number=SeqID_14279
  Subcellular localization annotation: CTP_CleavageSite=64; ConfidenceScore=5.48e-01
MNNLGQLKPIGSGGGAPVGRSFGNDTFRQPGINFPRTRAFFCTAVLDLLVVPLPLLPPPAERICENGAAPASSAFGSGGEDAVCGGADLEGGGRVAVAAEREEEVGRVEAVLGMGSPGSES

SEQ ID NO: 131058 - protein, 729 aa, Glycine max
  Coding DNA Sequence Number=SeqID_14280
  Gene Ontology: Mol. function=protein binding; Cellular component =nucleus
  Homolog annotation: Hit_ID=UPI00006604AC; Match level="QueryCoverage =55%, HitCoverage=45%, E-value=5e-33, Identity=26%"; Hit description =Homolog of Homo sapiens "Splice Isoform 3 of Breast carcinoma amplified sequence 3
  Subcellular localization annotation: CTP_CleavageSite=33; ConfidenceScore=5.46e-01
MKKGKGKNNGLLPNSLRIISLCLKTVSTNATTVASTVRSAGASVAASISSSSEDHKDQVTWAGFDTLELDPANLKRVLLLGYLNGFQVLDVEDASGFRELVSKRDGPVSFLQMQPFPVGCDGQEGFRKSHPLLLVVSGDDTSNANQNSTSLSGLGRDGNFETQPGNNVNSSTVVRFYSLKSHCYVHVLRFRSTVCMIRCSSRIVAVGLATQIYCFDAVTLENKFSVLTYPVSQFAGQGTTGVNVGYGPMAVGPRWLAYASNNPLPSNLGCLSPQNFSDSPGISPSTSPSSGSLVARYAVESSRHLAAGIIKYCQELLPDGSSSPIQSNSGVKVNRVTGIDADNAGMVVIKDFVSRSIISQFKAHTSPISALCFDPSGTLLVTASVYGNNINIFRIMPSFTCKSSGIPSSNWNSSHVHLYKLHRGITPAMIQDICFSNFSQWIAIVSSKGTCHLFVLSPFGGDTGFRIISSQGEEPFLLPVFSLPWWYTPASISYQQSLPPPAPVVLSVASRIKYSSFGWLNTVHNSSANVTGKVFVPSGAIAAIFHNSLSHSQQLVNSKAKPLEHILVYTPSGHVVQHELLASVGLGTTDNGLRNQSTSLLHMQEDEFRVKVEPIQWWDVCRRSEWPERGDTCCNTFDRQGGIERVQEKISYSDVHGLNFLGTRDRAGEKMVRSSNENMHDRFHWYLSNAEVQRNFGRLPIWQKSKGYEFVVNNFASSDLLLFNELCGS

SEQ ID NO: 131059 - protein, 70 aa, Glycine max
  Coding DNA Sequence Number=SeqID_14281
MPQPHGINMGLKEHSNRVSLPPRPRLRRIRLGLTFLIQTLFMSYIIPTTSLLYSNIFNKMRYSLTLQDPN

SEQ ID NO: 131060 - protein, 211 aa, Glycine max
  Coding DNA Sequence Number=SeqID_14282
  Gene Ontology: Mol. function=electron carrier activity; Cellular component=membrane; Biological process=electron transport
  Homolog annotation: Hit_ID=Q10ME8; Match level="QueryCoverage=56%, HitCoverage=11%, E-value=8e-27, Identity=50%"; Hit description=HAD -superfamily hydrolase, subfamily IA, variant 3 containing protein, expressed
MNEAEDALAGLQAVKAAQMRCIAVRTTLSDETLEPAGPTLIRDNIGSVSLDDILSGGSVGYNKRMQGSETLNNFAESSSTVLAGGLQGSRQDILRFGSLGIAISCLFFTISNWKLIAIQQAMQYASPKAVWNQFFGVTQPPLEQKEDNSRDDRIQQFENYISDLESRISKCILGENCEKRLGGVRRRGWGTGVWLPCASYSACSRGATSSA

SEQ ID NO: 131061 - protein, 501 aa, Glycine max
  Coding DNA Sequence Number=SeqID_14283
  Gene Ontology: Mol. function=protein serine/threonine kinase activity; Cellular component=membrane; Biological process=protein amino acid phosphorylation
  Homolog annotation: Hit_ID=Q8LI83; Match level="QueryCoverage=96%, HitCoverage=77%, E-value=1e-114, Identity=49%"; Hit description =Receptor protein kinase PERK1-like protein
  Pfam annotation: Domain name=Pkinase; Domain location=302-501; Score =77.9; E_value=3.2e-20; Accession=PF00069.15; Description=Protein kinase domain
  Pfam annotation: Domain name=Pkinase_Tyr; Domain location=302-501; Score=24.1; E_value=6e-14; Accession=PF07714.7; Description=Protein tyrosine kinase
  Pfam module annotation: Pfam domain module=Pkinase::Pkinase_Tyr; Domain location=302-501::302-501
MLSMSLPFYYFYIFYVVFLLTLNIFPPASLAANNTLPCPLNITVLRVVSGGRRPSFDSGTKCHYILQALHLLQADYLRRSSLFVPPLNTSESCWNTFQSFINEADPSISDIRSSCGFRTEWISQGCMNITTKQQFEDIVPRNAIQPVQDDCNQPLENNAPCALCTTKLSSMLSYLTGTTQGNVTDCRAYTQIYAASLSDQYGVTDPGTSKCLFGLDFSSSGSGGKRRRTIVIAVVSVFCVVSLSVFASLWAYLRFKKRLEVEKRKGAGISELGLGSGLDSINQSTTLIRFSFDEIKKATRNFSRDNIIGSGGYGNVYKGMLLDGSQVAFKRFKNCSVAGDASFTHEVEVIASVRHVNLVTLRGYCTATTNLEGHQRIIVTDLMENGSLYDHLFGSAKKNLTWPIRQKIALGTARGLAYLHYGAQPSIIHRDIKASNILLDHNFEAKVADFGLAKFNPEGMTHMSTRVAGTMGYVAPEYALYGQLTERSDVFSFGVVLLELL

SEQ ID NO: 131062 - protein, 637 aa, Glycine max
  Coding DNA Sequence Number=SeqID_14284
  Gene Ontology: Mol. function=acyl-CoA binding; Cellular component =nucleus; Biological process=regulation of transcription, DNA -dependent
  Homolog annotation: Hit_ID=Q94D04; Match level="QueryCoverage=97%, HitCoverage=99%, E-value=1e-163, Identity=48%"; Hit description =Putative p40
  Pfam annotation: Domain name=Kelch_1; Domain location=128-175; Score =11.7; E_value=0.18; Accession=PF01344.15; Description=Kelch motif
  Pfam annotation: Domain name=Kelch_1; Domain location=180-225; Score =30.8; E_value=4.8e-06; Accession=PF01344.15; Description=Kelch motif
  Pfam annotation: Domain name=Kelch_1; Domain location=27-72; Score =34.2; E_value=4.7e-07; Accession=PF01344.15; Description=Kelch motif
  Pfam annotation: Domain name=Kelch_1; Domain location=77-122; Score =30.4; E_value=6.5e-06; Accession=PF01344.15; Description=Kelch motif
  Pfam annotation: Domain name=Kelch_2; Domain location=127-175; Score =31.4; E_value=3.1e-06; Accession=PF07646.5; Description=Kelch motif
  Pfam annotation: Domain name=Kelch_2; Domain location=180-225; Score =20.6; E_value=0.0055; Accession=PF07646.5; Description=Kelch motif
  Pfam annotation: Domain name=Kelch_2; Domain location=27-72; Score =27.8; E_value=3.8e-05; Accession=PF07646.5; Description=Kelch motif
  Pfam annotation: Domain name=Kelch_2; Domain location=276-327; Score =4.0; E_value=11; Accession=PF07646.5; Description=Kelch motif
  Pfam annotation: Domain name=Kelch_2; Domain location=77-122; Score =27.5; E_value=4.7e-05; Accession=PF07646.5; Description=Kelch motif
  Pfam module annotation: Pfam domain module=Kelch_1::Kelch_1::Kelch _1::Kelch_1::Kelch_2::Kelch_2::Kelch_2::Kelch_2::Kelch_2; Domain location=128-175::180-225::27-72::77-122::127-175::180-225::27 -72::276-327::77-122
MSSSLPQVAKNKAMWLHPKVLGFNPPERWGHSACFSNGLMYVFGGCCGGLHFCDVLTLDLNKMVWSKLTTTGEKPGPRDSHSAVFVGHKMIVFGGTNGFKKMNHIHVLDLVTKEWVRPECKGTPPSPRESHTATLVGDERIVIFGGSGEGHANYLNDLHILDLRTMSWTSSELKGDFPVPRDSHSTLAIGNKLIVYGGDSGDQYHGNVHMLDMTTMTWSKLSIQGSPPGVRAGHAAVNIGTKARVGDKRYYNDVWIFDICNFTWTQLDIDFHQPQGRFSHTAVAAGMDIAIYGGCGEDERPLNELLVLQLGAEHPNGRYYIPMCKPFGTYWNQEKKIIPGEADTHSVQKFMNNVETFGQGAYEVASEKSPPYHFDSGGLSFMPYLDKVLSRGRIAAAKVWDVKSEQEENFLTLSLHSSPCQSDQEQTPSQKANTLFPSTCQHDNGSNYKRTFKTSQDLHFLRHQLKQEHCLNVHEGRKRAQLQGAEQKTMGQGSIQHLIGAEVGGRVDEPFDSVSLSPAAVNGRIFRGVIFSPGAGVVSKVANVKPNCSLTSSFPSSSQAFLNSNHVGNSRASQQAPIRLRAEPCHGSRQTPVALPFPIMRGTSNVVSKEHKINSDLQGGLVLTLGGPASAHPQVKH

SEQ ID NO: 131063 - protein, 68 aa, Glycine max
  Coding DNA Sequence Number=SeqID_14285
MTIKMTVNQKVVVEAEIIFQHNILMLDVKYHICMAQEHNMKIEVGRSGRFAHLVLTVNLTTYEDHFNL

SEQ ID NO: 131064 - protein, 417 aa, Glycine max
  Coding DNA Sequence Number=SeqID_14286
  Gene Ontology: Mol. function=protein serine/threonine kinase activity; Cellular component=integral to membrane; Biological process=protein amino acid phosphorylation
  Homolog annotation: Hit_ID=Q8LI83; Match level="QueryCoverage=62%, HitCoverage=51%, E-value=1e-66, Identity=59%"; Hit description =Receptor protein kinase PERK1-like protein
  Pfam annotation: Domain name=Pkinase; Domain location=176-391; Score =23.9; E_value=5.5e-10; Accession=PF00069.15; Description=Protein kinase domain
  Pfam annotation: Domain name=Pkinase_Tyr; Domain location=176-391; Score=-14.6; E_value=1.4e-11; Accession=PF07714.7; Description =Protein tyrosine kinase
  Pfam module annotation: Pfam domain module=Pkinase::Pkinase_Tyr; Domain location=176-391::176-391
MAVMNTNTQVDQISASPFMGEHNTTVAYTSCGKGNVSKKGGIFNNVTEEITVTNKNSKCHSSRSLSPSSSLPQPSPSLSHHHVPSTPPSSLHNPPPPRAAITSSEPFVFSNPITSAAPVYSSLLRIIPSRTGTLSNLQSTNTTFAPLATSLLPLMNQNTTLIRFTFDEIKKATSSFAGDNIIGKGGYGNVYKGVLFDGTQVALKRFKNCSVAGDASFTHEVEIALGTAKGLAYLHYGAQPSIIHRDIKASNILLDHNFEAKVADFGLAKFNPEGMTHMSTGVAGTKGYVAPEYALYGQLTDRSDVFSFGVVLLELFSGKKALHVENDGQPSALTDLAWSLVRYGETLDVIEDGMPELGPTEVLEKYVLVVVQCCHPQLYARPTMDQGVKMLETEEVEQPISCIAGRTDIDEKSVASN

SEQ ID NO: 131065 - protein, 105 aa, Glycine max
  Coding DNA Sequence Number=SeqID_14287
MDNAFLLLSNSPHRLNLKTHEMNFNMLKNFLNSRIQVLVLLTKPHLAPKTLLIFILWVYTFSIGGSNKEVPLLLLPNDALEVGTGEVGRGISGPWYAAYFPTSQL

SEQ ID NO: 131066 - protein, 99 aa, Glycine max
  Coding DNA Sequence Number=SeqID_14288
MEQLQFMAGIIKKGLKGLKNLTFLIFWFMNQRKYQLLVVEKLLDLDEATLQKYVDNNSNNYMRRSKVNVKGGEEGWGGEWVWVEVCEDERRGKDGRDQE

SEQ ID NO: 131067 - protein, 99 aa, Glycine max
  Coding DNA Sequence Number=SeqID_14289
  Subcellular localization annotation: CTP_CleavageSite=30; ConfidenceScore=5.06e-01
MWFFQNSSFNLMKLQMGLDFSMVLVTTCPFAGMRGEAHGCAFQRRKDARSRHQHLFVGNVGKTEGNRSKTKILSSGVVFTFEEGISSSHVCLKGQQPIF

SEQ ID NO: 131068 - protein, 244 aa, Glycine max
  Coding DNA Sequence Number=SeqID_14290
  Gene Ontology: Mol. function=translation release factor activity, codon specific; Cellular component=cytoplasm; Biological process =translational termination
  Homolog annotation: Hit_ID=Q9C7X9; Match level="QueryCoverage=99%, HitCoverage=66%, E-value=1e-91, Identity=67%"; Hit description =Peptide chain release factor 2, putative
  Pfam annotation: Domain name=PCRF; Domain location=27-125; Score =75.4; E_value=1.7e-19; Accession=PF03462.9; Description=PCRF domain
  Pfam annotation: Domain name=RF-1; Domain location=156-241; Score =67.6; E_value=4e-17; Accession=PF00472.11; Description=Peptidyl-tRNA hydrolase domain
  Pfam module annotation: Pfam domain module=PCRF::RF-1; Domain location=27-125::156-241
MLDMLSFHLSKEDLWNDPVRVGKISREHGSLLGKMKEESLKALLNMRRNAKEKELEALLSGEQDSCSCYIEVQAGAGGIESMDWAAMRRGYKVTVVDEMPGEITGIKRATIKVDGEFAFGYAKAEIGVHRLVNISPFDSNKHRHTSFAAVAVIPIPGDGSTHVQINESDLRIERFRAGGQHVNTTESAVRIVHIPTGVTATCQNERPQHQNKASAMAVLLQSKIRPTGDCTPGTVECTTYTISY

SEQ ID NO: 131069 - protein, 113 aa, Glycine max
  Coding DNA Sequence Number=SeqID_14291
MTFPIAFVCVENVPIIDQNSLARESPSEVEGSVLAAVAASDVQNRIWRNVNYATRTSLCRNKDNPLVLRDFPRKRDMLVSCVTKQCKLQGVALKTTKMLTAATKHSRFIQGVA

SEQ ID NO: 131070 - protein, 187 aa, Glycine max
  Coding DNA Sequence Number=SeqID_14292
  Gene Ontology: Mol. function=DNA binding; Cellular component =chromatin; Biological process=chromosome organization and biogenesis (sensu Eukaryota)
  Homolog annotation: Hit_ID=Q9LTA2; Match level="QueryCoverage=85%, HitCoverage=57%, E-value=6e-17, Identity=33%"; Hit description =Similarity to AT-hook DNA-binding protein
  Pfam annotation: Domain name=DUF296; Domain location=60-172; Score =46.1; E_value=1.2e-10; Accession=PF03479.5; Description=Domain of unknown function (DUF296)
  Subcellular localization annotation: CTP_CleavageSite=30; ConfidenceScore=5.00e-01
MVNPSTITPPSSEVHTFHNAIESSSHQIPPSSNKSRGRPLGSKNKPKIPLVINQDSDLALKPIFIQVPKNSDVIEAVVQFARQCQVSITVQSASGSILEATLCQTLPDTSTFVVFGPFTLISLTGTYINNNCSFRISFCSNLGQSFTGIVGGKIIAGDDVNVVAGIKGAGEERDSSKKPYACHLDDK

SEQ ID NO: 131071 - protein, 198 aa, Glycine max
  Coding DNA Sequence Number=SeqID_14293
  Gene Ontology: Mol. function=protein serine/threonine kinase activity; Cellular component=endoplasmic reticulum; Biological process=response to high light intensity
  Homolog annotation: Hit_ID=P30236; Match level="QueryCoverage=77%, HitCoverage=77%, E-value=1e-33, Identity=48%"; Hit description=22.0 kDa class IV heat shock protein precursor
  Pfam annotation: Domain name=CS; Domain location=74-167; Score=14.5; E_value=0.00084; Accession=PF04969.6; Description=CS domain
  Pfam annotation: Domain name=HSP20; Domain location=77-182; Score =158.3; E_value=2e-44; Accession=PF00011.11; Description=Hsp20alpha crystallin family
  Pfam module annotation: Pfam domain module=CS::HSP20; Domain location= 74-167::77-182
  Subcellular localization annotation: CTP_CleavageSite=35; ConfidenceScore=5.03e-01
MGRTLTTAATCLLLSLLLVSLCVTTTTNALMPYTRSSTLWDTMLSSEDPFRILEHTPFSDIPTTTRGVDTLALARADWKETPTAHVIALDLPGMKKEDVKIEVEENRVLRISGERKGEEEEVEGEKWHRAERTNGKFWRQFRLPLNADLEKVTARLEDGVLRITVAKLGEDKKRQPKVIDIAQRDSAAEDVKATKADM

SEQ ID NO: 131072 - protein, 189 aa, Glycine max
  Coding DNA Sequence Number=SeqID_14294
MWGKATEQKEEEEEEENVGSQESSITENIPLLQSYITVNSTKKIDGNKILETIFYHRTAYCCEGPLVSLFPEWPSCYPFARQCMEDFQQWFTRFMAMNGNAFSKISLFYAFIKKQVIRSDIAKVIECAAEISEVAAGVVQDIYEERGWHHSNHQQSSAQTECINQKIEEKTIQGTRGVKNQTLGRKAKL

SEQ ID NO: 131073 - protein, 306 aa, Glycine max
  Coding DNA Sequence Number=SeqID_14295
  Homolog annotation: Hit_ID=Q64EX4; Match level="QueryCoverage=99%, HitCoverage=88%, E-value=7e-91, Identity=48%"; Hit description=MtN19- like protein
  Pfam annotation: Domain name=SURNod19; Domain location=2-302; Score =332.8; E_value=5.8e-97; Accession=PF07712.3; Description=Stress up -regulated Nod 19
MKVKSTVFLSPKFELGPGSATTRHYYDIEFPRGHVALKSFSGEVVDEAGNPVPLHETYLHHWIVVRYTINNRDILPQYYGLGSETRRTDTDVPDPFGIVVGNPAEIPQGCDLYNVTKDENGEPLRPDYKGEEPLPKIHGNDWDKFMVHVKIYILHVTDTIKPSHDSRGMINPEHDSRISEFIKKHVESCSTDHKDGNGCLDVKRTSLPMKKGGYVIYGVAHQRSGLYALQYQDMEMEKKQEMRQITNYIVGMSTCYPPPGSVKIIDGKTFTMESNYSSSPGHTGVMGIFYLLVAEQLPRQHFKYSP

SEQ ID NO: 131074 - protein, 377 aa, Glycine max
  Coding DNA Sequence Number=SeqID_14296
  Homolog annotation: Hit_ID=Q64EX4; Match level="QueryCoverage=98%, HitCoverage=85%, E-value=1e-173, Identity=74%"; Hit description =MtN19-like protein
  Pfam annotation: Domain name=SURNod19; Domain location=1-360; Score =765.7; E_value=2.9e-227; Accession=PF07712.3; Description=Stress up -regulated Nod 19
DIDFPRGHIALKSFNAEVVDEAGNPVPLHETYLHHWVVGRYYQPKYVTTHTNYDGHRILHNSDHIFVRNSGICQRDILGQYYGLGSETRGTATDVPDPFGIVVGDHAEIPEGYEEKWLVNIHAIDTRGVVDKMGCTECRCDLYNVTKDEYGEFLRPDYKGGLKCCYDQTQCRLREGFEGPKRSLYLRYTVKWVEWDKFIVPVKIYILDVTDTLKISDDSGEMIPEHDCRVEYEVEYCSTGQKNGNGCLDGKRTSLPIQKGGYVIYGVAHQHSGGTGSTLYGQDGRVICSSIPSYGKGKEAGNEADYIVGMSTCYPRPGSVKIIDGETLTLESNYSSSREHTGVMGLFYLLVAEQLPDQHFRHTSRSSFFMNINSIFH

SEQ ID NO: 131075 - protein, 94 aa, Glycine max
  Coding DNA Sequence Number=SeqID_14297
MGTGTGDGDEEGQTWPQHPPPPNCHPCHCLRWTWFFFTDLDERILKQQQEEEERKRLRREKKKEKKEKAVEEPEIDPDVAAMMGFGGFRSSNKK

SEQ ID NO: 131076 - protein, 319 aa, Glycine max
  Coding DNA Sequence Number=SeqID_14298
  Homolog annotation: Hit_ID=Q10MM4; Match level="QueryCoverage=93%, HitCoverage=99%, E-value=3e-19, Identity=44%"; Hit description =Expressed protein
  Pfam annotation: Domain name=DUF1645; Domain location=106-287; Score =37.2; E_value=5.7e-08; Accession=PF07816.2; Description=Protein of unknown function (DUF1645)
MELQTPNNYGVTENPDTPLFEDIDSTCSTPYVSAPSSPGRESISAAGAGFFYSAPASPMHFTISAASTYSHSPSWSSLEKNSCCDFEFSARFGSSGLTGSGSMSSADELFLNGQIRPMKLSTHLERPQVLAPLLDLEEEEEEEENEVRGRDLRLRDKSLRRRTRSLSPLRNTPLEWTENEEKTDKKENVTPSVSSGSGRSSKRWVFLRDFLRSKSEGRSNNKFWSTISFSPAAKEKKGNGPQKPKKVAGKPTNGVGKRRVPASSPHELHYKANRAQAEELRRKTFLPYRQGLLGCLGFSSKGYGAMSGFARALNPVSSS

SEQ ID NO: 131077 - protein, 383 aa, Glycine max
  Coding DNA Sequence Number=SeqID_14299
  Gene Ontology: Mol. function=isomerase activity; Cellular component =endoplasmic reticulum; Biological process=cell redox homeostasis
  Homolog annotation: Hit_ID=Q38JJ2; Match level="QueryCoverage=90%, HitCoverage=91%, E-value=1e-135, Identity=69%"; Hit description =Disulfide-isomerase-like protein
  Pfam annotation: Domain name=ERp29; Domain location=289-368; Score =91.0; E_value=3.6e-24; Accession=PF07749.3; Description=Endoplasmic reticulum protein ERp29, C-te
  Pfam annotation: Domain name=Thioredoxin; Domain location=140-273; Score=151.0; E_value=3.1e-42; Accession=PF00085.10; Description =Thioredoxin
  Pfam annotation: Domain name=Thioredoxin; Domain location=28-127; Score=150.0; E_value=6.3e-42; Accession=PF00085.10; Description =Thioredoxin
  Pfam module annotation: Pfam domain module=ERp29::Thioredoxin::Thiored oxin; Domain location=289-368::140-273::28-127
MWSSKTTLMFGVAAIALMMFLSSASADDVVALTEETFENEVGKDRAALVEFYAPWCGHCKRLAPEYEQLGTTFKKTKSVLIAKKSVCSKYGVSGYPTIQWFPKGSLEPKKYEGARTAEALAAFVNIEAGTNVKIASVPSSVVVLSPDNFDEVVLDETKDVLVEFYAPWCGHCKALAPVRLFFSPWTSIIAYGYCRVSPVCNYVKIYEKVAAAFNLDKDVVMANVDADKYKDLAEKYGVSGYPTLKFFPKSNKAGEDYNGGRDLDDFVAFINEKCGTYRDGKGQLTSKAGIIASLDDLVKEFVSADSNEKKAVYSRLEEEVKKLKGSSARHGDLYLKLAKKGIEKGADYAKNEIQRLERMLEKIYWTVVPLHGMRGPMSTDIKT

SEQ ID NO: 131078 - protein, 183 aa, Glycine max
  Coding DNA Sequence Number=SeqID_14300
  Gene Ontology: Mol. function=nucleic acid binding; Cellular component= intracellular
  Homolog annotation: Hit_ID=Q4SQ28; Match level="QueryCoverage=67%, HitCoverage=51%, E-value=4e-33, Identity=56%"; Hit description =Chromosome 7 SCAF14536, whole genome shotgun sequence
  Pfam annotation: Domain name=zf-U1; Domain location=81-116; Score =9.3; E_value=0.0068; Accession=PF06220.3; Description=U1 zinc finger
MISLNQVAGVDNTFRRKFDREEYLERARERERQEEEGRAKPKGKGPPVQRKPLKHRDYEVDLESRLGKTQVVTPVAPLSQQAGYYCSVCECVVKDSANYLDHINGKKHQRALGMSMRVERASLEQVQERFEVLKKRKDVGSFTEQGKALDKRSPHQDPPLGVANSPIPVGITPTLMENIHFDR

SEQ ID NO: 131079 - protein, 137 aa, Glycine max
  Coding DNA Sequence Number=SeqID_14301
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=77%, HitCoverage=12%, E-value=2e-46, Identity=82%"; Hit description =Adenosine/AMP deaminase active site
MEKKKNERFLPPPLDAMINCLILVCIHGPEGKIPFETLPNHVNANREQMAITLSMIRSHSVSGDLHGVQPDPIAADILRKEPEHETFTRLRITPLEAPSPDEVEAYVVLQECLEMRKRYVFREVVAPWDKEVISCKN

SEQ ID NO: 131080 - protein, 101 aa, Glycine max
  Coding DNA Sequence Number=SeqID_14302
  Gene Ontology: Cellular component=anchored to membrane
  Homolog annotation: Hit_ID=Q1S608; Match level="QueryCoverage=75%, HitCoverage=50%, E-value=4e-21, Identity=64%"; Hit description=E1 protein and Def2/Der2 allergen
  Pfam annotation: Domain name=E1_DerP2_DerF2; Domain location=1-97; Score=16.3; E_value=0.00085; Accession=PF02221.6; Description=ML domain
KKADYAVKVSGVEISPNPVVSGQAATFKISATSGKAIYGGEVVIGVSYVGVPVHTERIDLCEEVTCPVANGNFLISHTQTLPAITPPLPLTSFKGPLSLDT

SEQ ID NO: 131081 - protein, 93 aa, Glycine max
  Coding DNA Sequence Number=SeqID_14303
  Subcellular localization annotation: CTP_CleavageSite=51; ConfidenceScore=5.33e-01
MGCQTEKIKLIKPASSSSSRQLRLLRENFSLQAAVRDRCVAAGARRRRLCRCVAAGGRRGCVCMRLRVSRLGVRVGCGRDAAGAGEARGWVLS

SEQ ID NO: 131082 - protein, 681 aa, Glycine max
  Coding DNA Sequence Number=SeqID_14304
  Homolog annotation: Hit_ID=Q10MM5; Match level="QueryCoverage=81%, HitCoverage=59%, E-value=1e-64, Identity=33%"; Hit description =Expressed protein
METEKKRSKGSFLSFFDWNTKSRKKLVWNDPEVSKQGKENVENLPKSRLTRKKVDEIGASPSNIQSCDFDSTLSICSDEGCGSKAPGLVARLMGLDSLPAAAATELSCTSLYGSKSHGASHCNEGALHSVDDFFPADYINTLLKPEKSSLEVMESRARKVENLPIKRFQTEMLPPKSAKPIPVTHNKLLSPIKSPSILPPKNAAHVMEAAAKIIEASPRPYSRNRTALTEPSSVPLRILNLKERFEAAQYISLPGKLENLSNSYPANGKLSERSSNLYKCTSAFKGSRVLEKNSSCHSASKGKSVSLTIQAKNNAHSRDTLISNGDRKCMKQREKNDIKSNQLSRSQKPSTQKAMQQRPCSSRNSNVLGQNNQKQNSMAAKGKSTSTIDSNKPTTRASSPETSGIRKTMNKGAKTANIQPKRSSSRATDNQKQFPRSKAVSISQKKKISRDVHEARGPDEVNNFGSKSIKCNFTTDGSFDQDAFNMKESKDVISFTFTSPLRRSMPESSSSTEQVMGTRNRIDVNSIGHSDNLYPKKLSLSPPGQPMIDSDALSVLLDKKLQELTSRINLPQCTLATEGSSTGLRSSVQDQVPSVSSNTPKEQDKSFCSDLSSDKLDSMHNSHYCSSDDPVLNMNQQLLTSEVSEDPSCSSNSESGNDLVCWHSTAVAGFETPFCQRKLLG

SEQ ID NO: 131083 - protein, 117 aa, Glycine max
  Coding DNA Sequence Number=SeqID_14305
MEGIQHHYARSCSYLHEVNVKSMNNNNNKMCMWVARSTTTPPSALYSNELASSRECYGPQMAVTKPKNTWRWNEAERKRRRRVAKYKFYAAEGKLKHSVKKGFRWLKIKCIKIVSSL

SEQ ID NO: 131084 - protein, 99 aa, Glycine max
  Coding DNA Sequence Number=SeqID_14306
MWHVNKHNGRLAINMVLMDHTEVNRSEIPDNIHVINEFANIISSIASRDTLVDVVNVVAEVIEQKYLLSVQNIKHGSKLYVNTDIAKIQQFCDKYDARI

SEQ ID NO: 131085 - protein, 55 aa, Glycine max
  Coding DNA Sequence Number=SeqID_14307
  Gene Ontology: Mol. function=helicase activity
  Homolog annotation: Hit_ID=Q1SZZ8; Match level="QueryCoverage=97%, HitCoverage=25%, E-value=2e-14, Identity=65%"; Hit description =Unnamed protein product; contains similarity to helicase gene _id:T13C12.11-related
IGIANLECVVLPPGSRIEAILLEATIKTMPPLERIADDKVFQTKVLLVPPYPSRK

SEQ ID NO: 131086 - protein, 318 aa, Glycine max
  Coding DNA Sequence Number=SeqID_14308
  Homolog annotation: Hit_ID=Q10NC3; Match level="QueryCoverage=90%, HitCoverage=72%, E-value=6e-19, Identity=42%"; Hit description =Expressed protein
MGMIRFMLMCHKYREEHLTIYFLILLVSSQGVDASKPYFQGQSRNNSDSRSQAHEEDMDVRYEGEHLSQSFEGLEQNFHDDIIKLTKEQNDAEDAEYARHREHTENGTNNEPPGKTASWLKCDDLNKKVSKRRIAFMLNPVVFLCKSKNKNWVSLWFKTLWDLFNSLFVFEDVKHTFEAVKLFIDVTKINAINAQYEEKLAALRAQHSSRRAEFLQRESHARQQQYQQIIRDPYPGGGMAPRDPHAPRDPHAPRDPHGYNNVNDSGAGGEVQRGYSADHFDPYRERARFLGGGRDQGFEPRGPYPGGRVYDTGSRYYN

SEQ ID NO: 131087 - protein, 99 aa, Glycine max
  Coding DNA Sequence Number=SeqID_14309
  Subcellular localization annotation: CTP_CleavageSite=50; ConfidenceScore=5.02e-01
MANGSENGFKTKRRQGTKNLINTFNYTNPGNTTNTLEEGIRNCRPLAPVSFTTKMKMKVHLFLSSWEQNGIGAQLNRDTPNRRKMKQRKRKRHKTINAH

SEQ ID NO: 131088 - protein, 578 aa, Glycine max
  Coding DNA Sequence Number=SeqID_14310
  Gene Ontology: Mol. function=calmodulin binding
  Homolog annotation: Hit_ID=Q0WVV6; Match level="QueryCoverage=90%, HitCoverage=91%, E-value=4e-66, Identity=32%"; Hit description =Putative calmodulin-binding protein
  Pfam annotation: Domain name=Calmodulin_bind; Domain location=83-388; Score=316.0; E_value=6.6e-92; Accession=PF07887.2; Description =Calmodulin binding protein-like
MVSKRQSGQRHEGRGKVPIQEQKQASISGLRNVINALWMSDKSSYLENFLRRVVREVVEQKIQDQAHLFSRERVGEAGISGAKHLKLCFINKLPETIFTRSSIITKDESFLQIALFDVRTESVVNDGPLSSLKIEICVLDGEFGSHGCEDWTEDEFNSNILREREGKEPLLIGERFITLKGGVGCITKIAFSDNSRWQRSRRFRIGVKAVQPTSNGEKIQEGRSEPFVVKDNRGESYKKHYPPYLKLNDDIWRLKKIAKEGKIHKQLSLHGIHNVKDLLRFYITNEPSLYETFGNIPKKSWLVITEHAKACEIDDYQLYSYHSEELQVGLLFNSIYILVGVTFDWQNYYLPDTLNPREKHLVEIVKHQAYKNVYDLKLIEETKLNYLNLAACLKARQSDTQDQGLQHVNISTAQGQSVTFPDYSQPSISPSYTDEGMHDHQVYADPLPGITEMSQNSHLLDELSSEMYTEEDSCDLNGSQFPFVRGGYSTENESSEIQFIDDCPPYTTWEPETGILFGSPVGAEFSSYSTFINSDVDISSSGKTKAVWYKIRVALKWVISVKRDAAARRNGHLFYHNY

SEQ ID NO: 131089 - protein, 218 aa, Glycine max
  Coding DNA Sequence Number=SeqID_14311
  Gene Ontology: Mol. function=chromatin binding; Cellular component =chromatin; Biological process=chromatin assembly or disassembly
  Homolog annotation: Hit_ID=Q1SAV4; Match level="QueryCoverage=50%, HitCoverage=24%, E-value=7e-19, Identity=50%"; Hit description =Integrase, catalytic region
MGTSDSNSAMDDTRPHFTIPFILESDASSIAMGVMLIQIKIPIPYLISARHFVVNSSKHDICPRTSCNYFFMQLLPQFENGYISSWATPLLSSPITRVPEFERPHVPTQCSVCQQTKYRSKKPSGDAILPPKDIRAYIIGSTSNLTHSILFVEGFITGFHYWITPSNDFTSILVVVDSYSKGTHFGALPPCYTGHKVVVLFLDMVCKLHEFPQSLVSD

SEQ ID NO: 131090 - protein, 614 aa, Glycine max
  Coding DNA Sequence Number=SeqID_14312
  Gene Ontology: Mol. function=protein transporter activity; Cellular component=nuclear pore; Biological process=intracellular protein transport
  Homolog annotation: Hit_ID=Q2PEZ3; Match level="QueryCoverage=88%, HitCoverage=98%, E-value=0.0, Identity=83%"; Hit description =Putative importin alpha
  Pfam annotation: Domain name=Arm; Domain location=106-147; Score =51.0; E_value=4e-12; Accession=PF00514.13; Description=Armadillobeta- catenin-like repeat
  Pfam annotation: Domain name=Arm; Domain location=149-189; Score =57.5; E_value=4.5e-14; Accession=PF00514.13; Description =Armadillobeta-catenin-like repeat
  Pfam annotation: Domain name=Arm; Domain location=191-232; Score =37.6; E_value=4.4e-08; Accession=PF00514.13; Description =Armadillobeta-catenin-like repeat
  Pfam annotation: Domain name=Arm; Domain location=252-291; Score =34.4; E_value=4.1e-07; Accession=PF00514.13; Description =Armadillobeta-catenin-like repeat
  Pfam annotation: Domain name=Arm; Domain location=293-333; Score =37.3; E_value=5.3e-08; Accession=PF00514.13; Description =Armadillobeta-catenin-like repeat
  Pfam annotation: Domain name=Arm; Domain location=335-376; Score =42.9; E_value=1.1e-09; Accession=PF00514.13; Description =Armadillobeta-catenin-like repeat
  Pfam annotation: Domain name=Arm; Domain location=378-418; Score =50.8; E_value=4.6e-12; Accession=PF00514.13; Description =Armadillobeta-catenin-like repeat
  Pfam annotation: Domain name=Arm; Domain location=421-461; Score =34.1; E_value=4.7e-07; Accession=PF00514.13; Description =Armadillobeta-catenin-like repeat
  Pfam annotation: Domain name=HEAT; Domain location=112-149; Score =4.3; E_value=13; Accession=PF02985.12; Description=HEAT repeat
  Pfam annotation: Domain name=HEAT; Domain location=155-191; Score =27.3; E_value=5.4e-05; Accession=PF02985.12; Description=HEAT repeat
  Pfam annotation: Domain name=HEAT; Domain location=258-293; Score =10.2; E_value=2.4; Accession=PF02985.12; Description=HEAT repeat
  Pfam annotation: Domain name=HEAT; Domain location=298-335; Score =4.9; E_value=11; Accession=PF02985.12; Description=HEAT repeat
  Pfam annotation: Domain name=HEAT; Domain location=341-378; Score =2.9; E_value=19; Accession=PF02985.12; Description=HEAT repeat
  Pfam annotation: Domain name=HEAT; Domain location=384-420; Score =9.3; E_value=3.2; Accession=PF02985.12; Description=HEAT repeat
  Pfam annotation: Domain name=HEAT; Domain location=427-463; Score =0.3; E_value=39; Accession=PF02985.12; Description=HEAT repeat
  Pfam annotation: Domain name=IBB; Domain location=6-97; Score=120.3; E_value=5.6e-33; Accession=PF01749.10; Description=Importin beta binding domain
  Pfam module annotation: Pfam domain module=Arm::Arm::Arm::Arm::Arm::Ar m::Arm::Arm::HEAT::HEAT::HEAT::HEAT::HEAT::HEAT::HEAT::IBB; Domain location=106-147::149-189::191-232::252-291::293-333::335-376::378 -418::421-461::...
  Pfam module annotation: Domain location=112-149::155-191::258 -293::298-335::341-378::384-420::427-463::6-97
MSYRPSANARTEVRRNRYKVAVDADEGRRRREDTMVEIRKSRREESLQKKRREGLQSQQIPSSLHSTVIEKKLEHLPAMVTGVFTDDNNMQLEATTQFRKLLSIERSPPIEEVIQAGVVPRFVDFLMREDFPQLQFEAAWALTNIASGTSENTKVIIDHGAVPIFVKLLGSPSDDVREQAVWALGNVAGDSPRCRDLVLGHGALLPLLAQLNEHAKLSMLRNATWTLSNFCRGKPQPAFDQKLTKTSGEGRREGGERSQVKPALPALASLIQSNDEEVLTDACWALSYLSDGTNDKIQGVIEAGVCSRLVDLLLHPSPSVLIPALRTVGNIVTGDDLQTQVIINHQALPRLLNILTNNYKKSIKKEACWTISNITAGNKKQIQDVIEASIIAPLVHLLQNAEFDIKKEAAWAISNATSGGSHEQIKFLVSQGCIRPLCDLLICPDPRIVTVCLEGLENILKVGEAEKNVSNTDGVNLYAQMIDDAEGLEKIENLQSHDNTEIYEKAVKILETYWMEEDDETMPPGDASQSGFNFGGTQPPAVPSGVLTGLSVKSSSLTVQQFGGVAGPAWVFEMAGFTYTMGTDGLWLDFLATQELYILEFAFCQVIIPNDLAL

SEQ ID NO: 131091 - protein, 51 aa, Glycine max
  Coding DNA Sequence Number=SeqID_14313
MGVEAALIQETKISGVSRSMVREIWGPSEHEGIDKDAEAGDEHKREKEKEV

SEQ ID NO: 131092 - protein, 373 aa, Glycine max
  Coding DNA Sequence Number=SeqID_14314
  Gene Ontology: Mol. function=exonuclease activity; Cellular component= intracellular
  Homolog annotation: Hit_ID=Q10MN9; Match level="QueryCoverage=71%, HitCoverage=86%, E-value=3e-46, Identity=41%"; Hit description =Exonuclease family protein, expressed
  Pfam annotation: Domain name=Exonuc_X-T; Domain location=171-340; Score=87.0; E_value=5.8e-23; Accession=PF00929.14; Description =Exonuclease
  Pfam annotation: Domain name=GATA; Domain location=12-44; Score=21.2; E_value=0.00068; Accession=PF00320.17; Description=GATA zinc finger
  Pfam module annotation: Pfam domain module=Exonuc_X-T::GATA; Domain location=171-340::12-44
MDLNVNEKKKCCADCKTTKTPLWRGGPAGPKEEKGLFEEARGAEVEDVGGRGTGRGVLDGLVLCLANCWGETFHGFSTTCGNNSSIRLLGSRIYGLQGGQRKKWTRPITTNTEGKGSTKSKSIKHEILSETILANATANVNKTQLDQSQEIQDCDIQQEIAENKDLSSYTVIVFDIETTGFSRENERIIEIALRDLQGGENSTFQTLVNPQCKVPNSHIHGITTQMVNKPDVPRMEDLIPILFQYVRSREKPGGDVLFVAHNARCFDVPFIISELRRYSIKIPPNWLFLDTLPLARELMKSGGTTLSSSSLAALRDLYGIKVDGSAHRAMVDVNTLSLILSRLTSDLKLTLSDLVDKSFTESDIINSKKKKKN

SEQ ID NO: 131093 - protein, 582 aa, Glycine max
  Coding DNA Sequence Number=SeqID_14315
  Homolog annotation: Hit_ID=Q8H2B1; Match level="QueryCoverage=28%, HitCoverage=100%, E-value=1e-71, Identity=85%"; Hit description=DnaJ- like protein
  Pfam annotation: Domain name=Calmodulin_bind; Domain location=56-311; Score=78.4; E_value=2.2e-20; Accession=PF07887.2; Description =Calmodulin binding protein-like
  Pfam annotation: Domain name=DnaJ; Domain location=430-497; Score =106.0; E_value=1.1e-28; Accession=PF00226.21; Description=DnaJ domain
  Pfam module annotation: Pfam domain module=Calmodulin_bind::DnaJ; Domain location=56-311::430-497
MEYSKRQSQQEGTDDQKGIQIRGQDSKRRREDSQQSDTLRIISLRSLVHITNDDIARYMKDLVQRLNELPDTIYTNSKIKAKGNTPLEVVLFDIESKSIVAEGSLSSIKIEICVLDGEFCSINGREDWSEDEFNAKIVRQRDNKGRLLKGDTIITLENGVGYITNLEFTDNSSWRRTRCFSLGAKLLQSNLKDAINIREENQKRDTPSLNDETWRLKHISKNVYRRLLKHGIKTVGDLLKENETNPSSLQEEEIIKLAKKAKYAKTCVAEATFDGQNYHSEKNTLISNQREAYKNLKDPVPIETITHELVKTLTPVNAQYYSAPNQDVQQLDFSIAQQEEISRLNWSAGGQIVDGYILSQIDDENVSNFLPEINSEFIFPYGDEAEYCNSSSFPNSALNISDKGKSKMGVSPLFLCSLMDREGGSNAGSCYYSVLGIRRDASFSDIRTAYRKLAMKRWHPDKWALNPATAGEAKRRFQQIQEAYSVLSDQSKRSMYDAGLYDPLEEEDQDFCDFMQEMISMMNNVKDEGDSLEDLQRMFVDMVGGDHGHGIGVDLNQDRTAGKRGRVYGSKGNAPKRSNSRS

SEQ ID NO: 131094 - protein, 410 aa, Glycine max
  Coding DNA Sequence Number=SeqID_14316
  Gene Ontology: Mol. function=microtubule motor activity; Cellular component=microtubule associated complex; Biological process =microtubule-based movement
  Homolog annotation: Hit_ID=Q1RV39; Match level="QueryCoverage=97%, HitCoverage=38%, E-value=1e-102, Identity=52%"; Hit description =Calponin-like actin-binding; Kinesin, motor region
  Pfam annotation: Domain name=CH; Domain location=40-161; Score=62.3; E_value=1.6e-15; Accession=PF00307.21; Description=Calponin homology (CH) domain
MATEPVLTFSLASVVEDVLQQHDGRLDVNLASRKAEEASLRRYEAAGWLRKTVGVVGGKDLPAEPSEEDFRIGLRSGIILCNVLNKIQPGAVPKVVEGPCDSVIIPDGAALSVYQYFENVRNFLVAVEEMGLPSFEASDLEQGGKSSRIVNCVLELKAHAERKLRGGNGLSKYSRVAKPPTSGKTLLRKNSEPFMKSMWTMTSGDRDGYMSDPGHDLSERGSVSSLNSLVRQYLSDKKPEEIPTVVESLLSKVMEEFEHHMKIQHEMWKITQEDKAPSGTECSISEAASINERLEEKEDEQDEQDGQNIHDNQEESYEEKYIEHEDSSRQISILKQQNIVETQNRSIQELKSIVHQTKLGMQFMQNEHQKEIINLSKHLHSLASAASGYHKVLDENRKLYNLVQDLKGEF

SEQ ID NO: 131095 - protein, 184 aa, Glycine max
  Coding DNA Sequence Number=SeqID_14317
  Homolog annotation: Hit_ID=Q06445; Match level="QueryCoverage=47%, HitCoverage=90%, E-value=1e-38, Identity=90%"; Hit description =Cysteine proteinase inhibitor
  Pfam annotation: Domain name=Cystatin; Domain location=5-93; Score =70.7; E_value=4.7e-18; Accession=PF00031.11; Description=Cystatin domain
MAALGGNRDVAGSQNSLEIDGLARFAVEEHNKKQNALLEFEKVVSAKQQVVSGTLYTITLEAKDGGQKKVYEAKVWEKAWLNFKEEEETSCEHVLHWMFLGSAPLSNKNTLTTLPPFIVVYEGPPVCYDIPKVWISVTIQCIHGLAASATIALTTILSPVESHRPQSQYASTPSTVATLTSSTK

SEQ ID NO: 131096 - protein, 136 aa, Glycine max
  Coding DNA Sequence Number=SeqID_14318
MVLQAMEGIVPIWRVLSKRTYLLKGVKPWKGALMVKVLGRRVHLHVIENKLKREWVSKGCLKIIALYSVWRNRNEVVFSQTASSVESIMTYVKALTFNVISCRKHAQVTQMPNQGIVLRDDKGRVKLSYASNLSMC

SEQ ID NO: 131097 - protein, 270 aa, Glycine max
  Coding DNA Sequence Number=SeqID_14319
  Pfam annotation: Domain name=GRP; Domain location=173-266; Score= -30.4; E_value=0.099; Accession=PF07172.2; Description=Glycine rich protein family
MGSDGSEVLQSDLIAPERQQHSRKKTTSMVTVNVGSYDRFPSAALNQLLAVPSFQATAKGFVAAAFANDNLIVFLCDGNDNDDVGNVNSNNDNKDCSRNDDGDGGRGGIGGDGNTNGGGDNICDISGDGDYVVGDGCSNVGGDNDDGGMVVVMVVVVMVAVTKVMLLVVVVVTIILIVVVAATLIVLVVVTTLMVIMISMAVDSDVIGGGGGCDDIGVDCGIDNGGGGGCDDIDSDCRDNDDGDNNVVGADNVGQDGGMGTYGCGGDSPL

SEQ ID NO: 131098 - protein, 547 aa, Glycine max
  Coding DNA Sequence Number=SeqID_14320
  Gene Ontology: Mol. function=microtubule motor activity; Cellular component=microtubule associated complex; Biological process =microtubule-based movement
  Homolog annotation: Hit_ID=Q1RV39; Match level="QueryCoverage=98%, HitCoverage=54%, E-value=1e-159, Identity=56%"; Hit description =Calponin-like actin-binding; Kinesin, motor region
  Pfam annotation: Domain name=Kinesin; Domain location=1-263; Score =426.6; E_value=3.5e-125; Accession=PF00225.13; Description=Kinesin motor domain
EVFADTQPLIRSVLDGYNVCIFAYGQTGSGKTFTMSGPDDLNEETIGVNYRALKDLFYLSEQRKDTISYEISVQMLEIYNEQVRDLLTTDEIRNSSHNGINVPDASLVPVSCTSDVINLMNLGHKNRSVGSTAMNDHSSRSHSCLTVHVQGKNLTSGSTIRGSMHLVDLAGSERADKTEATGDRMKEAQHINKSLSALGDVISSLAQKNAHVPYRNSKLTQLLQDSLGGQAKTLMFVHISPEPEALGETLSTLKFAERVSTVELGAARVNKDNLDVKDLKEQIASLKAALARKEGGEAEHFQQFVNSSSHEIPKLKSYASSPPMERSLIGGARKLPKDDSSSLDGKKNAASKLKRRSLDLHDMRKNSSPWPPVRSHGKEEDKESISGDWVDKISINRNDSLTSDDSLVGQWEAESKQSSPMSSPTFLSEPSKICLDHSLHRKDNQELFDMSTTYESDELEIATSDSAESDLHWPAHIPKPITVSSGLGIKARKKPINLRPTKSLEARSMIPSLIPIPVPSRKQPTLVTPARKNPVSIDVKRRIVNAK

SEQ ID NO: 131099 - protein, 82 aa, Glycine max
  Coding DNA Sequence Number=SeqID_14321
  Gene Ontology: Mol. function=5-formyltetrahydrofolate cyclo-ligase activity; Biological process=folic acid and derivative biosynthetic process
  Homolog annotation: Hit_ID=Q2QX67; Match level="QueryCoverage=54%, HitCoverage=12%, E-value=1e-11, Identity=77%"; Hit description=5 -formyltetrahydrofolate cyclo-ligase family protein, putative, expressed
TPLMAAMHEDDSPDLREIARILNDIFEARKNVVKVCDVVTRNDCQLVDDIPVEKLLIHDVPVDIIYTSTQVIFTNTSIPKPQ

SEQ ID NO: 131100 - protein, 174 aa, Glycine max
  Coding DNA Sequence Number=SeqID_14322
  Gene Ontology: Mol. function=RNA methyltransferase activity; Biological process=RNA processing
  Homolog annotation: Hit_ID=Q6ZJE6; Match level="QueryCoverage=94%, HitCoverage=47%, E-value=2e-61, Identity=70%"; Hit description =Putative rRNA methylase
  Pfam annotation: Domain name=SpoU_methylase; Domain location=1-122; Score=92.9; E_value=9.6e-25; Accession=PF00588.9; Description=SpoU rRNA Methylase family
MLICVSVCLDSPQNHGRPWYKDNRHVSMGAEKWLDIELWDSTKECFKMLKSRGYRIATTHVGMDAVSILDLDWSSPTTIVVGNENRGISDEALELSDLHCSIPMAGMVKSFNVSVAAGILMHHAVCDRISRMGYHGDMTVEECQILLAEFLLRHSKSSISIVEDYAMRKAVTLT

SEQ ID NO: 131101 - protein, 57 aa, Glycine max
  Coding DNA Sequence Number=SeqID_14323
MLESMLEVVSRFKFFWVERYRRETISMGKKVSYMEGLGGVGLECVRGRHMEWKKGTI

SEQ ID NO: 131102 - protein, 722 aa, Glycine max
  Coding DNA Sequence Number=SeqID_14324
  Gene Ontology: Mol. function=ion channel activity; Cellular component= integral to membrane; Biological process=ion transport
  Homolog annotation: Hit_ID=Q5D6H2; Match level="QueryCoverage=94%, HitCoverage=94%, E-value=0.0, Identity=74%"; Hit description=CNGC2
  Pfam annotation: Domain name=Ion_trans; Domain location=166-443; Score=0.1; E_value=0.011; Accession=PF00520.21; Description=Ion transport protein
  Pfam annotation: Domain name=cNMP_binding; Domain location=552-650; Score=37.3; E_value=5.3e-08; Accession=PF00027.19; Description =Cyclic nucleotide-binding domain
  Pfam module annotation: Pfam domain module=Ion_trans::cNMP_binding; Domain location=166-443::552-650
MIVMSTLFDSWISKKLRRRNSISNGDSGSDSFQNGAATVVDDNPFSSGVECYACTQVGVPVFHSTSCDSAFHQLQWEASAGSSLVPIQSRPNKVLGFRTVSGSSRGPFGRVLDPRSKRVQRWNRALLLARGVALAIDPLFFYSLSIGREGSPCLYMDGGLAAMVTVARTCVDAVHLLHVWLQFRLAYVSRESLVVGCGKLVWDAREIASHYLRSLKGFWFDAFVILPVPQVVFWLLVPKLLREEKIKIIMTIMLLIFLFQFLPKVYHSICMMRRMQKVTGYIFGTIWWGFGLNLIAYFIASHVAGGCWYVLAIQRVASCLRQQCERTNGCNLSVSCSEEICYQSLLPASAIGDSCGGNSTVVRKPLCLDVEGPFKYGIYQWALPVISSNSLAVKILYPIFWGLMTLSTFGNDLEPTSHWLEVIFSICIVLSGLLLFTLLIGNIQVFLHAVMAKKRKMQLRCRDMEWWMRRRQLPSRLRQRVRHFERQRWAAMGGEDEMEMIKDLPEGLRRDIKRHLCLDLIRKASNVHMKEVPLFHNLDDLILDNICDRVKPLVFSKDEKIIREGDPVPRMVFIVRGRIKRNQSLSKGMVASSILEPGGFLGDELLSWCLRRPFIDRLPASSATFVCLESSEAFGLDANHLRYITDHFRYKFANERLKRTARYYSSNWRTWAAVNIQFAWRRYRQRTKGPVTPVRDTNGGTERRLLQYAAMFMSIRPHDHLE

SEQ ID NO: 131103 - protein, 161 aa, Glycine max
  Coding DNA Sequence Number=SeqID_14325
MARWHFCNFHSSFYDSLVHTCAPLYPKAQLTQVIALLSYLSSCAVDLLCRTCRRDLLCRTCRRDLSQFLLRQLYCRTSHPVPLISSAVRAAVTSSAVPPRRSHLIPKQAARPARFPPWASPRSRSFKTILELSYAWHCVCYSGCRYGQPGWALRGYQPLRY

SEQ ID NO: 131104 - protein, 78 aa, Glycine max
  Coding DNA Sequence Number=SeqID_14326
  Gene Ontology: Mol. function=2 iron, 2 sulfur cluster binding; Cellular component=membrane; Biological process=electron transport
  Homolog annotation: Hit_ID=Q7XZD1; Match level="QueryCoverage=94%, HitCoverage=43%, E-value=2e-18, Identity=81%"; Hit description =Succinate dehydrogenase iron-sulfur protein subunit
MAATTSRASPRSPKKKNLSHHDGHSFAARVCFQGPGHGHDELLQSVQECRAMTEEEEPTSAEKRDSAEQEGEGEGWVG

SEQ ID NO: 131105 - protein, 289 aa, Glycine max
  Coding DNA Sequence Number=SeqID_14327
MLLYQKGVSKDKEQRRFGSLVRQQHSSCHCGFLEFKNQESTQFQCVGPRTPSGGGGGGARYRFPKEPSQGFCFDYGITLQSRRDPRCKFREIANNASLHLSSKRSIDNVLCTPSHAPSVNNGEKPYSREQCHNNNNNNNNNNNNNNNNKNYERESSSTKRRIDDVLSTPSHACSMNTREKLNFREQCHDNNKKNYEREGSLGWKPLNKGNNTSERFYSRSTVNGRDRNMNIVESSANSVIEETRKRPRLSWGEGLAKFEKKKTEGDGVSAATTATPASCACNSFSGFSK

SEQ ID NO: 131106 - protein, 112 aa, Glycine max
  Coding DNA Sequence Number=SeqID_14328
MGARDANNGEILESNCKGESSAKVSKKDEIEEDKVSESEVNLLQWSRKNRWKVVGVLEEDGVTGNGGNSSYMESFIKTDVPFEGCEGIMDDDWFYQFINGTNTGGASPGKEH

SEQ ID NO: 131107 - protein, 1194 aa, Glycine max
  Coding DNA Sequence Number=SeqID_14329
  Gene Ontology: Mol. function=protein binding; Biological process =multicellular organismal development
  Homolog annotation: Hit_ID=Q1SGM6; Match level="QueryCoverage=92%, HitCoverage=97%, E-value=0.0, Identity=85%"; Hit description =Lissencephaly type-1-like homology motif; CTLH, C-terminal to LisH motif
  Pfam annotation: Domain name=WD40; Domain location=1064-1099; Score =2.7; E_value=18; Accession=PF00400.22; Description=WD domain, G-beta repeat
  Pfam annotation: Domain name=WD40; Domain location=1115-1155; Score =2.2; E_value=20; Accession=PF00400.22; Description=WD domain, G-beta repeat
  Pfam annotation: Domain name=WD40; Domain location=400-438; Score =23.7; E_value=0.00064; Accession=PF00400.22; Description=WD domain, G-beta repeat
  Pfam annotation: Domain name=WD40; Domain location=506-546; Score =28.3; E_value=2.7e-05; Accession=PF00400.22; Description=WD domain, G-beta repeat
  Pfam annotation: Domain name=WD40; Domain location=549-589; Score =23.1; E_value=0.00099; Accession=PF00400.22; Description=WD domain, G-beta repeat
  Pfam annotation: Domain name=WD40; Domain location=639-678; Score =11.6; E_value=1.6; Accession=PF00400.22; Description=WD domain, G -beta repeat
  Pfam annotation: Domain name=WD40; Domain location=926-965; Score =12.9; E_value=1.1; Accession=PF00400.22; Description=WD domain, G -beta repeat
  Pfam annotation: Domain name=WD40; Domain location=969-1007; Score =31.1; E_value=3.8e-06; Accession=PF00400.22; Description=WD domain, G-beta repeat
  Pfam module annotation: Pfam domain module=WD40::WD40::WD40::WD40::WD4 0::WD40::WD40::WD40; Domain location=1064-1099::1115-1155::400 -438::506-546::549-589::639-678::926-965::969-1007
MVLTLRMNELHVVKKTMPRNYCDTLQEDKEIKSVFEDRDYWRLSDLRSSYDFFEPRISVSDTPIFGGGEVQGVGAQEEAIRATKWRETFEMLEKESGFFFNMKYFEEKVQAGEWEEVEKYLTGFTKVDDNRYSMKIFFEIRKQKYLEALDGQDKAKAVEILVGDLKVFSTFNEELYKEITQLLTLTNFRENEQLSKYGDTKTARGIMLIELKKLIEANPLFRDKLIFPTLRSSRLRTLINQSLNWQHQLCKNPRPNPDIKTLFTDHTCTPPNGPLAPTPVNLPVAAVAKPAAYTSIGSHGPFPPAAATANTNALAGWMANASASSSVQAAVVTASTIPVPQNQVSILKRPRTPPTTPGMADYQNADHEQLMKRLRPAPSVEEVSYPAARQASCSLDDLPRTVAMTLHQGSSVTSMDFHPSHPTLLLVGSNNGEISLWELGFRDRLVSKPFKIWDISACSLPFQAAMVKDSPISASRVTWSLDGNFVGVAFTKHLIHLYAYTGSNELAQRIEVDAHIGGVNDLAFAHLNKQLCIVTCGDDKLIKVWDIAGRKLFNFEGHEAAVYSICPHHKESIQFVFSTAIDGKIKAWLYDNMGSRVDYDAPGHWCTTMLYSADGSRLFSCGTSKDGESFLVEWNESEGAIKRTYNGFRKKSTGVVQFDTTQNRFLAAGEDGQIKFWDMDNINLLTSTDAEGGLQTLPHLRFNKEGNLLAVTTADKGFKILANANGLRSLRTVETPGFEALRSPIESAAVKASGSSAVNVSPVNCKVEKSSPVGPSPILNGVDTTGQNAEKPRTVEDGVDRAKPWQLSEIVDAVQCRLVTMPDSTDSSSKVVRLLYTNSGAGVLALGSNGVQKLWKWARSEQNPNGKATASVVPQHWQPNSGLLMTNDVAGVNLDEAVPCIALSKNDSYVMSACGGKVSLFNMMTFKVMTTFMPPPPASTFLAFHPQDNNIIAIGMEDSTIHIYNVRVDEVKSKLKGHQKRITGLAFSTCLNILVSSGADAQLCVWSIDTWEKRKSVPIQLPAGKAPVGDTRVQFHLDQIRLLVAHETQLAIYDASKMDRIRQWVPQDVLAAPISYAAYSCNSQLIYATFCDGNTGVFDADSLRLRCRIALSTYFSPPAALSGNQSAYPVAIAAHPLEPNQFAVGLTDGSVKVIEPSESEGKWGTSPPMDNGILNGRAASTSITSNLTPDQAQR

SEQ ID NO: 131108 - protein, 498 aa, Glycine max
  Coding DNA Sequence Number=SeqID_14330
  Homolog annotation: Hit_ID=Q1SYZ1; Match level="QueryCoverage=14%, HitCoverage=26%, E-value=5e-21, Identity=60%"; Hit description=Myb, DNA-binding; Calcium-binding EF-hand
  Pfam annotation: Domain name=DUF179; Domain location=121-309; Score =199.1; E_value=1e-56; Accession=PF02622.6; Description =Uncharacterized ACR, COG1678
MEACFLSHNSFTKTTDQLIPTIRNGSLPHPKRSSQHFHYRKARIPLPISCCHMSSPSPFDDDEKSTLSGDWRSFRAKLVAGEQLTRPVEEVSFSSVNDLDIVVDHPPLITIGDKWAHVIHEPEKGCILIATEKLDGVHIFERTVILLLSTGPLGPSGIILNRPSLMSIKETRSTALDVEGTFSNSPLFFGGPLEEGLFLLSPKEGGGGGDGVGKSGVFEEVMKGLYYGAKESVGCAAEMVKRNVIGLGDFRFFDGYCGWEKEQLRDEIRAGYWTVAACSPSVVGLGSVGSVGLWDEVLGLMSRRKLLRSRTLAKLKTREKKFKPVAEHVNAVHRLLDPASLPFKWSWRDVSIKKICLSLHHFNWKDDNNHWENFLKYKEGEEVGFDGGAEGGGGEARGEVAGEGVPPEEGGGKAGEEEERGGVSVGEAEGVVGGSGDGAGGAPVEVGQCALVLLSQRDNLPKGGVYPPGIIFGPTDLQERLQQNGISFDVISESTISS

SEQ ID NO: 131109 - protein, 257 aa, Glycine max
  Coding DNA Sequence Number=SeqID_14331
  Gene Ontology: Mol. function=transferase activity; Cellular component= intracellular; Biological process=mRNA editing
  Homolog annotation: Hit_ID=Q1SV87; Match level="QueryCoverage=76%, HitCoverage=61%, E-value=1e-25, Identity=35%"; Hit description =Pentatricopeptide repeat
MSPPLLYPQTIVDHETIFLQGILSNSSNAVSISPALAHFIKQLTRTLQLTTSDQPTNHGVPSDHIPLLHGQKQAHGPIKPGIPAPGVGVNKRIGHKDIPIKTNFFNMGMDHSDQRKRGGARTSLKEKRVREIIRKESVFLHLEESVEGERTVGTVVGVGSDDGVVEVDVGVGDVVEDVDSGGEVAAEGEGGDEFGSDEEVLVEIGFEDLGVDLVHRVQIGALVEVAELLFEESSPREPCGDSPSHRNLHLHRHSHSA

SEQ ID NO: 131110 - protein, 451 aa, Glycine max
  Coding DNA Sequence Number=SeqID_14332
  Gene Ontology: Mol. function=transferase activity; Cellular component= nucleus; Biological process=regulation of transcription
  Homolog annotation: Hit_ID=Q1RZ85; Match level="QueryCoverage=86%, HitCoverage=74%, E-value=5e-82, Identity=32%"; Hit description =Asp/Glu racemase; Polynucleotidyl transferase, Ribonuclease H fold
  Pfam annotation: Domain name=PPR; Domain location=100-134; Score =42.7; E_value=1.2e-09; Accession=PF01535.11; Description=PPR repeat
  Pfam annotation: Domain name=PPR; Domain location=202-236; Score =45.9; E_value=1.4e-10; Accession=PF01535.11; Description=PPR repeat
  Pfam annotation: Domain name=PPR; Domain location=237-271; Score=7.9; E_value=0.88; Accession=PF01535.11; Description=PPR repeat
  Pfam annotation: Domain name=PPR; Domain location=320-354; Score=1.3; E_value=5.3; Accession=PF01535.11; Description=PPR repeat
  Pfam annotation: Domain name=PPR; Domain location=38-72; Score=40.2; E_value=7.3e-09; Accession=PF01535.11; Description=PPR repeat
  Pfam module annotation: Pfam domain module=PPR::PPR::PPR::PPR::PPR; Domain location=100-134::202-236::237-271::320-354::38-72
MEERDVVTWNSMIGGLVRCGELQGACKLFDEMPDRDMVSWNTMLDGYAKAGEMDTAFELFERMPWRNIVSWSTMVCGYSKGGDMDMARMLFDRCPVKNVVLWTTIIAGYAEKGLAREATELYGKMEEAGMRPDDGFLLSILAACAESGMLGLGKRIHASMRRWRFRCGAKVLNAFIDMYAKCGCLDAAFDVFSGMMAKKDVVSWNSMIQGFAMHGHGEKALELFSWMVQEGFEPDTYTFVGLLCACTHAGLVNEGRKYFYSMEKVYGIVPQLFMLLRSMPMEPNAIILGTLLNACRMHNDVDLARAVCEQLFKLEPSDPGNYSLLSNIYAQAGDWMNVANVRLQMKNTGGEKPSGASSIEVEEEVHEFTVFDQSHPKSDDIYQMIDRLVQDLRQCIAGLLKTSKQIIVFITTTGLATKLYAWLMAEPMLLVQASQYGSQKLCLQHGVISLA

SEQ ID NO: 131111 - protein, 378 aa, Glycine max
  Coding DNA Sequence Number=SeqID_14333
  Gene Ontology: Mol. function=O-methyltransferase activity; Cellular component=cellular_component; Biological process=lignin biosynthetic process
  Homolog annotation: Hit_ID=P93324; Match level="QueryCoverage=99%, HitCoverage=100%, E-value=1e-121, Identity=57%"; Hit description =Isoliquiritigenin 2'-O-methyltransferase
  Pfam annotation: Domain name=Dimerisation; Domain location=40-98; Score=48.8; E_value=1.9e-11; Accession=PF08100.2; Description =Dimerisation domain
  Pfam annotation: Domain name=Methyltransf_2; Domain location=107-354; Score=340.1; E_value=3.9e-99; Accession=PF00891.8; Description=O -methyltransferase
  Pfam module annotation: Pfam domain module=Dimerisation::Methyltransf_ 2; Domain location=40-98::107-354
MSSCCLEKENHVVETATPQREDTDIILDAMVLGSNVVFPAALNAAIELKVFEIIGKESSEESGGFMSPHEIASKLLLPTQQHHSDLPNRLERLLLLLASYSLLTVSTRTDENGSAVRVYAVSPSGKYFVYDKNGGGYLASFTSFLCHPAMLGVWLNFKEAIIDPEIDLFKKVHGISKFEYFGKEPELNHVFNKAMNDVCTTHMKKILEVYTGYEGISTLVNVAGGTGQCLKLIISKYPSIKGINFDLPHVIENSPPIPGVEHIGGNMFEGVPQGDAIMLKAICHNWSDEKAIELLSNCHKALPPNGKVIVGDLIVPEDPEPTNDCKMISILDNIMFITPGGRERTEKQFESLGKRSGFSRFQVVCRAFSTMAVMEFYK

SEQ ID NO: 131112 - protein, 262 aa, Glycine max
  Coding DNA Sequence Number=SeqID_14334
  Subcellular localization annotation: CTP_CleavageSite=45; ConfidenceScore=5.47e-01
MTTLPSPSLLFILPNLKFSKTRAQCVNGLLCIHPKCTVKFSSRVNAFTLVANPTTRQVITLPLDQSIDKDFASQLILDTTLIKMSSKFLAWLCIKVVLIMRSRHYALMYHDLLSAFDSMWGLNSSGVMPAPPRYLEGVVWNLKHLNLMEIHGCLCLPGHTYNNSRNLKLWILMDYMWEQQKSVVLPSRVIFPLCRVPTGEILLLPYFLDRCVGEAYSDMDTTSSRSLVVMEMPCDPLWGDHTLVDFDIFYSQESFRLLSEET

SEQ ID NO: 131113 - protein, 498 aa, Glycine max
  Coding DNA Sequence Number=SeqID_14335
  Gene Ontology: Mol. function=sequence-specific DNA binding; Cellular component=nucleus; Biological process=regulation of transcription
  Homolog annotation: Hit_ID=Q39658; Match level="QueryCoverage=98%, HitCoverage=97%, E-value=1e-134, Identity=52%"; Hit description=SPF1- like DNA-binding protein
  Pfam annotation: Domain name=FLYWCH; Domain location=382-450; Score =6.2; E_value=0.015; Accession=PF04500.7; Description=FLYWCH zinc finger domain
  Pfam annotation: Domain name=WRKY; Domain location=217-275; Score =148.9; E_value=1.3e-41; Accession=PF03106.6; Description=WRKY DNA -binding domain
  Pfam annotation: Domain name=WRKY; Domain location=393-452; Score =157.1; E_value=4.7e-44; Accession=PF03106.6; Description=WRKY DNA -binding domain
  Pfam module annotation: Pfam domain module=FLYWCH::WRKY::WRKY; Domain location=382-450::217-275::393-452
  Subcellular localization annotation: CTP_CleavageSite=74; ConfidenceScore=5.56e-01
MYTPNADSGTAPHPRPTITLPPRPSAEAFFSAAGGASPGPMTLVSSFFGSDAAADCRSFSQLLAGAMASPMAFSAAAASAADNSGKDDDGPHKGFKQSRPMNLVIARSPVFTVPPGLSPSGFLNSPGFFSPQALAQVTAQAVLAQSHMHMQADYQMPSVTAPTEPPVQQLSFALNEASEQQVVSCVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKLSENIPNSSVPESDQTSNQGAPRQLLPGSNESEEVGIVDNREEADDGEPNPKRRQVYPLPLSQKTVTEPKIIVQTRSEVDLLDDGYRWRKYGQKVVKGNPHPRSYYKCTSAGCNVRKHVERASTDPKAVITTYEGKHNHDVPAARNSSHNTASSNSMPLKPHNVVPEKHPLLKDKDFGVQNEENEVA

SEQ ID NO: 131114 - protein, 702 aa, Glycine max
  Coding DNA Sequence Number=SeqID_14336
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=96%, HitCoverage=46%, E-value=0.0, Identity=60%"; Hit description =Multidrug resistance-associated protein 3
  Pfam annotation: Domain name=ABC_membrane; Domain location=167-444; Score=44.6; E_value=3.4e-10; Accession=PF00664.13; Description=ABC transporter transmembrane region
  Pfam annotation: Domain name=ABC_tran; Domain location=516-666; Score= 72.8; E_value=1.1e-18; Accession=PF00005.17; Description=ABC transporter
  Pfam module annotation: Pfam domain module=ABC_membrane::ABC_tran; Domain location=167-444::516-666
MSQKLTNSEFRSPQFTTNNKSLIPECLLGLLKTKTVIYITHQVEFLPDADLILVMREGRITQSGKYNDILRSDTDFMELVGAHREALSSVMSSERIPTLETVNISTKDSDSLRYFELEQEEKNIDDHHDKSDDTVKPKGQLIQEEEREKGRVRFKVYWKYITTAYGGAFVPFILLSQTLTTVFQIGSNYWMTLETPISATAETGIESFTLMVVYVALAIGSSFFNLVISVLREIAGYKTATILFNKMHFCFFRAPMSFFDATPSGRILNRASTDQNTIDISISYLVWVFTFILIHLLGTIAVMSQAAWQVFIILIPITATCIWYQRYYSASARELARLVGICQAPVIQHFSETISGSTTIRCFEQESRFNDIHMKLIDRYSQPRLYSASAIEWLAFRLDILSITTFAFCLVSLISFPNSITAPGIAGLAVTYGLNLNELQYNLIWDLCNLENEFISVERILQYTSIPSEAPLTIKDNQPDHSWPSFGEVHIQDLQVRYAPHLPLILRGLTCTFAAGAKTGIVGRTGSGKSTLVLTLFRLLEPVAGQILIDSVDISLIGIHDLRSRLSIIPQDPTMFEGTVRSNLDPLEEYTDEQIWEALDMCQLGDEVRKKEGKLDSSATASVDTATDNIIQQTVKQHFSECTVITIAHRITSILDSDMVLFLNQGLIEEYDSPKKLLKNNSSSLAQLVAEYTRRSNCGFGT

SEQ ID NO: 131115 - protein, 647 aa, Glycine max
  Coding DNA Sequence Number=SeqID_14337
  Gene Ontology: Mol. function=protein serine/threonine kinase activity; Cellular component=nucleus; Biological process=protein amino acid phosphorylation
  Homolog annotation: Hit_ID=Q1RZY7; Match level="QueryCoverage=73%, HitCoverage=78%, E-value=0.0, Identity=69%"; Hit description=Protein kinase
  Pfam annotation: Domain name=Pkinase; Domain location=40-324; Score =285.3; E_value=1.2e-82; Accession=PF00069.15; Description=Protein kinase domain
  Pfam annotation: Domain name=Pkinase_Tyr; Domain location=33-324; Score=31.6; E_value=2.1e-14; Accession=PF07714.7; Description =Protein tyrosine kinase
  Pfam module annotation: Pfam domain module=Pkinase::Pkinase_Tyr; Domain location=40-324::33-324
MSYFFKQNLTILKSSRLGIQTGCVKIYESAHELVKNRDSEQAKLSIGQGTYSSVFQAREVKTGRMVALKKVHFDKFQAESIRFMAREILILRTLDHPNIMKLEGIITSKLSNSIYLVFEYMEHDLAGLVASPDIKFTDSQIKCYMRQLLSGIEHCHLKGIMHRDIKVSNILVNNEGVLKIADFGLANTLVPNSKQPLTSRVVTLWYRPPENLLGSTNYGVSVDLWSVGCVFAELFLGKPILKGRTEVEQLHKIFKLCGSPPEEFWKKNKLPLATMFKPRTNYKTSLKERCRGFPATAVNLLETLLSIDPSKRGTASSALMSEYFSTKPYACNPSLLPKYPPSKEMDAKNWEDVRRKKNGGKVREAVTSKRQRQVHKVSHDHINFNKPALKEEMQNDSQNAAPDDGRAHVTKGKVAGAMHKEQPKPSYDAKSEAAQVVNGCNGYSVYSGPSPVSGSSGFTWAKRRKPKASSILSNGSIRKVSALDPTFAKGTYVLTEHGIEVSERKHSYNTNHQDVTSNYVSKKYLAPRVQQKSFDVADTYNSNYYMDFDFTDKMDALIDTQGHRKHGEPVEPKIIPSDKNDEMLHWNEHSMRQCLRKSRFGRGVVESVDIYDDGCNEPSSLHDEQHATTSFQIQDNERGKRSKDLTK

SEQ ID NO: 131116 - protein, 336 aa, Glycine max
  Coding DNA Sequence Number=SeqID_14338
  Gene Ontology: Mol. function=protein phosphatase type 2C activity; Cellular component=nucleus; Biological process=protein amino acid dephosphorylation
  Homolog annotation: Hit_ID=Q1SGL9; Match level="QueryCoverage=92%, HitCoverage=89%, E-value=1e-138, Identity=74%"; Hit description =Protein phosphatase 2C-like
  Pfam annotation: Domain name=PP2C; Domain location=43-305; Score =38.1; E_value=3.1e-08; Accession=PF00481.12; Description=Protein phosphatase 2C
MKKGRRNGKCGGREAAEAMAKEAKKNDMMLCSSGIVHVDGSNNFASVFSKRGQKGVNQDCCMVWEEFGCQEDMIFCGIFDGHGPWGHFVAKRIRESMPPSLLCNWQETLAQTSIDHPAIDVEEEKSKHYRFNIWKHSYLKTCAAIDQELEQYRKIDSFYSGTTALSIVRQGELIVIANVGDSRAVLATTSDDGSLVPVQLTIDFKPNLPQEAERIIQCQGRVFCLEDEPGVHRVWLPDEESPGLAMSRAFGDYCIKGHGLISVPEVWDVISNKEAVDIVSSAADKAKAAKRLVECAVHAWKRKRRGIAVDDISAICLFFHSSSLSTGQVSQVATLK

SEQ ID NO: 131117 - protein, 103 aa, Glycine max
  Coding DNA Sequence Number=SeqID_14339
MRHQIPMIGGMMNVLSGATLICKITHASNIFMIHIYRDSLAPLIELVRNHVPSWKMPRKWGDGMMQSYPSRALNRRLQEDWARDAREGAMVLMSLRVDFGPVG

SEQ ID NO: 131118 - protein, 413 aa, Glycine max
  Coding DNA Sequence Number=SeqID_14340
  Gene Ontology: Mol. function=transcription factor activity; Cellular component=nucleus; Biological process=regulation of transcription, DNA-dependent
  Homolog annotation: Hit_ID=Q1T6R1; Match level="QueryCoverage=99%, HitCoverage=98%, E-value=8e-99, Identity=50%"; Hit description =Pathogenesis-related transcriptional factor and ERF
  Pfam annotation: Domain name=AP2; Domain location=40-104; Score =133.8; E_value=4.6e-37; Accession=PF00847.10; Description=AP2 domain
MARKRKVTEAVEERNPCEATMAWEEVMKEAAELGSARRLRKKFVGVRQRPSGRWVAEIKDTIQKIRVWLGTFDTAEEAARAYDEAACLLRGANTRTNFWPSSQSSSTPALPSKITNLLLQRLKARNNNNNNNPCSLSSSSSSSSLFINHQQKQLEDVCGTESTFFSMDLFSDFLNDPEDYSTSNDEFSNDSAQIDYITSSLESCLNGNDDCREKEKEMEMEFDFSSVTPTSSADVNSGGEREEESEEATDLSAQDFQFLDNDVPPGYFYSPFEIAEDIEEQLEPENYGDEPSMLREVMKRMKYERKFSASLYAFNGIPECLKLKLESGNTNGRGVSISNQLTNLKMACSKNKNEANKKNEEYIEAMDRKEEENPQTSIGMECSSLSFSSRIDDDDGELLLWNSLDLPTLCFVN

SEQ ID NO: 131119 - protein, 68 aa, Glycine max
  Coding DNA Sequence Number=SeqID_14341
MKAPPSPGENTLNDAEASESRLTGWEFRDILKSRVHEAKWEVQEVKASTYARINHYRRGACTLANTNC

SEQ ID NO: 131120 - protein, 128 aa, Glycine max
  Coding DNA Sequence Number=SeqID_14342
  Gene Ontology: Cellular component=endoplasmic reticulum; Biological process=protein transport
  Homolog annotation: Hit_ID=Q9FKK1; Match level="QueryCoverage=61%, HitCoverage=75%, E-value=3e-21, Identity=68%"; Hit description =Arabidopsis thaliana genomic DNA, chromosome 5, P1 clone:MUF9
  Pfam annotation: Domain name=Sec61_beta; Domain location=30-75; Score= 80.6; E_value=4.8e-21; Accession=PF03911.7; Description=Sec61beta family
MAPRSFVTATAGMRRCHLGDKNSSTNIGIGGDSSNMQRFYTDDASGLKISPMVVLMMSLCFIDFVTALHVFGKLYHSKSGGTPDLKSIRFDVVATSTTSSKVYNDVAFKDRPAPSLNANKDRCKMGFF

SEQ ID NO: 131121 - protein, 85 aa, Glycine max
  Coding DNA Sequence Number=SeqID_14343
MRIKRSFKVVMGPRTRLVVSSKTRKGKQGSKGLSKELIQGKSIWLEAYKNKIASIISKYAWELGRINKNQAKAIVQAINGAKHTK

SEQ ID NO: 131122 - protein, 38 aa, Glycine max
  Coding DNA Sequence Number=SeqID_14344
MAIVIPRAVQINVKDPMVVLVHLHSIRLKIEMTPLNYK

SEQ ID NO: 131123 - protein, 576 aa, Glycine max
  Coding DNA Sequence Number=SeqID_14345
  Gene Ontology: Mol. function=amylo-alpha-1,6-glucosidase activity; Cellular component=membrane; Biological process=carbohydrate metabolic process
  Homolog annotation: Hit_ID=Q2QN15; Match level="QueryCoverage=92%, HitCoverage=68%, E-value=1e-102, Identity=40%"; Hit description =Early-responsive to dehydration protein, putative, expressed
  Pfam annotation: Domain name=DUF221; Domain location=354-576; Score= -70.7; E_value=5.8e-06; Accession=PF02714.6; Description=Domain of unknown function DUF221
MILAALLTSVVINLGLCFIFFTLYSVLRKQPGNITVYAPRLVSEGKRQEGDQFNLERLLPATTAGWVRKAWETSEEEFLSTAGLDAFVFMRIFVFSLKIFTFGGIVGLLILLPINCTGSQLHDDSDFQNKSLDSFSISNVNNGSNRYFKAFLLPMQYAYCVSRPGCSPIHCVHKGYSIECHQIWPFSRLWIHFCAAYVFTGVVCILLYDEYEHISSKRIACFYSSKPEPHHFTILVRGIPVPHGSTCNDIVEHFFQEYHPSTYHSHSVVRRSSKLQILVEDIAQAHLTLCWNLVFIQKMGETDAERLYKRLTQLKDKDNAPQRHRRDGCLGLFGHKVDILDHYEKTLGDIADNVRMEQSSLAGKEIPAAFVSFKSRFGAAIALNIQEGVNPTDWSTEQAPEPHDVYWPFFSVTFIRRWISKLVAYVACNILTILFLIPVALVQGLIHLDQLETMFPSLRCILRMAVVSQVITGYFPILILQMFLSAVPPIMIMLSSLQGYISWSQIQKRSALYRLTIFLEPKEFPRVLAEAVPAQFYEKFLNCLYQDEVIKRARNQKKNDDKKDYVISKELPYQSA

SEQ ID NO: 131124 - protein, 714 aa, Glycine max
  Coding DNA Sequence Number=SeqID_14346
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=97%, HitCoverage=99%, E-value=1e-130, Identity=48%"; Hit description =Probable Na/H antiporter [imported]-Arabidopsis thaliana
  Pfam annotation: Domain name=Na_H_Exchanger; Domain location=34-398; Score=-25.6; E_value=0.0023; Accession=PF00999.11; Description =Sodiumhydrogen exchanger family
MANTMPACYEVYITNPSRIWQTDKVLKTELPIIAFQIAFVVVLSRIFFIIYKPLHQTRLISQISVGFLLTPPLLGRYTPIFEFIFPVNGVLNVEVLSHLGLIFYAFLSGLEMNLDTILRVKKKAASIAVAGIVFPMVMGPCLYALYRKIYGSHGVFPLEESTVNAYLLWTLILTVTGFPVIAHTLSELKLIYTGLGKAALTAAMISDTYSWILFTLLVPFAINGQGAIYTVLSTLVFIVVCIFVVRPIILRFMDNKILSTLFASFFFGVHTKDGLAMGLLLNTKGAMALIMLNIAWDRAIFSVPTYAVMASAVLLMTVVVSPVINAVYRPRKRFEQNKLKTIQKLRVDAELRILACVHNTRQATSMISIIETFNATRLTPIHVFAMYLIELTGRAAALVAAHIEKPSSQPGEQNLTKSQAELENIANAFDAFGEAYDAARIETLNVVSSYATIHEDIYNSANEKHTSLIVLPFHKQLNSEGALEVTNVVYRDINQNVMQHAPCSVGIFVDRDFGSIPKTNLRILMLFVGGPDDREALAVAWRMAGHPGIKLSVIRILLCDEAAEVDSSIHAEARGILSSVMDSEKQKELDDDYINSFRYTAVNNKDYISYSEIDVHTGEDIPAILNELEKNGCDLYVVGQGNCRSSKVFSNLLEWCECLELGVIGDILASNNSGSRSSLLVVQQYGYGGMAFGNNLHQKGTNNDGFESLVVKTE

SEQ ID NO: 131125 - protein, 84 aa, Glycine max
  Coding DNA Sequence Number=SeqID_14347
MTDDSEVSFNNLCVAFHRLHEYSIETGLATIIDGDDILKVSTKHLRDLTFQVGSVYQFISELLIQAVMREFCKHVLVETLMGLI

SEQ ID NO: 131126 - protein, 277 aa, Glycine max
  Coding DNA Sequence Number=SeqID_14348
  Gene Ontology: Mol. function=transferase activity, transferring hexosyl groups; Cellular component=Golgi stack; Biological process =metabolic process
  Homolog annotation: Hit_ID=Q1SQR9; Match level="QueryCoverage=99%, HitCoverage=63%, E-value=9e-73, Identity=37%"; Hit description =Tetratricopeptide-like helical
  Pfam annotation: Domain name=PPR; Domain location=219-253; Score =19.2; E_value=0.014; Accession=PF01535.11; Description=PPR repeat
  Pfam annotation: Domain name=PPR; Domain location=22-56; Score=30.4; E_value=6.2e-06; Accession=PF01535.11; Description=PPR repeat
  Pfam annotation: Domain name=PPR; Domain location=57-91; Score=28.5; E_value=2.3e-05; Accession=PF01535.11; Description=PPR repeat
  Pfam module annotation: Pfam domain module=PPR::PPR::PPR; Domain location=219-253::22-56::57-91
MFHEAIDFLFLTRRRGIVPDVLTCNFLFNRLVEHGEVDKALAVYEQLKRFGFSPDCYTYAIVIKALCKKGDLKQPLCVFEEMERVGGIPHSYCYAGYIEGLCNNHRSDLGYEVLQAFRNGNAPLQVYTYEVVRGFSNEMKKLDEARGVFNGYCKSHNLLKALALHDEMLHSSLFGEMGMTLEVVDQFKDLKESRMLLDGVAYNIVFDALCKLVKVEDAVEMVEDINGYCLQGDLVTAFSVFKEMKGKGFKPDVVTSNVLATRLSRNGHACEAVKLLV

SEQ ID NO: 131127 - protein, 79 aa, Glycine max
  Coding DNA Sequence Number=SeqID_14349
  Gene Ontology: Mol. function=protein binding; Cellular component =integral to membrane; Biological process=transport
  Homolog annotation: Hit_ID=Q1T6P1; Match level="QueryCoverage=91%, HitCoverage=26%, E-value=4e-25, Identity=73%"; Hit description=GOLD
MELAKPVMELELQKLNDIASSIHDEIFYLREREVEMQDLNDETNTKMFTFTLVSILVCLSVAGLQLWHLKSFFEKKKLI

SEQ ID NO: 131128 - protein, 643 aa, Glycine max
  Coding DNA Sequence Number=SeqID_14350
  Gene Ontology: Mol. function=binding; Cellular component=nucleus; Biological process=protein kinase C activation
  Homolog annotation: Hit_ID=Q8S7V8; Match level="QueryCoverage=73%, HitCoverage=95%, E-value=1e-117, Identity=47%"; Hit description =Putative pentatricopeptide repeat containing protein
  Pfam annotation: Domain name=PPR; Domain location=143-177; Score =11.4; E_value=0.33; Accession=PF01535.11; Description=PPR repeat
  Pfam annotation: Domain name=PPR; Domain location=209-243; Score =50.5; E_value=5.8e-12; Accession=PF01535.11; Description=PPR repeat
  Pfam annotation: Domain name=PPR; Domain location=244-278; Score=9.8; E_value=0.52; Accession=PF01535.11; Description=PPR repeat
  Pfam annotation: Domain name=PPR; Domain location=310-344; Score =37.0; E_value=6.4e-08; Accession=PF01535.11; Description=PPR repeat
  Pfam annotation: Domain name=PPR; Domain location=345-379; Score =16.3; E_value=0.087; Accession=PF01535.11; Description=PPR repeat
  Pfam annotation: Domain name=PPR; Domain location=413-447; Score=5.6; E_value=1.6; Accession=PF01535.11; Description=PPR repeat
  Pfam annotation: Domain name=PPR; Domain location=73-107; Score=12.9; E_value=0.22; Accession=PF01535.11; Description=PPR repeat
  Pfam module annotation: Pfam domain module=PPR::PPR::PPR::PPR::PPR::PP R::PPR; Domain location=143-177::209-243::244-278::310-344::345 -379::413-447::73-107
MGTTTVAFTLAHMAERCTCMRDLKLLHAHAFRTRLHDHTVVLGKLFRFAAVSPLGDLRYAHRMFDQMPHPTTFFYNTLIRAHAHSTTPSLSSLSFNLMRQNNVAPDQFSFNFLLKSRSRTTPLTHHNDVHGAVLKFGFCRHLHVQNGLIHFYANRGMTLLARRVFEDVLQLGLEVDVVSWSGLLVAHVKAGELEVARRVFDEMPQRDVVSWTAMLTGYSQAKRPREALELFGEMRRSGVWPDEVTMVSLVSACASLGDMETGMMVHRFVEENGFGWMVALCNALIDMYGKCGCLEEAWRVFHGMTRKSLITWNTMVTVCANYGNADEAFRLFEWMVCSGVVPDSVTLLALLVAYAHKGLVDEGIRLFESMDRDYGVEPRIEHYGAVIDMLGRAGRLQEAYDLLTNIPIPCNDAVWGALLGACRIHGDVEMGEKLIKKLLELKPDEGGYYILLRDIYVAAGQTVEANETRQAMLASRARKNPGFHQGNYNGEFVCAFASNLGVCLIVKVELWAILIAIILALSRGFSKLSVECGSATAINMINSGVDASTNLGTTLNFRCYHVFREANSPADAVASHGMSIDTGIKLLDSIPDFIYLLLLAYASAATWYCHEEAEQFLMYPFIDPEPEKPWLAQRRALRISYSA

SEQ ID NO: 131129 - protein, 75 aa, Glycine max
  Coding DNA Sequence Number=SeqID_14351
MLYRLKGMLRILGDGETKILISNKVAFMILRDTVMTRSIDQQNQEPGTAEPSKDAKPNNGQKEKSTNPTTLKDFV

SEQ ID NO: 131130 - protein, 64 aa, Glycine max
  Coding DNA Sequence Number=SeqID_14352
  Gene Ontology: Mol. function=protein binding; Cellular component =nucleus; Biological process=regulation of timing of transition from vegetative to reproductive phase
  Homolog annotation: Hit_ID=Q84XL0; Match level="QueryCoverage=90%, HitCoverage=33%, E-value=5e-26, Identity=93%"; Hit description=SP3D
MGIHRLVFVLFRQLGRETVYAPGWRQNFNTREFAELYNLGLPVAAVYFNIQRESGSGGRSCRML

SEQ ID NO: 131131 - protein, 37 aa, Glycine max
  Coding DNA Sequence Number=SeqID_14353
MEDAYVEGELLLQCLRWWAWVSEVGANWFGVLRIQNM

SEQ ID NO: 131132 - protein, 161 aa, Glycine max
  Coding DNA Sequence Number=SeqID_14354
MATKVPASAEVAMKALLAENAAEGGGGSALPEGPGEGPGGVLGEVGLGVTVGEGEGGEAAGEEAGVGAAVGGAGAGVGVAAGGGVAAGGGVAAGGGVAGGADLGGGGDGVVVGGCDGAAPGAWAKHELAKSPKIRNSCTAPEPISREKVVVVAVLRCVRER

SEQ ID NO: 131133 - protein, 55 aa, Glycine max
  Coding DNA Sequence Number=SeqID_14355
MKEKWSECEAAEEKKRKVLLDNGVAEVEVTDLDVRGKFDDAEGFENNVIHATKIC

SEQ ID NO: 131134 - protein, 300 aa, Glycine max
  Coding DNA Sequence Number=SeqID_14356
  Gene Ontology: Mol. function=protein-tyrosine kinase activity; Cellular component=integral to membrane; Biological process=protein amino acid phosphorylation
  Homolog annotation: Hit_ID=Q67YR4; Match level="QueryCoverage=97%, HitCoverage=96%, E-value=1e-77, Identity=52%"; Hit description =Somatic embryogenesis receptor-like kinase-like protein
  Pfam annotation: Domain name=Pkinase; Domain location=16-291; Score= -46.9; E_value=9e-06; Accession=PF00069.15; Description=Protein kinase domain
  Pfam annotation: Domain name=Pkinase_Tyr; Domain location=47-291; Score=-88.7; E_value=5e-07; Accession=PF07714.7; Description=Protein tyrosine kinase
  Pfam module annotation: Pfam domain module=Pkinase::Pkinase_Tyr; Domain location=16-291::47-291
MDPFIHKLRRHLLAWFHRSRSGAVFFVRRISYKDVRRATDGFHRVLYSNSEVSAYAAKFGDGGGACLVREVKGFDEGNDDFYRHVQFLGRLRHRHLLSLRGFSVGRNHKRLLIFDNIENGSLKDHLNDPLKTPLDWRTRLQIANGVVAALEYLFLFSDPPVCHVSITSSNIMLDENFTAKLSDFGLLTSGGNSVMVPYSEDLKQKSCKIIFQLGVLILELVTGQSSEMEGSDLIEWIQESRFYNSIDKMIDPDLGNNYDCTELKSLLAVAKLCIKSWDKPSFTIPQLFRHLQKKIDISNY

SEQ ID NO: 131135 - protein, 123 aa, Glycine max
  Coding DNA Sequence Number=SeqID_14357
MDLSRPQFSKPDSSESLQFFWFLLLLNLESTLLWVHRVGTHKSCDTLSYSFEVHSNARSLRSDRRARFTWKSSEELPSLRMRELGIDSETVRYIFVADGEMCLNSTISGSAFLLLGILGFNGY

SEQ ID NO: 131136 - protein, 516 aa, Glycine max
  Coding DNA Sequence Number=SeqID_14358
  Gene Ontology: Mol. function=protein binding; Cellular component =cytoplasm; Biological process=ubiquitin cycle
  Homolog annotation: Hit_ID=Q1SGK8; Match level="QueryCoverage=99%, HitCoverage=84%, E-value=0.0, Identity=58%"; Hit description=Leucine- rich repeat; Leucine-rich repeat, cysteine-containing subtype
  Pfam annotation: Domain name=LRR_1; Domain location=21-40; Score=4.8; E_value=37; Accession=PF00560.23; Description=Leucine Rich Repeat
  Pfam annotation: Domain name=LRR_1; Domain location=226-253; Score =7.5; E_value=11; Accession=PF00560.23; Description=Leucine Rich Repeat
  Pfam annotation: Domain name=LRR_1; Domain location=278-301; Score =6.4; E_value=18; Accession=PF00560.23; Description=Leucine Rich Repeat
  Pfam annotation: Domain name=LRR_1; Domain location=303-326; Score =2.6; E_value=95; Accession=PF00560.23; Description=Leucine Rich Repeat
  Pfam annotation: Domain name=LRR_1; Domain location=329-353; Score =3.2; E_value=72; Accession=PF00560.23; Description=Leucine Rich Repeat
  Pfam annotation: Domain name=LRR_1; Domain location=355-378; Score =10.5; E_value=3.1; Accession=PF00560.23; Description=Leucine Rich Repeat
  Pfam annotation: Domain name=LRR_1; Domain location=406-429; Score =0.5; E_value=2.3e+02; Accession=PF00560.23; Description=Leucine Rich Repeat
  Pfam annotation: Domain name=LRR_1; Domain location=432-455; Score =2.1; E_value=1.2e+02; Accession=PF00560.23; Description=Leucine Rich Repeat
  Pfam annotation: Domain name=LRR_1; Domain location=47-82; Score=2.4; E_value=1e+02; Accession=PF00560.23; Description=Leucine Rich Repeat
  Pfam annotation: Domain name=LRR_1; Domain location=97-124; Score =0.5; E_value=2.3e+02; Accession=PF00560.23; Description=Leucine Rich Repeat
  Pfam annotation: Domain name=LRR_2; Domain location=226-251; Score =10.4; E_value=0.6; Accession=PF07723.3; Description=Leucine Rich Repeat
  Pfam annotation: Domain name=LRR_2; Domain location=255-277; Score =2.7; E_value=6.9; Accession=PF07723.3; Description=Leucine Rich Repeat
  Pfam annotation: Domain name=LRR_2; Domain location=278-302; Score =2.4; E_value=7.7; Accession=PF07723.3; Description=Leucine Rich Repeat
  Pfam annotation: Domain name=LRR_2; Domain location=329-354; Score =0.5; E_value=14; Accession=PF07723.3; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_2::LRR_2::LRR _2::LRR_2; Domain location=21-40::226-253::278-301::303-326::329 -353::355-378::406-429::...
  Pfam module annotation: Domain location=432-455::47-82::97-124::226 -251::255-277::278-302::329-354
MDKCLGVTDIGLAKIAVGCGKLERLSLKWCLEISDLGIDLLCKKCLDLKFLDVSYLKVEGTKWTTEDSDFSRPLHSLPLSLLMVTSESLRSIASLLKLEVFVMVGCSLVDDVGLRFLEKGCPLLKAIDVSRCDCVSSSGLISVISGHGGLEQLDAGYCLSELSAPLVKCLENLKQLRIIRIDGVRVSDFILQTIGTNCKSLVELGLSKCVGVTNKGIVQLVSGCGYLKILDLTCCRFISDAAISTIADSCPDLVCLKLESCDMVTENCLYQLGLNCSLLKELDLTDCSGVDDIALRYLSRCSELVRLKLGLCTNISDIGLAHIACNCPKMTELDLYRCVRIGDDGLAALTSGCKGLTNLNLSYCNRITDRGLEYISHLGELSDLELRGLSNITSIGIKAVAISCKRLADLDLKHCEKIDDSGFWALAFYSQNLRQINMSYCIVSDMVLCMLMGNLKRLQDAKLVCLSKVSVKGLEVALRACCGRIKKVKLQRSLRFSLSSEMLETMHARGCKIRWD

SEQ ID NO: 131137 - protein, 129 aa, Glycine max
  Coding DNA Sequence Number=SeqID_14359
  Gene Ontology: Mol. function=protein binding
  Homolog annotation: Hit_ID=Q1SGK8; Match level="QueryCoverage=100%, HitCoverage=19%, E-value=1e-50, Identity=77%"; Hit description =Leucine-rich repeat; Leucine-rich repeat, cysteine-containing subtype
  Subcellular localization annotation: CTP_CleavageSite=66; ConfidenceScore=5.18e-01
MGHIHGLQHGTRPNQHLQAHMPQPGGATQHESPQSPSPTRRSLTQHNRHSSVLDPRTHRQVQRLNVAELLQQPKQKLDSEDPNLLPGRRFDPEKLLAHQPPRFPIRPELFEDPDEQVLGQEAENGFRQH

SEQ ID NO: 131138 - protein, 565 aa, Glycine max
  Coding DNA Sequence Number=SeqID_14360
  Gene Ontology: Mol. function=enzyme inhibitor activity; Cellular component=cell wall; Biological process=cell wall modification
  Homolog annotation: Hit_ID=Q1SFY9; Match level="QueryCoverage=99%, HitCoverage=99%, E-value=0.0, Identity=72%"; Hit description =Pectinesterase; Pectinesterase inhibitor
  Pfam annotation: Domain name=PMEI; Domain location=36-189; Score =124.4; E_value=3.1e-34; Accession=PF04043.6; Description=Plant invertasepectin methylesterase inhibitor
  Pfam annotation: Domain name=Pectinesterase; Domain location=247-546; Score=624.7; E_value=8e-185; Accession=PF01095.10; Description =Pectinesterase
  Pfam module annotation: Pfam domain module=PMEI::Pectinesterase; Domain location=36-189::247-546
MGGDAQKKRIAIIGVSTFLLVAMVVAVTEESKSSVASSIKAVKTLCAPTDYKKECEDSLIEHSNNITDPRELIKIAFHVTISKIGEGLEKTELMHQVENDPRTKEALDTCKQLMNLSIGEFTRSLDRFTKFDLNNLDNILTSLKVWLSGAITYQETCLDAFENTTTDASLKMQRLLQSAMHMSSNGLSIITELSKTLSEMHIGKPGRRRLLNNNVLGHDYFDLPEWVDDQVGVRKLLHMTGRKRMAHVVVAKDGSGNFTTINEALKHVPKKNLRPFVIYVKEGVYNEYVEVSKNMTHVVMIGDGGKKSRITGNKNFVDGVGTFRTASAAILGDFFVGIGMGFENSAGAEKHQAVALRVQADRSIFYKCRMDGYQDTLYAHTMRQFYRDCIISGTIDFVFGDAVAVLQNCTFVVRKPLENQQCIVTAQGRKEMNQPSGLIIQGGSIVADPMYYPVRFDNKAYLARPWKNFSRTIFMDSYIGDLITPDGYMPWQTLEGLRGMDTCFYSEFNNRGPGSDKAKRVKWEGIKALDSDGISNFLPAKFFHGDDWIRVTRVPYYSGQPSPTH

SEQ ID NO: 131139 - protein, 79 aa, Glycine max
  Coding DNA Sequence Number=SeqID_14361
MSKQNPQLRLQPPAVRSEFGDTKLRAPHPIYRVCPSQSSLNLLSERWVCGVKRSISALAVSISGDSSSFKIKRATKQNI

SEQ ID NO: 131140 - protein, 170 aa, Glycine max
  Coding DNA Sequence Number=SeqID_14362
  Subcellular localization annotation: CTP_CleavageSite=37; ConfidenceScore=5.21e-01
MAASSSSLSASDDSSSHRRRRHHRHRRYRDKDSLKIRKKSKSQSQSRGERRRRHHRHSSDSDSYSSSSLSDYSRSESSSDSEHETSHRSKRHKKSDRPKKNKEKDRSKSHRHKRQKHKVKEFLGHDKDDGVRRSAVSGKKILLKLEKTKEDKVAESKRNELLNFLNASFD

SEQ ID NO: 131141 - protein, 377 aa, Glycine max
  Coding DNA Sequence Number=SeqID_14363
  Gene Ontology: Mol. function=RNA-directed DNA polymerase activity; Biological process=RNA-dependent DNA replication
MWQELHDLQSTHKGAWSFIGTLTPSLVPTRNRGDLLCPPQVNSDHNPLMLLMNGVQRPKAPFKYHAMWSSHPDCKRLVSEIWNQPQVGCPMQVLKQKLKNLISALKSWNNEVFGNIHQNCDRAMQQVVAIHSRIELEVLNDELVRLDFKAQKDLHEALAYEEAFWKEKSRLDWLTLGDRNSAFYRMTKIKRATKSISTIKYGDIMLCSLICSLWKEVKAAVFSMSSSSAPGPTSFGGFGFCATFCCWVRIILELARLSFAINDSLWGGKEKYHYSHDFFSQLQGGFWPAYSPEKCQFFHGALSNIRVREIKNILGFSVGSLPFIYLSVPLFQEKPRPVHLRPIADRIKAELQSWKGNLLSFMGCVQLIISIIDGMLL

SEQ ID NO: 131142 - protein, 275 aa, Glycine max
  Coding DNA Sequence Number=SeqID_14364
  Gene Ontology: Mol. function=protein translocase activity; Cellular component=outer membrane; Biological process=intracellular protein transport
  Homolog annotation: Hit_ID=Q6H7M7; Match level="QueryCoverage=97%, HitCoverage=40%, E-value=3e-30, Identity=32%"; Hit description =Putative outer envelope membrane protein OEP75
  Pfam annotation: Domain name=Bac_surface_Ag; Domain location=3-273; Score=-51.5; E_value=0.042; Accession=PF01103.13; Description =Surface antigen
MQHVRPLNDDGRAICRDYDGFPLTSSGNPHDSMVVLKQESQFAKANDNSFFHFNLQIEQGIPVLSKWIIFNRFKFVASKGIKLGPAFLLTRLFDKQLANITTLSCDRLTGGSIVGDMAPYQAFSIGGVGSVRGYGEGAVGSGRSCLVANSELTLPLRIREYMSPSDKKLTGSCCIFTIFSDLLFVAQCFAHDILALKNFMNKMLEGAIFLDFGTDLRSGHLVPGNPALRQGKPGSGIGLGYGLRFKSQFGHFQVDYAINAFQQRTLYFGLSNLAS

SEQ ID NO: 131143 - protein, 184 aa, Glycine max
  Coding DNA Sequence Number=SeqID_14365
  Gene Ontology: Mol. function=structural constituent of ribosome; Cellular component=ribonucleoprotein complex; Biological process =translation
  Homolog annotation: Hit_ID=P42791; Match level="QueryCoverage=78%, HitCoverage=77%, E-value=5e-68, Identity=84%"; Hit description=60S ribosomal protein L18-2
  Pfam annotation: Domain name=Ribosomal_L18e; Domain location=14-183; Score=375.5; E_value=8.1e-110; Accession=PF00828.9; Description =Eukaryotic ribosomal protein L18
MMINVIPAHYETLRHLKVSFLCHCNGLKLYRFLVRRTGSNFNAVILKRLFMSKVNKPPISLSRLIKYTKGKEDKIAVIVGTVTDDIRVYEVPALKITALKFTERARARIEKAGGECLTFDELALRAPLGQNTVLLRGPKNAREAVKHFGPAPGVPHSHTKPYVRAKGRKFERARGRRNSRGFRV

SEQ ID NO: 131144 - protein, 77 aa, Glycine max
  Coding DNA Sequence Number=SeqID_14366
  Gene Ontology: Mol. function=phosphoprotein phosphatase activity; Cellular component=cytoplasm; Biological process=protein amino acid dephosphorylation
  Homolog annotation: Hit_ID=P48490; Match level="QueryCoverage=79%, HitCoverage=19%, E-value=5e-23, Identity=91%"; Hit description =Serine/threonine-protein phosphatase PP1
DRQIAKRRLVTIFSAPNYGGEFDNAGALLSVDDSLVCSFEILKPADRASGSGSSKMNFKKEFDMGEPSFHSTIADCQ

SEQ ID NO: 131145 - protein, 178 aa, Glycine max
  Coding DNA Sequence Number=SeqID_14367
  Homolog annotation: Hit_ID=Q8LKG1; Match level="QueryCoverage=73%, HitCoverage=100%, E-value=2e-34, Identity=58%"; Hit description=Drm3
MNTAKAKKAATSSAFRYEKMRHTSKGEEGPDLFCPLFSRKEITTLPENGEIGGVEPAGETGGDPLWYPGGFTIMILRVTLVASSDDSSPCGLVVKRKSLVTYMSVINEALRQGVPLPELGRKVKVWCFRSLPRPFSGLGPATVSSHKWSRRPIWIKRILADPAYGDPNNDQVSESGHI

SEQ ID NO: 131146 - protein, 108 aa, Glycine max
  Coding DNA Sequence Number=SeqID_14368
  Homolog annotation: Hit_ID=Q1SYH1; Match level="QueryCoverage=87%, HitCoverage=40%, E-value=7e-12, Identity=36%"; Hit description =Nucleic acid-binding, OB-fold, subgroup
  Pfam annotation: Domain name=DUF223; Domain location=4-100; Score =21.9; E_value=2.7e-05; Accession=PF02721.5; Description=Domain of unknown function DUF223
MTSMEMVLLDAKGDNIHAYVKKSLKKDFKDVIQEDNADLFENLLVALNDYQFKTTPHKFKLNFMGSTKCKDVHDDSIPKFSFDFMSFTDILGKTRENILLGNVLLDLL

SEQ ID NO: 131147 - protein, 60 aa, Glycine max
  Coding DNA Sequence Number=SeqID_14369
MSTCMSKKIQGQSLSIEEENTVVVQKQGIVTIFASNHDAPTSLRRTLSADMSSKTWLSQN

SEQ ID NO: 131148 - protein, 113 aa, Glycine max
  Coding DNA Sequence Number=SeqID_14370
MGLNQAHAFTKKVHQVKLKYGSNHLAKIGAKDGSEHALRCPYRTLARARVIGEVEEVQEQIKTDMEAMKEQMATLMEVMMSMKKIMEVNAVAIAATSSIAEVDLTPPHMASTK

SEQ ID NO: 131149 - protein, 78 aa, Glycine max
  Coding DNA Sequence Number=SeqID_14371
MESKVLVDKGVSDVENDTGHANDNSTVVAVVAGMAIARRQRQRLSSSLCVAPPSPPTPPQKQDDVKSYLSHHHLTDAN

SEQ ID NO: 131150 - protein, 94 aa, Glycine max
  Coding DNA Sequence Number=SeqID_14372
MLKRTCGVESWRRRETCALGPLMVVGRILELEKKRRAEKQGLNYVVGKKRRTKGAASVAVAGERKGKRDTKINCLFCVWPSRASQSRLNFPILG

SEQ ID NO: 131151 - protein, 77 aa, Glycine max
  Coding DNA Sequence Number=SeqID_14373
MTSVILDIGDPFIDKNLGLHLMMFDNRRGLGIGLENRLFYRNSFQVGEVVEGDRTGPEEVVEAHVQANKVCHIKQKG

SEQ ID NO: 131152 - protein, 60 aa, Glycine max
  Coding DNA Sequence Number=SeqID_14374
MEKKGLIGLRAYSSTLIQWCKPPQDWLKCNVDGSEAGVLSGLPLAIGSLVISIILVLLMC

SEQ ID NO: 131153 - protein, 113 aa, Glycine max
  Coding DNA Sequence Number=SeqID_14375
  Gene Ontology: Mol. function=zinc ion binding
  Homolog annotation: Hit_ID=Q1SG03; Match level="QueryCoverage=98%, HitCoverage=33%, E-value=1e-31, Identity=75%"; Hit description=Zinc finger, RING-type; Zinc finger, PHD-type
MLGPVIESKLFKHIINLSYLIILPQYGHLLLLALEDPVVIVGSSGHNFQEETHLPSRFHAREREHLPSLPLNHVGRESSWRAYHQTASVSDPSIRSSSFRLRHESDRMPSQNR

SEQ ID NO: 131154 - protein, 161 aa, Glycine max
  Coding DNA Sequence Number=SeqID_14376
  Gene Ontology: Mol. function=zinc ion binding
  Homolog annotation: Hit_ID=Q1STG4; Match level="QueryCoverage=83%, HitCoverage=35%, E-value=6e-57, Identity=75%"; Hit description=Zinc finger, RING-type; Zinc finger, PHD-type
MEDWGEQVFGNNGVWKCCAGWLAGNAYHDMLGQQAIFAEHTAVSSASHPCPYIAYFGPIHPSTSNSGLTVSEASNFNHWNGPPVPGDMPTSYTFPAVDLHYHSWEHNSSHFSSANSRLGTSEQTSVSPGSQRPARGGSDVPRSGSFMHPFLVGHRCLFVPY

SEQ ID NO: 131155 - protein, 267 aa, Glycine max
  Coding DNA Sequence Number=SeqID_14377
  Gene Ontology: Mol. function=transition metal ion binding
  Homolog annotation: Hit_ID=Q6AVJ1; Match level="QueryCoverage=99%, HitCoverage=23%, E-value=6e-96, Identity=70%"; Hit description =Expressed protein
  Pfam annotation: Domain name=Acid_phosphat_A; Domain location=13-264; Score=-20.5; E_value=2.9e-06; Accession=PF00328.12; Description =Histidine acid phosphatase
WIKVAKSNGEGEEERPVQALMVLKYGGVLTHAGRKQAEELGRYFRNNMYPGLLRLHSTYRHDLKIYSSDEGRVQMSAAAFAKGLLDLEGQLTPILVSLVSKDSSMLDGLDNASIEMEEAKARLNEIITSSSKTIYNNGSPEFSWMVDGAGLPPNASELLPKDHVELSFMFILSHPYLLGTCLPLSEPINLERMVTEQVRLLATDEDEKLAEKSLYDVIPPYDQAKALGKTNIDVDRIAAGLPCGSEGFLLMYARWKKLERDLYNERK

SEQ ID NO: 131156 - protein, 83 aa, Glycine max
  Coding DNA Sequence Number=SeqID_14378
MENQGRNEIKGERESRRRGWQWWCNGGGSIGEGEEGDDMTIIPDRESDSEAEVEHTEKLRQVKAVLEEVFNFNFVHYMIIASL

SEQ ID NO: 131157 - protein, 212 aa, Glycine max
  Coding DNA Sequence Number=SeqID_14379
  Homolog annotation: Hit_ID=Q1SG00; Match level="QueryCoverage=99%, HitCoverage=97%, E-value=1e-62, Identity=63%"; Hit description =Fibronectin, type III-like fold
FDLKIWVSSSLSIYHICMCNMLILLSILHIIVNGPTLCFGNKVEDKILKVGEELWRETLPLHGGSCFYQLQGLKPHTWYEVKISYPASIPASFSIQLKRNKSDVVLNNNRRLLNTEKLIFKTNSNQDEFQSVLVTVEPEGFPAKLHVAERQFIIFNIVSDELLLGIPHKAWWVVALALLGLGIAFIVPSFLPLYLLPKKQVSRTDNYVSKTS

SEQ ID NO: 131158 - protein, 113 aa, Glycine max
  Coding DNA Sequence Number=SeqID_14380
MHLHLSNPNQSLDPLSPEIEGIRYRDPIVSPSWDWAPLVASSSLHCGPLSELELPEPKPYTHLSHKFNSAYNQILVMNPFFSVSSQPDPDIGYGLVVRKTTATGDNRLYTFEG

SEQ ID NO: 131159 - protein, 122 aa, Glycine max
  Coding DNA Sequence Number=SeqID_14381
MASRKRHASTSRPQEPYDTSRFVSEVACERYEQNVHARNILPERNVELAVTQYDEFRQVLKRRKWSRALTKQPYNHIDLALVNEFYANLYDPEDCSLRSLPRSSASQGEDSFLMLREHHGSF

SEQ ID NO: 131160 - protein, 68 aa, Glycine max
  Coding DNA Sequence Number=SeqID_14382
MASVLCMEVSTGAEGTGAGVGAGQVNGRAEGLEGEGIRHNSSNDAQGCDKCKKSKPRGVGLGHLGDLA

SEQ ID NO: 131161 - protein, 130 aa, Glycine max
  Coding DNA Sequence Number=SeqID_14383
  Gene Ontology: Mol. function=endopeptidase Clp activity; Biological process=proteolysis
  Homolog annotation: Hit_ID=Q67XY5; Match level="QueryCoverage=72%, HitCoverage=28%, E-value=6e-37, Identity=78%"; Hit description=ClpP protease complex subunit ClpR3
  Pfam annotation: Domain name=CLP_protease; Domain location=1-75; Score=-72.6; E_value=0.0024; Accession=PF00574.13; Description=Clp protease
MIQQPRIPSSGLMPASDVLIRAKEVIINRDNLVKLLAKHTGNSEETVANVMKRPYYMDATRAKEFGVIDRILWRGQEKVMADVASPDDWDKGAAIHRKLELSTGFRPVGQPGPVRVRASNSSGNSHSEIE

SEQ ID NO: 131162 - protein, 328 aa, Glycine max
  Coding DNA Sequence Number=SeqID_14384
  Homolog annotation: Hit_ID=Q00XY7; Match level="QueryCoverage=35%, HitCoverage=23%, E-value=1e-16, Identity=43%"; Hit description =Homology to unknown gene
  Subcellular localization annotation: CTP_CleavageSite=58; ConfidenceScore=5.78e-01
MSHPSVSFRLALFLSFSLTASSSLPPLPVFSKRYAPSSSLIPKATPSDLLSLLGSKPQSSAVNPEVARDLKSCFKFLVPFSPVHPRHRKLGLGRPKLTSPTRRDKNKLIWWPPEPVLELARLAVDSGGDPAAIHRLLDPTIIQVPDCEGSKDERCELTRTPYGRRFICEELNLYLQFLFELIVDRGPSVGLDVTLNRFDLFHGHLFLALDSGRLGILFHAKEYPAYDKQVFPYNMGFCQRGSNVTYDDSMNLRNILWLAPMPGDSGESWVAPGVLVVLDARPDGIIYRDLIPDYVNFARTIYEDNYDVLSLPNDTPAYINEDCRSLNE

SEQ ID NO: 131163 - protein, 124 aa, Glycine max
  Coding DNA Sequence Number=SeqID_14385
MFQKKATTCGGRKSCHTVDALPYYGAKRMLFPAAFGLTLQLIDFGSLKLVVLPIFFIMVILWAIMFSQFWKRKNSALLARWPISSIVAADQGYKISGRKSSSWQPPMELMKVFETDRAKEKEIF

SEQ ID NO: 131164 - protein, 351 aa, Glycine max
  Coding DNA Sequence Number=SeqID_14386
  Gene Ontology: Mol. function=nucleic acid binding; Biological process= DNA integration
  Homolog annotation: Hit_ID=Q1SVD1; Match level="QueryCoverage=65%, HitCoverage=26%, E-value=3e-18, Identity=26%"; Hit description=Zinc finger, CCHC-type
YEGIKDVRLRKAVSMTKLYESFTVKDEESMNDMFGRLKVLLNNLEALGQTYSKAQINRKVLESFPKVWEPKTTTTQEARDLENLAWDELLGIQRVHKVHLQNREHFQKKNFVALNFEETHFRREEKKSLSKALKVQMQETDGSDNSNASTDDEEKNNEIIYFECRKPEHMKDMPYAVLLQNFDLIYLQWIKLKEKFKASASENTELRKSNEDLKKKNQTLEKSLEQASMTDESSIVEKLIEEVVFITEVFEKFLQSPKTLTVLLKFHQHPYDKSGLGLKKGTTSFKSPSDSNKCDLCDNSSHFKFKCIHKKRQMSKDILGRKRSMFKLVPGQWMLMTHDRGKVYVPRPKAT

SEQ ID NO: 131165 - protein, 73 aa, Glycine max
  Coding DNA Sequence Number=SeqID_14387
MQLKPFLKIGLSMENGVGWTPFLEKVSNWHYYLYVLFRGTAKQDGVNIKRTVDGTQVGISNHHRCCIYSLWMV

SEQ ID NO: 131166 - protein, 206 aa, Glycine max
  Coding DNA Sequence Number=SeqID_14388
  Homolog annotation: Hit_ID=UPI0000E450AF; Match level="QueryCoverage =49%, HitCoverage=32%, E-value=9e-09, Identity=40%"; Hit description =putative capsule O-acetyl transferase
MMTTKDDDKCDEQKAQVIKEHPSQDSRFKFKNQEEFKTQEESLQTKIQDLKNQDQDSRIKNQDSRFQESRSRFKTQDSRMKKRLNQDKGYIYLGLTENKRGYISCGSVLVEGTSIRFKENKGGFFTRLKEISRTAGRLGTGGRHRLLPNRYKNPCFQFLCLAYFGTKFQLGVDKLVLIPKVKYYKSKEKRLRMMKMHPLLATLRKD

SEQ ID NO: 131167 - protein, 295 aa, Glycine max
  Coding DNA Sequence Number=SeqID_14389
MSKDWEKKITQKIVLLYEKPRPNRGDKKVLNNFLRTTNLTYMCRMIYNGLFKIVMPRVRSRDYVSDKDCFCMYKIMGFKDMLNPKVKKNPIPYGILFTHIMRLAEVDISLLEPSSRTTQLNGATFVNMGITENFLEYVQRHIKKKVKKETVGTQAHPLDLEFEASPQQTQGEQDQAKPSQPRHKLPTKRKKLPSSSDPIPLTLSKKPKNQPPSNPKKRKPFQPKPSSKSPPPSLTLVQNSEASQPKPASPSSEVKILKTTSPLPSPSLAIPSQHTPKSTSPPPSKAETATIGKAK

SEQ ID NO: 131168 - protein, 47 aa, Glycine max
  Coding DNA Sequence Number=SeqID_14390
MAIFRDQCRKWELQREKEESGWVGTRNTSLARRCLRVPKLLHAPAAI

SEQ ID NO: 131169 - protein, 352 aa, Glycine max
  Coding DNA Sequence Number=SeqID_14391
  Gene Ontology: Mol. function=metal ion binding; Biological process =metal ion transport
  Homolog annotation: Hit_ID=Q1RSM5; Match level="QueryCoverage=91%, HitCoverage=96%, E-value=2e-37, Identity=35%"; Hit description=Heavy metal transport/detoxification protein
  Pfam annotation: Domain name=HMA; Domain location=32-92; Score=50.8; E_value=4.5e-12; Accession=PF00403.16; Description=Heavy-metal -associated domain
MAATAPATETRVEIKEPPTEELLEPLMCKSCVLKVSIHCQGCTRKVKKILQSIDGVYCTSIDLRQQKVIVKGNVDSDTLIKKLTETGKRAELWPDQPELKKKKKKKKKKKKKANPENKEKPSEQESSEESNQSGDDNNNEKEAIKVVVQDPAKNNEGFFNVNRVGEGSATGLTGVQFQDPRMEVRQTVMVPPGYQSSVMGEKRVTINVPGMMDENEGGSGGKRTKSKGQKGNVVINGGNEGVTVVEHAGGDWNQMPGGHGHGPPNESPPRHQYPPHYHAPASPVYTGTYHTAYPTVTRYGAAYYTSPQPYSYSHVYRCVGSESDSETYTSPSPPSCSFELFSDENPNACFIM

SEQ ID NO: 131170 - protein, 231 aa, Glycine max
  Coding DNA Sequence Number=SeqID_14392
MDSQNARRQNSKVVDNLFPLDIDRKIKAIILKPLELTYSRYLHCRSTHETCRLDPPPKRCLIQGIPKSRIHHYHLSRLSWLPSQIIGSNTNCWEIKGYIIATTFFVNSELGIREVEVTTFRMAIINANELDPTRCWNNVESRGRELFHGLVDECKRLIHGLHPNKLLFTKRDGNKTTHILASLAFLYFDHCWLEEVLSQLDQIISSYAYTSLRSVGTSSTIKDFSQVARST

SEQ ID NO: 131171 - protein, 795 aa, Glycine max
  Coding DNA Sequence Number=SeqID_14393
  Gene Ontology: Mol. function=actin binding; Cellular component =phragmoplast; Biological process=actin cytoskeleton organization and biogenesis
  Homolog annotation: Hit_ID=Q1RSM0; Match level="QueryCoverage=99%, HitCoverage=99%, E-value=0.0, Identity=49%"; Hit description=Actin -binding FH2
  Pfam annotation: Domain name=FH2; Domain location=380-775; Score =470.5; E_value=2.1e-138; Accession=PF02181.13; Description=Formin Homology 2 Domain
MGLDSQAHSMVFIITILIFLSLQNAAGNENQIETISGMDENENKQTPIVENFRTLLGLNMFNTRKPCYNVADSNFVSLSPSLSPNTEAEALAPAPASELHVHPHSYHSHRNLPLHKILKEDKGMAKRTTIVAVVVPGGVATLICALGCVCVCKKFRNHKRKPNRTMPLFSKNERTGCTSTYQNSSSNVSLNSAPDLFYLTCLKQTCDTQNRSTSTHDSPKRTIYEKKVLRKEEYDKASTSSSSTKEILSVHEDLEYQCGKASSGEKTVLRGCHSLPSDNESFHSCFDTHSSVSETETLCLSPRNSISSTNQFPCPPQNSTTKVKLKPNQSQSPCIPQQDEQKKIQTCQPSIPPPPCPPPFLKGNINSAIKTPPSLLPQGKGGSSPLPKLKPLHWDKVRATPDRTMVWDKLRTSSFELDEVMIESLFGYNLQNSVKNDETKSKTPSPSKHVLEPKRFQNIAILSKALNTTAEQICEALILGKGLSLEQLEALVKMVPTKEEEAKLLSYKGDVNELGSAEKFVRAMLSVPFAFQRVETMLYRETFEDELFHLSNSFSTLEEACKELRSNRFFLKLLEAVLKTGNRMNVGTIRGGARAFKLNALLKLADVKGTDGKTTLLHFFVKEIVRSEGIKASERIMGQKSENRTEEEKEENYKRIGLELVSDLSAELCNVKKTATIDLDVLASSISNLSSGVANMQNLVKGLLCEDEKSESFVISMKWFLNYAERKVQDLQGCEGRVMARVKEITEYFHGDESKEESNPLRIFVIVRDFLEMVDNVCNELKRSSTKSPRTIRLQ

SEQ ID NO: 131172 - protein, 422 aa, Glycine max
  Coding DNA Sequence Number=SeqID_14394
  Gene Ontology: Mol. function=exodeoxyribonuclease III activity; Cellular component=cytoplasm; Biological process=regulation of progression through cell cycle
  Homolog annotation: Hit_ID=Q10LK4; Match level="QueryCoverage=80%, HitCoverage=89%, E-value=1e-104, Identity=54%"; Hit description=Rad9 family protein, expressed
  Pfam annotation: Domain name=Rad9; Domain location=1-362; Score=6.4; E_value=9.8e-09; Accession=PF04139.3; Description=Rad9
MEITLSDNALKTFARCITCLARIGNELAIQASSSQLLFHTINSSRSAYQCIAFKSGLFDAYNVSSNSLQCSVLLKAVCAVLRTPITNIDHLTVRLPDPDAPKVQWILDCYNGMRKTYWITCNVEPDIHHLSLDRQKFPSNFVVRPRDLSRLLANFQSSLQEITIIATEPSSLLTDASNEIGGKEVELRSYMDPTKDNDTLLHTQLWIDPKEEFLQYVHTGDPIDVTFSVKELKAFLSFCEGCEVDLHLHFEKAGEPILMAPKFGLEDGSHSNFDATLVLATMLISQLHEGAASEPPVGATGTHPHTEERNASHMLQENCRANVSFEPPSDHTRIWSDLSASAFKSISPLEERQAQGETILNDDGQREIQRISTMQISGVASVPGNNPIDSNRTFTEYGMLKPDTRSETLYLDFRLICMFKTL

SEQ ID NO: 131173 - protein, 197 aa, Glycine max
  Coding DNA Sequence Number=SeqID_14395
  Subcellular localization annotation: CTP_CleavageSite=42; ConfidenceScore=5.27e-01
MPCPSSHLRTSHPPPSSSALSSMKLKSLIHTLIVSHMCRIIRALSKVKATILEILKGSNNQSNNIHFHHKKKQKMTKKIIFGSFRLHYNWCSSKSSHVIPVPARVFEGLPKAGDMIHHHDEQYLYEDCHDDDSQLAGYLQWLEEKVQDDDDDKKACGNEMNEIDMLAEMFIANCHEKFKLEKQESDRRFHEMLARGM

SEQ ID NO: 131174 - protein, 62 aa, Glycine max
  Coding DNA Sequence Number=SeqID_14396
MKAVAYLATLTQGLGRINDPIIDYAVNQIKTTHAIVITHIMTTPTSAFDECSQAQRGWQLSG

SEQ ID NO: 131175 - protein, 314 aa, Glycine max
  Coding DNA Sequence Number=SeqID_14397
  Gene Ontology: Mol. function=zinc ion binding
  Homolog annotation: Hit_ID=Q5SMM0; Match level="QueryCoverage=99%, HitCoverage=60%, E-value=1e-117, Identity=66%"; Hit description=LIM domain containing protein-like
MLIPTNPAGLIEYRAHPFWIQKYCPTHEHDGTPRCCSCERMESQEAGYIALKDGRKLCLECLDSSIMDTNECQPLHADIQRFYDSLNMKLDQQIPLLLVERQALNEAREGEKNLSNVLGTIFWCLALSAQLTLKGHYHMPETRGLCLSEELSTFSRRPRLGTAMDMRAQPYRPTTRCDVTAILVLYGLPRLLTGSILAHEMMHAWLRLKGYRTLSQDVEEGICQVLAHMWLESELSSASGSNFVSASSSSASHTSRKGKRPQFERKLGEFFKHQIESDISPVYGDGFRAGQKAVRKYGLQRTLHHIRMTGTFPY

SEQ ID NO: 131176 - protein, 109 aa, Glycine max
  Coding DNA Sequence Number=SeqID_14398
  Gene Ontology: Mol. function=DNA binding
  Homolog annotation: Hit_ID=Q84UQ4; Match level="QueryCoverage=72%, HitCoverage=29%, E-value=1e-08, Identity=43%"; Hit description=DNA -binding protein-like
MKQEQMSKIEGNGVLLAFVEGRLKKLRLGRRGSMVVVLSHDHICDRSIVTEDTYTTLGGVDDNIFEDVTVAADFKDMGTKHVGALPDCQLQLLRPFRRLLRVLPHHVEV

SEQ ID NO: 131177 - protein, 89 aa, Glycine max
  Coding DNA Sequence Number=SeqID_14399
MVNSSEVSLVAGMSMPQRLRMVKNCLRECCAAILVQSVECVAEGGGCCRVCRRRLADIADGWSWYRVWFTVAEAGHGCGFCDGVDKLTR

SEQ ID NO: 131178 - protein, 594 aa, Glycine max
  Coding DNA Sequence Number=SeqID_14400
  Gene Ontology: Mol. function=protein kinase activity; Cellular component=extracellular region; Biological process=protein amino acid phosphorylation
  Homolog annotation: Hit_ID=Q69TY6; Match level="QueryCoverage=92%, HitCoverage=89%, E-value=9e-89, Identity=35%"; Hit description =Putative receptor protein kinase PERK1
  Pfam annotation: Domain name=LysM; Domain location=151-195; Score =23.9; E_value=0.00057; Accession=PF01476.10; Description=LysM domain
  Pfam annotation: Domain name=Pkinase; Domain location=306-570; Score =50.4; E_value=6.2e-12; Accession=PF00069.15; Description=Protein kinase domain
  Pfam annotation: Domain name=Pkinase_Tyr; Domain location=311-570; Score=34.1; E_value=1.5e-14; Accession=PF07714.7; Description =Protein tyrosine kinase
  Pfam module annotation: Pfam domain module=LysM::Pkinase::Pkinase _Tyr; Domain location=151-195::306-570::311-570
  Subcellular localization annotation: CTP_CleavageSite=40; ConfidenceScore=5.35e-01
MGASPSFLYTCNGLNKSCLAFLIFKSKPPFNSIATISNLTSSNPEELARINDVNVLKVFPTGKEVLVPLNCSCLTRDYYQAETNYVLGQSPTYLTVANDTLQGLTTCDSLMRANPYGELDLHPGMELHVPLRCACPTWHQITNGTKYLLTYSVNWGDNITNIAARFNVAAGNVVDANGFSTQTQTIFPFTTVLIPLPSEPVSSMTRIVSDPPDVSPLVCSSKKCNSKRKLYTVIATTGGSMLVLCVVLYGVFLFRKRSAMFIKRGEQGEKSKKLSSEDIRGEIAIIEHHSKVYKFEEIEKATENFSSKNRIKGSVYRGVFGKEKNILAVKKMRGDASKEVNLLEKINHFNLIKLQGYCENDGCPYLVYEYMENGSLREWLSRNGSTEHQSLARRILIALDVANGLQYLHNFTEPCYVHRNINSGSILLNKDLRAKIADFALAEESESKITSGCASSHIAKSRGYMAPEYLEAGKVTTKMDVFAFGVVLLELITGKDAVTLQDGREVMLRAFIVNLIGKEDEEEKESLFIDPSLNGNIEKVWALQLVKLGLACLIQESAERPTMVEVVSSLLKTYTSYMEQIIPPSISNSPSMER

SEQ ID NO: 131179 - protein, 68 aa, Glycine max
  Coding DNA Sequence Number=SeqID_14401
MGFIHNQAHIGIRTVGVEKACNFSTNSDLCIPSYLEYEWPAVGLQEAPPCPRNKVATLLSAALDESHT

SEQ ID NO: 131180 - protein, 383 aa, Glycine max
  Coding DNA Sequence Number=SeqID_14402
  Gene Ontology: Mol. function=lyase activity
  Homolog annotation: Hit_ID=Q1S6Y2; Match level="QueryCoverage=96%, HitCoverage=98%, E-value=1e-117, Identity=57%"; Hit description =Cyclin-like F-box; FBD
  Pfam annotation: Domain name=F-box; Domain location=17-64; Score =32.3; E_value=1.8e-06; Accession=PF00646.23; Description=F-box domain
  Pfam annotation: Domain name=FBD; Domain location=305-353; Score =24.2; E_value=0.00047; Accession=PF08387.1; Description=FBD
  Pfam annotation: Domain name=LRR_2; Domain location=169-193; Score =29.5; E_value=1.2e-05; Accession=PF07723.3; Description=Leucine Rich Repeat
  Pfam module annotation: Pfam domain module=F-box::FBD::LRR_2; Domain location=17-64::305-353::169-193
MRREQPRSPCLTDVEPDRISCLPGHVIDQVLSHLSIREAVRTSVLSSKWRYKWATLPILVFDTHCVSVASQDHMIIKNKLLRIIDHVLLLHSGPINKFKLSHRDLIGVTDIDRWTLHLCRKSIKEFVLEIWKGQRYKIHSCLFSCQSLTHLELFNCWLKPPSTFQGFKNLKSLDLQHVTLAQDVFENLISSCPLLERLTLMNFDGFTNLNIDAPNLLFFDIGGKFEDISFENTFQLAVYLAVGVVPIKLPRPCIDLSYLSIRINFNDLKEISASLCLLRSSPNLQELEILARPEEQTVLLTHTYCWEDVYFSCPVMQLRYVKIDGISGIKPELDFINFLLLHSPVLERMTVKPVANVGLELMKELLRFRRASGQAEIIYLEPS

SEQ ID NO: 131181 - protein, 57 aa, Glycine max
  Coding DNA Sequence Number=SeqID_14403
MAEKDSITYLRAMRIRNSEDTQKKLPCQAIKVPINNQMVKKRIEKCGRIGLIEKYSQ

SEQ ID NO: 131182 - protein, 209 aa, Glycine max
  Coding DNA Sequence Number=SeqID_14404
  Gene Ontology: Mol. function=drug transporter activity; Cellular component=membrane; Biological process=multidrug transport
  Homolog annotation: Hit_ID=Q1T635; Match level="QueryCoverage=81%, HitCoverage=25%, E-value=6e-29, Identity=40%"; Hit description=Multi antimicrobial extrusion protein MatE
  Pfam annotation: Domain name=MatE; Domain location=42-205; Score =21.8; E_value=0.00013; Accession=PF01554.9; Description=MatE
MDSPLLENIDNSCSNVEEEKTPNTVVKRFGFESKKLWKIAGPAIVTSICQYSLGALTQTFAGLVGDLDLAAVSVENSVIAGLAFGVMLNDNVKTLILPMQKRQRGKNKWAEHSGKEWDPCSSYFKCRGSALLLGMGSALETLCGQAYGAGQIRMLGVYMQRSWVILFITALILLPLYIWSPPILRLAGQTAEISDAAGIKSRDFLFLND

SEQ ID NO: 131183 - protein, 419 aa, Glycine max
  Coding DNA Sequence Number=SeqID_14405
  Gene Ontology: Mol. function=transferase activity; Biological process= biosynthetic process
  Homolog annotation: Hit_ID=Q5XWK4; Match level="QueryCoverage=74%, HitCoverage=75%, E-value=9e-56, Identity=38%"; Hit description =Expressed protein-like
  Pfam annotation: Domain name=DUF616; Domain location=82-410; Score =530.2; E_value=2.2e-156; Accession=PF04765.4; Description=Protein of unknown function (DUF616)
MSYVLVLLMDKYVSEVVNSVVRLLECLLGINFASEVVKSCLKLLPPEKLEQLDIPVEEESSSVPVGEVLYMSESDRSFVGGSVTLSQLRTEDTRFNLFTGNQTFKQRDQSFELLAFTAWPFVYVYTLPYPTLCFFIFMQKKETMAIHCGFYSVNGGFKISDEDKSYMQGCKVVVSTCAFGGGDDLYQPIGVSEASLKKVCYVAFWDEITLKAQELVERRIGENGFIGKWRVVVVRDLPFADQRLNGKIPKMLSHRLFPQAKYSIWVDSKSQFRRDPLGVLEALLWRSNSLLAISEHGARSSVYDEAKAVVKKNKAKPEEVEVQLNQYRKDGLPEDKRFNGKKALCEASVIVRKHTPVTNLLMCVWFNEVARFTSRDQLSFPYVLWRLKAFKNINMFPVCTRKDLVNSMGHVRKAKPLQS

SEQ ID NO: 131184 - protein, 199 aa, Glycine max
  Coding DNA Sequence Number=SeqID_14406
  Gene Ontology: Mol. function=drug transporter activity; Cellular component=membrane; Biological process=multidrug transport
  Homolog annotation: Hit_ID=UPI000034F09A; Match level="QueryCoverage =94%, HitCoverage=33%, E-value=1e-40, Identity=46%"; Hit description =antiporter/ drug transporter/ transporter
  Pfam annotation: Domain name=MatE; Domain location=1-131; Score=44.2; E_value=4.6e-10; Accession=PF01554.9; Description=MatE
MRSMNINGWDAMIAIGFNAAISVRVSNELGAGDFKAAKFSVWVVSITSVSIGVVVMIGVLLTKDYFPYLFTTSVPVANETTRLSALLAVTVLLNSLQPVLSGVAVGAGWQSLVAYINIVCYYLVGLPAGIILGFKLGLGAELFNLYACVIQGIWSGMIAGIVLQTTILIIVTSIRNWKKEAEEAESRVRKWGGAISYDQ

SEQ ID NO: 131185 - protein, 187 aa, Glycine max
  Coding DNA Sequence Number=SeqID_14407
  Gene Ontology: Mol. function=structural constituent of ribosome; Cellular component=ribonucleoprotein complex; Biological process =translation
  Homolog annotation: Hit_ID=P82278; Match level="QueryCoverage=51%, HitCoverage=48%, E-value=7e-42, Identity=86%"; Hit description=30S ribosomal protein S9, chloroplast precursor
  Pfam annotation: Domain name=Ribosomal_S9; Domain location=89-187; Score=93.1; E_value=8.4e-25; Accession=PF00380.9; Description =Ribosomal protein S9S16
MASSSATDDISNSFFLRPLDNPGLNLVSWPLTSDDYSTLLHSMKMVSVAKADGFVNGLSNELINCSQGSLNVNQYCTKLKSIWEELGGYLVKEYLQGNPLWLQYIKVPLITLGYESNYDVFVKAEGGGLSGQAQAISLGIARALLKVSEDHRVPLRQEGLLTRDSRVVERKKVGLKKARKAPQYSKR

SEQ ID NO: 131186 - protein, 69 aa, Glycine max
  Coding DNA Sequence Number=SeqID_14408
  Subcellular localization annotation: CTP_CleavageSite=47; ConfidenceScore=5.41e-01
MEGTIVAAQQTKGTMAKMLTSSSTPRYWRAATLTLVHVILASKSTTVAKKGRTGRSAFGHNMMNDDLSA

SEQ ID NO: 131187 - protein, 122 aa, Glycine max
  Coding DNA Sequence Number=SeqID_14409
MRGKGLTFSDTSDNMGGGIEAIQVCGGFLAKCGTRSISFINGGNNDEKHPVSEKQLPQQSSVPEFLALPSRADPHPTQLVGFVIRDGDRQTVVVVVVVVAAAAVEHCGRKIWPKTIRVEEGN

SEQ ID NO: 131188 - protein, 137 aa, Glycine max
  Coding DNA Sequence Number=SeqID_14410
MDCTVPKIENQAVPKKAQNNDAKKEFLPKTSPTEMKLKGQSRMGTLLGISAPGAPDGMFVVRKVCQKVCQRVDGRQNSGSGWPENEAEFAGKVRQVDGLTGRRAMSKTAHLGTQMQVAGKGEATIKVHQGQWLPVGG

SEQ ID NO: 131189 - protein, 275 aa, Glycine max
  Coding DNA Sequence Number=SeqID_14411
  Homolog annotation: Hit_ID=Q5YLM3; Match level="QueryCoverage=91%, HitCoverage=28%, E-value=1e-119, Identity=84%"; Hit description =Roothairless 1
MQSVNNKSLIEELDKLLERLRVPSEYATSLTGGSFDEARMLQNVEACEWLTSALRGLEMPNLDPSYANMRAVKEKRAELEKLKSTFVRRASEFLRNYFASLVDFMISDKSYFSQRGQLKRPDHADLRYKCRTYARLLQHLKSLDKNCLGPLRKAYCSSLNLLLRREAREFANELRASTKASRNPTVWLEGSTGSGQNVNATDTSTVSDAYAKMLTIFIPLLVDESSFFAHFMCFEVPTLVPPGGVVNGNKAGSDDDDDLGIMDIDENDSKSGTHT

SEQ ID NO: 131190 - protein, 346 aa, Glycine max
  Coding DNA Sequence Number=SeqID_14412
  Homolog annotation: Hit_ID=Q5YLM3; Match level="QueryCoverage=98%, HitCoverage=33%, E-value=1e-101, Identity=60%"; Hit description =Roothairless 1
MAKSSADDGELRRACDAAIEDPKQKIVMALRVAKSHGILGKPSSKLGRMAKPRVLALSSYLPLPKSLSSIRNSTISITYTRCYFDFACTRFHPFVGDDVVFPAAKSKGQRTTAFLRVLKYSTGGVLEPAKLYKLKHLSKVEVVANDPSGCTFTLGFDNLRSQSVAPPQWTMRNIDDRNRLLLCILNICKDVLGRLPKVVGIDVVEMALWAKENTPPVSAQNKVRDGGPVASVVTETEITELKVNVEKELVSQAEEEDMEALLGTYVMGIGEAEEFSERLKRELQALEAANVHALLESEPLMDEVLQGLDAATSVVEDMDEWLSIFNVKLRHMREDIASVRTLYPSI

SEQ ID NO: 131191 - protein, 229 aa, Glycine max
  Coding DNA Sequence Number=SeqID_14413
MTLHLTSLRMKNIRLRMKGFMVLKLDKSKAYDKVDWTFLEGVLRVIDFPVRHGNGAGRDRVLFTPPPPPKPTGVCIYTPSPSSTGVGGAGSGTGSGTGSGRVLRISSPTPNPNLAIGENPTPIPTPVNSDFPRQNRSGSGAGPTGSVPVAMPIPGEIGVVDYKGCHHGFYRNNVEWQSATKRSMGSKFALEIHKSPTCLMMTTLFSPGAMLEEASKLSHILKTYEMASG

SEQ ID NO: 131192 - protein, 410 aa, Glycine max
  Coding DNA Sequence Number=SeqID_14414
  Homolog annotation: Hit_ID=Q5YLM3; Match level="QueryCoverage=96%, HitCoverage=34%, E-value=1e-106, Identity=55%"; Hit description =Roothairless 1
EFYHFFHSVGKNSVELEALNKSLKDLLDGIQEDFYAVVDWAYKIDPLRCISMHGITERYLSGQKADAAGFVRDLLRDLESRISMQFNRFVDEACHQIERNERNVRQMGVLSYIPSSSGTIYSEWAWRMNSMVGGSVMDLRTSFDIMWDFGSNSILQNRHICNPCNSDGAVHPGFYRNITGGNVALQVSIMFATLEKIAQTDPKYADIFLFENYAAFQNSLYDLANIVPTLAKFYHQASEAYEQACTRHISMIIYYQFERLFQFARRIEDLMFTVAPEEMYYEVHERTWTGVSNVDLGDVTSNEAIGTGECPHKGVKMAKIDSFSAWTVKNGSSEDVKIQFIWGMVDKSIAAMYKKLQKNLTSEELLPSLWDKCKKEFLDKYESFAQLVSKIYPTETIPSVAEMRDLLASM

SEQ ID NO: 131193 - protein, 49 aa, Glycine max
  Coding DNA Sequence Number=SeqID_14415
MDKKFEGIGVRVKSAIDDHARESQFEAILFVDKYARTNAKYPSATHVSL

SEQ ID NO: 131194 - protein, 115 aa, Glycine max
  Coding DNA Sequence Number=SeqID_14416
MCSLVMMQVQKAAKLYNPSNGKIVVSKDVEFDEEETWNWEKEECTYDLFPYFEENDEEVVVANEFFTPPPSPTQSIHEASSFERSSSERPRKMRSLQDIYDETEIINYSFCLFGY

SEQ ID NO: 131195 - protein, 66 aa, Glycine max
  Coding DNA Sequence Number=SeqID_14417
MGEKEGITTSLDKMANSFNRMVEKMDGKVDDEDIQEVLPDDPKQLAIVKALLIHEKTDYVLTHLAE

SEQ ID NO: 131196 - protein, 167 aa, Glycine max
  Coding DNA Sequence Number=SeqID_14418
PPAVVEREKFDHIEEKLRVIEGGRNYAFADMAELCLVPNMVIPPKFKVPNFNKYKGTTCPNNHLKMYYRKIGAYAKDEKLLMHFFQESLTGAAVTWDLAAQVAPPVMEREMIIMIVDMLPVFYYEKMVGYMPSSFANLVFAGKRIEVDLRIGKFDYPALMNRKPGEN

SEQ ID NO: 131197 - protein, 155 aa, Glycine max
  Coding DNA Sequence Number=SeqID_14419
  Homolog annotation: Hit_ID=Q75KB0; Match level="QueryCoverage=91%, HitCoverage=87%, E-value=5e-10, Identity=32%"; Hit description =Expressed protein
MRKGNKKKQNKLVWIITTPLRMLGKARDIYVRSITNCGHKMNYSNPVDAAGRFQALPRSYSAATSRSDNNEDFAELLRAASARTLGNRIDVDLVLKQQAQARPVSSNGLPKSTSVGMGRIDEDTPYDLGEGEVPVVPKAYPRSRSYAVGMTSAVL

SEQ ID NO: 131198 - protein, 127 aa, Glycine max
  Coding DNA Sequence Number=SeqID_14420
MARKKYFHDETCFDKLLMPLRRLPPLTTMGNNVEEDEAETNERRKRICFVEVGGETEPEEHAELFYYFIDYFGGVACPLTFKNEEYNGSLPNLTLKPQSWTKVELAWKFLDELDHILIDDIDFICCS

SEQ ID NO: 131199 - protein, 400 aa, Glycine max
  Coding DNA Sequence Number=SeqID_14421
  Gene Ontology: Mol. function=RNA-directed DNA polymerase activity; Biological process=RNA-dependent DNA replication
  Homolog annotation: Hit_ID=Q1T3B0; Match level="QueryCoverage=32%, HitCoverage=58%, E-value=1e-22, Identity=47%"; Hit description=RNA -directed DNA polymerase
KVKLLKKDIKEWILEKFGGNQANGTKLVTDINNLDMGVKRIIFRGEPVVIKEVKEHFQNVFLEQGSMEVPLEGINVRTISEENNAMLIAIFSKKEIMEAASLEPYMNSIAMDDCRKGQINASFFTLIPKKENPQELGGYRPISLIGCLYKITAKLLAKRISKILGNVVNERQSTFIRGRNILDGVMIANEPISYIDWALTQNGYEGAYNHPQLSSLLTVVQWKSFGLVGINVEQRDVRMCVSVLNCKIMTIPFVYLGVSIGADARKLSTWQPVIDNMRAKFLEERLVFLIGYKKAFYGGAKGEGRKVAWVKLVSEKQGLWKKGDLVSICELERSTVGQFQKGMSRVVGNGGKSLEKSHLDSLAMTDGHVVKEVHELLHSKGNNEDASFYMQLWKLQIPSK

SEQ ID NO: 131200 - protein, 138 aa, Glycine max
  Coding DNA Sequence Number=SeqID_14422
  Gene Ontology: Mol. function=nucleotide binding; Biological process =translation
  Homolog annotation: Hit_ID=UPI0000689DD8; Match level="QueryCoverage =76%, HitCoverage=12%, E-value=1e-29, Identity=52%"; Hit description =glutaminase
MNKVGKIGLCYLVACVSTFLHVQVHVQAQERKAPAYPLITHNPNFSIWSMTDQLNASTTKHWTEADHSLLGLINVDGNIYRFLGKEEPNYAVILPTAEDKSYTIHYSESKPQGDWQSAAYKAEGWKSGVAPIGDDEKQ

SEQ ID NO: 131201 - protein, 296 aa, Glycine max
  Coding DNA Sequence Number=SeqID_14423
  Gene Ontology: Mol. function=phosphatidylcholine-sterol O -acyltransferase activity; Cellular component=integral to membrane; Biological process=lipid metabolic process
  Homolog annotation: Hit_ID=Q71CE5; Match level="QueryCoverage=99%, HitCoverage=93%, E-value=3e-71, Identity=59%"; Hit description =Lecithine cholesterol acyltransferase-like protein
  Pfam annotation: Domain name=LACT; Domain location=2-294; Score= -98.1; E_value=4.2e-06; Accession=PF02450.6; Description =Lecithin:cholesterol acyltransferase
MKKEQGLKIEVATFRVTVVAVMLSLLCTCGASNFDPLILIPGNGGNQLEASVILAPFTQCFAERMTLHYHQELDDYFNTPGVQTRIPHFGSTNSLPYLKHITGYMAPLVDSLQKLGYADAPWGGDIDEMYTFASGNTLGVPLVDPLLVRDEQRSSESNLWLLPNPKVFGPQKPIVITPNKTYSAHDMVDFLKDIGFPEGVYPYETRIVPLIGNIQAPQVPITCIMGTGVRTLETLFYGKGDFDERPEISYGDGDGTVNLVSLLVFQSLWKEEKNQYLKVVKIDGVRILQYLKMRLH

SEQ ID NO: 131202 - protein, 164 aa, Glycine max
  Coding DNA Sequence Number=SeqID_14424
  Homolog annotation: Hit_ID=Q75HC2; Match level="QueryCoverage=42%, HitCoverage=6%, E-value=2e-09, Identity=48%"; Hit description =Putative piwi domain containing protein
MKGSETIGGAKDVALVHLATVEHVSYMNFFISSEVKLCSSPEHIIVSGLTCLYPSIVTTKVKVKCKRVCVGWGHTSSLAIMSCGMNTNTYRTQANKISVKRGEPPIRGLIHSRYIGVSFCFAHLHVLFCTRILKRPYPKECSFSMASSMLIAGTELKSAFSMCF

SEQ ID NO: 131203 - protein, 242 aa, Glycine max
  Coding DNA Sequence Number=SeqID_14425
  Gene Ontology: Mol. function=nucleic acid binding; Biological process= DNA integration
  Homolog annotation: Hit_ID=Q1RWN2; Match level="QueryCoverage=72%, HitCoverage=12%, E-value=2e-17, Identity=37%"; Hit description =Peptidase S8 and S53, subtilisin, kexin, sedolisin; Integrase, catalytic region; Zinc finger, CCHC-type
MEDVVIVEKILRSMAPKYNYVVCSIEESKDVDTLSLDELQSSLLVHEQKINQDTITQEQALKASTSSRGRGKGTRRSGRGRGRGDQNNNSGRGDQNNNGGRGLAIIILNVIQSCYATKKRKFISKFVEENETETLLMAIQNSKEPKSDIWYVDIGCSNHMSGMAEIKDPSWLWHFRYGHLSFGGLKTLNQKNMVIGLPPIAAPCQEKSEAFTAFKFFKVRVEMRLEKISRPFVQIVVVNIAQ

SEQ ID NO: 131204 - protein, 329 aa, Glycine max
  Coding DNA Sequence Number=SeqID_14426
MAARAMWMQELHKQTKPEFEIFGRSASYSRDKAQHDDFTPNLLDDAYSDDTPNQTYGYRTTSLSMMSDCETDKHMVESSGMHFTDKSVIEENSIIKTENKDLKCGRPSQIIIQDYDDDDEWPEEDSDIGGYGGTTHPMVNEDDISFSDLEDDDYGIKPVSSSTGSVDPHSAPRTMKRLPDVGNNKSAELVNPFFPYICYGTMGSKRSKMRIWDEICASIRGTALFQKLLDPTGETKPVLLKPGDPAGYGTRTALAAKSSRRRTHGLGAGTRTLGEVRSSLAPSLGVGGFDLFEFESYTCTVDSGTLLLRNTCSLLSFGNGQRHPDKVAY

SEQ ID NO: 131205 - protein, 282 aa, Glycine max
  Coding DNA Sequence Number=SeqID_14427
  Gene Ontology: Mol. function=ubiquitin-protein ligase activity; Cellular component=ubiquitin ligase complex; Biological process =protein ubiquitination
  Homolog annotation: Hit_ID=Q9FHP0; Match level="QueryCoverage=86%, HitCoverage=55%, E-value=7e-31, Identity=34%"; Hit description =Arabidopsis thaliana genomic DNA, chromosome 5, TAC clone:K14B20
  Pfam annotation: Domain name=BSD; Domain location=174-240; Score =71.4; E_value=2.9e-18; Accession=PF03909.7; Description=BSD domain
MSWLARSFANSLRLDGDVDDENDIVLDPPTTSSRDPAQQQHEARENAFGSEAEEDEETQDRAGVKEDLDEIKQTLTRQFWGMASFLAPPPSDSHSHSQSDPSSFVSDQSNHRAVSPNEELQLDEAAISNHSNSVSVGSDSEGDFGLEQRAVGITEEVLVFAMNIAMHPETWLDFPIDEEDDTDDFDMSDAQQEHAAVVERLTPRLAALRIELCPCHMSESYFWKVYFVLLHSRLNKEDAGILSTPQEGVFQYLYLMEEQAHSLEIGGFQCHLLGIKLPDKND

SEQ ID NO: 131206 - protein, 303 aa, Glycine max
  Coding DNA Sequence Number=SeqID_14428
  Homolog annotation: Hit_ID=Q801S4; Match level="QueryCoverage=52%, HitCoverage=39%, E-value=1e-08, Identity=29%"; Hit description =Uncharacterized protein C22orf9 homolog
MLGDGGEIPSRYELLSMVKKHSNLIGKTVVEEQHASDIEMDMRFWHDVFDLYFVCGKESRGRQDDDLVFFVRKLGSHGSGSNNKTESVDPYFVRRWAPKLSNLVDETSIDVNWRRSFYLNLIAHTSFSVTVAICSHQDLLNHRAGQDTPAGQDTPLSPIYKEVETTPAYPDICFAIDDFDSTFDAVVLTEKDHCYCVVLNAHDGAAFPSEKVANDCSTSDSSSLPVHSSSAKKRNTKHGHYKLKPETIHTTFICIWFLQNQIQWTYYEGAAKFNRIRPYLKSMLVPNGVTSSEMLSVNQSIQK

SEQ ID NO: 131207 - protein, 170 aa, Glycine max
  Coding DNA Sequence Number=SeqID_14429
  Subcellular localization annotation: CTP_CleavageSite=21; ConfidenceScore=5.31e-01
MGATYHISVVSLASYNIFTPSCFTAAGRSRFGSLLSVGHSSGKTDRIYMKGPGGRGEVEVAVSGVADQSQQDSGPFSPVISKKGFGLGVIVHKAASAASVAARHAYAAASASSPNFDELIPLKCSLMSISLPWEFIAYDLLFKPIPPEKIKGKRNWSPVKAELHAGSDGH

SEQ ID NO: 131208 - protein, 145 aa, Glycine max
  Coding DNA Sequence Number=SeqID_14430
  Gene Ontology: Mol. function=protein dimerization activity; Cellular component=nucleus; Biological process=regulation of transcription, DNA-dependent
  Homolog annotation: Hit_ID=Q9T062; Match level="QueryCoverage=56%, HitCoverage=26%, E-value=1e-11, Identity=43%"; Hit description=BZIP transcription factor-like protein
  Pfam annotation: Domain name=bZIP_1; Domain location=55-117; Score =33.3; E_value=8.5e-07; Accession=PF00170.11; Description=bZIP transcription factor
  Pfam annotation: Domain name=bZIP_2; Domain location=55-109; Score =38.5; E_value=2.3e-08; Accession=PF07716.5; Description=Basic region leucine zipper
  Pfam module annotation: Pfam domain module=bZIP_1::bZIP_2; Domain location=55-117::55-109
MLFHEDEAVQLPCTPVHETMLTESELEDLFSLINQSRDQPSPGSGSQGSNRAVYSPEERKLRRMKSNRESARRSRYRKKQHMENLTSQLNQLRIQNRLIKNQLASTMHQHLLLSLHNDHLKSESVALMATLSDLCGILGTMLAHY

SEQ ID NO: 131209 - protein, 146 aa, Glycine max
  Coding DNA Sequence Number=SeqID_14431
MERSMIDAASGGALGDMTPTEARNLIEKMAFNSQQFSARNDAIVLRGVHEQSEVNEQLEAYAANIYNRPPQQQNQQQQNNYDLSSNRYNPGWRNHPNLRWISPPQQQQPVPHFQNVAGPSNHMFLLQYSSSDNKDNQQLRLLLNLP

SEQ ID NO: 131210 - protein, 320 aa, Glycine max
  Coding DNA Sequence Number=SeqID_14432
  Gene Ontology: Mol. function=nucleotide binding; Cellular component =cytoplasm; Biological process=transport
  Homolog annotation: Hit_ID=Q69ST5; Match level="QueryCoverage=96%, HitCoverage=92%, E-value=1e-132, Identity=74%"; Hit description =Putative purine nucleotide binding protein
  Pfam annotation: Domain name=ATP_bind_1; Domain location=7-285; Score= 302.4; E_value=8.5e-88; Accession=PF03029.7; Description=Conserved hypothetical ATP binding prot
  Pfam annotation: Domain name=Fer4_NifH; Domain location=4-260; Score=- 128.7; E_value=0.06; Accession=PF00142.9; Description=4Fe-4S iron sulfur cluster binding pr
  Pfam module annotation: Pfam domain module=ATP_bind_1::Fer4_NifH; Domain location=7-285::4-260
MVFGQVVVGPPGSGKTTYCNGMSQFLSLIGRKVAVINLDPANDSLPYPSLYLFQTSLFSKLYSSIVIVSPNKEYSYECAVNIEDLVKLSDVMVEHSLGPNGGLVYCMDYLEKNIDWLEAKLEPLLKDHYLLFDFPGQVELFFLHSSAKNVILKLIKKLNLRLTAVHLIDAHLCSDPGKYISALILSLSTMLHLELPHINVLSKIDLIESYGKLAFNLDFYTDVQDLSYLQHHLDQDPRSAKYRKLTKELCDIIENFSLVSFSTLDIQDKESVGNLVKLIDKSNGYIFVGMEASAVEFSKIAVGPVNWDYYRYPFFSFSCV

SEQ ID NO: 131211 - protein, 263 aa, Glycine max
  Coding DNA Sequence Number=SeqID_14433
  Gene Ontology: Mol. function=kinase activity; Biological process=D -ribose metabolic process
  Homolog annotation: Hit_ID=UPI00005F80AD; Match level="QueryCoverage =92%, HitCoverage=37%, E-value=1e-120, Identity=89%"; Hit description= COG0524: Sugar kinases, ribokinase family
MLPAGRHARAAAGVLLKQKETGMATQEKQLDVICLGRIAVDFYAQQIGARLEDAGTFAKYLGGSSGNVAYGTAIQGLKSGMLARVGDEHMGRFLREELQRVGADTRCLITDKQRLTGLVILGIKDQETFPLIFYRENCADMALTPDDIDEAYIASSRALAITGTHLSHPNTRAAVLKALEYARRHGLRTALDIDYRPVLWGLTSLGDGETRFVESDQVTRELQEVLHHFDLIVGTEEEFHIAGGSTDTLTALKNVRRATAATL

SEQ ID NO: 131212 - protein, 92 aa, Glycine max
  Coding DNA Sequence Number=SeqID_14434
  Gene Ontology: Mol. function=metal ion binding; Cellular component =intracellular
  Homolog annotation: Hit_ID=Q59HI2; Match level="QueryCoverage=87%, HitCoverage=43%, E-value=4e-34, Identity=84%"; Hit description =Transcription factor lim1
MAIISVPLCLLLSNYNSFEGVLYCRPHFDQLFKRTGSLDKSFEGTPKIAKPEKTGEEKPAATKVSSMFGGTRDKCAGCQKTVYPTEKVTIQP

SEQ ID NO: 131213 - protein, 96 aa, Glycine max
  Coding DNA Sequence Number=SeqID_14435
MWSYTELEDSYLCVNVLRVSVNNKQRLPKDEDGQIVQTREGLFLEGDSPVELASWTRDGAWWTRQWSWRVAVHVPGPTSRTDEMLCYGIFLVNLKQ

SEQ ID NO: 131214 - protein, 76 aa, Glycine max
  Coding DNA Sequence Number=SeqID_14436
  Subcellular localization annotation: CTP_CleavageSite=65; ConfidenceScore=5.46e-01
MAYYNQNPPPMSGVIPPPQGYPQPGFQGPPPPQPQVFVTQAPAQPAQGAAATTALARWAASAASRCAAAWRRVTKY

SEQ ID NO: 131215 - protein, 136 aa, Glycine max
  Coding DNA Sequence Number=SeqID_14437
MEYVFCQIVEQQWQQEDGIIPRFWKGYHHHNHHHSPAQAPVPLIKAPIHPPTHQPAHAPNYFHYHHHSPTPTSAPIPIGNIHIGSTIEGLHFCPYCPSQTLQSSYFSKVWYPGEIEETSTFLPPQPLHFNLMSPER

SEQ ID NO: 131216 - protein, 354 aa, Glycine max
  Coding DNA Sequence Number=SeqID_14438
  Gene Ontology: Mol. function=transporter activity; Cellular component= membrane; Biological process=transport
  Homolog annotation: Hit_ID=UPI000034F4F5; Match level="QueryCoverage =98%, HitCoverage=62%, E-value=1e-108, Identity=54%"; Hit description= permease
  Pfam annotation: Domain name=Xan_ur_permease; Domain location=1-272; Score=-77.5; E_value=3.2e-05; Accession=PF00860.11; Description =Permease family
MCLLSTIVLQYLNHFVSTKRLMYERFALLFSIASAWLLAQLLTSSTAYNHKPESTQNSCRTDRAGLISGSEWGTEELMILSKNALSFWGLFIYVYKFHLPLVPFPWGVPTFNFGEALAMIAASFVSLFESTGTFYAAARYGSGTPVPPHVVSRGTGWVGVASLVNGFVGSVTGCTASVENAGLLALTKAGSRRVIQISAGFMIFFSIAGKLGAVLASIPLPIIAAMNCIFFGYVSSAGLDFLQFCNLNSFRTKFVLGLSFFLGISIPQYFIEYFHVKHHHGWFNDIVSVIFMSHTTVAALVAFILDITLSREDDAVRKDIGLQWWEKFSVYNADGRNADFYKLPCRLNEFFPAL

SEQ ID NO: 131217 - protein, 67 aa, Glycine max
  Coding DNA Sequence Number=SeqID_14439
MDISSSQYNSAGESGWTHYLDHSSLSESYFQMRGGIEDHGGKGARVEEEEEDLSMISDASSGPPQLA

SEQ ID NO: 131218 - protein, 87 aa, Glycine max
  Coding DNA Sequence Number=SeqID_14440
MACASTTSSKCDRNYDWFFALLKDWNGGDIDSAGGDNGDNNGEMVVMHNDNHDNNNGDERMVAKAKYNDNGDGGGMIETIVVVVVEW

SEQ ID NO: 131219 - protein, 402 aa, Glycine max
  Coding DNA Sequence Number=SeqID_14441
  Gene Ontology: Mol. function=phosphatidylcholine-sterol O -acyltransferase activity; Cellular component=integral to membrane; Biological process=lipid metabolic process
  Homolog annotation: Hit_ID=Q10PI5; Match level="QueryCoverage=95%, HitCoverage=96%, E-value=1e-142, Identity=62%"; Hit description =Haemolysin-III related family protein, expressed
  Pfam annotation: Domain name=HlyIII; Domain location=79-387; Score =235.0; E_value=1.7e-67; Accession=PF03006.10; Description=Haemolysin- III related
MTHGAYDGLIATPKKINDFVDGEDERASSKSRKGVRLWRKLKYQLIEYNSLPAYMRDNEFILGYYRADWPLKQIFLSIFSIHNETLNVWTHLIGFFLFLFLTIYTAMRAPMVVDFNSVQDLSEMIGKADLNMIRLDLLKCLASLPNMPEILKLNDLSESLYSLDFSSLSGWTLVELLTNCLPEQFSLNGLKGDMNMVSPLMQPITRWPFYAFLGGAMFCLLASSACHLLTCHSQRLSYIMLRIDYAGIAALIATSFYPPVYYSFMCNPFFCYLYLGFITLMGITTIVFSLLPFFQKSEFRKYRASLFFLMGFSGVAPIIHKLILHKHQPEALQTTGYEILMGVLYSLGALIYVTRIPERWMPGKFDIAGHSHQLFHILVVAGAYTHYHDGLIYLRWRDSQGC

SEQ ID NO: 131220 - protein, 58 aa, Glycine max
  Coding DNA Sequence Number=SeqID_14442
MIPLLRLGSANRNSGSDDSDVRLTRNEPMKVAELGISSRLRNQIRSISNITGEDSKLL

SEQ ID NO: 131221 - protein, 496 aa, Glycine max
  Coding DNA Sequence Number=SeqID_14443
  Gene Ontology: Mol. function=hydrolase activity, acting on acid anhydrides, catalyzing transmembrane movement of substances; Cellular component=membrane; Biological process=cation transport
  Homolog annotation: Hit_ID=Q9SY55; Match level="QueryCoverage=95%, HitCoverage=42%, E-value=0.0, Identity=69%"; Hit description=Calcium- transporting ATPase 3, endoplasmic reticulum-type
  Pfam annotation: Domain name=E1-E2_ATPase; Domain location=4-278; Score=170.9; E_value=3.2e-48; Accession=PF00122.10; Description=E1 -E2 ATPase
MFPLDSSVGDYGTNKDSVGCFSILPATELVPGDIVEVSVGCKIPADMRMIEMLSNQVRVDQAILTGESSSVEKELKTTTTTNAVYQDKTNILFSGTVMVAGRARAVVVGVGPNTAMGSIRDSMLRTEDIIFQILICKQHMISFQIRAHDQLVIKAQLYRRARARPHNRTIEALTFFFNHWLQEVTPLKKKLDEFGTFLAKVIAGICVLVWIVNIGHFRDPSHGGFLRGAIHYFKIAVALAVAAIPEGLPAVVTTCLALGTKRMAKLNAIVRSLPSVETLGCTTVICSDKTGTLTTNMMSVAKVCVVESAKRGPVVSEYSVSGTTYAPEGIIFDSTGLQLDFPAQLPCLLHMAMCSALCNESTLQYNPDKGNYEKIGESTEVALRVLAEKVGLPGFNSMPSSLNMLTKHERASYCNHYWEEQFRKIHVLEFSRDRKMMSVLCSRNQMHVLFSKGAPESIISRCTSILCNDDGSIVSLTADIRAELDSRFHRFGFYHL

SEQ ID NO: 131222 - protein, 57 aa, Glycine max
  Coding DNA Sequence Number=SeqID_14444
MNGRNQSRYLRTDASRDGVTTDRSLPLLCARLAENVAARQPRILCILQLSFTICKNK

SEQ ID NO: 131223 - protein, 199 aa, Glycine max
  Coding DNA Sequence Number=SeqID_14445
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9SY55; Match level="QueryCoverage=84%, HitCoverage=16%, E-value=9e-67, Identity=75%"; Hit description =Calcium-transporting ATPase 3, endoplasmic reticulum-type
  Pfam annotation: Domain name=Cation_ATPase_C; Domain location=10-175; Score=188.4; E_value=1.7e-53; Accession=PF00689.11; Description =Cation transporting ATPase, C-terminus
MWPSKLPCTKPGWRAKRLLHQPKNVFFLVAYVGLATVAGFIWWFVYSDSGPKLPYTELMNFDTCPTRETTYPCSIFDDRHPSTVSMTVLVVVEMFNALNNLSENQSLLVIPPWSNLWLVASIILTMLLHMLILYVHPLSVLFSVTPLSWTDWTVVLYLSLPVIVIDEVLKFFSRNPIGLRFRLWFRRSDLLPKKELRDK

SEQ ID NO: 131224 - protein, 254 aa, Glycine max
  Coding DNA Sequence Number=SeqID_14446
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=O03636; Match level="QueryCoverage=92%, HitCoverage=74%, E-value=1e-113, Identity=70%"; Hit description =Ribulose-1,5-bisphosphate carboxylase/oxygenase large subunit
  Pfam annotation: Domain name=RuBisCO_large; Domain location=39-241; Score=385.5; E_value=8.1e-113; Accession=PF00016.10; Description =Ribulose bisphosphate carboxylase large chain, catalytic domain
MFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETAKALRLSGGDHVHAGTVVDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 131225 - protein, 77 aa, Glycine max
  Coding DNA Sequence Number=SeqID_14447
  Subcellular localization annotation: CTP_CleavageSite=39; ConfidenceScore=5.40e-01
MRSLGRILLSSNVIYVRVVMLVRMIRTRLFAAARVKSCPSMHSSSVIASLSSCARTVRPPPISGGGPGTVKRKLLVP

SEQ ID NO: 131226 - protein, 231 aa, Glycine max
  Coding DNA Sequence Number=SeqID_14448
MAKFDLEVVLEFYANAWPTEEGVRDMRSWVRGQWIPFDADSLSQFLGDPLVLEEGQECEFSQRRNRADGFDEKAVAQLLCTPGQDFTRTAAGRRVRIMGTSMTTLTQMWMTLLLSNVLPSDHNSDLHLPKCMPTTRHPLDPDKSNRALGFLALITGLCQSFGVLVTTSKVIRTPIAQAFIEKYCTPRQAQGDAPQAADAPLPPHQADPAGSLGMERYLQHLVRQQAANNGG

SEQ ID NO: 131227 - protein, 110 aa, Glycine max
  Coding DNA Sequence Number=SeqID_14449
MGPVLSDPQRPLLGDVRKKTQAIQKQNTAPHLLSRGGYEYLEQKLMAEKTKKKLEEAAQSGSIEGMIDPSSPIRQHMKCKMAHTKKTGQMTFEATKEIADKIDSLEEQAS

SEQ ID NO: 131228 - protein, 77 aa, Glycine max
  Coding DNA Sequence Number=SeqID_14450
MEREEKRFVYRIRCSSDENNDPEGVEEGIGVTRNVVDSDSKCPFASSMVPPFEELFEISIGSNEREWKKKKFGLCGE

SEQ ID NO: 131229 - protein, 175 aa, Glycine max
  Coding DNA Sequence Number=SeqID_14451
  Subcellular localization annotation: CTP_CleavageSite=57; ConfidenceScore=5.13e-01
KNYWNPDDLTVSIRGARRVRARPAELLSTSAAPTPASTSAAPSVPAQRSIPTIEQFLASVAWPEAQPSLHREDEGPIAQVAQHMEDESSEATIPEPFIAKEEAGHFRASCTSGGPILASVEEHAVDPSAPILEILEDSTTLVQTLNTSPLATPVLHLTDDEDVQTQDTQDQSQEF

SEQ ID NO: 131230 - protein, 126 aa, Glycine max
  Coding DNA Sequence Number=SeqID_14452
  Subcellular localization annotation: CTP_CleavageSite=27; ConfidenceScore=5.00e-01
MHALLGSFNSGNWSDSKVLDSVGLSCRAFMRNQGAIRIGPRGEGNFCKTEQLHPFLRRKLISPTYYDRIHHHQGNLPLNYQKPLPWQKSMIKGLPLRIIQVAQYHNFLPALHVLKCKLTTSTIHIP

SEQ ID NO: 131231 - protein, 156 aa, Glycine max
  Coding DNA Sequence Number=SeqID_14453
  Homolog annotation: Hit_ID=Q1SKA8; Match level="QueryCoverage=31%, HitCoverage=17%, E-value=2e-07, Identity=53%"; Hit description=Zinc finger, CCHC-type
ALDLNIWEAIEIGPYIPTMMVGNKTIEKPRHEWSEEEKREWQPKVTTITESRDLSNMSLATLFGMLQEHEMELKRLNKHEENDKKKKGIAFKASSSIQEESDKEDSIEIDEDDDLSLFAKKAYITWDDNDMDSSEDSENEIVNLSLMAKSYESDEE

SEQ ID NO: 131232 - protein, 144 aa, Glycine max
  Coding DNA Sequence Number=SeqID_14454
  Pfam annotation: Domain name=Transposase_23; Domain location=37-107; Score=-2.1; E_value=0.0019; Accession=PF03017.5; Description =TNP1ENSPM transposase
MQSQELTLPSEPEVGPSAARVSTKESCVDPSGNDPDTGDSDKCGLYIKENPPRLVALGKVYEGSTTVHNIPLLHDQVKVGVEEVKDADAPILVPTEEVKLVEQELNTFLACPTHLVKRLSEQEAVGPAKSADRPDHEVDDPTIS

SEQ ID NO: 131233 - protein, 187 aa, Glycine max
  Coding DNA Sequence Number=SeqID_14455
  Gene Ontology: Mol. function=ribonuclease H activity; Cellular component=mitochondrion; Biological process=DNA integration
MADALATLASMFQLTPHGDMLYIEFQCPSKPAHAKEAEWMLIEVHEGSFGTHANGHALVKKILRAGYYWLTIESDYCIYVRKCHKCQTFTDNVNAPPMPLNVLAAPWPFSMWGIDVIGAIEPRASNGHRFILVAIDYFTKWVETASYSSVTRSVVVRFIKKEIICRYSLPWKIITDNATDRGRTRIK

SEQ ID NO: 131234 - protein, 418 aa, Glycine max
  Coding DNA Sequence Number=SeqID_14456
  Gene Ontology: Mol. function=translation elongation factor activity; Cellular component=DNA polymerase III complex; Biological process =DNA replication
  Homolog annotation: Hit_ID=Q66DQ1; Match level="QueryCoverage=81%, HitCoverage=51%, E-value=1e-167, Identity=89%"; Hit description=DNA polymerase III, tau and gamma subunits; DNA elongation factor III
RTQQGHLNPHAAIRRIGQLFAADQQRLVVKLHIGRRQGARQLAQPLFHGGVLIVEHRRQQLHHRNAVQQRQRLHQQVFPVHAARSGLCDLRHHLFAVGADQRFEDRQRLFIIERAEHLADGGGGHLPLPHGDRLIGQAQRIAHAAVGGARQQLQRAGVAGDLLRRQHRFQLLADLIDVQRLEVELQTARENGHRQLLRIGGGQQEFDVRRRLFQRLEQRVEAVAREHVHFIDQVDLEAAARRRVLNVVQQIAGIFHLGSGSGVDLDQIDEAPLLDLAAVVALAARRGGDAGFTVQTFGQQARDGGFPHAARAREQIGVMDPPQREAVGQRGQDMFLADHGHANTAPRRSARPLCPRGDAASMAGEVHQAVAVDAQLVQTRFPAQIRQVDDECGVVHFTAQAADQFGGRFDGAAGRQQI

SEQ ID NO: 131235 - protein, 242 aa, Glycine max
  Coding DNA Sequence Number=SeqID_14457
  Homolog annotation: Hit_ID=Q1SM49; Match level="QueryCoverage=53%, HitCoverage=53%, E-value=1e-13, Identity=34%"; Hit description =Peptidase S1 and S6, chymotrypsin/Hap
MTNWGYLTLLQCWIYEHFLSVHQCITDDAYEEMSPCASRWLTTKAHMKGITGAPYRAHCDALTVTDVCWLPYSDHRGVRGFELISSFQGQLRWGPIVVTVRPERVVSADYIEWFFQISHPFIIPTQAGDEPRHPPAPEHDDYIQLDIPEVPMAFNPPGHALDDYEGYEAITERLEHVLNLRMVTTDTELHDIMQDCLRIARGVPTQMEVLGLDKDGAQSIDDVFYVLYLTTFFVFVTLFCLI

SEQ ID NO: 131236 - protein, 43 aa, Glycine max
  Coding DNA Sequence Number=SeqID_14458
  Gene Ontology: Biological process=regulation of GTPase activity
  Homolog annotation: Hit_ID=Q1T0M4; Match level="QueryCoverage=84%, HitCoverage=7%, E-value=2e-12, Identity=91%"; Hit description=Arf GTPase activating protein
MNEKANVSKELNAKHKKILEGLLKLPENKECADCKAKYVFGWI

SEQ ID NO: 131237 - protein, 50 aa, Glycine max
  Coding DNA Sequence Number=SeqID_14459
MFTATCLHIIDHLKGTMRCGKGTATGRLRKGDPTRCGNRTVTKEGFGKGM

SEQ ID NO: 131238 - protein, 303 aa, Glycine max
  Coding DNA Sequence Number=SeqID_14460
  Gene Ontology: Biological process=regulation of GTPase activity
  Homolog annotation: Hit_ID=Q1T0M4; Match level="QueryCoverage=98%, HitCoverage=58%, E-value=1e-62, Identity=46%"; Hit description=Arf GTPase activating protein
MAKPQHVEKVEPVAPPPQAETSKQTTETTQNSPPKVDYATDLFDMLSMDDPNEKGSGAANDNNWAAAAEASEAEKTDAPKAIESTPQSTRQSTSGIEDLFKDSPSVTPSLTPEKPQKDLKNDIMSLFEKSNVVSPFAMHQQQLAMLAQQQSLLMAAAKSAGGDPKYLASLQQQQSLLMAAAAAKSGGTDSKYLASIQEPGSNIPLQSWLGAGYPMPGAMPMGSQEELQKLMQTVNMNAAHSAGSSVQYPPSSYYAMGQVAPSNGSTPTEASKPQSASPASSNTSKTGNDYDFSSLTQGMFAKH

SEQ ID NO: 131239 - protein, 396 aa, Glycine max
  Coding DNA Sequence Number=SeqID_14461
  Gene Ontology: Mol. function=protein-disulfide reductase activity; Cellular component=membrane; Biological process=cytochrome complex assembly
  Homolog annotation: Hit_ID=Q7XY14; Match level="QueryCoverage=99%, HitCoverage=100%, E-value=1e-160, Identity=77%"; Hit description=C -type cytochrome biogenesis protein
  Pfam annotation: Domain name=DsbD; Domain location=179-386; Score =164.8; E_value=2.2e-46; Accession=PF02683.6; Description=Cytochrome C biogenesis protein transmembrane region
MSLSMSLCGNYSLQLQNRRIVSCNLHQDDHVARDSVLTCSRCGMEGHFMFLSLGFGTMFVANYFIRCCYPLFGSTFMSLNKMHIVPINTHQKPSKPEKCLRSKWKINGNNIGTCIGVMTVAHLVAPVAAKAEVAASIYALADGSLGDWFGGFLFSAGQQANEAVQGQLTSLSFTSLAVIYGAGLVTSLSPCTLSVLPLTLGYIGAFGSGKSRAQVVGDSIAFSLGLATTLALLGVGASFAGKAYGQIGQGLPLAASGLAIIMGLNLLEIIELRLPSFFDSFDPRAAAANFPSSVQAYLAGLTFALAASPCSTPVLATLLGYVAASKDPVIGGSLLLTYTTGYVSPLLLAASFAGALQSLLSFRKFSAWINPISGAMLLGGGVYTFLDRLFPVTMVM

SEQ ID NO: 131240 - protein, 99 aa, Glycine max
  Coding DNA Sequence Number=SeqID_14462
  Gene Ontology: Biological process=regulation of GTPase activity
  Homolog annotation: Hit_ID=Q1T0M4; Match level="QueryCoverage=88%, HitCoverage=21%, E-value=2e-31, Identity=65%"; Hit description=Arf GTPase activating protein
MGNEKANSYWEAELPQHYDRVGIENFIRAKYEEKRWAARNEKPKSPSSFREEKSPSHWQKPEETKKIQPSNAIPATRISVPAPPKGPELSLFCYQCFDS

SEQ ID NO: 131241 - protein, 176 aa, Glycine max
  Coding DNA Sequence Number=SeqID_14463
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O48551; Match level="QueryCoverage=92%, HitCoverage=66%, E-value=3e-90, Identity=98%"; Hit description =Proteasome subunit alpha type 6
  Pfam annotation: Domain name=Proteasome; Domain location=32-176; Score=103.7; E_value=5.4e-28; Accession=PF00227.16; Description =Proteasome A-type and B-type
MSRGSGGGYDRHITIFSPEGRLFQVEYAFKAVKAAGITSIGVRGKDSICVVTQKKVPDKLLDNTSVTHLFPITKYLGLLATGMTADARTLVQQARNEAAEFRFTYGYEMPVDVLAKWIADKSQVYTQHAYMRPLGVVAMVLGIDDEYGPQLYKCDPAGHYFGHKVHRRSSLTLIDV

SEQ ID NO: 131242 - protein, 133 aa, Glycine max
  Coding DNA Sequence Number=SeqID_14464
  Subcellular localization annotation: CTP_CleavageSite=86; ConfidenceScore=5.13e-01
MQLVLGKSATKKKPRVETETVLLLFNSFKHRSQLPTQENMEVMILRSNYASSSFFFFFASRFCIFFPSEGFFFAFLLLPRGTFLLRVSASSTIVVSDGGNRYREVAGLFTNHLIRKRLTDQVDPEEAYGSSDP

SEQ ID NO: 131243 - protein, 185 aa, Glycine max
  Coding DNA Sequence Number=SeqID_14465
  Gene Ontology: Mol. function=structural constituent of ribosome; Cellular component=intracellular; Biological process=translation
  Homolog annotation: Hit_ID=Q1SP37; Match level="QueryCoverage=57%, HitCoverage=32%, E-value=1e-24, Identity=50%"; Hit description =Bacterial adhesion
MGTSENITLKEGGGNIKKKQRIKWSMKEDNLLIRSWLNISNNPIEGGKVKAQMRMSVFTEVYAIYEQDTKETFNYEHELDALGNHDEYFQTRFDVADIMSLSPLQKCTITICVLAYKSPANNVDYYVQIGETTARECLETFVRGVNQNFGIEYLRRPNNNNTQYLLQMGEAHGFLDMLGLVDCMH

SEQ ID NO: 131244 - protein, 254 aa, Glycine max
  Coding DNA Sequence Number=SeqID_14466
  Gene Ontology: Mol. function=protein binding; Cellular component =membrane; Biological process=defense response
  Homolog annotation: Hit_ID=Q6R271; Match level="QueryCoverage=99%, HitCoverage=22%, E-value=1e-105, Identity=77%"; Hit description =Disease resistance protein
MAAELVGGALLSAFLQVAFEKLTSPQVLDFFHGRKLDEKLLSKMEIKLHSIQALADDAEQKQFRDPHVRNWLLKVKNVVLDAEDVLDEIQYEISKCQVEAESESQTSTGCSCKVPNFFKTSHASSFNKEIKSRIEQVLDSLEFLSSQKGDLGLKNASGVDYGSGSGSEVSQKLPSTSLLSESVIYGRDDDKEMILNWLRSDTEDCNQLSVLSIVGMGGVGKTTLAQHVYNDPRIEGKFDIKAWVCVSNEFDVFK

SEQ ID NO: 131245 - protein, 133 aa, Glycine max
  Coding DNA Sequence Number=SeqID_14467
MATWQQQHRSIFFTLVAVAPLVAKSPNWGVCYFTTKRLPEERVPPERDTWLVWTWRCDRGGRACLPGATSRAYLPGATSRAYLPGATTSGSLAGTSTSGGAPGTSMFPIKPSALRFIFTQTQNQAHLETLKLS

SEQ ID NO: 131246 - protein, 601 aa, Glycine max
  Coding DNA Sequence Number=SeqID_14468
  Gene Ontology: Mol. function=protein binding; Cellular component =membrane; Biological process=defense response
  Homolog annotation: Hit_ID=Q6SQJ2; Match level="QueryCoverage=99%, HitCoverage=48%, E-value=0.0, Identity=69%"; Hit description=NBS-LRR type disease resistance protein RPG1-B
  Pfam annotation: Domain name=LRR_1; Domain location=298-320; Score =7.3; E_value=12; Accession=PF00560.23; Description=Leucine Rich Repeat
  Pfam annotation: Domain name=LRR_1; Domain location=322-343; Score =12.4; E_value=1.4; Accession=PF00560.23; Description=Leucine Rich Repeat
  Pfam annotation: Domain name=LRR_1; Domain location=345-367; Score =10.5; E_value=3.2; Accession=PF00560.23; Description=Leucine Rich Repeat
  Pfam annotation: Domain name=LRR_1; Domain location=369-390; Score =5.4; E_value=28; Accession=PF00560.23; Description=Leucine Rich Repeat
  Pfam annotation: Domain name=LRR_1; Domain location=505-526; Score =1.2; E_value=1.7e+02; Accession=PF00560.23; Description=Leucine Rich Repeat
  Pfam annotation: Domain name=NB-ARC; Domain location=1-161; Score= -40.3; E_value=1e-07; Accession=PF00931.13; Description=NB-ARC domain
  Pfam module annotation: Pfam domain module=LRR_1::LRR_1::LRR_1::LRR _1::LRR_1::NB-ARC; Domain location=298-320::322-343::345-367::369 -390::505-526::1-161
MTYGMKTDINGKLFRDLLIVGLKESKEHHLEQLEKDHCWRLFNKHAFQDDNAQSNPDFKEIGMKIVEKCKGLPLALKTIGSLLHRKTSILEWESILKSKIWEFSEEDSEIVPALALSYHHLPSHLKRCFAYCALFPKDYEFDKECLIQLWMAENFLQCHQQSKSPEEVGEQYFNDLLSRSFFQQSSINDLSPIFFLTSSRIRNKTYFVMHDLLNDLAKYVGGDIYFRLEDDQAKSIPKTARHFSFETNDIYCYDEELGSLHDVERFRTFMPTSKSMDFLYYSWYCKMSIHQLFSKFKFLRVLSLLGCSELKEVPDSVGNLKHLHSLDLSNTNIKKLPESTCSLYNLQILKLNGCSHMKEFPTNFHKLTNLRRLELIKTEVRKVPEQLGKLKNLHVLMSSFDVGKSREFGIHQLGELNLHGRISIGELQNIENPSDALAVDLKNKIHLVEIDLKWVRDQNPDDSIKERDEIVIQNLQPSKHLEKLSIGHYGGTKFPSWLSDNSLSNVVSLRLTDCKYCLCLPRFGLLPFLKDLVIKRLDGIVSIDADFYGNNSSSFTSLETLKFSAMKEWEKWECQAVTGAFPRLQRLSIKRCPKLKGHLPE

SEQ ID NO: 131247 - protein, 271 aa, Glycine max
  Coding DNA Sequence Number=SeqID_14469
  Gene Ontology: Mol. function=phosphoglycolate phosphatase activity; Biological process=metabolic process
  Homolog annotation: Hit_ID=Q8PFJ5; Match level="QueryCoverage=84%, HitCoverage=94%, E-value=2e-90, Identity=71%"; Hit description =Hydrolase
MRQVLRGAAASRLASIQSAQTGEGVELQVRLQVRMGPGGCFAVDPAPAQAGGDRPGHVHLGMVADMQYLCRRHTQAGAGGVEDARLGLGCAVLAGAQLEGEMMGQADPLQIGIAIAQRCHRHPRGNPRQRIDRIGVALDLVARGEEHFIRRLQQLQAGTTGVQRFVQGQPAQRAQVVVKVRMGVVQALAQFAHRRHRIHLGSGRAVFTHPRVQDQVDAGADRSERPQRVVKVESDGLDGEIHPAILRLPARAFIPAGVPSPACRPAVPAPA

SEQ ID NO: 131248 - protein, 450 aa, Glycine max
  Coding DNA Sequence Number=SeqID_14470
  Homolog annotation: Hit_ID=Q84VH5; Match level="QueryCoverage=99%, HitCoverage=65%, E-value=0.0, Identity=79%"; Hit description =Envelope-like protein
MATAPKETSAPGSPSVPSSTKAPSNQEQPEFHIQPIQMIPGQAPVPEKLVPKRQQGVKTSENPSLATSPREVDTKMDKKIRSIVSNILKNASVPDADEDVPTSSTPNVSVPDAEKDVPTSSTPNAEALPSPSEEESTEEEDQATEETPAPRAPEPVPGDLIDLEDVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVEKWKYVYQRRLAVERKLGRDALACKEIMDLIKAAGLLKTVTKLGDCYESLVREFIVNIPSDITNRKSDDYQKVFVRGKCVRFSPAVINKYLGRPTEGVVDLAVSELQIAKEITAKQVQHWPKKGKLSAGKLSVKYAILHRIWRLQTGYPPIILPLFATGLGKFSVCCWNQVQI

SEQ ID NO: 131249 - protein, 63 aa, Glycine max
  Coding DNA Sequence Number=SeqID_14471
DDVPKGKPYKVPEFQQTLSTITNHVASHATRLLGHGNKRCGGRQKQGFCSYVSSISDEELKPT

SEQ ID NO: 131250 - protein, 180 aa, Glycine max
  Coding DNA Sequence Number=SeqID_14472
  Homolog annotation: Hit_ID=Q1SI90; Match level="QueryCoverage=62%, HitCoverage=6%, E-value=5e-14, Identity=42%"; Hit description =Disease resistance protein; AAA ATPase
MACLTADPKVVLHIFDVKTAMGLGAAAFPRPLPFSLKKLTLERLPKLENIWNEDPHGILSVQHLQLVIVEKCKCLTSVFPASVAKDLEKLVVKDCEGLMEIVAEDNADPRGANLDLMFPCPCVRSLKLQGLPKFKYFYYGSLQCDMFQTPTEDGKVLLSYYFVLTAESDACLLYIIALLL

SEQ ID NO: 131251 - protein, 136 aa, Glycine max
  Coding DNA Sequence Number=SeqID_14473
  Homolog annotation: Hit_ID=UPI0000545E95; Match level="QueryCoverage =77%, HitCoverage=9%, E-value=2e-12, Identity=35%"; Hit description =PREDICTED: similar to RIKEN cDNA 4732495E13, partial
  Pfam annotation: Domain name=DUF300; Domain location=4-135; Score= -57.6; E_value=1.2e-08; Accession=PF03619.7; Description=Domain of unknown function
MHPAQIVLYGSTLCVMITVHFSMKLLAEHVLNWKKPKEQNAIVIIILMAPLYAVDSYVGLINFFGSEAFFTFLDSIKECYEALVIAKFLGLMYSFLNISLSKNIVPDEIKGREIHHSFPMTLFQVVDTQTILQCSD

SEQ ID NO: 131252 - protein, 59 aa, Glycine max
  Coding DNA Sequence Number=SeqID_14474
MSSFQGIVLDLLAALGIIRSRYSWLTVERIEEGYQNLLQYAYSAAPYKVNSSPSDKKSK

SEQ ID NO: 131253 - protein, 133 aa, Glycine max
  Coding DNA Sequence Number=SeqID_14475
MAAAVTDMARRHTISQILVDLLKFAVGSAIDGSRKIIPGRKQVDKMVPEGLINIPLPTPVNAKKHPDLKVANDLHFETKMEEVKEDLNNIKQQYKTSTKRIQESQPPNKSDDGFKEINHVQSNGRRVFIRSRL

SEQ ID NO: 131254 - protein, 130 aa, Glycine max
  Coding DNA Sequence Number=SeqID_14476
  Gene Ontology: Mol. function=transition metal ion binding; Cellular component=cytoplasm; Biological process=fucose metabolic process
MLPEEYTLPRDHYEAKKILCPVGMEYQKIHACPNDCILYKNQFAEMHKCPTCEVSRYKVKDDEFSDDARKNNSRTAKVMNKKLKDQKNNSSESKNISRESRTSQEFKNQEEFKTQEESLESRIKIQDSRS

SEQ ID NO: 131255 - protein, 166 aa, Glycine max
  Coding DNA Sequence Number=SeqID_14477
  Homolog annotation: Hit_ID=Q1S0F5; Match level="QueryCoverage=89%, HitCoverage=29%, E-value=6e-08, Identity=28%"; Hit description=IMP dehydrogenase/GMP reductase
ELDRGKQVENGVVGVPRKCLEAKARVLASQDEWAPFMDILTLLIFGVVLFPNVDGLVDRAAIDAFLSFYDHKESLVIAILADLYDTFDQRCEKNNARIVCYTLALYRVHKAWEMSQRKDKELKGSSNGPIGGYHRWLKAYAQDLDWLPSLRTTKGMEVETPEEDEE

SEQ ID NO: 131256 - protein, 82 aa, Glycine max
  Coding DNA Sequence Number=SeqID_14478
MCSPLMARTYSPLKVIGTSTQKSTFMRKQEIDSSREPVIQKDWTRDIDCLFEKGDNSCNLIPSFANISGNSLRVYILFDSVT

SEQ ID NO: 131257 - protein, 246 aa, Glycine max
  Coding DNA Sequence Number=SeqID_14479
  Gene Ontology: Mol. function=transporter activity; Cellular component= outer membrane; Biological process=transport
  Homolog annotation: Hit_ID=Q6D8P5; Match level="QueryCoverage=99%, HitCoverage=32%, E-value=5e-96, Identity=65%"; Hit description=TonB -dependent receptor
MNSLYEDGNGNSSNLVMTYNRQNNTNYNTLSKAQFQNDGRGTDYATTPEYNSKGQLNKYYKIERNPFENFTLSFTQKLQLRDDLSLTLQPYYYWGNGGSFNGQTASVLSSTSDRAGQYDLSNLQSNTYYRPSWTQTWRPGITTKLKWDINEQHSLDIGYWYERARQLQTQPFISIKDDGNPAQIWGKPGGSDQVKDANGNTVQGRNQYTITPAQKVWLQDTWFATPDWTFVGGLAYQYVERKGDNR

SEQ ID NO: 131258 - protein, 255 aa, Glycine max
  Coding DNA Sequence Number=SeqID_14480
  Gene Ontology: Mol. function=sequence-specific DNA binding; Cellular component=intracellular; Biological process=regulation of transcription, DNA-dependent
  Homolog annotation: Hit_ID=Q2NVZ8; Match level="QueryCoverage=53%, HitCoverage=47%, E-value=8e-31, Identity=49%"; Hit description=Right origin-binding protein
MSLDTADFPLVWMRQNGRDTQAELAEFSALLARAEPFVLMTDRSVGDEEEEHDRDARTQVALWKRDNREVLKLWVKGMIMLEPDDAKRAAAEEFAEYGAKFWGYPVLVAADEAAGRPGSAADAGRHCRQVRLLQVAFAADVQATYRPYSRHVRAPQKADRRRARTAPDRHQRGLHRRHLPVRFAADLHPLLPQAVRSAAGQLSPQPGLVELWPAAAAAADRNTVAAGRYRDAARHAAGGPYPAAQLYAGAVGGLQ

SEQ ID NO: 131259 - protein, 80 aa, Glycine max
  Coding DNA Sequence Number=SeqID_14481
  Gene Ontology: Mol. function=protein serine/threonine kinase activity; Cellular component=mitochondrion; Biological process =protein amino acid phosphorylation
  Homolog annotation: Hit_ID=Q1SF47; Match level="QueryCoverage=83%, HitCoverage=8%, E-value=5e-24, Identity=72%"; Hit description =Protein kinase; EGF-like, subtype 2; S-locus glycoprotein; Curculin- like (Mannose-binding) lectin; Apple-like
MASSSTFIPGYMSPEYAMDGLFSEKSDVYSFGVLLLEIISGKRNTSFRNHDQSLSLIGYAWNLWNEDNIRCLVDPEISAS

SEQ ID NO: 131260 - protein, 936 aa, Glycine max
  Coding DNA Sequence Number=SeqID_14482
  Gene Ontology: Mol. function=chitin binding; Cellular component =extracellular region; Biological process=chitin metabolic process
  Homolog annotation: Hit_ID=Q1SD81; Match level="QueryCoverage=14%, HitCoverage=10%, E-value=3e-24, Identity=51%"; Hit description=H+ -transporting two-sector ATPase, alpha/beta subunit, central region; TonB box, N-terminal
MGLNVKDIHLRLFKVVQDSTKSSYSFMRRHPLVSGASLVCFILYVFLSYIYNLLVYMSPFLVCAVIFIKIFWSSEQTQLKYVKTNEEKGGQKKVEPKCPKIPNNRRPEMLYKYPSQNATSRRRNFRDKNWDVYGGLEEKAKDLSAVFHNEFTKRNIEKKGARYFEKGESALDNRLSTKKTQVPKRQILRSEPSMVDLVECSDLEIEKKIEDGDDEDGEETQEESNKAIEWTEDDQKNLMYLGNSEMERNRRLENLIARRRAKKLFKGQVEKGQIDKKPMAPVLTKRSNHLDSSSKDFDDGLDMPGSAPSLMPRSPSDNPYDPSEEKPNLTGDSFPQEFSSQKYMPFSRHESFISSHLFPSETKHDHGAREHYYFNKGRKYSDRLAYSRFRRPHTDKGTHDWLIDQLIYNESGENGLHTPNPPTTNGEESTHEEDGKCITDMENTIDENDHETKSMSGQISEPGSDRSRPWARFPKPHARLLSFPVSTTATTYITNINEALYDTVTSVVDKRQESMFLNHGRNCHTPTYSIASDLQVEVSEVGSPTSTVGENAETNSSIDRDSILYDGDIGRDVSSGSEELWGASFHGGKEARGVRSEADNNAEVNNNSKDVVSSTTPRHIDENAADVSSMSSKSDVPEDTPTNAINNHHNFFGYMKYPVGETEAPQSSNSSHALDQLPNEAHSERPEEWCNMLENVTNEEQVINDVNNSTSTEQDNTENLRSNEEPSTLVMRQESIDETSNSSVSSSPRSVLPEKTMSDDVSPSTFDQDLHIDVQQFIMEGLAQETLNSESPTGTMPQTIQPTMDETTDESHNVDFNHSQEQTNPLENSIEESNVFGSMNDEEVSNMEEEDKSKNDENSEGNSDHLNTQATTESARPISEITTLEDTVLSTELIEDGKNDKPSSSSNIQKECSDKRVSTKPTVHNKESRYIYDIFD

SEQ ID NO: 131261 - protein, 36 aa, Glycine max
  Coding DNA Sequence Number=SeqID_14483
MGSNQCFSRSADGLKRQGVLRSTDGSLSQQIGLARG

SEQ ID NO: 131262 - protein, 124 aa, Glycine max
  Coding DNA Sequence Number=SeqID_14484
  Gene Ontology: Mol. function=nucleic acid binding
MAEDHPQRMTLEDYSSLATPQYFTSIARPDVQATNISYPHSLIQLIQGNLFHGLPSEDPYIRTPGHIHRDLQHGEDSRSEAKRWLHSFKGNSLRTWEEMVEKFLKKYFPKSKTAEWKVESHLIM

SEQ ID NO: 131263 - protein, 38 aa, Glycine max
  Coding DNA Sequence Number=SeqID_14485
MEQLEESLEIARDAAIAAGIHVSPLRGFYFPCCDKPFI

SEQ ID NO: 131264 - protein, 109 aa, Glycine max
  Coding DNA Sequence Number=SeqID_14486
  Gene Ontology: Mol. function=nucleic acid binding
  Homolog annotation: Hit_ID=Q1SDG1; Match level="QueryCoverage=61%, HitCoverage=6%, E-value=3e-13, Identity=52%"; Hit description =Integrase, catalytic region; Zinc finger, CCHC-type
MESSEDSENEEINLCLMAKSYESDEEVSLRKKWYIDSGCSKHMTGDASKFTHISPKKNGHVTYGDNNKGRILGVGKIGSLALAFGHVHTLDVVYDRGGHCALTFQGLWH

SEQ ID NO: 131265 - protein, 59 aa, Glycine max
  Coding DNA Sequence Number=SeqID_14487
  Homolog annotation: Hit_ID=P58722; Match level="QueryCoverage=98%, HitCoverage=8%, E-value=3e-16, Identity=67%"; Hit description =Putative membrane protein igaA homolog
MPGDHQYRAYQPEEQQQQRNGDDNGFTDAVRPVQRMLFRRFLANIDQLDMLTLLLADGR

SEQ ID NO: 131266 - protein, 131 aa, Glycine max
  Coding DNA Sequence Number=SeqID_14488
GRGHITSQCPTTKTHDYEGPKTFIVAKDKATTSPSSSESEKAKGEESSEEIYPQEEGQPLVVKEKCKELSVSSKSDQGVPMNPKRIKVIPEWPTPPSVKEKSPEFQEPRDLRSNPFQGGGNHAILFCKGIG

SEQ ID NO: 131267 - protein, 360 aa, Glycine max
  Coding DNA Sequence Number=SeqID_14489
  Gene Ontology: Mol. function=RNA-directed DNA polymerase activity; Cellular component=intracellular; Biological process=RNA-dependent DNA replication
MLEGGQEVPLPSPTPAISVDNIASDGKVLRNGRVIPTLFAKKVNDPAVKQATVNGPGTRKEVGQSNGTSKNSDHDEILKLIQKKAHREALMKVLDQAFVERDVTVNQLDSIVGNITACNNLSFSDEELPEEGRNHNLALHISVNCKSDALSNVLVDTGSSLNVMAKSTLGQLSYQGPPMRRSGVVVKAFDGSRKSVIGEVDLPITIGPFVFQITFQVMDIQAAYSCLLGRPWIHEAGAVTSTLHQKLKFVRNGRLITVSGEEALLVSHLSAFSFIGADEVEGTSFQGLTVEGKKPEKNEVSFATWKSAQKVVQEGTGVGWGKVVQLIESKNREGLGFASSAGSATNSVGSSSITSTFCSA

SEQ ID NO: 131268 - protein, 39 aa, Glycine max
  Coding DNA Sequence Number=SeqID_14490
MMLAKMDELMRVDYVELKECFASISERSDAMGAPYVDDI

SEQ ID NO: 131269 - protein, 123 aa, Glycine max
  Coding DNA Sequence Number=SeqID_14491
MADHHHSDVIGLVCLWMIKSRPEDANISGKGADDDIANETISQSRPEDDDIFEKGADDDSRPEVADIFGEGADDDSRPEDADISEEGADDDVSHCMLSDFEFLRIANETFPQSRSEDADIFEE

SEQ ID NO: 131270 - protein, 304 aa, Glycine max
  Coding DNA Sequence Number=SeqID_14492
  Pfam annotation: Domain name=zf-CCHC; Domain location=53-70; Score =22.8; E_value=0.00017; Accession=PF00098.13; Description=Zinc knuckle
MSTSKSYVSHSYPKKDQGQGILGVTPSKPKDDKGKTIEKQAPKASMQEKTSSIKCFKCLGRGHITSQCPTTKTMIMRGQDIYSSQDEATTSPSSSESEKAKGEESSEEIYPQEEGQPLVVKEKCKEVSVSSKSLAKKETHFTIKTNNKETFPLRQPPHFLFCKKTLASIATPLGLEFIPQVKKLLDEGLVHKSLNPCALLVPKIGIIRHQVPKIGGMMNVLSGATLFCKITRTPNIFMVCVHRDPLGSDQGVPMNPKRIKVIPEWSTPPSVEGRSPEYEEPRDLRSNPFQGGGNDAILSRKGIG

SEQ ID NO: 131271 - protein, 68 aa, Glycine max
  Coding DNA Sequence Number=SeqID_14493
MGVATCTQHYCWGTQQTVKWRNCPSAIILPEEDNFRKNVIRNVSGRSFFRKNSIVFRKKLLPEVSFFF

SEQ ID NO: 131272 - protein, 95 aa, Glycine max
  Coding DNA Sequence Number=SeqID_14494
MSLHVLYLYVFSGFPPGIPRLLYLSLQSFKEVNVGAGSSRATFWGGDKVKAAGTNQGKTTTRSRFATPRCFLLSDTWGRTQKEARVTTNRSSSLT

SEQ ID NO: 131273 - protein, 253 aa, Glycine max
  Coding DNA Sequence Number=SeqID_14495
  Homolog annotation: Hit_ID=Q10B01; Match level="QueryCoverage=29%, HitCoverage=11%, E-value=3e-20, Identity=68%"; Hit description=Acyl -CoA binding family protein, putative, expressed
MGLQVEQIFFQRAMGRLVSDEKNELGPVVSQKLSRRQVVAPKEVNGANGDTLEMYRWRSWILPWEEQEGRNKLRLKGGTKERNRLKKGSDHHGITQLKQHLCHHFRTKDLLLLRDRGDAIGKKIKAILEFCALVTCWSWVRIRKQSLCICKGKAAYNIPPSHSEEPLGNGELQSVRGQLASEQSRCFKLEVEVAELGQKLQTIGTLQKELELLQRQKAASEQAALNAKQRQSSGGVWGWLAGTPPPSRNADDA

SEQ ID NO: 131274 - protein, 156 aa, Glycine max
  Coding DNA Sequence Number=SeqID_14496
  Homolog annotation: Hit_ID=Q1SPB5; Match level="QueryCoverage=57%, HitCoverage=62%, E-value=3e-26, Identity=65%"; Hit description=ENT
  Subcellular localization annotation: CTP_CleavageSite=56; ConfidenceScore=5.56e-01
MPSGSGDKLAVTNLQGAAHLSLGQSLPALSSVKSVQYTSAGPTGGRHFANRSSSALASNVPAEAAAFDPLIGKKVWTRWPEDNHFYEAVVTDYNPADGRHALVYDINKVNETWEWVDLKELLDEGDIYISVKSCSPFPHPVVTCPKTDASSTDCIF

SEQ ID NO: 131275 - protein, 446 aa, Glycine max
  Coding DNA Sequence Number=SeqID_14497
  Gene Ontology: Mol. function=acyl-CoA binding; Cellular component =intracellular; Biological process=lipid transport
  Homolog annotation: Hit_ID=Q10B01; Match level="QueryCoverage=98%, HitCoverage=68%, E-value=1e-174, Identity=67%"; Hit description=Acyl- CoA binding family protein, putative, expressed
  Pfam annotation: Domain name=ACBP; Domain location=12-104; Score =50.0; E_value=8.2e-12; Accession=PF00887.9; Description=Acyl CoA binding protein
  Pfam annotation: Domain name=Kelch_1; Domain location=185-230; Score =39.8; E_value=9.4e-09; Accession=PF01344.15; Description=Kelch motif
  Pfam annotation: Domain name=Kelch_1; Domain location=240-286; Score =10.1; E_value=0.28; Accession=PF01344.15; Description=Kelch motif
  Pfam annotation: Domain name=Kelch_1; Domain location=291-337; Score =21.2; E_value=0.0037; Accession=PF01344.15; Description=Kelch motif
  Pfam annotation: Domain name=Kelch_1; Domain location=343-388; Score =22.7; E_value=0.0013; Accession=PF01344.15; Description=Kelch motif
  Pfam annotation: Domain name=Kelch_1; Domain location=393-438; Score =22.0; E_value=0.0021; Accession=PF01344.15; Description=Kelch motif
  Pfam annotation: Domain name=Kelch_2; Domain location=185-230; Score =41.1; E_value=3.9e-09; Accession=PF07646.5; Description=Kelch motif
  Pfam annotation: Domain name=Kelch_2; Domain location=240-286; Score =20.0; E_value=0.0083; Accession=PF07646.5; Description=Kelch motif
  Pfam annotation: Domain name=Kelch_2; Domain location=291-337; Score =22.6; E_value=0.0014; Accession=PF07646.5; Description=Kelch motif
  Pfam annotation: Domain name=Kelch_2; Domain location=342-388; Score =21.9; E_value=0.0023; Accession=PF07646.5; Description=Kelch motif
  Pfam annotation: Domain name=Kelch_2; Domain location=393-438; Score =14.6; E_value=0.36; Accession=PF07646.5; Description=Kelch motif
  Pfam module annotation: Pfam domain module=ACBP::Kelch_1::Kelch _1::Kelch_1::Kelch_1::Kelch_1::Kelch_2::Kelch_2::Kelch_2::Kelch _2::Kelch_2; Domain location=12-104::185-230::240-286::291-337::343 -388::393-438::185-230::...
  Pfam module annotation: Domain location=240-286::291-337::342 -388::393-438
MAMARATSGLQYPERFYAAASYVGFDGSSPTKTLTSKFAKSTALLLYSLYQQASVGPCNIPEPSTWKLVEHSKWASWNQLGNMSSTEAMRLFVKILEVMQEEDPGWYSRASNSVVEPVIDVQMNNSKVEPVIENGNSYPETKTISTQNGSEVGTQDKDIVVEGFGSVEVYDQWIAPPVSGGNPKARYEHGAAVVQDKLYIYGGNHNGRYLNDLHVLDLRSWTWSKIEAKTGVESPTTSIPCAGHSLIPWGNKLLSIAGHTKDPSESIQVKEFDLETAAWSTLKIFGKAPVSRGGQSVNLVGKTLVIFGGQDAKRTLLNDLHILDLETMTWDEIDAVGVPPSPRSDHTAAVHVDRYLLIFGGGSHATCYNDLHVLDLQTMEWSRPTQLGEIPSPRAGHAGVTVGENWFIVGGGDNKSGVSETVVLNMSTLTWSVVTSVQGRVPVASE

SEQ ID NO: 131276 - protein, 82 aa, Glycine max
  Coding DNA Sequence Number=SeqID_14498
MKNIKLNEHYGYPLTEISGWFGSGLVSTSVVIAINTFPWKLNLALKVVSNRQLMRLCNLAWMVCLEFKRELIASTGDEPNTY

SEQ ID NO: 131277 - protein, 70 aa, Glycine max
  Coding DNA Sequence Number=SeqID_14499
MKVKEVVGVMRGRRGRREGIDSAVVSTRRCNSMGERKRKRVNEGRERWVSKEILQNLGVQKAKNRVLNLE

SEQ ID NO: 131278 - protein, 512 aa, Glycine max
  Coding DNA Sequence Number=SeqID_14500
  Gene Ontology: Mol. function=nucleic acid binding; Cellular component= intracellular; Biological process=chromatin modification
  Homolog annotation: Hit_ID=Q1RSK1; Match level="QueryCoverage=98%, HitCoverage=99%, E-value=1e-141, Identity=53%"; Hit description=Zinc finger, C2H2-type
  Pfam annotation: Domain name=RS4NT; Domain location=158-195; Score =13.7; E_value=0.046; Accession=PF08071.2; Description=RS4NT (NUC023) domain
  Pfam annotation: Domain name=zf-C2H2; Domain location=173-195; Score =20.1; E_value=0.0079; Accession=PF00096.16; Description=Zinc finger, C2H2 type
  Pfam annotation: Domain name=zf-C2H2; Domain location=200-221; Score =17.5; E_value=0.05; Accession=PF00096.16; Description=Zinc finger, C2H2 type
  Pfam annotation: Domain name=zf-C2H2; Domain location=97-119; Score =26.4; E_value=0.0001; Accession=PF00096.16; Description=Zinc finger, C2H2 type
  Pfam module annotation: Pfam domain module=RS4NT::zf-C2H2::zf -C2H2::zf-C2H2; Domain location=158-195::173-195::200-221::97-119
MSNSNITSCDSWRFSTENNINSGEDAAVAVKQQLEMLGQLHSPNSNTSTTTNNSNGSASNTDSQPPAKKKRNLPGNPDPSAEVIALSPNTLVATNRFVCEICNKGFQRDQNLQLHRRGHNLPWKLKLRTTTDVRKRVYVCPEPSCVHHNPARALGDLTGIKKHFSRKHGEKKWKCEKCSKKYAVQSDWKAHSKICGTKEYKCDCGTIFSRRDSFITHRAFCDALSEENNKFNEGQLPKMHGSNLQPPTIIPNLVASLPINGANNHKHPLSLPHDLMTTIPAKPFNNNMAAAFTRSLSSTSQLSSKSPNINMFEENGLLSPHMSATALLQKAAEMGATVNSNSNNNSMMMSGEKSFINVTSMAPPSYGIMNPNMHNGQQDLSQYNFIANGVVDGGSNGMGMSGLDMFNAILDQSKALSKIIEQNNRSSTYNGVLHAMNNGRSSGSIEVGGTKESEDVMTLDLLGIGGGGGGGGDGNFYGGDQQLEMVGGDGIWGNWSNKNAGLESFSATNSTI

SEQ ID NO: 131279 - protein, 321 aa, Glycine max
  Coding DNA Sequence Number=SeqID_14501
  Gene Ontology: Mol. function=RNA-directed DNA polymerase activity; Cellular component=chromatin; Biological process=chromatin assembly or disassembly
  Subcellular localization annotation: CTP_CleavageSite=25; ConfidenceScore=5.63e-01
MLHTHSLSTLFHITSVPNQTQPSSSSSTISNITTPFPITFFISKFKFLFIEPSGLSPHRPITHHILLLPHSNPVNVKPYHYPNSQKAKLERQVSSVLDAGLIQLSKSPFSSPMLLVKKKDDSWRCYIGYHALNVITVKDRFPMPTIDELLDELGEASWFSKLDLRQGFHQIRMVEIDIPKTAFLTHQGHYKYRVMPFGLCNALATFRATMNKVLKPFLCKFNAIFFNDILIYSSSLPYHVQHLEAVFVVLAEAQFHLRQSKCLFARKNLQNLGHIVSTSGVAPEPAKIPAMVDWPTPSSTIALWGFLGLTNFNRRFIRGYA

SEQ ID NO: 131280 - protein, 587 aa, Glycine max
  Coding DNA Sequence Number=SeqID_14502
  Gene Ontology: Mol. function=ATP-dependent helicase activity; Cellular component=nucleus; Biological process=mRNA catabolic process, nonsense-mediated decay
  Homolog annotation: Hit_ID=Q1RUZ0; Match level="QueryCoverage=99%, HitCoverage=99%, E-value=0.0, Identity=90%"; Hit description =DEAD/DEAH box helicase, putative
  Pfam annotation: Domain name=DEAD; Domain location=166-346; Score =206.9; E_value=4.6e-59; Accession=PF00270.19; Description=DEADDEAH box helicase
  Pfam annotation: Domain name=Helicase_C; Domain location=412-488; Score=129.4; E_value=1e-35; Accession=PF00271.21; Description =Helicase conserved C-terminal domain
  Pfam annotation: Domain name=ResIII; Domain location=162-341; Score= -37.9; E_value=0.069; Accession=PF04851.6; Description=Type III restriction enzyme, res subunit
  Pfam annotation: Domain name=zf-CCHC; Domain location=544-561; Score =23.9; E_value=0.00011; Accession=PF00098.13; Description=Zinc knuckle
  Pfam module annotation: Pfam domain module=DEAD::Helicase _C::ResIII::zf-CCHC; Domain location=166-346::412-488::162-341::544 -561
MEEDDYVEYVPVAKRRALEAQKILQRKGKASAVTDDDLEKQRVAETKPSLLVKASQLKREQPEISVTEQIVQQEKEMIENLSDRKTLMSVRELAKGITYTEPLPTGWKPPLHVRRMSKKECDLIRKQWHIIVDGGDIPPPIKNFKDMRFPEPVLKKLKAKGIVQPTPIQVQGLPVILSGRDMIGIAFTGSGKTLVFVLPMIMMAMQEEIMMPIVPGEGPFGLIICPSRELARQTYEVIEQFLIPLKEAGYPELRPLLCIGGVDMRSQLDIVKKGVHIVVATPGRLKDMLAKKKMNLDNCRYLTLDEADRLVDLGFEDDIREVFDHFKAQRQTLLFSATMPTKIQNFARSALVKPIIVNVGRAGAANLDVIQEVEYVKQEAKIVYLLECLQKTPPPVLIFCENKADVDDIHEYLLLKGVEAVAIHGGKDQEEREYAIAAFKAGKKDVLVATDVASKGLDFPDIQHVINYDMPAEIENYVHRIGRTGRCGKTGIATTFINKNQSETTLLDLKHLLQEAKQRIPPVLAELNDPMEDNEEITDISGVKGCAYCGGLGHRIRDCPKLEHQKSMAIANNRKDYFGSGGYRGEI

SEQ ID NO: 131281 - protein, 814 aa, Glycine max
  Coding DNA Sequence Number=SeqID_14503
  Gene Ontology: Mol. function=DNA binding; Cellular component=nucleus
  Homolog annotation: Hit_ID=Q1SBB2; Match level="QueryCoverage=91%, HitCoverage=97%, E-value=0.0, Identity=51%"; Hit description =Homeodomain-like
MDSFKNLIVVKIIEINGQEILVPSISVMLCKINGQMELIQENFNDDFMDHASNSPPNSSYISGLVGAPQLDPRVGLEYQVEVPSIIKQSEQLQLLMNPAESEVGHDNSLSFAIGLPISVTWIHNEVENSGHEGWGYLRDNRKELKPITSQSVMTGDNNSSQLGKSKTYALVPGTLSNSWSDTDAKSFLLGLYIFRKNFVQIKRFLENKGIGEILAFYYGKFYKSDEYRRWSDCRKIKGRKSTIGQKLFTGRRLHELLSRLIPHVSEESKDILLQVSKSYMEGRASLEEYISSLKSTVGLGVLVEAVGIGKEKEDLTCLAVEPGKNNWVFSAPTCKAWSSLGPSDIMKFLTGFRLSKAKSKDLFWEAVWPRLLARGWHSEQPKNQGYVSSKDYLVFLVPGVEEFSRTKLVKGDHYFDSVCDILSKVVAEPNLLDLEEAKVDICNDEEPERGLNKDDQSDYHPQTYLKPRSSTYNTDHIKFTVIDTSLVHGRKSSDLREFKSVPVNSVGNVEVNAAGTHKGAKYIKDMPENIDQKLTDTSMLCEGKLLPARELKYLPVEVENTSKMEANMLIYDKNNISNADSQNNAKKMEESLENQKTSVSNDNQLKSAIKQRFSPRVRPGYSKHPILPFKKRRLTACAKAETSQIIGNSSGDLGSEKMTFSQENVDDPVSCQKSGASAEKSVEENNEESILNEVCQCTSVSDDKVEKSESQSSVTFKIPQVALNSEDGERATVEEDGQCLKANDQCLSSDAQAVVEQPPRTSGDVGSMENQPNMNSRRQSTRNRSLSLRALESLANEFTLGERRQKRKNIQTQR

SEQ ID NO: 131282 - protein, 65 aa, Glycine max
  Coding DNA Sequence Number=SeqID_14504
MVVHDEPEGEDGGIGGEVWCEGRDRDDVKLGVADKLGDDENVEGGAVREIRNDERGGGEEGGEWG

SEQ ID NO: 131283 - protein, 302 aa, Glycine max
  Coding DNA Sequence Number=SeqID_14505
  Gene Ontology: Mol. function=isomerase activity; Cellular component =periplasmic space; Biological process=carbohydrate metabolic process
  Homolog annotation: Hit_ID=Q1SCH9; Match level="QueryCoverage=85%, HitCoverage=82%, E-value=1e-98, Identity=59%"; Hit description=Non -cell-autonomous protein pathway1
  Pfam annotation: Domain name=Aldose_epim; Domain location=32-302; Score=251.5; E_value=1.8e-72; Accession=PF01263.10; Description =Aldose 1-epimerase
MVFYVMFKVYRVSSFLLWLLLLAQAHGNDKIGFYQLKRGNLHLNLTNYGASVISVFVPDKHGNLGDITLGYDDIEQYKNDSWYFGATIGRVANRIGHAQFTLDGHTYKLPANDHGNTLHGGFTGFSDVVWTVKSHKEDDHVTFTYDSYDHEQGFPGRLEVSVTYMVIGTNKYSVKMIAKPIDKATPVNLAHHTYWNLKGHNGGDILSHELQIFGSKITPVDKKLIPTGKFESVKGTPYDFLEPREVGSRINDLPGLYDMNYVLDASSPNHFRPVLILREKVSGRKLELWSNQIGLQFYTVAC

SEQ ID NO: 131284 - protein, 141 aa, Glycine max
  Coding DNA Sequence Number=SeqID_14506
MRTSDEIGRTATNKTSNTEHGTTKSSNTSRDHQWKMQKGPHRKQQQPTKTKETKHRRKKAQAKSSLHLPEEAFSGNIPDDVLPEGVSEYFRKSQINLSEKGSSGMFPEKGSSGMFPEKASSGFRFTEGQFRHFTVCWVPQQ

SEQ ID NO: 131285 - protein, 140 aa, Glycine max
  Coding DNA Sequence Number=SeqID_14507
  Gene Ontology: Mol. function=protein phosphatase type 2C activity
  Homolog annotation: Hit_ID=Q9ZSQ7; Match level="QueryCoverage=65%, HitCoverage=24%, E-value=1e-12, Identity=45%"; Hit description =Protein phosphatase 2C homolog
MTMDSQTISKMKTWIEREFSQQANIAGAIGAAVAVVDADEGAEAAGLDLALDLEDLVGLDDGHGEIAGSELSDVAKPEEVLLAFSSGGGGDITDVITVPKQLPTACDKAHECMEHPISLRNPNPRLPNTGNLFFPMVARI

SEQ ID NO: 131286 - protein, 343 aa, Glycine max
  Coding DNA Sequence Number=SeqID_14508
  Gene Ontology: Mol. function=kinase activity; Cellular component =nucleus; Biological process=cholesterol homeostasis
  Homolog annotation: Hit_ID=Q84PE0; Match level="QueryCoverage=99%, HitCoverage=84%, E-value=1e-154, Identity=71%"; Hit description=AKIN betagamma
  Pfam annotation: Domain name=CBS; Domain location=205-342; Score =49.0; E_value=1.5e-11; Accession=PF00571.18; Description=CBS domain
YKFNVDGEWRHDEQQPFVNGSCGVVNTIYIVREPDILPSILNTETPGRSHMEVDNMEANPRMTVSDLEVSRHRISVFLSTHTSYDLLPESGKVIALDINLPVKQAFHVLYEQGISMAPLWDFCRSQFVGVLSAMDFILILKEAGPHECLKDVALKVLQNKVSSVPIIHSSSEDGSHPQLLHLASLSGILKVASIPLGTWMPRVGEPNGRPLAMLMPSASLGAALSMFVQAKVSSIPIVDNNDSLLDIYSRSDITALAKDKAYARISLDEISIHQALLLGQDATSPYGLYNGHRCHMCLRSDSLYKVMERLANPGVRRLVAVEAGSKRVEGIISLSDVFRFLLG

SEQ ID NO: 131287 - protein, 41 aa, Glycine max
  Coding DNA Sequence Number=SeqID_14509
MVVVVMMIVVTTNGGGRWGWQQQLTGGIVGDCDSGSNMWVF

SEQ ID NO: 131288 - protein, 221 aa, Glycine max
  Coding DNA Sequence Number=SeqID_14510
  Gene Ontology: Mol. function=DNA binding; Cellular component=nucleus; Biological process=regulation of transcription, DNA-dependent
  Homolog annotation: Hit_ID=Q10G93; Match level="QueryCoverage=77%, HitCoverage=14%, E-value=2e-16, Identity=37%"; Hit description=DIRP family protein, expressed
EESDSERERNDVPGSRQPMKRKCGKIQLSISNDSVQSQSIASKDGCLSLLKKRQFDGIPPWPVAKRTPRFPVNDSKPDDRENYVLPNKRNPKSMFDANDDEAAHVVTMASTEAAQRGVSPRESQNPYKKSKQEFSLVQSGQIMHQESETVPAKFYDASIDEEYLKDKSSSMDALLTLADMCLLVSTSTMESGKKGVFGIGDIPSNNPVYTILRAFVSSIQE

SEQ ID NO: 131289 - protein, 62 aa, Glycine max
  Coding DNA Sequence Number=SeqID_14511
MHWSSKSCFSGQRGMKVDDGDLPKHADARQDGKTKLLQKITYHMHFSPVTIFPKSMLYDNIS

SEQ ID NO: 131290 - protein, 415 aa, Glycine max
  Coding DNA Sequence Number=SeqID_14512
  Gene Ontology: Mol. function=DNA binding; Cellular component=nucleus; Biological process=regulation of transcription, DNA-dependent
  Homolog annotation: Hit_ID=Q10G93; Match level="QueryCoverage=99%, HitCoverage=47%, E-value=7e-64, Identity=38%"; Hit description=DIRP family protein, expressed
  Pfam annotation: Domain name=DIRP; Domain location=114-215; Score =196.8; E_value=5.1e-56; Accession=PF06584.3; Description=DIRP
MAHKKDEKSVLPEGKSTRQNRDKIKLQGLKQKVDHAVPGVGSSTKHRSRRKTILQRPFTPKEKSSEKILKSKQNKNLTPVHGGALNILVGTYQEKLSGCLSSYMVRRWCMFEWFYSAIDYPWFSKREFMEYLNHVDLGRIPRLTRVEWSVIRSSLGKPRRFSERFLHGERQKLEQYRESVRKYYDELRTGIRDGLPTDLSKPLCVGQRVIAFHSKKTREIHDGSVLTVDHDNYRVQFDRPELGVDSVMVFNALCYSRKHNTEHIRNSPPPQMNPKASFDNHDSLPNTMDGSLVQELGSAVEIIKGSKLRAHAMVDAAFQALSSTKEGEDALTRIEQALDCADNQQLATNSRLPVIRSQGQISGSFDYHNRSISHPSKPLLNNASGRKLHNDSDKVNTQILLDLITSCVATGITIQ

SEQ ID NO: 131291 - protein, 181 aa, Glycine max
  Coding DNA Sequence Number=SeqID_14513
HLTETCMRAGNSDIYGFLEPQSIQRSGQSQFESESYIKSWMQNSQRDVYLGAYLNGFHCSGHWQMVVILPKEHLVVWFCSLHNKPDNYLKGIINSAIKGLDDAPQPKSKAPARWIVVKCNRQKGTIECSNYVMHWMSTIILGSFRNNWEAYFNDPRPLEPERLKALRIQWAQFYLRVRDQA

SEQ ID NO: 131292 - protein, 130 aa, Glycine max
  Coding DNA Sequence Number=SeqID_14514
  Gene Ontology: Mol. function=DNA binding; Cellular component=nucleus; Biological process=regulation of transcription, DNA-dependent
  Homolog annotation: Hit_ID=Q6A332; Match level="QueryCoverage=87%, HitCoverage=10%, E-value=1e-29, Identity=57%"; Hit description =Always early protein 3
  Pfam annotation: Domain name=Myb_DNA-binding; Domain location=43-88; Score=24.7; E_value=0.00032; Accession=PF00249.21; Description=Myb -like DNA-binding domain
MAPTKKPRTMKNKRFSSEVSTKKDEVGSSKNKQRKKNMSDELGPKWKAGELNQFYEAYRKHGKDWTKVAEIVSSRSAKMVEALYNISKAYLSLPKESASAVGLIAMITDHYSMVVWSKIKICRFVMIVVV

SEQ ID NO: 131293 - protein, 85 aa, Glycine max
  Coding DNA Sequence Number=SeqID_14515
SRLFRFFRRFPQINVGGDSARIPFVEHASRESRVTLPPKEKAECFGLFLLCGAGYRQSRTGIRKEETPKMGLPLPTVTYLADNSS

SEQ ID NO: 131294 - protein, 546 aa, Glycine max
  Coding DNA Sequence Number=SeqID_14516
  Subcellular localization annotation: CTP_CleavageSite=84; ConfidenceScore=5.71e-01
MVYAPSSSTSTIFILSPTMLDPTSSIPPPLLNAGVTTIGVLMSMLPPSSVFPPLAPIAPSRVKSLAILEENGNRHKEAMNRIASLEAKATKWRATLRIMWREECPKVANATVAFAEVVRSNHQLSSWVNNVFAKLVSIRLDRDEVRMSEYEKSEMKLGTYRVEWELRVHVCRSCYGDVTTYSNNEVVRDNLFGESLTVKGMTSVLMCQGRHGGMTLSNVVGDCLVSRVVALTSRRVGFEAPSAWTRVVRATSIKLSKVDILLVLQAKSDVLVQCMCIALAYMSLMEWAYTGDVFQGILLRQCLSSLTPPWSWAVVTPGSSSFERLMVLSHVGEGTFHLRSRAQPPASSLDGESIPITMILPSFVSRGERRSDGGDVSASPVSSFTSVVSVVALHRQVKLANLEDSCKLAVQACGSDDFPFLRATSALERSPFSTPPQQLGYGEDRLFNVLAIDVVAGGLPLMFNLDGEPHFPYNGYFSWRPLVKQVKPVGAIVPPVIPPTGEWGQPAAGVGPTNKIVQVSPNMPSFILAKRKCDGGAGPQEVEGPF

SEQ ID NO: 131295 - protein, 95 aa, Glycine max
  Coding DNA Sequence Number=SeqID_14517
MSIGFTRIGLVSEISRRYTRVTLPRASETIEVDVVEVTPDVPPSVVNKRKRSEEVGGTDQCKKSRAPFSLLALKHANGLVFNSSRPSLLHVTAKP

SEQ ID NO: 131296 - protein, 143 aa, Glycine max
  Coding DNA Sequence Number=SeqID_14518
MGEKERPWGKFYRGPIVGAKCTYQNLELSHVRVDMAKVSSKILYVVLRVPFVKRTRGGTYKTKDFDAQYKHYKDVGFGETHQGQILGLMSLWRFDQERICLGFGETHHGWTLGFISLWRFDQERVLPGFGETHQGRTLGLTRL

SEQ ID NO: 131297 - protein, 111 aa, Glycine max
  Coding DNA Sequence Number=SeqID_14519
MANLATIVEQAFNVEVPIQLPPVPPPDLVCIELSTTGTTATMVTTSKTIGPSRTRLRNLYKKGYLAQEKTKDKIEGEIEWRIEEDRGLTNKDVGFPMEEYPTSPKSVISMP

SEQ ID NO: 131298 - protein, 169 aa, Glycine max
  Coding DNA Sequence Number=SeqID_14520
  Homolog annotation: Hit_ID=Q1L6W5; Match level="QueryCoverage=55%, HitCoverage=9%, E-value=2e-21, Identity=54%"; Hit description=RNA polymerase IV second largest subunit
MEALMVSRRNHMFVIIKKGENVNVCIHDIDDAKEESNKVASKDKHLLQDLYKIASTNKPIPLKIIEATRSNRKLLQTFITQEQLHLKRLWVMNSPGWMIAYKSQMKGNRMVIKLLGNSKGEEVENGDMYLVVYFLSVEVPVWVLFFALDVSSDKEIVDLIGCGNDDVRI

SEQ ID NO: 131299 - protein, 94 aa, Glycine max
  Coding DNA Sequence Number=SeqID_14521
  Gene Ontology: Mol. function=oxidoreductase activity
  Homolog annotation: Hit_ID=Q338B1; Match level="QueryCoverage=55%, HitCoverage=15%, E-value=2e-14, Identity=67%"; Hit description=Auxin- induced protein PCNT115, putative, expressed
MEVSQSATPSRREWRWWEEEAEDGEGDPKKKSTMKLKEQKEMADIPRLKLGSQGLEVSKLGFGCMGLTGVYNDPVLEEVGISLIKYAFSKGITC

SEQ ID NO: 131300 - protein, 256 aa, Glycine max
  Coding DNA Sequence Number=SeqID_14522
  Gene Ontology: Biological process=cell wall catabolic process
  Homolog annotation: Hit_ID=Q7W0R5; Match level="QueryCoverage=47%, HitCoverage=33%, E-value=1e-38, Identity=64%"; Hit description =Putative peptidoglycan binding protein
MSFDRAVGRQRELGAVGQFQRHETIGRGHDLAAFAHARAGFERLSVDVRLATDMHHARVGGAFGDHRQRDAQLQADGQALGRGDAVERLQRTPVGLIARVGGSDVDQRVALAHAIDEIVSQRASGLAMRGSGEQQAGKQGWQRKHAAAAHDFQISRRTQQLQPVAERVGRTQAHAMFRAQLELLPDVRQVGVERAGGGWNLAIPDAFCQHIARHEPAQVAKEQQRELELLGRQRDLRAIERDRARSAVDAIAGDVE

SEQ ID NO: 131301 - protein, 60 aa, Glycine max
  Coding DNA Sequence Number=SeqID_14523
MEDRVTTDQSSPLPDAGPAENVAARQPSLRPMLCSEAMGHATLPPFSCNLCPNVRPPSAR

SEQ ID NO: 131302 - protein, 92 aa, Glycine max
  Coding DNA Sequence Number=SeqID_14524
  Subcellular localization annotation: CTP_CleavageSite=59; ConfidenceScore=5.02e-01
MAPGIMKIRRPTKIKKLISKTMRVMVPVLGRLRAEMALFTRGGSCKSPAGRWQHLVTTRPGAGGRSVRHRLCRGVIDDDRKPHTFTNRTNPL

SEQ ID NO: 131303 - protein, 288 aa, Glycine max
  Coding DNA Sequence Number=SeqID_14525
  Gene Ontology: Mol. function=cation transporter activity; Cellular component=integral to membrane; Biological process=cation transport
  Homolog annotation: Hit_ID=Q668D5; Match level="QueryCoverage=98%, HitCoverage=57%, E-value=2e-66, Identity=47%"; Hit description =Putative divalent cation (Mg++/Co++/Ni++) transport protein
  Pfam annotation: Domain name=CBS; Domain location=164-281; Score =61.2; E_value=3.5e-15; Accession=PF00571.18; Description=CBS domain
  Pfam annotation: Domain name=MgtE_N; Domain location=34-162; Score =87.3; E_value=4.8e-23; Accession=PF03448.7; Description=MgtE intracellular domain
  Pfam module annotation: Pfam domain module=CBS::MgtE_N; Domain location=164-281::34-162
MSASHAQQLSETRQRILHLLLSEHDLVDVLLDKSVDLNAAELRKITGWRQQLEHELPQLHAADLADILEALPEEERLALWRLVPYEQRGRVLVEASETVWASLTEEMTDREILRAIEPLDIDDQVYLARYLPRDLTGRLLTTLDPSLRARLLDVIELDRDRVGQVMDFNILTVRSDVTLATVQRFLRKRKSMPDGTDKIFITDEHNQLLGELALTDILLNKPKTLVAEVMNARPTTFQLDDKAEEAASAFERYNLISAAVTDAKGKLIGRITVEDVIDLVNEENESNI

SEQ ID NO: 131304 - protein, 585 aa, Glycine max
  Coding DNA Sequence Number=SeqID_14526
  Gene Ontology: Mol. function=zinc ion binding; Cellular component =intracellular
  Homolog annotation: Hit_ID=Q1SBC2; Match level="QueryCoverage=99%, HitCoverage=75%, E-value=0.0, Identity=52%"; Hit description=Zinc finger, RanBP2-type
  Pfam annotation: Domain name=zf-RanBP; Domain location=154-183; Score= 45.9; E_value=1.3e-10; Accession=PF00641.9; Description=Zn-finger in Ran binding protein and others
  Pfam annotation: Domain name=zf-RanBP; Domain location=187-216; Score= 30.1; E_value=7.8e-06; Accession=PF00641.9; Description=Zn-finger in Ran binding protein and others
  Pfam module annotation: Pfam domain module=zf-RanBP::zf-RanBP; Domain location=154-183::187-216
MIDFRSLSRKDIQVLVGYGCPTVDRKVVFSAKLLRKHVHLDEGDVCSSCSLRSNCERGYLLTNKEDEARTLDVMRLLLTFGFDPVDGSVINKSLLKQKSVKTVVRKLLHEVVKLSSVPIDPNLPPPVIKKPPPKVKQPPPPPKRRVGRDDVEMKRGDWLCPKCEFMNFAKNTVCLQCDAKRPKRQLLPGEWECPKCNFLNYRRNMVCFHCECKRPPDEFLENKMQDRIQNSKPKLDKKGSRQEVSNAWNFDFDDNESDGADVAAFEYADTHAIDENSDNHAQRGNDRGWEDDFEKNNRVQGSPDGEYANPGLYRSRTGFDDFEDEDDIDSYELETAQNSMFSPDQFARIRLSLGPKDDELDFGTDEQLSVVSNFKYGHVSASDRKRKGRGPSKKLSFGSESEEDMGGGLYSDEDGDLNEEYSFRKNKGNKDTILEEGTLPKTGSQDLLVVAEQICSVMILMDHPSSLIGTVGGLREMTVIGRVLKILMDRLGNHMVMAEGPEETTVMDHPGSLMGMVGGLEEMTAIGRDLKILMDHLNDHIVMVEGPVEATAMDHPGSLMGMIEDLKEMTVDGRDLKTGRIAQDG

SEQ ID NO: 131305 - protein, 553 aa, Glycine max
  Coding DNA Sequence Number=SeqID_14527
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=Q1SBC4; Match level="QueryCoverage=99%, HitCoverage=57%, E-value=0.0, Identity=85%"; Hit description=DNA -directed DNA polymerase B
  Pfam annotation: Domain name=DNA_pol_B; Domain location=2-425; Score =276.8; E_value=4.2e-80; Accession=PF00136.12; Description=DNA polymerase family B
MECLPLVMEPESGFYSDPVVVLDFQSLYPSMIIAYNLCFCTCLGKVVASKANTLGVSSFSPEQHVLQDLKDQILLTPNGVMFVPSKVRRGILPRLLEEILTTRIMVKQAIKKLAPPEKVLQRIFNARQLALKLIANVTYGYTAAGFSGRMPCAELADSIVQCGRSTLEKAISFVNLHEKWNAKVIYGDTDSMFVLLRGCTVKESFQIGSEIASAITAMNPSPVTLKMEKVYHPCFLLTKKRYVGYSYESPDQIEPVFDAKGIETVRRDTCGAVAKIMEQSLRLFFEHQNLLEVKTYLHRQWKRILSGRICLKDFIFAKEVRLGTYSARISSLPPAAIVATKAMTVDPRAEPRYAERIPYVVIHGEPGARLVDMVVDPLEVLAIDSPFRINDLYYINKQIIPALQRVFGLVGADLNHWFSEMPRPTREASAKHTLTTNFHQTRIDYYYLSKHCVLCDRLVQASARLCNQCSENEVAAATAVISKTSKLEQEMQHLVAVCHHCGGGDRLLENGVKCTSISCLVFYERRKVQKELLAATHVAADKDLYPRCTVEWF

SEQ ID NO: 131306 - protein, 209 aa, Glycine max
  Coding DNA Sequence Number=SeqID_14528
MSPPRQKEVIPQQQQAPTADLTRSKTNLDRLEDATTKLTSTQLNFLATQNTIVAKLDDFIQKVSFLETNQHSSSSSTANPTFSSPSPTPYRMKLEVPRFDGSDLLGWIFKINQFFYYHATLDIEYLTIASFYMDGPALAWFHPALANKIIGLPPPFLLSCSISSLSSNIHRKVQALQALMLLQEIALALLQEENSSIHNEHFVVVLFHQ

SEQ ID NO: 131307 - protein, 800 aa, Glycine max
  Coding DNA Sequence Number=SeqID_14529
  Gene Ontology: Mol. function=lipoxygenase activity; Cellular component=cytoplasm; Biological process=electron transport
  Homolog annotation: Hit_ID=Q1SBD0; Match level="QueryCoverage=99%, HitCoverage=92%, E-value=0.0, Identity=79%"; Hit description=Plant lipoxygenase; Lipase/lipooxygenase, PLAT/LH2
  Pfam annotation: Domain name=Lipoxygenase; Domain location=113-784; Score=1545.7; E_value=0; Accession=PF00305.9; Description =Lipoxygenase
  Pfam annotation: Domain name=PLAT; Domain location=2-101; Score =119.8; E_value=7.8e-33; Accession=PF01477.13; Description=PLATLH2 domain
  Pfam module annotation: Pfam domain module=Lipoxygenase::PLAT; Domain location=113-784::2-101
MITNVEGNGMKGKLGKPAYLEDWITTITPLTAGESAFRVAFDWNGDEDIGTPGAFLVRNNHHSEFYLKSLTLENVPGHGVIHFICNSWVYPAHKYKTDRIFFSNKTYLPSETPVPLLKYREEELENLRGDGKGTLQEWDRVYDYAYYNDLGDPDKGAQYARPVLGGSIEYPYPRRGRTGRPPTKSDANSESRLNFAMSLDIYVPRDEKFGHLKLSDFLANALKSIAQIVKPELESLFDSIPEEFDSFEDVFKLYEGGIKVPESILKNIRDKIPAEMLKEILRTDGERFLKFPVPQVIKEDKSAWRTDEEFAREMLAGVNPVIIRCLKEFPPESKLDSKVYGDQTSTIRKKHIESNMDGLTAIRQKKLFILDHHDALIPYLRRINSTSTKTYASRTILFLQNDGTLKPLVIELSLPHPEEDQYGVISKVYTPAEEGVENSIWQLAKAYVAVNDSGYHQLISHWLNTHAVIEPFVIAANRQLSVLHPIYKLLHPHFRDTMNINALARQILINGGGIVEATVFPSKYSMEMSSVIYKNWVFPDQALPTDLIKRGMAVKDSGCPHGLRLLIEDYPYAVDGLEIWFAIKKWVQDYCSFYYKEDDTVKKDSELQSWWKELREEGHGDKKNEPWWPKMQTREDLIEVCTIIIWVASALHASTNFGQYPYAGFLPNRPTISRRFMPEEGTSEYDELVNNPDKVFLKTITAQLQTLIGISLIEILSRHSSDELHLGQRDTPNWTCDVEPLEAFDEFGKKLVEIEERIMALNNDGKHKNRVGPVNMPYTLLFPSSKAGLTGMGIPNSVAI

SEQ ID NO: 131308 - protein, 174 aa, Glycine max
  Coding DNA Sequence Number=SeqID_14530
  Homolog annotation: Hit_ID=Q1SBD5; Match level="QueryCoverage=29%, HitCoverage=7%, E-value=1e-19, Identity=82%"; Hit description =Peptidase M24; Peptidase aspartic, active site
MLAPPRRSWVDVDGEVGIGVDGDPNFRRAPPTRVGVARGGGVDLTGSAWCAKERIGSAHEGMGWVRWVVHECELMITYVPIQCCCIAEFLGSAIATPSAIAAAMGAVSWSPHASGILLPSSTIKLVDLSLLSAAEIDWLNNYHSLVWEKVSPLLDGSARQWLWNNTLPIVHEKI

SEQ ID NO: 131309 - protein, 276 aa, Glycine max
  Coding DNA Sequence Number=SeqID_14531
  Homolog annotation: Hit_ID=Q013P4; Match level="QueryCoverage=62%, HitCoverage=31%, E-value=5e-08, Identity=30%"; Hit description =Chromosome 08 contig 1, DNA sequence
  Pfam annotation: Domain name=DnaJ; Domain location=48-113; Score =41.4; E_value=3e-09; Accession=PF00226.21; Description=DnaJ domain
  Subcellular localization annotation: CTP_CleavageSite=34; ConfidenceScore=5.15e-01
MMGSMSLNLITTPTILPFGSRSFAQFAKKKARASCSLRDDDAPLSIASSYAVLGLDPHCSAADIKAAFRTKVKQFHPDLNRDANARTFSDAMIRRVIQAYRILSNCTPSELIESECLDPFDTPECEAFDLFVNQLLCVGKGFQHVEGNAVLIGSIIMGGQNYNYAACSNSCVERAPHAFTYASSTGTARASSQGHGDDYQVQCAVGQCPRSCIHYVTPSQRILLEELLDSTLEAPYDTSAEADLLYSLITKAKFENNRYQKPKKQPKSSSQHVDWF

SEQ ID NO: 131310 - protein, 662 aa, Glycine max
  Coding DNA Sequence Number=SeqID_14532
  Gene Ontology: Mol. function=protein serine/threonine kinase activity; Cellular component=incipient cellular bud site; Biological process=protein amino acid phosphorylation
  Homolog annotation: Hit_ID=Q40541; Match level="QueryCoverage=99%, HitCoverage=100%, E-value=1e-171, Identity=50%"; Hit description =Protein kinase
  Pfam annotation: Domain name=Pkinase; Domain location=69-332; Score =294.4; E_value=2.1e-85; Accession=PF00069.15; Description=Protein kinase domain
  Pfam annotation: Domain name=Pkinase_Tyr; Domain location=69-332; Score=85.1; E_value=2.2e-22; Accession=PF07714.7; Description =Protein tyrosine kinase
  Pfam module annotation: Pfam domain module=Pkinase::Pkinase_Tyr; Domain location=69-332::69-332
MQDIFGSVRRSLVFRGSPENEEASSLGVGGSLVDKISYCIRSSRVFSKPSPPSPPPPSFPKNAAPPIRWRKGELIGCGAFGQVYVGMNLDSGELLAVKQVLIAASNATKEKAQAHIKELEEEVKLLKDLSHPNIVRYLGTVREEDTLNILLEFVPGGSISSLLGKFGAFPEAVIRTYTKQLLLGLEYLHKNGIMHRDIKVDFYFIDNKGCIKLADFGASKQVVELATISGAKSMKGTPYWMAPEVILQTGHSFSADIWSVGCTVIEMATGKPPWSQQYQQEVAALFHIGTTKSHPPIPDHLSAAAKDFLLKCLQKEPILRSSASELLQHPFVTGEHMNSLPLSSNVTENFEASSPSCAPNDDESFLFRSTVNPLDSGNKQSWGMSNDDDMCVIDDKEDFSQSDAKYKSFMSTNNIESFNPMSDPSDDWGYKFDASPELENRGVSFGTDVSYMPPDQSGDDDKGQKDFSFPGVPSLSEEDDELTESKIKAFLDEKALELKKLQTPLYEEFYNSLNTSCSPNVIESTSEDTACRKYLKLPPKSRSPSWVPISTPSKAVDNSESPGSNGRSSSTVGHVNNHSPQDIPASPLNEWKGLTVDSQQQPSSPSLSFSERQRKWKEELDQELERKREMMRQAGMGGKTSSPKDRALNRQRERTRFASPSK

SEQ ID NO: 131311 - protein, 1133 aa, Glycine max
  Coding DNA Sequence Number=SeqID_14533
  Gene Ontology: Mol. function=DNA-directed DNA polymerase activity; Biological process=nucleobase, nucleoside, nucleotide and nucleic acid metabolic process
  Homolog annotation: Hit_ID=Q1SBC5; Match level="QueryCoverage=88%, HitCoverage=99%, E-value=0.0, Identity=58%"; Hit description =Probable DNA polymerase zeta catalytic subunit F12B7.5 [imported]- Arabidopsis thaliana-related
MSDSQSNSEIFSIRIVTIDYYMAPPIPDADICYSSFHGGKVNEVPVIRVYGPTPAGQKTCLHIHRALPYLYVPCSDIPLQLDSGDAFTYKVAASLEKALKFLILKMWHQIWLQLLQLKGNAGSSRQHAGAVLDKSLQPYESHIPFILQFLVDYNLYGMGHLHLSKMKFRYPIPDTCKKLNTDDQHRKADSDAHACLESKLWMSSTISSEWMWSPPSKSGALSNDEAHCPKRQSICELEGDTSVDEILNQQFKMYSSLSQTCSDVNMVQSLVPIWEEQQKRNGVHEATMPSDPGKPLPEDVMKLLSVGLDFEKKFIELCSEAETSLFCTFSAKELRETDIIGSASPPASLCKNAKLHEEGTDANLEMLTMDEIPSSEMIGTLDIKAAADKEAQNILKWLATSQAAEDINSDDELVYETILTPLLPAATIDKVLEEANIAYENESQKECQDILDSIDDMLELELPNEKPSHSLDHYCPIGASSSSMLPQVDGSNDDEFSSPRDSLAGTSSLVEINSEYTRASEHHVLPNTDTSTLIKDKRNKQWGSLPFSSIDKANNDGEHATLLVTHPFESETGDSAHSNYLNRNEVRNGACFIRNKGRDASDSKEVHKLVNCSLRDLMRRKRSYRVEQADCESGTTKKLLLDRHEEQNACLWQKQLDLKTMQTDEEEMEHQKNCECEVSNHANLVHGKMPLPAGSDCLLQATSRPKDEYFGQHEIEGLEASSVLRNCTNGESALMHGGPGLQKPEKLYLINSIDPSMVCRGENLKVGTTFTKPVASDACTQNPLLDTRSRTASVHTVRASERTPQTDTSASSSVQSSFIDDKVSDKFMDQSSHGSRSFVQHDQMTFCENSVEKNAASDVQVLLSEKVDTQKLGENLLHETIKLTEITTGKNPLADKTLEGTLTLPTTSNTHFHLDEDSSDEMPGDVLDDFLPISARDSQKGMETCNEYVTVKTLTSNGTKSVSTHYQNDGSHLYLLTPNILPPSVGTVHRWLLCNKRGNIPDHTHQETDAEDKDVPKCASETEPPLRPKLYQDSDTENKPPCNGEGQTERVKACLDDSQDISQISDPDRKSSFTPLSQIGFRDPASVGCGQQLTLLSIESCFSHRSNLTATGRFLQNVEETFYPILNLMPSTL

SEQ ID NO: 131312 - protein, 471 aa, Glycine max
  Coding DNA Sequence Number=SeqID_14534
  Gene Ontology: Mol. function=hydrolase activity
  Homolog annotation: Hit_ID=Q1SBD1; Match level="QueryCoverage=97%, HitCoverage=93%, E-value=1e-136, Identity=55%"; Hit description =Epoxide hydrolase
  Subcellular localization annotation: CTP_CleavageSite=81; ConfidenceScore=5.22e-01
MAIITEEPEPEQPTHSRSQISPTKPNNNPFSFWFYFTLSVSLFTLFFVFTSSTLSPQDSKTWFLTLPSPLRHHYSNGRTIKVQTHPDETPLQVFTLQEGPTSSENILIVHGQGLSSYSYRHLAKSLAANGLHVTSLDLPGHGFSDNSVEVSVEGGANGVFGRFWYVYSEIQERGLFWAFDQMVETGQIPYEEIQARMSKRKIRKPIDLGPQEMGKVLGEVIDSMGLAPVHLILHDSALGLSADFVSERAELVRSVTLIDTASSTKGAFPVWALEVPVVREVVVGVSFVFAKVVGLCCSKRVGVADSEGSRALLKGRDGRRAVVNVGKRVNSSFDLAEWGEGLKGVPMQVVWSAGWSEEWSREGHRVASALPQAGFLTHSGGRWAQEDAAVEIAEKISQFVLSLPKSIRKVEQESTPEHVQKMLDEAKSSGHDHHHHQSPDHGHGHDHYGDAHIHGANYMDAYGLGHGHHGW

SEQ ID NO: 131313 - protein, 337 aa, Glycine max
  Coding DNA Sequence Number=SeqID_14535
  Homolog annotation: Hit_ID=Q6K3K4; Match level="QueryCoverage=84%, HitCoverage=70%, E-value=3e-47, Identity=42%"; Hit description =Putative microtubule-binding protein
MVTRSPPKQNKMLAVLNPALIRETLNKVDQCMVRLQELQYTVAGGKKVVSGVSLSPRSTKGYLRTSLRCKQESVRIKHDAPRRFTPGKFPKPTNSGEEWRQMSLPAMLVGETVGEIYKASQFAREIVSAVSRKTATKEPKTPLSQRSNQKVDLENTQLNARRRKEKQIKPVSDTPPPQRARSRINFKISPPKAFDKKNDNKCLPNRACASNRTNKKKNDNKCLPNRACASNRTNKTMLVPKPLFLSTHSSRQQQFCQTKSPVISRNIGTQQKCLIKSPPPSAASKVQVKVKNPSIMFISSSPTRPTTTSLSFLSFSKKNSPQTKRWVRTSSPSRIAT

SEQ ID NO: 131314 - protein, 671 aa, Glycine max
  Coding DNA Sequence Number=SeqID_14536
  Gene Ontology: Mol. function=microtubule motor activity; Cellular component=microtubule associated complex; Biological process =microtubule-based movement
  Homolog annotation: Hit_ID=Q75HV1; Match level="QueryCoverage=55%, HitCoverage=44%, E-value=1e-134, Identity=67%"; Hit description =Putative kinesin-related protein
  Pfam annotation: Domain name=Kinesin; Domain location=17-318; Score =431.0; E_value=1.7e-126; Accession=PF00225.13; Description=Kinesin motor domain
MDQHYLLSILSQLLMGFKSFALILQKSTLNLIMYSDLKITKVHEKLELLDETVFEQTIPIVTSVLDGYNVCIFAYGQTGTGKTFTMEGTPQHRGVNYRTLEELFRISEERNDVIKYELFVSMLEVYNEKIRDLLVENSVEPTKKLEIKQAADGTQEVPGLVEACVYGTDDVWEKLKSGNRARSVGSTSANELSSRSHCLLRVTVLGENLINGQKTRSHLWLVDLAGSERVVKTEAEGERLKESQFINKSLSALGDVISALASKSAHIPYRNSKLTHILQSSLGGDCKTLMFVQISPSAADLTETLCSLNFAARVRGIESGPARKQTDLTELNKYKQMVEKVKHDEKETRKLQDNLQSLQMRLTSRELMCRNLQEKVRDLENQVTGERKMRLKHENILLAAVSAQPSTMWESIASDQKIMKKPPLDPRLPLRRITNILPPPPERRPSYSSSMDEQENVARTTSINAQDLVKPRRGVSIAVRPPPPPSTSQSLQPRRRRVSVATLCPVRTPLCSPTRQSLIRPSCSSSMDGQESVAKTTSINTQDLMKPRRRGVSIAVRPPPPPSTSQARQPRRRRVSVAALCPVRTPLRFPTQQSPKRNQREAQYSRLFAILPEARTSVETASPTLMRSSSKFAGSPRHPRRKPLVWTPLKQKGGLKISSRKSLVIPSRPFY

SEQ ID NO: 131315 - protein, 46 aa, Glycine max
  Coding DNA Sequence Number=SeqID_14537
MEGIMRESIHEGRWALNFHLDFIHERGNKEADEASYIDQIIIFFCT

SEQ ID NO: 131316 - protein, 1204 aa, Glycine max
  Coding DNA Sequence Number=SeqID_14538
  Gene Ontology: Mol. function=heat shock protein binding
  Homolog annotation: Hit_ID=Q84XI2; Match level="QueryCoverage=45%, HitCoverage=57%, E-value=0.0, Identity=72%"; Hit description =Glycosyl hydrolase
  Pfam annotation: Domain name=PPR; Domain location=1021-1055; Score =18.1; E_value=0.031; Accession=PF01535.11; Description=PPR repeat
  Pfam annotation: Domain name=PPR; Domain location=1057-1091; Score =4.0; E_value=2.5; Accession=PF01535.11; Description=PPR repeat
  Pfam annotation: Domain name=PPR; Domain location=1123-1157; Score =4.2; E_value=2.4; Accession=PF01535.11; Description=PPR repeat
  Pfam annotation: Domain name=PPR; Domain location=680-714; Score =26.5; E_value=9.3e-05; Accession=PF01535.11; Description=PPR repeat
  Pfam annotation: Domain name=PPR; Domain location=784-818; Score =41.3; E_value=3.4e-09; Accession=PF01535.11; Description=PPR repeat
  Pfam annotation: Domain name=PPR; Domain location=885-919; Score =28.8; E_value=1.9e-05; Accession=PF01535.11; Description=PPR repeat
  Pfam annotation: Domain name=PPR; Domain location=986-1020; Score =35.5; E_value=1.9e-07; Accession=PF01535.11; Description=PPR repeat
  Pfam module annotation: Pfam domain module=PPR::PPR::PPR::PPR::PPR::PP R::PPR; Domain location=1021-1055::1057-1091::1123-1157::680-714::784- 818::885-919::986-1020
VWQEFWITGDVDGRGVPVSNPNGPLDHDLFLFSARDTVKLLRNHPSLALWVGGNEQVPPDDINAALKNDLRLHPYFESEDENSKPVGDWFPMSTDFSQYLDGTRIYIQGSMWDGFADGKGNFTDGPYEIQNPEDFFKDHFYNYGFNPEVGSVGMPVAATIRATMPSEGWQIPVFKKLPNSYVEEVPNPIWEYHKYIPYSKPTKVHDQIQLYGDAKDLDDFCLKAQLVNYIQYRALLEGWTSRMWSKYTGVLIWKTQNPWTGLRGQFYDHLLDQTAGFYGCRCAAEPVHVQLNLATYLIEVVNTTSEELSNVAIEASVWDLDGTCPYYRVHENFSLLPKKVAPIVKMKYPESKDPKQVYFLLLKLYNMADNRVISRNFYWLHLSGGDYKLLEPYREKKIPLKITSKVSVEESIYNIQVLVTNTSTRSDSTSSTGRLSDGFYGTHSLETLDCGVGIEQETGGSKRIHKCFSGKSDGLKVTEINGPDVGVAFFLHFSVHTSKRDYEEGKDTRILPVHYSDNYFSLVPGETLPINISFDVPQGVTPRVILHGWNYDGASLFPLSWMKSRWKFNAHLPSWMDSLIIPSIMKKPPTSQNPFPATSKSVLNHADLSSLLSVCGRDGNLNLGSSIHARIIKQPPSFDFDSSPRDALFVWNSLLSMYSKCGKLQDAIKLFDHMPVKDTVSWNAIISGFLRNRDCDTGFRFFRQMSESRTVCCLFDKATLTTMLSACDGLEFSSVTKMIHCLVFVGGFEREITVGNALITSYFKCGCFSQGRQVFDEMLERNVVTWTAVISGLAQNEFYEDGLRLFDQMRRGSVSPNSLTYLSALMACSGLQALLEGRKIHGLLWKLGMQSDLCIESALMDLYSKCGSLEEAWEIFESAEELDDVSLTVILVAFMQNGLEEEAIQIFMRMVKLGIEVDPNMVSAILGVFGVGTSLTLGKQIHSLIIKKNFIQNLFVSNGLINMYSKCGDLYDSLQVFHEMTQKNSVSWNSVIAAYARYGDGFRALQFYDDMRVEGIALTDVTFLSLLHACSHAGLVEKGMEFLESMTRDHGLSPRSEHYACVVDMLGRAGLLKEAKKFIEGLPENPGVLVWQALLGACSIHGDSEMGKYAANQLFLATPDSPAPYVLMANIYSSEGKWKERARSIKKMKEMGVAKEVGISWVEIEKKVNSFVVGDKMHPQADAIFWLLSRLLKHLKDEGYVPDK

SEQ ID NO: 131317 - protein, 128 aa, Glycine max
  Coding DNA Sequence Number=SeqID_14539
  Gene Ontology: Mol. function=transferase activity, transferring hexosyl groups; Biological process=carbohydrate biosynthetic process
  Homolog annotation: Hit_ID=Q94HG3; Match level="QueryCoverage=67%, HitCoverage=13%, E-value=9e-12, Identity=41%"; Hit description =Putative glycogenin
MLEVNPKPRPRPRPVWFDVIAKGIINNKNKITVGLVNIDARVDGNILKQLDALHSQVETISIDFDHVDKNFKWEDIFPERIDENGKWGLPKCPNLPMPALQNYGDLNVVMAKVPCGIRDVFGWWLIWL

SEQ ID NO: 131318 - protein, 451 aa, Glycine max
  Coding DNA Sequence Number=SeqID_14540
  Gene Ontology: Mol. function=hydrolase activity, hydrolyzing O -glycosyl compounds; Cellular component=lysosome; Biological process =carbohydrate metabolic process
  Homolog annotation: Hit_ID=Q84XI2; Match level="QueryCoverage=100%, HitCoverage=42%, E-value=1e-173, Identity=66%"; Hit description =Glycosyl hydrolase
  Pfam annotation: Domain name=Glyco_hydro_2; Domain location=263-370; Score=-13.2; E_value=0.018; Accession=PF00703.11; Description =Glycosyl hydrolases family 2, immunoglobulin-like beta-sandwich domain
  Pfam annotation: Domain name=Glyco_hydro_2_N; Domain location=118 -210; Score=-43.6; E_value=0.0036; Accession=PF02837.8; Description =Glycosyl hydrolases family 2, sugar binding domain
  Pfam module annotation: Pfam domain module=Glyco_hydro_2::Glyco_hydro_ 2_N; Domain location=263-370::118-210
MAEQLRKTTLDSGWVAARSTEVQFTGTQLTTTHSPTGPTSPWMEALVPGTVLATLVKNKAVPDPFYGLQNEHIIDIADSGRDYYTFWFFTTFNCKLSNISVPDIAAIAVAESKNFDIAASITIMNLFLKPCQDLNNNLLLNKRWCNEHCDLNFRGINYSADVYLNGHEIILPKGMFRRHSLDVTNILHPDGTNLLAVLVHPPDHPGRIPPEGGQGGDHEIGKDVTTQYVEGWDWMAPIRDRNTGIWDEVSISVTGTMVLPAVPWWDDAYLHTTTELENRSSLTAECSLSVLVTTELEDSICLVEHHLQTQDLTIPANSRVQYTFPELFFSNPNLWWPNGMGKQSLYNVVISIDVKGFGESDSWSHHFGFRKIESHIDDATGGRLFKVNGEPIFIRGGNWILSDGLLRLSKKRYNTDIKFHADMNFNMIRCWGGGLAERPEFYHYCDCYGLL

SEQ ID NO: 131319 - protein, 71 aa, Glycine max
  Coding DNA Sequence Number=SeqID_14541
  Homolog annotation: Hit_ID=Q9AX74; Match level="QueryCoverage=81%, HitCoverage=20%, E-value=2e-10, Identity=54%"; Hit description =Putative integral membrane Yip1 family protein
  Subcellular localization annotation: CTP_CleavageSite=49; ConfidenceScore=5.17e-01
MMSGKYTSIDAQQLQGSVPAVPDSRPATVNFADSNLQTFPPSGAQGKITAASGPPRDADGLCLYPWILFYF

SEQ ID NO: 131320 - protein, 323 aa, Glycine max
  Coding DNA Sequence Number=SeqID_14542
  Homolog annotation: Hit_ID=Q9LUB0; Match level="QueryCoverage=94%, HitCoverage=94%, E-value=8e-59, Identity=43%"; Hit description =Arabidopsis thaliana genomic DNA, chromosome 5, P1 clone:MIF21
  Pfam annotation: Domain name=Rrp15p; Domain location=146-261; Score =94.5; E_value=3.3e-25; Accession=PF07890.2; Description=Rrp15p
MAEEMKMVEPGRGKRKFFKTQGHKKSSKKAKVMPPQHGQKKVKIDKKMKKLFRKRAREYNSDDEEDDEATVPATLEPKSLASITNKRNDKDGIESEDRSEDEGAAGPQKTWNKNATDMNYHSSDDEGEDDDEIQPGITKFTEGCRAFKMAFRNLMKKSVPDDMLGPILSGQRKLVVDKLAEEEAERKVKGEAKKEKQMLAEKGHVKPATYLDSHEKFLISVATKGVVKLFNAVNKAQTAQRGLDPSRTKDAKELGKPSLPAIGTTTKAKESTDRVEDEQPAWAPLRDNYMLTSSKLKDWDKMPDKNVSDDMGKTSEDSSSDED

SEQ ID NO: 131321 - protein, 68 aa, Glycine max
  Coding DNA Sequence Number=SeqID_14543
MPKELQAYCELTEKMNERIVKWRRIARNASLSDGHWKIKIKYSNIILQAVAMTYSYGSDTTIPPSKNS

SEQ ID NO: 131322 - protein, 287 aa, Glycine max
  Coding DNA Sequence Number=SeqID_14544
  Gene Ontology: Mol. function=oxidoreductase activity; Cellular component=integral to membrane; Biological process=potassium ion transport
  Homolog annotation: Hit_ID=Q5PNE8; Match level="QueryCoverage=98%, HitCoverage=85%, E-value=1e-137, Identity=83%"; Hit description =Putative ion-channel protein
  Pfam annotation: Domain name=Aldo_ket_red; Domain location=1-286; Score=179.5; E_value=8.1e-51; Accession=PF00248.11; Description =Aldoketo reductase family
NSRQLLRHAFDLGITHFDLANNYGPPPGSAESNFGRILKEDFLPYRDELIISSKAGYTMWDGPYGDWGSRKYLVASLNQSLKRMGLEYVDIFYHHRPDPETPLEETMRALDHLVRQGKALYVGLSNYPLEQARQAIAILNDLGTPCLIHQPKYSMFERWVEEELLAMLQAEGVGSIAFSPLAGGQLTNRYLNGIPPDSRAASNSRFLLPEQLTDERLEKVRQLDAIAGRRGQKLSQMALAWVLREDKVTSVLIGASKTAQLDDAVGMLSNRQFSAEECAAIDAILAV

SEQ ID NO: 131323 - protein, 256 aa, Glycine max
  Coding DNA Sequence Number=SeqID_14545
  Gene Ontology: Mol. function=oxidoreductase activity; Cellular component=membrane; Biological process=metabolic process
  Homolog annotation: Hit_ID=Q9LLQ6; Match level="QueryCoverage=99%, HitCoverage=99%, E-value=8e-92, Identity=62%"; Hit description=Seed maturation protein PM34
  Pfam annotation: Domain name=adh_short; Domain location=43-207; Score= -35.2; E_value=0.0011; Accession=PF00106.15; Description=short chain dehydrogenase
MASGENQFPPQKQYTQPGKEYLMNPPPQYSSPDYNPSNQLQGKIAVVTGGDSGIGRAVCNLFSLEGATVIFTYVKGQEDRDASDTLEIIKKAKTEDAKDPLAIPVDLGYEENCKRVVDEVINAYGRIDILVNNAAVQYERDSLEEIDDATLERVCSEAREGRKQHYKHDIGERIHGLVSKGIRVNGVAPGPIWTPLQIASLRVEEIVGLGSDTTAMKRAGQPIEVAPSYVFLASNLCSSYITGQVLHPNGGIIVNT

SEQ ID NO: 131324 - protein, 184 aa, Glycine max
  Coding DNA Sequence Number=SeqID_14546
MANVTECSKKSTPRMSNPWPLRIKLTNDRMLWDSIKISSKEFEEFILGQMNESSRKSLESWIPVNILIYDVDNCETYDAKLFKKESFWFDPMPVLGEKPKKGESMKESSSYSLEKARKEFAYSIEPFRQIIRKRGLKYDQEIGLRYCGGQVVVAFEFSGSVARKLKSKISWKELKRGVGGRHNL

SEQ ID NO: 131325 - protein, 547 aa, Glycine max
  Coding DNA Sequence Number=SeqID_14547
  Gene Ontology: Mol. function=methyltransferase activity; Cellular component=intracellular; Biological process=protein amino acid phosphorylation
  Homolog annotation: Hit_ID=Q84KA5; Match level="QueryCoverage=99%, HitCoverage=96%, E-value=1e-179, Identity=55%"; Hit description =Selenium binding protein-like protein
  Pfam annotation: Domain name=PPR; Domain location=155-189; Score =42.3; E_value=1.6e-09; Accession=PF01535.11; Description=PPR repeat
  Pfam annotation: Domain name=PPR; Domain location=263-297; Score =39.5; E_value=1.1e-08; Accession=PF01535.11; Description=PPR repeat
  Pfam annotation: Domain name=PPR; Domain location=364-398; Score =32.3; E_value=1.7e-06; Accession=PF01535.11; Description=PPR repeat
  Pfam annotation: Domain name=PPR; Domain location=400-434; Score=9.6; E_value=0.54; Accession=PF01535.11; Description=PPR repeat
  Pfam annotation: Domain name=PPR; Domain location=436-470; Score =11.6; E_value=0.32; Accession=PF01535.11; Description=PPR repeat
  Pfam annotation: Domain name=PPR; Domain location=502-536; Score=1.0; E_value=5.7; Accession=PF01535.11; Description=PPR repeat
  Pfam annotation: Domain name=PPR; Domain location=54-88; Score=34.7; E_value=3.3e-07; Accession=PF01535.11; Description=PPR repeat
  Pfam module annotation: Pfam domain module=PPR::PPR::PPR::PPR::PPR::PP R::PPR; Domain location=155-189::263-297::364-398::400-434::436 -470::502-536::54-88
MRELKKLHGLIVTTPTIKSIIPLSKLIDFCVDSEFGDINYADLVLRQIHNPSVYIWNSMIRGFVNSHNPRMSMLLYRQMIENGYSPDHFTFPFVLKACCVIADQDCGKCIHSCIVKSGFEADAYTATGLLHMYVSCADMKSGLKVFDNIPKWNVVAWTCLIAGYVKNNQPYEALKVFEDMSHWNVEPNEITMVNALIACAHSRDIDTGRWVHQRIRKAGYDPFMSTSNSNIILATAILEMYAKCGRLKIARDLFNKMPQRNIVSWNSMINAYNQYERHQEALDLFFDMWTSGVYPDKATFLSVLSVCAHQCALALGQTVHAYLLKTGIATDISLATALLDMYAKTGELGNAQKIFSSLQKKDVVMWTSMINGLAMHGHGNEALSMFQTMQEDSSLVPDHITYIGVLFACSHVGLVEEAKKHFRLMTEMYGMVPGREHYGCMVDLLSRAGHFREAERLMETMTVQPNIAIWGALLNGCQIHENVCVANQVKVRLKELEPCQSGVHILLSNIYAKAGRWEEVNVTRKVMKHKRITKTIGHSSVEMKLLS

SEQ ID NO: 131326 - protein, 276 aa, Glycine max
  Coding DNA Sequence Number=SeqID_14548
  Gene Ontology: Mol. function=oxidoreductase activity; Cellular component=membrane; Biological process=metabolic process
  Homolog annotation: Hit_ID=Q2HTL8; Match level="QueryCoverage=96%, HitCoverage=97%, E-value=1e-122, Identity=75%"; Hit description =Short-chain dehydrogenase/reductase SDR
  Pfam annotation: Domain name=adh_short; Domain location=44-199; Score= 16.0; E_value=4.9e-07; Accession=PF00106.15; Description=short chain dehydrogenase
MANSSENNFPPQKQDTQPGKEYLMNPPPQYNSSQYKPSNKLQGKIAVVTGGDSGIGRAVCNLFSLEGATVIFTYVKGQEDRDASDTLEIIKKAKTEDAKDPLAIPVDVGYEENCKKVVDEVINAYGRIDILVNNAAEQYESDSLEDIDDARLERHMKEGSSIINTTSVNAYQGDGTLVDYTSTKGAIVGFTRALALQLVSKGIRVNGVAPGPIWTPLIVATMNEETIVRFGSDVPMKRAGQPIEVAPSYVFLASNICSSYITGQVLHPNGGIIVNA

SEQ ID NO: 131327 - protein, 404 aa, Glycine max
  Coding DNA Sequence Number=SeqID_14549
  Gene Ontology: Mol. function=phosphotransferase activity, alcohol group as acceptor; Cellular component=cytoplasm; Biological process =isoprenoid biosynthetic process
  Homolog annotation: Hit_ID=Q2HTL9; Match level="QueryCoverage=85%, HitCoverage=89%, E-value=1e-150, Identity=79%"; Hit description =Mevalonate kinase/phosphomevalonate kinase
  Pfam annotation: Domain name=GHMP_kinases_C; Domain location=285-365; Score=20.8; E_value=0.0051; Accession=PF08544.3; Description=GHMP kinases C terminal
  Pfam annotation: Domain name=GHMP_kinases_N; Domain location=131-212; Score=73.7; E_value=6e-19; Accession=PF00288.16; Description=GHMP kinases N terminal domain
  Pfam module annotation: Pfam domain module=GHMP_kinases_C::GHMP _kinases_N; Domain location=285-365::131-212
MEVKSRAPGKIILTGEHAVVHGSTAVASSIDLYTYVSLHFSTPSDNEDSLKLKLQETALEFSWPITRIRAAFPESTAQLSSTPNSCSVENAKAIAALVEELNIPEAKLGLASGVSAFLWLYSSIQGFKPATVVVTSELPLGSGLGSSASFCVALAAALLAYTDSVSLDLKHQGWLSFGEKDLELVNKWAFEGEKIIHGKPSGIDNTVSAYGNIISFKSGNLTHMKSSVPLKMLITNTKVGRNTKALVAGVGERMLRHPDIMAFVFSAVDSISNELTSILKSPTPDELSVTEKEEKIEELMEMNQGMLQSMGVSHATIETVLRTTLKYKLASKLTGAGGGGCVLTLLPTSHFRNFKHFPSPSNPLNIGGETKILGKGFLLPYFPSNKTLCQKGCPESSDIYVLPG

SEQ ID NO: 131328 - protein, 224 aa, Glycine max
  Coding DNA Sequence Number=SeqID_14550
MVMGDFISRLSFPENTETFPSLTSYPELRRSEFLMGGYVGARASLLSTTPNFVAMTQELVARGDTLRLFAPFCHPEAAGPMTSRDQVWSFCTHDTRRYFTVSRTLLSSRGGGPDDKQRPKTKFGHSAPMIRGDTLRLSAPFCHPEAAGPMTSRDQVWSFCTHDTRRYLTVIRTLLSSRGGGPDDKQRPKTKFGHSAPMIRGDTLWLFAPFCHPEAAGPMTSRDQ

SEQ ID NO: 131329 - protein, 512 aa, Glycine max
  Coding DNA Sequence Number=SeqID_14551
  Gene Ontology: Mol. function=lithium ion binding; Cellular component =integral to membrane; Biological process=calcium ion transport
  Homolog annotation: Hit_ID=Q2HTM6; Match level="QueryCoverage=79%, HitCoverage=99%, E-value=1e-169, Identity=74%"; Hit description =Sodium/calcium exchanger membrane region
  Pfam annotation: Domain name=MFS_1; Domain location=68-446; Score= -53.8; E_value=0.091; Accession=PF07690.6; Description=Major Facilitator Superfamily
  Pfam annotation: Domain name=Na_Ca_ex; Domain location=364-504; Score= 111.5; E_value=2.5e-30; Accession=PF01699.14; Description =Sodiumcalcium exchanger protein
  Pfam annotation: Domain name=Na_Ca_ex; Domain location=76-207; Score =100.1; E_value=6.6e-27; Accession=PF01699.14; Description =Sodiumcalcium exchanger protein
  Pfam module annotation: Pfam domain module=MFS_1::Na_Ca_ex::Na_Ca_ex; Domain location=68-446::364-504::76-207
  Subcellular localization annotation: CTP_CleavageSite=40; ConfidenceScore=5.36e-01
MAVASSFIIIIIVIIALIFFSLNPPPSPSRRSLLLTTSSSCSNESNGLLNYHCIFPQTSSFSIPSLSLFLLLHFYILITTAQHHFSLVTTKLASHLNLSPSMAAVTLLSLGNGAPDVFSSLAALRAGQYRTGFGAILSAGAFVSALVVGFVAIYAAPFSVDPAPFVRDVLFYLTAAMFLFYVYLSAEIFLWQAVGFVGFYLFFVGFVFYMDLGMADRREKSSEDLEGQKEPDSDDVKVSESSVGEKRASSGLRGAIRLISKTWELPVKTLLRLTIPQPAPSQWSRFYASANIALCPLALLYACNSFMPFNHPIVFLLPNSHVPLWSVVLMTSFSLALFHYVMEKEPPKTEHMPVVIVAFVMSVFWISTTAGELVNCLEAIGVLLELPPALLGLTVLAWGNSVGDLVADVAVAKAGHPAMAMAGCFAGPMFNMLVGLGTALVIQTANIYPRAYQLNFHVGIVIAFVFLLLSLMGSLLVITWCRFRVPRFWGFCLVGIYVAFTAVSLVIAMFSG

SEQ ID NO: 131330 - protein, 957 aa, Glycine max
  Coding DNA Sequence Number=SeqID_14552
  Gene Ontology: Mol. function=snoRNA binding; Cellular component =nucleus; Biological process=ribosome biogenesis and assembly
  Homolog annotation: Hit_ID=Q9LVF2; Match level="QueryCoverage=99%, HitCoverage=98%, E-value=0.0, Identity=60%"; Hit description =Arabidopsis thaliana genomic DNA, chromosome 3, P1 clone: MIL23
  Pfam annotation: Domain name=Utp12; Domain location=714-957; Score =204.5; E_value=2.5e-58; Accession=PF04003.3; Description=Dip2Utp12 Family
  Pfam annotation: Domain name=WD40; Domain location=138-176; Score =37.4; E_value=4.9e-08; Accession=PF00400.22; Description=WD domain, G-beta repeat
  Pfam annotation: Domain name=WD40; Domain location=180-218; Score =30.4; E_value=6.3e-06; Accession=PF00400.22; Description=WD domain, G-beta repeat
  Pfam annotation: Domain name=WD40; Domain location=398-435; Score =25.8; E_value=0.00016; Accession=PF00400.22; Description=WD domain, G-beta repeat
  Pfam annotation: Domain name=WD40; Domain location=479-517; Score =37.2; E_value=5.8e-08; Accession=PF00400.22; Description=WD domain, G-beta repeat
  Pfam annotation: Domain name=WD40; Domain location=533-570; Score =4.7; E_value=10; Accession=PF00400.22; Description=WD domain, G-beta repeat
  Pfam annotation: Domain name=WD40; Domain location=55-92; Score=33.8; E_value=6.2e-07; Accession=PF00400.22; Description=WD domain, G-beta repeat
  Pfam annotation: Domain name=WD40; Domain location=574-612; Score =40.3; E_value=6.8e-09; Accession=PF00400.22; Description=WD domain, G-beta repeat
  Pfam annotation: Domain name=WD40; Domain location=616-654; Score =34.8; E_value=3e-07; Accession=PF00400.22; Description=WD domain, G -beta repeat
  Pfam annotation: Domain name=WD40; Domain location=658-696; Score =41.3; E_value=3.2e-09; Accession=PF00400.22; Description=WD domain, G-beta repeat
  Pfam annotation: Domain name=WD40; Domain location=96-134; Score =46.2; E_value=1.1e-10; Accession=PF00400.22; Description=WD domain, G-beta repeat
  Pfam module annotation: Pfam domain module=Utp12::WD40::WD40::WD40::WD 40::WD40::WD40::WD40::WD40::WD40::WD40; Domain location=714-957::138 -176::180-218::398-435::479-517::533-570::55-92::574-612::616 -654::658-696::96-134
MVKAYLRYEPAASFGVIASVVSNITYDSSGKHLLSPALEKVGVWHVRQGLCTKTLTPSSSSRGPSLAVNSIASSPSSLIASGYGDGSIRIWDSDKGTCETTLNGHKGAVTALRYNKTGSLLASGSKDNDVILWDVVGETGLFRLRGHRDQVTDVVFLSSGKKLVSSSKDKFLRVWDIDTQHCMQIVGGHHSEIWSLDVDLDERYLVTGSADNELRFYSIKHESADGESVNGGEESSIQNKWEVLRHFGEIQRQSKDRVATVQFNKSGSLLACQVAGKTVEIYRILDDAEAKRKAKRRVHRKKEKKHSKEALEGIENVDGNNENKGNDSSVTHGPIETSNPTVTVPDVFKLLHTIRASKKICSISFCPITPKNSLGSLALSLNNNLLEFYSIEQGETKKTLAIDLQGHRSDVRSVTLSSDNTFLMSTSHNAVKIWNPSTGSCLRTIDSGYGLCSLILPTNKYGLVGTKDGTIEIIDIGSGTCVEVMEAHGGSVRSIAALPHKNGFVTGSADHDVKFWEYQIKQKPGQAAKQLIVSNVSTMKMNDDALVVAISPDAKYIAVALLDSTVKVHFADTFKFFLSLYGHKLPVLCMDISSDGDLIVTGSADKNIKIWGLDFGDCHKSIFAHADSVMAVQFVPKTHYVFSVGKDRLVKYWDADKFELLLTLEGHHADIWCLAVSNRGDFIVTGSHDRSIRRWDRTEEQFFIEEEKEKRLEEMFEADIDNAFENKYALKEEIPEEGAVALAGKQTQETLSATDLIIERLDIAEAEEKCIAEHQEKNSRNVAVFQANPLMNGLSPSDYVLSAFSDVHSNDLEQTLLKSISASGVSGMAIGALPFSDALKLLSYLKDWTSYSDKVELVCRIGTLLLQTHYNQLLATPAARPILTVFSDIFYERVKGWKDIFGFNLAAMDHIQQMMASRSDALFHDARSKLLEIRARQSKRLEERSDTGEVKRKKKKT

SEQ ID NO: 131331 - protein, 213 aa, Glycine max
  Coding DNA Sequence Number=SeqID_14553
  Gene Ontology: Cellular component=extracellular region; Biological process=cellulose and pectin-containing cell wall organization and biogenesis
  Homolog annotation: Hit_ID=Q9XGI6; Match level="QueryCoverage=71%, HitCoverage=80%, E-value=1e-50, Identity=50%"; Hit description =Expansin9 precursor
  Pfam annotation: Domain name=DPBB_1; Domain location=42-121; Score =40.6; E_value=5.5e-09; Accession=PF03330.8; Description=Rare lipoprotein A (RlpA)-like double
  Pfam annotation: Domain name=Pollen_allerg_1; Domain location=132 -201; Score=70.4; E_value=5.6e-18; Accession=PF01357.11; Description =Pollen allergen
  Pfam module annotation: Pfam domain module=DPBB_1::Pollen_allerg_1; Domain location=42-121::132-201
RGDQISSPGICPCPSIVAGGVGEAAETESIPGPEDMVATAMARVGRGVTHVPPGKGRRGACGYDDVVKDGYGLDMAALSSVLFNHGDNGGWCNPPRQHFDLAKPAYLKIAQYKAGIVPVQYRRVPCKKQGGIRFTITGNPYFNLVEVWNVGGAGDITKVQVKGDKKLLNWTNLKRNWGEKWETNAMLVGETLTFRVKASDGSFGQTFEGKNFP

SEQ ID NO: 131332 - protein, 407 aa, Glycine max
  Coding DNA Sequence Number=SeqID_14554
  Gene Ontology: Mol. function=chitin binding; Cellular component =extracellular region; Biological process=chitin metabolic process
  Homolog annotation: Hit_ID=UPI000044A8F0; Match level="QueryCoverage =55%, HitCoverage=99%, E-value=3e-28, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRRLHVLAFRGMHVLTFRRLHVLAFRVLHVLTFRRLHVLAFRVLHALAFRGLHFLTFRRLHILAFRGLHVLAFRRLDVLAFTELYVLAIRGLHVLAFRGLHILAFRGLHVLAFRELHVLTFRGLHVLAFRGMHVLPFRGLHVLTFRGLYVLTFRGLHVLAFKGLYVFAFRGLDALAFRELHVLAFTGLHVLAFRGLQVLAFRGLHVLTFRGLQDFARTIAGRQMRIMGTNTWMMLLVSNILPSKYARGSTDFRGHLLFAGIAPPRHPMDPEKSNRTLGFPSLFTGLCRFYRVPISPSKRRVRHHTSLETASSGRQTYRHHLHSPPQLIYKGWSVAYDTWPTDRRPTTGAGTRPLSTKWSRKDTSGEGSSAAQDFDSHQFRSAEHQQRLKAIKGWSFLRDRQV

SEQ ID NO: 131333 - protein, 117 aa, Glycine max
  Coding DNA Sequence Number=SeqID_14555
  Subcellular localization annotation: CTP_CleavageSite=27; ConfidenceScore=5.44e-01
HKTPSGPGGVQQGPGVSSSGYRPLSVLQSARPPPARSRHHHIGITPARHPVGPKKSNSVMGFPTLITSLCQFYGVPISPGKVIRPPINRTFIEKYCAPGRRRARHHSSGQQAHHHHF

SEQ ID NO: 131334 - protein, 63 aa, Glycine max
  Coding DNA Sequence Number=SeqID_14556
MAFAHKFVNFAYGIGLCIHGCHFWMRGQLVKVRANTWFGLYHDDFFVPRWCENVVHHVHGYIE

SEQ ID NO: 131335 - protein, 56 aa, Glycine max
  Coding DNA Sequence Number=SeqID_14557
MSQNFTDYATIPSLTSGMLRDFMDCAIMLPFNSRHVAKLHGLSNDGCQVPRSGQAK

SEQ ID NO: 131336 - protein, 64 aa, Glycine max
  Coding DNA Sequence Number=SeqID_14558
  Subcellular localization annotation: CTP_CleavageSite=30; ConfidenceScore=5.75e-01
LSLAHKWAKRASTTKSSFSVTKESGRASISRSRAKGVIRALSTTVVFSQAQRTTGAKLKFTYLR

SEQ ID NO: 131337 - protein, 454 aa, Glycine max
  Coding DNA Sequence Number=SeqID_14559
  Gene Ontology: Mol. function=hydroxymethylbilane synthase activity; Biological process=tetrapyrrole biosynthetic process
  Homolog annotation: Hit_ID=P06983; Match level="QueryCoverage=48%, HitCoverage=70%, E-value=1e-101, Identity=85%"; Hit description =Porphobilinogen deaminase
  Pfam annotation: Domain name=Porphobil_deam; Domain location=232-429; Score=409.9; E_value=3.7e-120; Accession=PF01379.11; Description =Porphobilinogen deaminase, dipyromethane cofactor binding domain
MLGRTTVFAAEAAAFVMAEAVFVDQEETDLDAERRRPAFKQAAFTLQQLAFFVIQPGLMAYPDIQIGRAALPDGRGTAHRIDAGRDAVRVRQDSGVGFHQACRGKCRGERYRQGNPASAGDDNVVMSAEDCKPAGKRVPWQQARDPRAVVFQQEPSPFVIGVVVMNCWLTNGLKRDQFNTLLIDRKERCATYKCSTVCRVIMPASHINRETNIPKATMLGWLMVDNDGNKHAHYVKERLESCHPGLSVELVPMVTRGDVLLDTPLAKVGGKGLFVKELELAMIEGRADIAVHSMKDVPVEFPEGLGLVTICEREDPRDAFVSNHYASIDALPAGSIVGTSSLRRQCQLAAERPDLVIRSLRGNVGTRLGKLDNGEYDAIILAAAGLKRLKLESRIRQPLSPEQSLPAVGQGAVGIECRLDDEWTKALLAPLNHTETAVRVRAERAMNTRLEGGV

SEQ ID NO: 131338 - protein, 757 aa, Glycine max
  Coding DNA Sequence Number=SeqID_14560
  Gene Ontology: Mol. function=RNA-directed DNA polymerase activity; Cellular component=chromatin; Biological process=chromatin assembly or disassembly
  Pfam annotation: Domain name=RVP_2; Domain location=348-456; Score= -60.3; E_value=0.05; Accession=PF08284.2; Description=Retroviral aspartyl protease
  Pfam module annotation: Pfam domain module=RVP_2::RVT_1::Retrotrans _gag; Domain location=348-456::582-751::112-202
MPEHHTRQVTTEKLEEAIRNLNVGQANLDNKVESIHSLLAAKFDSLAERFAAMAIPHHSPASSPVPPPHTPTHRHHMKLDVPQFDGHDALGWIFKISQFFDYQGIPDQERLTVAAFYMDGSALSWYQWMARNGFFPSWPAMLQALESRFAPSYYDDPQGALFKLQQTGTVSEYLTDFERLANRTIGLPPSCLLSCFVSGLTPELRREVQALRPLSLPQATKLARLQEDKLLDRRRGARAPPFHPTPLPANRTQPPTSKVPIKRLTPEEMATRREQGLCYQCDEKWAHGHRCKSRLHILIADEDPEPSPRPISPAVPSDIELDPTLTPHISLNAMEGTPTPQTFRLLGSLKRHQVVILVDGGSTHNFIQSRVAKFLDLPSTPTPALQVMVGNGHTLDCDNLSRQVPVWIQGHEFTLDLHHLPLCGVDLVLGVQWLKLLGPITTNYQTLTMTFSHLGQPITLNADAPPTPSSASAHQLKRLTQTQSIAALFLLTTTSLQSPPPSSSSPDPIPPVITSVLNRYPHIFAEPTQLPPPRNIQHHIHLLPQASPVNVRPYRYPHYQKTEIERQISAMLEANLIQPSHSPFSSPILLVKKKDASWRCCVDYRALNAVTVKDRFPMPTIDELLDDLGQASCFSKLDLRQGFHQIRMADEDIHKTAFRTHLGHYEFRVMPFGLSNAPSTFQSAMNDTLRPFLRKYVAVFFDDILVYSPDLDTHVSHLDSVLATLSDKQFLLRQSKCLFAQSQLNYLGHICWTLWPQ

SEQ ID NO: 131339 - protein, 176 aa, Glycine max
  Coding DNA Sequence Number=SeqID_14561
  Subcellular localization annotation: CTP_CleavageSite=24; ConfidenceScore=5.50e-01
MADLSSDPFFHAGSSPDSSSGEVRLSNVASSCLQGRRMAMKQFSEDMLVRCSFYQEGRPVCSSESFDTPVVEVDSAVQDESLNLGGHRDACNEKINISKMSESTPLESSVSDSSSLAVTPGSVVWARTDSQVWWPAETKRIHSYKGHPLFQTSLKNLLILHAVHLPPKFFSGKYTG

SEQ ID NO: 131340 - protein, 114 aa, Glycine max
  Coding DNA Sequence Number=SeqID_14562
MEETSVLSNPGNDGHVLVQFYGNLPSAWIDPMTDISTFEDSFEDRSNNPSEDFQKALKQALQRKAQLSSCQKLTPDRSAHYDLQERSSGNPCTMDPRSSLKATISWCAFGMLPQ

SEQ ID NO: 131341 - protein, 62 aa, Glycine max
  Coding DNA Sequence Number=SeqID_14563
MEIHMKVSCYTLGMSFIRDKAGTLQAGADRRSGQLVHGGLGAVGLAVSRNNEMLKKRKEEEN

SEQ ID NO: 131342 - protein, 258 aa, Glycine max
  Coding DNA Sequence Number=SeqID_14564
GGGDCAPYIGECGGGGPLPPAGGGVGGGRSGDRPPGVGGAPYIGGGGGGGPLPIREVGGGGGPPFIGGGGGGGGGAPLNGGRGGGGGGGALDNGGGGGGGGVGGALCNVGGGGGGACLKGGGGGGGGDGGSEALPKGGGGGGGGTGGGAKYIYELAKGGRRGGRDGDGGGGAGGGEALCDANGGGGGGGGGVLSVEAVGNMVVGGGGGGIDGIPCFGRGDANGVRGGMDETSYLGGGIGGGGGGGCESATAVPTTKGL

SEQ ID NO: 131343 - protein, 443 aa, Glycine max
  Coding DNA Sequence Number=SeqID_14565
  Gene Ontology: Mol. function=receptor activity; Cellular component =anchored to membrane; Biological process=protein amino acid phosphorylation
  Homolog annotation: Hit_ID=Q1SBD8; Match level="QueryCoverage=98%, HitCoverage=92%, E-value=1e-106, Identity=44%"; Hit description =Unnamed protein product; contains similarity to elicitor-inducible receptor EIR gene_id:T5M7.12
  Pfam annotation: Domain name=LRR_1; Domain location=112-135; Score =13.6; E_value=0.73; Accession=PF00560.23; Description=Leucine Rich Repeat
  Pfam annotation: Domain name=LRR_1; Domain location=137-159; Score =8.6; E_value=7.1; Accession=PF00560.23; Description=Leucine Rich Repeat
  Pfam annotation: Domain name=LRR_1; Domain location=161-183; Score =11.9; E_value=1.7; Accession=PF00560.23; Description=Leucine Rich Repeat
  Pfam annotation: Domain name=LRR_1; Domain location=185-207; Score =6.5; E_value=18; Accession=PF00560.23; Description=Leucine Rich Repeat
  Pfam annotation: Domain name=LRR_1; Domain location=209-231; Score =14.5; E_value=0.38; Accession=PF00560.23; Description=Leucine Rich Repeat
  Pfam annotation: Domain name=LRR_1; Domain location=233-255; Score =8.8; E_value=6.4; Accession=PF00560.23; Description=Leucine Rich Repeat
  Pfam annotation: Domain name=LRR_1; Domain location=257-280; Score =9.6; E_value=4.6; Accession=PF00560.23; Description=Leucine Rich Repeat
  Pfam annotation: Domain name=LRR_1; Domain location=282-304; Score =9.2; E_value=5.4; Accession=PF00560.23; Description=Leucine Rich Repeat
  Pfam annotation: Domain name=LRR_1; Domain location=306-328; Score =15.6; E_value=0.18; Accession=PF00560.23; Description=Leucine Rich Repeat
  Pfam annotation: Domain name=LRR_1; Domain location=330-351; Score =5.3; E_value=29; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=112 -135::137-159::161-183::185-207::209-231::233-255::257-280::282 -304::306-328::330-351
MKNKEKEAIYSVIQGFVGKWWNGSYLYPDPCGWTPVQGVSCEQYDDGFWYVSTVNFGPVFDNSLVCSHEAQFPQQLFNLKHLKVLSLSTCFHSPTKNPVKLPLSKWDKFSHSLESLTLRSNPGLVGTIPPAIGSLKNLQSLLLLENGLSGELPLSIGNLVKLRQLVLAGNNLEGEVPANYGRLSELLIFDASRNNLSGVFPSTLGLLDSLLKLDFSNNMLEGELPRELGRLKNLTLLDISHNKLRGGLVRTIKELVSLKHLVLSNNPIGGDLLGVKWENFQNLEALDLSNIGLEGSVPKSMAKMKRLRFLDLSNNDLCGSLSRSLEKLPCLTALHVNGNNLTGRLEFSERFYMKMGMRFAAWNNTNLCCMAKPTTHEMPYGVKPCVQKNITISEGVSTVKMSEGNYEDSFVVASLGGSGFYYGLWCLFTVNGVLYVFLWDMLF

SEQ ID NO: 131344 - protein, 63 aa, Glycine max
  Coding DNA Sequence Number=SeqID_14566
MPKELKREIKSPNMVIEKTERELRPQWWGARMTWRCGALKGKGGTAQSDQISTGKGGTMQCDP

SEQ ID NO: 131345 - protein, 386 aa, Glycine max
  Coding DNA Sequence Number=SeqID_14567
  Gene Ontology: Mol. function=prephenate dehydrogenase (NADP+) activity; Cellular component=cytoplasm; Biological process=tyrosine biosynthetic process
  Homolog annotation: Hit_ID=Q1RX89; Match level="QueryCoverage=94%, HitCoverage=96%, E-value=1e-142, Identity=68%"; Hit description =Prephenate dehydrogenase; NADP oxidoreductase, coenzyme F420- dependent
  Pfam annotation: Domain name=F420_oxidored; Domain location=75-228; Score=-51.2; E_value=0.052; Accession=PF03807.7; Description=NADP oxidoreductase coenzyme F420-dependent
  Pfam annotation: Domain name=NAD_binding_2; Domain location=73-203; Score=-76.8; E_value=0.02; Accession=PF03446.5; Description=NAD binding domain of 6-phosphogluconate dehydrogenase
  Pfam annotation: Domain name=PDH; Domain location=78-338; Score= -48.2; E_value=5.8e-06; Accession=PF02153.8; Description=Prephenate dehydrogenase
  Pfam module annotation: Pfam domain module=F420_oxidored::NAD_binding_ 2::PDH; Domain location=75-228::73-203::78-338
  Subcellular localization annotation: CTP_CleavageSite=50; ConfidenceScore=5.51e-01
MAVSTFQAAPPKPTLGSSLLSRRMKHVPFSLSFFSAPKTISSYRPILRIRAIDAAQPFDYESRMAQQFHDSQKLKIAIVGFGNFGQFLAQTLVRQGHTVLAHSRSDHSLAAQQLGVTFFPNPHDLCEEHPEVILLCSSIISTQRVLLTLPLQRLKRSTLFVDVLSVKEFPKNLLLHALPSDFDVLCTHPMFGPQSAPRAWTGLPFVYEKVRIGSDEHRIARCEKFLGIFAREGCRMVEMSCADHDKFAAGSQFITHTVGRVLEMLTVESTPINTKGYESLLNLVENTSGDSFDLFYGLFMYNKNSLEMLERLDFAFEDLRKQLMGRLHDVVREQLFDNAGMGKVQSLPDEYVHQLLLKNGQNGSAAPVLSLPSNDLSITTFDAAVE

SEQ ID NO: 131346 - protein, 78 aa, Glycine max
  Coding DNA Sequence Number=SeqID_14568
MVHSNIANYFNCRVLAINQPPASPLSPMVGVQGSSANMDFSQIDISRLQVPERPPPKIKEVKEKKMKGKINTSNISRS

SEQ ID NO: 131347 - protein, 308 aa, Glycine max
  Coding DNA Sequence Number=SeqID_14569
  Gene Ontology: Mol. function=prephenate dehydrogenase (NADP+) activity; Cellular component=cytoplasm; Biological process=tyrosine biosynthetic process
  Homolog annotation: Hit_ID=Q1RX89; Match level="QueryCoverage=98%, HitCoverage=90%, E-value=1e-148, Identity=76%"; Hit description =Prephenate dehydrogenase; NADP oxidoreductase, coenzyme F420- dependent
  Pfam annotation: Domain name=F420_oxidored; Domain location=25-200; Score=-49.4; E_value=0.04; Accession=PF03807.7; Description=NADP oxidoreductase coenzyme F420-dependent
  Pfam annotation: Domain name=GFO_IDH_MocA; Domain location=24-113; Score=-21.3; E_value=0.083; Accession=PF01408.12; Description =Oxidoreductase family, NAD-binding Rossmann fold
  Pfam annotation: Domain name=PDH; Domain location=28-288; Score= -21.7; E_value=2e-07; Accession=PF02153.8; Description=Prephenate dehydrogenase
  Pfam module annotation: Pfam domain module=F420_oxidored::GFO_IDH _MocA::PDH; Domain location=25-200::24-113::28-288
SSDVVKLYNYKSNDANQSDDKTKLKIAIVGFGNFGQFLAKTFVRHGHQVLAYSRSDYSHVAQELGVSYFNNIDDLCEQHPEVILLCTSILSTEKVLKSLPVQRLKRSTLFVDVLSVKEFPRNLFLHHLPHNFDILCTHPMFGPESGKNGWNGLAFVYDKVRIGIDESRTSRCDQFLDIFASEGCRMVEMSCAEHDWHAAGSQFITHTTGRFLEKLELEGTPIDTKGYETLLSLVENTAGDSFDLYYGLFLYNINAMEQLERFDLAFESVKKELFDRLHGFYRQQVFKHEEKLHDLPERPMLSKISEDK

SEQ ID NO: 131348 - protein, 97 aa, Glycine max
  Coding DNA Sequence Number=SeqID_14570
MQSIHALAQHQPIMSMVEFASQVAWPGVQPSFFGGGEASAAQEPQPEIEADTNVDPEADLEIPETDPTTQEDAAEATPETTPQPSPVTTPVLELSSP

SEQ ID NO: 131349 - protein, 179 aa, Glycine max
  Coding DNA Sequence Number=SeqID_14571
MASGKRKATASHPREPYDTSKFVSEAAWERYAQNIHSRNILLERNVNLFVIEYDEFWRELIRRNWHRALTQYEGGHIDVALVKEFYANLYDPEDKTPRQVRIRGRLVKSDGETLNTFLETPPVIQPGEQYTSYSLFCRLRPNPQEFAARLCILGRGFVLNAEGAPWKLLRKDLTTLAQT

SEQ ID NO: 131350 - protein, 110 aa, Glycine max
  Coding DNA Sequence Number=SeqID_14572
MEGSIKDFGAPESWDVADLDESMNCLNLMLSSNNDSKQPHQCVADDDDAMSPPIPPPLSNGDEVFDYVINQLSIFSLETLLFETLSDTKDSFPTPHSERLDNPFLLKKEV

SEQ ID NO: 131351 - protein, 265 aa, Glycine max
  Coding DNA Sequence Number=SeqID_14573
  Homolog annotation: Hit_ID=Q6CQE5; Match level="QueryCoverage=24%, HitCoverage=77%, E-value=8e-12, Identity=49%"; Hit description =Protein TAR1
MSDSLVRVSRRAEWGAHRPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFSRVRARKGSSMGPELTGSHVIGLRAWLIHHFYHGEVGHEPRFSTNHEAGARGRRALGLMASGATCVQRLDGSRDSAIHTKYRISLRSSSMQEPRYPLPRVIDEEAGRTGRRGHPLPPDGR

SEQ ID NO: 131352 - protein, 400 aa, Glycine max
  Coding DNA Sequence Number=SeqID_14574
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q2RAU3; Match level="QueryCoverage=72%, HitCoverage=85%, E-value=4e-48, Identity=39%"; Hit description =Transcription initiation factor IIE, putative
  Pfam annotation: Domain name=TFIIE_alpha; Domain location=6-170; Score=-39.3; E_value=0.0035; Accession=PF02002.7; Description=TFIIE alpha subunit
MPELDLDCEEEEGGERTEEGIVTCGETRAKGAKIYSAAVAATADGQQTAKEGEEKGEVEMIYDVIRYRLHRMKHKLKDELENKNTLQEYICPNCGKRYNALDALRLVSFEDEDFHCESCNGRLEVESDKIAAQERGDGDDNARRRRREKLKDMLQKMEVQLKPLMDQLSRVKDLPVPEFGSLQAWEARASAAVRAANGDINAGDSKISQPGYNGVPYSGDTKVVVDFNTEGKGEGVKSETDSTSLKVLPPWMITSGMNLTKEQRGEVKQETKMDGTSTSTAAQYTDDKKSTIGHDNNQNIQDEYIKAYYAALLKQQHELEEAAKKQLSNTLAAANPSSSTSIRQVGMKSKREEDDDDTEWEEAPIAGNGNGGYTVDLNVEAEEVAAEDDDDDDDVDWEEG

SEQ ID NO: 131353 - protein, 89 aa, Glycine max
  Coding DNA Sequence Number=SeqID_14575
MGLDQLEQGVSQHHSVDQSRSPLTPARHSGGGDADDDDGGGGGGGGGGGEMGQRELKLVVAYDGLIIVGFGTKPAMKEYQEEEEPKNEA

SEQ ID NO: 131354 - protein, 706 aa, Glycine max
  Coding DNA Sequence Number=SeqID_14576
  Gene Ontology: Mol. function=protein dimerization activity; Cellular component=intracellular; Biological process=transposition, DNA -mediated
  Homolog annotation: Hit_ID=Q1SYN6; Match level="QueryCoverage=84%, HitCoverage=85%, E-value=2e-36, Identity=25%"; Hit description=Zinc finger, BED-type predicted
  Pfam annotation: Domain name=hATC; Domain location=586-666; Score =110.6; E_value=4.4e-30; Accession=PF05699.5; Description=hAT family dimerisation domain
  Pfam annotation: Domain name=zf-BED; Domain location=80-122; Score =24.1; E_value=0.00049; Accession=PF02892.5; Description=BED zinc finger
  Pfam module annotation: Pfam domain module=hATC::zf-BED; Domain location=586-666::80-122
MHMLMLCLLLIRQVTVGDAHYMDWGGSVNHHYRTTYKDDQKSMMEVALISNMDPVNIGLGCSDKPGPVTSLKPRKKTMTSVYLKFFETAADGKTRRCKFCGQSYSIATATGNLGRHLANRHPGYDKSGEAVSNAAARPATVVKKSQPHGKANQVDYDHLNWLLIRWLILASLPPSTLEEKWLVNSYKFLNPSIQLWPSDKYRTVLDEVFRSMREDVRALLEQVSSKLSITLDFWTSFEQVYYMSVTCQWIDENWCFQKLLLDICRIPYPCGGAEIYRSLVKVLKFYNIENRILSCTHDNSTSAMHACHTLKEDLDGQKIGPFCYIPCAARNLNAIIDDGLRSAKQVISKIREFAIELNASPVISEDFIQLSTAYQEGIWKFPLDVSARWSGNYQMIDLVRKAGKSVDAVIRKYEEVLGSRMLLGSSDKSAVSIMHQYLEPFYKTTNNICTSKVPTIGLVLFFMDHISETITSFRESRLSPEWLKNAAEEMAKKARSYINQVCNVFTYMTAILDPRIKGDLVPDSLNSENFLDEARTHFMRNYSTSHFSSMSSGYNAQEIEDGGSFSFAEEIARKKRRISMSFATDELTQYLSEAPAPIPADVLEWWKVNSTRYPRLSVMARDFLAVQATSVVPEELFCGKGDEIDKQRICMPHDSTQAILCIKSWIQVGVKFKFKSTEIDYERLMKLAAAAAATDNSPSSSDKKQK

SEQ ID NO: 131355 - protein, 259 aa, Glycine max
  Coding DNA Sequence Number=SeqID_14577
  Homolog annotation: Hit_ID=UPI00001632AD; Match level="QueryCoverage =42%, HitCoverage=23%, E-value=7e-45, Identity=74%"; Hit description =protein binding / ubiquitin-protein ligase/ zinc ion binding
MEVWDRRALKPSQSVERTVRRERLKKVNNVSEYVIINQSKRKRKRELGKEDELAQGIEFSTGLGCTHFPFVLHSLPRSQARSQSLFFLVAAEYKPTMLVVFHMGTNIIECASFCFNWRWNDGRVLVNKLPKRITRQFKVGPTFRLKLEWVIFLPLWMFHGVVARGRFSLPAPSAPRNRNWAPCHAVVATPLLIAFELLLCIYLESLYDRGYAAVGLKIVFLPLLTFEIIILIDNFRMCKALMPGDGENMSDEAIWETLP

SEQ ID NO: 131356 - protein, 144 aa, Glycine max
  Coding DNA Sequence Number=SeqID_14578
MALKIDISKAFDRTVNYCVVVNRESVGQFSPGREINAPMVFTHSGALTITLWRASLILLIQKLQAKLFWQAAGLRNKLNTSIPNEQITWLPPMTGFVKCNLDAAIFKDSYSYGTDIVIRDSNGIFLKARSSTHNRIPTPTEAEA

SEQ ID NO: 131357 - protein, 179 aa, Glycine max
  Coding DNA Sequence Number=SeqID_14579
MVVENNKDSDLTVRDKKRCISVATKSDVNEEAKSTNPTPKPTLASFNPDLVNSHSHLPTLSTASDEPSPQANLIQPTTSVPLSNPNLTNTNMNTNPPTIISNILSPMMDLFPNSKLSKGIAAKSDHSLILLYLDASKRRIFGRNFIFENSWLLEPGLEEIVHFGWSKPLSNNLISKLNC

SEQ ID NO: 131358 - protein, 356 aa, Glycine max
  Coding DNA Sequence Number=SeqID_14580
  Homolog annotation: Hit_ID=Q1WK55; Match level="QueryCoverage=100%, HitCoverage=97%, E-value=4e-73, Identity=51%"; Hit description=CYC5
  Pfam annotation: Domain name=TCP; Domain location=104-342; Score =173.9; E_value=4.1e-49; Accession=PF03634.4; Description=TCP family transcription factor
  Subcellular localization annotation: CTP_CleavageSite=34; ConfidenceScore=5.15e-01
MYSSNTSLNGNELISYPNQPFCFRPFSFESNPTNSSKEETNSNYALPLPPPPPLLSFFQSPFDENIFQEHHHDFLLLHHSLADSGVLTKNLDVAAEISPIPCPGEGSIAMEHTPRKRSSKRDRHSKINTARGLRDRRMRLSLEVAKRFFGLQDMLGFDKASKTVDWLLNQAKGEIKQLGREKTSVGGAKSASSTSECEGVSSLDEVVVSGGVNEEQERETVPNMKRRTNKVCRKSAFNPIDKESREKARERARERTREKMRTRRVLADASNLNRLSSWNPFETVEDSAGTTHQSQSVNHPSLDVHLPEADQEPSSHNAKEHWGENMAHEDNSLAIMNKWSPTMMFNSLHNSGVLQE

SEQ ID NO: 131359 - protein, 194 aa, Glycine max
  Coding DNA Sequence Number=SeqID_14581
  Gene Ontology: Mol. function=metal ion binding
  Homolog annotation: Hit_ID=UPI00001632AD; Match level="QueryCoverage =86%, HitCoverage=36%, E-value=4e-61, Identity=70%"; Hit description =protein binding / ubiquitin-protein ligase/ zinc ion binding
MNQNLVCFFGFSLCYQILSGTNNVFSNGDVGALGWWDLFINFIIAECFAFLVCTKWSNPVIHRNSREASSSSSTTIGYLDWNSGLVVSTDENQPQGRICSLQDIGGHFMKIPIIVFQVLLCMHLEGTPACAVYIPLPVIFSPLFLLQGAGVLLSASKLGEKLVLLLRSGAGGGIYFRFSSRAHDCLGFLCHGSR

SEQ ID NO: 131360 - protein, 312 aa, Glycine max
  Coding DNA Sequence Number=SeqID_14582
  Gene Ontology: Mol. function=monooxygenase activity; Cellular component=membrane; Biological process=electron transport
  Homolog annotation: Hit_ID=Q1RV12; Match level="QueryCoverage=100%, HitCoverage=64%, E-value=1e-123, Identity=70%"; Hit description=E -class P450, group I
MEVTNLVVLPAVSAFFVLSLHFITKADRLRKHPNLNLPPGRLGCPIVGETLEFLRTMNEGNVLRFIQERVEKYDARVFKTSMFGDPVVVFCGPAGNKFLFSNENKNVQVWWPSSVRKLLRLSLVNKVGDEAKMVRRLLMSFLNAETLRNYLPKMDSIAQRHIDTYWEGKEQVLVYPIVQLYTFELACCLFLSIEDSDHISKLSLKFDEFLKGIIGLPLNIPGTRFHRAMKAADVIRNEIEMILKKRKVDLEEKRASPTQDLLSHMLVTSDPNGRFMTEMEIIDNILLLLFAGHDSSRSVLSLVMKYLGPLPQ

SEQ ID NO: 131361 - protein, 481 aa, Glycine max
  Coding DNA Sequence Number=SeqID_14583
  Gene Ontology: Mol. function=monooxygenase activity; Cellular component=membrane; Biological process=electron transport
  Homolog annotation: Hit_ID=Q1RV12; Match level="QueryCoverage=99%, HitCoverage=99%, E-value=0.0, Identity=72%"; Hit description=E-class P450, group I
  Pfam annotation: Domain name=p450; Domain location=38-475; Score =125.5; E_value=1.5e-34; Accession=PF00067.12; Description=Cytochrome P450
MEVTNLVVLPAVLAFFVLGLYFITKVVRLGKHPNLNLPPGRLGWPIVGETFDFMRTMNEGNVLRFIQERVEKYDARVFKTSMFGDPVVVFCGPAGNKFLFSNENKNVQVWWPSSVRKLLRLSLVNKVGDEAKMVRRLLMSFLNAETLRNYLPKMDSIAQRHIDTYWEGKEQVFVYPIVQLYTFELACCLFLSIEDSDHISKLSLKFDEFLKGMIGFPLNIPGTRFHRAMKAADAIRKEIRMILKKRKVDLEEKRASATQDLLSHMLVTSDPSGRFTTEMEIIDNILLLLFAGHDTSRSVLSLVMKYLGQLPHVFEHVLKEQLEISQGKEAGQLLQLEDVQKMKYSWNVASEVMRLSPPVSGAYREAKEDFTYADYNIPKGWKLHWNTGSSHKDPALFSNPETFDASRFEGAGPTPFSYVPFGGGPRMCLGQEFARLEILVFMHNIVKRFKWDLVIPDEKFKYDPMLEPVEGLAIRLHPSHF

SEQ ID NO: 131362 - protein, 398 aa, Glycine max
  Coding DNA Sequence Number=SeqID_14584
  Homolog annotation: Hit_ID=Q10NT2; Match level="QueryCoverage=99%, HitCoverage=75%, E-value=2e-88, Identity=42%"; Hit description =Expressed protein
  Pfam annotation: Domain name=DUF1630; Domain location=1-364; Score =138.1; E_value=2.3e-38; Accession=PF07792.3; Description=Protein of unknown function (DUF1630)
PLYFDIGKIALELIAAYVSTWPAPVLGKLMDLPIGNALLKENLPPAHSLPKENGVSLDESAAPVAPFLPNNQYIPQGLFHDSDLYGAFHGLLLQLWLFWELLLGEPILIIAPTPPQCSEALHKIPYIVSVGSPPPSSNRVSLSTRSSTGKVSSRPEGLGLQQLSLQKFSPSSLLNAIKLWRDGPLCLMTEHKEAIWTTYSATTKPDTSILNRLIDAGMSPRVEESMITAPLEGSSPYVDPPSLPPFNADEFLAILSARGPRKFILKQMKSNWLDFYRRRAVAEQKQDRLWRHARMKTDIQKLISKMAELEVVDSFSVIERLLLGELLQPGNGGIDSTVTCQKLMGDLQAVFSALTKDMQQLMLSNPQRASLLRGSPELTKLPALALVQAGGASSTSLT

SEQ ID NO: 131363 - protein, 383 aa, Glycine max
  Coding DNA Sequence Number=SeqID_14585
  Gene Ontology: Mol. function=zinc ion binding; Cellular component =intracellular; Biological process=chromatin silencing at silent mating-type cassette
  Homolog annotation: Hit_ID=Q9LS38; Match level="QueryCoverage=80%, HitCoverage=53%, E-value=1e-104, Identity=62%"; Hit description =Genomic DNA, chromosome 3, P1 clone: MYF24
  Pfam annotation: Domain name=Hist_deacetyl; Domain location=1-248; Score=242.1; E_value=1.2e-69; Accession=PF00850.10; Description =Histone deacetylase family
MKVHSLEHIESVEVTSESLSSYFTSDTYANEHSALAARLAAGLCADLASAIVSGRAKNGFALVRPPGHHAGVRQAMGFCLHNNAAVAALAAQAAGARKDVHHGNGTQEIFEQNKSVLYISLHRHEGGKFYPGTGAAEEVGSMGAEGFCVNIPWSQGGVGDNDYIFAFQHVVLPIAAEFNPDLTIVSAGFDAARGDPLGCCDITPSGYAHMTNMLNALSGGKLLVILEGGYNLRSISSSATAVIKVLLGESPGCELENSFPSKAGLQTVLEVLKIQMNFWPALGPIFVNLESQWRMYCFERKRKQIKKRRRVLVPMWRWGRKSLLFHFLNGHHNSRVLCLRCNESEDGDGMEVTGNIDIDITVDIKPPISPPLLLNSYLMLGSI

SEQ ID NO: 131364 - protein, 184 aa, Glycine max
  Coding DNA Sequence Number=SeqID_14586
MSRFNNLMQKKQKKKRKGIALKANSSKEDYKESSCNEEEAENFNLMVKKFGKFLKKSKDKKFSKPSKKFESSNNNFTCFECAWEDNASTSSDSSSDEEVANAWQMADSMDDSSTIEEIEVNSEFEEVLEAFNEMHEEAQRLVLNKKLKSDLKLHITKLGSTQTELDKLKQENENLVSSYKAIGW

SEQ ID NO: 131365 - protein, 92 aa, Glycine max
  Coding DNA Sequence Number=SeqID_14587
MEDRLCAIKGGGNYAFADMAELCLVPDVVIPPKFKVLDFDSSLSEAVVSSALSARLALSQISLTRAKRENGTKHAFERTEEKAKQGSKGPNF

SEQ ID NO: 131366 - protein, 35 aa, Glycine max
  Coding DNA Sequence Number=SeqID_14588
MGSGALETNEEAENSLHKQASQVSDANDAVADPDV

SEQ ID NO: 131367 - protein, 197 aa, Glycine max
  Coding DNA Sequence Number=SeqID_14589
MQVMVQVLRADKHLRCLMGDDNCSLAWGETRGGGNGGGWRGGGGGGRLTGAHIEGGATRGGVLELTMEKKRRLRESRIRATDATPLEPIFLKLLETLIGEQLLVLAGGGGGNVELGGGGSGELGSGGGETKGGGGGDFVLQGDGGGGLTRGGVAITIWRWSNRAMTADNRNKKVIDEEGKGNRCNNTLGSHFQTVLS

SEQ ID NO: 131368 - protein, 140 aa, Glycine max
  Coding DNA Sequence Number=SeqID_14590
  Subcellular localization annotation: CTP_CleavageSite=25; ConfidenceScore=5.57e-01
MGSKGVASVALILLSLNLLFFSMVSSSTPPRVAPPSMCAPVRRPPPPPPRQPPPLPPPLVSPLLFLIKELFKIFVCFLYHLMLMIFFFQEAPSKLAEHQLGEGIGRHLELHPPGKRAIVIAHQAAEMLVGTEDLDHDLHR

SEQ ID NO: 131369 - protein, 110 aa, Glycine max
  Coding DNA Sequence Number=SeqID_14591
  Gene Ontology: Mol. function=nucleoside-triphosphatase activity; Cellular component=nucleus
  Homolog annotation: Hit_ID=Q2PEP9; Match level="QueryCoverage=51%, HitCoverage=18%, E-value=2e-09, Identity=70%"; Hit description =Putative RuvB DNA helicase-like protein
MACIIELREKFPRLPQTAWSGNKTAIAMGMAKSLELETPFAMITASEIFSLQILKTKAPSLSTSRKKPKSSRFKWTVPRHELLSIHMPAYSDSIVKGVSTVMVQTPVGMV

SEQ ID NO: 131370 - protein, 48 aa, Glycine max
  Coding DNA Sequence Number=SeqID_14592
THHLEDKVSFPGRDDDGTISAASTMNEEALAERPRRNISRPRHLDDYV

SEQ ID NO: 131371 - protein, 381 aa, Glycine max
  Coding DNA Sequence Number=SeqID_14593
  Gene Ontology: Mol. function=O-sialoglycoprotein endopeptidase activity; Cellular component=nucleus; Biological process=proteolysis
  Homolog annotation: Hit_ID=Q6K200; Match level="QueryCoverage=95%, HitCoverage=88%, E-value=2e-92, Identity=45%"; Hit description =Putative met-10+ protein
  Pfam annotation: Domain name=Met_10; Domain location=94-379; Score =165.7; E_value=1.2e-46; Accession=PF02475.7; Description=Met-10+ like-protein
MLDESKFEVHFKLWALRIPCQHCKLATRILNGYLLDKPRVKPITEDPTCDKNRYLILSDNVHNQDLSDIPKQKLDELKGLCEIEVVPYSLTLGYSYWSADHVLKQILPTGVEKNYPRIKTIVNKVGTITNEFRVPEFEILAGEHNMITEVKQYGATFRLDYSLVYWNSRLEHEHKRLVSMFQAGETICDMFAGIGPFAIPAAQKGCIVYANDLNPDSIHYLRINAKINKVGDCIYAYNMDARKFISQMMEVPNTEVTLENSHEVPILDTRDNAESNSKNELLTVDTKDLGDSNNSGLEDVNGSTRHTATSVIAGKRSSTSYHEGNGEAHGTDILEGGRRKGSANKRMRGSEISVTKTWEHVDHVIMNLPASAVQFLGFRSI

SEQ ID NO: 131372 - protein, 229 aa, Glycine max
  Coding DNA Sequence Number=SeqID_14594
  Gene Ontology: Mol. function=hydrolase activity; Cellular component =cytosol; Biological process=carbohydrate biosynthetic process
  Homolog annotation: Hit_ID=Q67V42; Match level="QueryCoverage=95%, HitCoverage=88%, E-value=9e-62, Identity=49%"; Hit description=MutT domain protein-like
  Pfam annotation: Domain name=NUDIX; Domain location=59-191; Score =56.2; E_value=1.1e-13; Accession=PF00293.18; Description=NUDIX domain
MAAEDQVQRVNLLTSTDDNYGGVIVELDQHMDSATFVSILRASVSHWKLLGKKGVWIKLPIHLVNLVEALVKVLVVQENSGLFQGTGVWKFPTGVVDQGEDICVAAVREVKEETGVDSEFVEVLAFRQSHNSFFEKSDLFFMCMLRPLSSDIQAQRLEILNAQWMPFEEYAAQPFIQKSELLKYINDTCLAKMGGQYSGFSPVSTSSNFSDQKNYLYLSAGALKSSNSS

SEQ ID NO: 131373 - protein, 39 aa, Glycine max
  Coding DNA Sequence Number=SeqID_14595
MEDSHFMEHLTSCNTCGATSKPMNVANELLERQCKVVYG

SEQ ID NO: 131374 - protein, 653 aa, Glycine max
  Coding DNA Sequence Number=SeqID_14596
  Gene Ontology: Mol. function=identical protein binding; Cellular component=cellulose and pectin-containing cell wall; Biological process=negative regulation of enzyme activity
  Homolog annotation: Hit_ID=Q9FJF3; Match level="QueryCoverage=99%, HitCoverage=95%, E-value=0.0, Identity=51%"; Hit description=Serine protease-like protein
  Pfam annotation: Domain name=PA; Domain location=263-361; Score=87.8; E_value=3.3e-23; Accession=PF02225.12; Description=PA domain
  Pfam annotation: Domain name=Peptidase_S8; Domain location=100-490; Score=-40.0; E_value=0.00012; Accession=PF00082.12; Description =Subtilase family
  Pfam annotation: Domain name=Subtilisin_N; Domain location=4-81; Score=55.9; E_value=1.4e-13; Accession=PF05922.7; Description =Subtilisin N-terminal Region
  Pfam module annotation: Pfam domain module=PA::Peptidase _S8::Subtilisin_N; Domain location=263-361::100-490::4-81
MGSQEHGEEVTDAAFDRVAETHREFVQSYVGSPQKAKEAIIYSYTRHINGFAAMLEEEEAADIAKHPDVVSVFLNKGRKLHTTHSWEFMDLEMNDGVIPSDSLFRKARYGEDTIIANFDTGVWPESPSFSDEGMGPIPSRWKGTCQHDHTGFPCNSAKSNRTLSTARDYEGHGSHTLSTIGGSFVPGANVFGLGNGTAEGGSPRARVATYKVCWPPIDGNECFDADIMAAFDMAIHDGVDVLSLSLGGSAMDYFDDGLSIGAFHANKKGIPLLLNSTMDSTSSTLCMRGTIDPEKARGKILVCLRGVTARVEKSLVALKAGAAGMILCNDELSGNELIADPHLLPASQINYEDGLAVYAYMNSTKNPLGYIDPPKTKLQIKPAPSMAAFSSRGPNIVTPEILKPDVTAPGVNIIAAYSEGVSPTDMNFDKRRVPFITMSGTSMSCPHVAGVVGLLKTLHPDWSPTVIKSALLTTARTRDNTGKPMLDGGNNANATPFAYGSGHIRPNRAMDPGLVYDLTNNDYLNFLCVSGYNQSQIEMFSGAHYRCPDIINILDFNYPTITIPKLYGSVSLTRRVKNVGSPGTYTARLKVPVGLSISVEPNVLKFDNIGEEKSFKLTVEVTRPGVATTFGGITWSDGKHQVRSQIVVGGVRG

SEQ ID NO: 131375 - protein, 111 aa, Glycine max
  Coding DNA Sequence Number=SeqID_14597
MWLNIYRQISDSRYALPDAFRGLIQKKYWKGCLPWIHCYCFIRATETPETIIAVAESALDAHIQDSRFHRVRDVAPNKNTITSTIPYSWLLLFTYCAGNVLFKLQVARSMP

SEQ ID NO: 131376 - protein, 605 aa, Glycine max
  Coding DNA Sequence Number=SeqID_14598
  Homolog annotation: Hit_ID=Q2QYH0; Match level="QueryCoverage=98%, HitCoverage=85%, E-value=3e-94, Identity=38%"; Hit description =Expressed protein
  Pfam annotation: Domain name=DUF936; Domain location=1-601; Score =416.6; E_value=3.5e-122; Accession=PF06075.3; Description=Plant protein of unknown function (DUF936)
  Pfam annotation: Domain name=Rep-A_N; Domain location=3-107; Score= -23.8; E_value=0.023; Accession=PF04057.3; Description=Replication factor-A protein 1, N-terminal domain
  Pfam module annotation: Pfam domain module=DUF936::Rep-A_N; Domain location=1-601::3-107
MASLTPGILLKMLQAMNTNTRVTGDHRSPLLQVIGIVPALAGSDLWSNQGFYLNLSDSVNSTYVLLSHPDTDLILSNRLQLGQFVHVDRFHFDSPLPSVSNLRPLAGRHPFLGTPEPLIARISPSTRHFLIQPLSDSELDPLSLLSLNNNNKSPIPNPNPNPNHNHEEHKQHHKDSSKERISRDPLAPRDNNLPPQRFSSPATAKRSQSAGRNKIVSTTAERDPSPAGKGKRSASPVPSKCVVPSLVSAREENRKVSREPAIIVPSRYRQPSPTGRKQPSSSPRRTSLSPGRRLSGGLKVSPLVADSSVKKKMATIVAGISKVSDALVGSKSARKNWDEQLPATPVEAGGSKSKVDAQAILRTQAAMSRRLSDVSGQKPGSNDSSSNEKTKAVSPQSCVLEDKSNFAAMGITIHEKKWTDGSVPLDAVSGNLARLGKEAMQRKILASTAAAEALEEANATECIIRNLSMFSDLCSVCQARNPLPTIDRFFTIYDDVLKSTAMVESVASRHNSETPDEGIPTKHSKSLSFWVEAALATDLQIVSLLTGTTVDPPSTLQKSLSKRQSLGAAKNLKVRSSPQSSLSTGVWTGGSGMKETVELGANFAV

SEQ ID NO: 131377 - protein, 132 aa, Glycine max
  Coding DNA Sequence Number=SeqID_14599
  Gene Ontology: Mol. function=acyl carrier activity; Cellular component=mitochondrion; Biological process=fatty acid biosynthetic process
  Homolog annotation: Hit_ID=Q2A9Q5; Match level="QueryCoverage=54%, HitCoverage=78%, E-value=4e-25, Identity=73%"; Hit description=Acyl carrier protein, putative
  Pfam annotation: Domain name=PP-binding; Domain location=63-130; Score=57.7; E_value=3.9e-14; Accession=PF00550.15; Description =Phosphopantetheine attachment site
MRVGQQGKGALCLFPWQDAKPTLIFSARLRAEKARTGGKDEVVHMQLRCWCSSTAVSSDQILDRVIALAKKYDKMDGSKVTETADFQKDLNLDSLDRVELIMALEEEFSIEIPDEKADKLVCCADVAKYIAE

SEQ ID NO: 131378 - protein, 151 aa, Glycine max
  Coding DNA Sequence Number=SeqID_14600
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LK11; Match level="QueryCoverage=59%, HitCoverage=18%, E-value=1e-27, Identity=63%"; Hit description=Beta -1,3-glucanase-like protein
MAQEKALRVRYLVAFLLVFFTMASCGSGVGVNWGTMATHKLPPNKVVKMLQENGFDKLKLFDAEEWIMAALMGTDIEVMLAIPNNMLEEMSRNPQVADSWVYENVTSYMYPGGLNIKLSSPMSILYTAFIITSFVCLFRADNFLLLNVSTV

SEQ ID NO: 131379 - protein, 318 aa, Glycine max
  Coding DNA Sequence Number=SeqID_14601
  Gene Ontology: Mol. function=heat shock protein binding; Cellular component=integral to membrane; Biological process=protein folding
  Homolog annotation: Hit_ID=UPI000034EDA4; Match level="QueryCoverage =100%, HitCoverage=11%, E-value=1e-121, Identity=70%"; Hit description=GRV2; heat shock protein binding / unfolded protein binding
  Subcellular localization annotation: CTP_CleavageSite=81; ConfidenceScore=5.10e-01
MDSPAIILLSDAFGKKNIDHGSGFVLCPLYGRKSKAFQAASGCTISAIISNLTKTAKSTVGLSLSVESSQTLSISEYIKQRAKEAVGAEDTPLGGWSVTRLRSAARGTLNVPGLSLGVGPKGGLGEHGDAVSRQLILTKVSLVERRPENYEAVTVRPLSSVTALVRFAEEPQMFAIEFSDGCPIHVYASTSRDSLLAAVRDALQTENGVSKTQIARLTSSNVYFQGQCAIPVLPRLTMPGHRIDPPCGRVFLQYGQQRPVTDAETASMHLKHLASSAKDAVAEGGSIPGSRAKLWRRIREFNACIPYSGVPPNLDVPE

SEQ ID NO: 131380 - protein, 243 aa, Glycine max
  Coding DNA Sequence Number=SeqID_14602
  Homolog annotation: Hit_ID=UPI000034EDA4; Match level="QueryCoverage =45%, HitCoverage=4%, E-value=1e-41, Identity=71%"; Hit description =GRV2; heat shock protein binding / unfolded protein binding
MKHRELSHWGQPVPPYPMQLRQNTRPVPRRELHGLEFSASIGPHAEVELVRIHVAAENRRGTFEVRRDVVRVRDGKRGRIESENGDAGNAENPLVAAAPRVLNDHIPRQVLGLFERRGSGINGGGGVGSVFHDRRRVKLDRAVEIGCVAAHGFDLGEMREGVNTWRIVEAEEEPESLLLRRWRERLGLRESENGKSNRSKQSHVGVREMARERENGGSGRRRNRRTNAPSDADHDDVAVSYSR

SEQ ID NO: 131381 - protein, 1265 aa, Glycine max
  Coding DNA Sequence Number=SeqID_14603
  Gene Ontology: Mol. function=heat shock protein binding; Cellular component=integral to membrane; Biological process=protein folding
  Homolog annotation: Hit_ID=UPI000034EDA4; Match level="QueryCoverage =97%, HitCoverage=48%, E-value=0.0, Identity=71%"; Hit description =GRV2; heat shock protein binding / unfolded protein binding
  Pfam annotation: Domain name=DnaJ; Domain location=985-1049; Score =39.5; E_value=1.1e-08; Accession=PF00226.21; Description=DnaJ domain
MSFPAAVGRIMGLLRNGSEGVASEAAGLVAVLIGGGPGDANVTDSKGEWHATIMHTKLKPTSVSPLLSMTVVEVLEAMICDPHGETTQYTVFVELLRQVAGLKRRLFALFGHPAESVRETVAMIMRSIAEEDAIAAESMRDASLRDGALLRHLLHAFFFPAGERREVSRQLVALWADSYQPALELLSRILPPGLVAYLHTRADGVLAEDTNQEESSIGRRKRRLLQHRKGRIGRGLTSQEQPFPSANNFDVSDSAKQPVGAIVRGSDGYHKTVMDPSSGQASNIQSSVVHTSEHLNNGSSTGEENGHSTFVDSAIVASTNSNEAPGSDFSNSLDPDSNAVDLQNAGIPAPAQVVVENTPVGSGRLLCNWPEFWRAFDLDHNRADLIWNERTRQELRESLQAEVHKLDVEKERTEDIVPGRATLDMVSGVECAPQISWNYPEFSVRYPSLSKEVCVGQYYLRLLLESGSGGRAQDFPLRDPVAFFRALYHRFLCDADTGLTVDGAVPDELGASDDWCDMGRLDGFGGGGGSSVRELCARAMAIVYEQHYMTIGPFEGTAHITVLLDRTDDRALRHRLLLLLKALMKVLSNVEACVLVGGCVLAVDLLTVVHETSERTSIPLQSNLIAASAFMEPLKEWMYIDKDGAQVGPMEKDAIRRLWSKKAIDWTTRFWASGMLDWKKLRDIRELRWALALRVPVLTPPQVGDTALSILHSMVSAHSDLDDAGEIVTPTPRVKRILSSPRCLPHIAQAILSGEPSIVEAAAALLKAIVTRNPKAMVRLYSTGAFYFALAYPGSNLLSIGQLFSVTHVHQAFHGGEEAAVSTSLPLAKRSVLGGLLPESLLYVLERSGPTAFAAAMVSDSDTPEIIWTHKMRAENLIRQVLQHLGDFPQKLSQHCHVLYDYAPMPPVTYPELRDEMWCHRYYLRNLCDDIRFPNWPIVEHVEFLQSLLVMWREELTRKPMDLSEEEAGKILEISFEDVSSDDVNKRNSLEVTDEASSLSKQIENIDEEKLKRQYRKLAMKYHPDKNPEGREKFLAIQKAYERLQATMQGLQGPQPWRLLLLLKGQCILYRRHGDVLEPFKYAGYPMLLSAVTVDKDDSNFLSSDRAPLLVAASELVWLTCASSSLNGEELVRDGGVHLLATLLSRCMGVVQPTTPGNEPSAIIVTNIMRTFAVLSQFEAARAEILEFSGLVEDIVHCTEFELVPAAVDAALQTIANVSVSSELQDALLKAGVLWYASLVIVLLRSMFEAEIGKGWDNDVGSTNK

SEQ ID NO: 131382 - protein, 585 aa, Glycine max
  Coding DNA Sequence Number=SeqID_14604
  Gene Ontology: Mol. function=signal transducer activity; Cellular component=membrane; Biological process=response to light stimulus
  Homolog annotation: Hit_ID=Q9FIK1; Match level="QueryCoverage=94%, HitCoverage=99%, E-value=0.0, Identity=58%"; Hit description =Photoreceptor-interacting protein-like
  Pfam annotation: Domain name=NPH3; Domain location=200-453; Score =295.9; E_value=7.4e-86; Accession=PF03000.5; Description=NPH3 family
MKFMKLGTKADTFYTEQATRTLISEIAADLVIQINDITYLLHKLQFPLLPKCGLLQRLCYDTSDSESVSLELHDIPGGEDAFELCAKFCYGIAINISAHNFVSALCAAKFLRMNDSIEKGNLVGKLESFFNSCILEGWKDSIATLQTTATLPEWSENLGIVRKCIDSIIEKILTPPPQVKWSYTYTRPGYTKKQHHSVPKDWWTEDVSDLDIDLFRCIIMAIRSTYVLPPQLIGEALHVYACRWLPGLTKLKSSGSSASQTEESNKEKNRKILETIVSMIPADRGSVSVGFLFRLLSISIHLGVSSVTKTELIRRASLQFEEATVSDLLYPSKSSSDQNYYDTELVLAVLETFLKLWKRMSPGAVDNSYFLRSIRNVGKLIDSYLQVVARDDNMQVSKFVSLAETVPSIAREDHDDLYQAINIYLKVHTDLSKADKKRLCGILDCQRLSPEVRAHAVKNELLPLRTVVQLLYFEQDKGSKATTSHKLPKPHEILLGAKHRPATTNEEFNGEEIRERDHHKTKRSDGKLLALDLEKKMVIKGDIEETRSEKARGIKDASSSSGKVDLDPKKIIRRTRSKSEHGVKK

SEQ ID NO: 131383 - protein, 841 aa, Glycine max
  Coding DNA Sequence Number=SeqID_14605
  Gene Ontology: Mol. function=heat shock protein binding; Cellular component=integral to membrane; Biological process=protein folding
  Homolog annotation: Hit_ID=UPI000034EDA4; Match level="QueryCoverage =96%, HitCoverage=30%, E-value=0.0, Identity=63%"; Hit description =GRV2; heat shock protein binding / unfolded protein binding
YDSTAEESDATESHGVGASVQIAKNMHAIKASLALSRLSGLCSDESATPYNQAAADALKVLLTPKFSSMLKDQMSKDLLSKLNANLESPEIIWNSSTRAELLKFVDQQRAAQGPDGLYDIKDSHDFVYKALSRELFIGNVYLRVYNDQPDFEISEPETFCLALIDFISYLVHNQCVEDADHKIEDADQKVEGTSSFFETSEHTSETVDGSVNEQVLDNSGTMSEEQSVGKEELELIKNLRSALTSLQNLLTNNPNLASIFSNKDKLLPLFECFSVPEASHSNIPQLCLGVLSLLTAHAPCLQAMVADGSSLLLLLQMLHSAPSCREGSLHVLYALASTPELAWAAAKHGGVVYILELLLPLKEEIPLQQRAMAASLLGKLVSQQMHGPRVAITLARFLPDGLVSVIRDGPGEAVVVGLEQTTETPELVWTPAMAASLSAQISTMALELYREQMKGRVVDWDLPEQASGQQEMRDEPQVGGIYVRLFLKDPKFPLRNPKRFLEGLLDQYLSSIAATHYEAQVVDPELPLLLSAALVSLLRVHPALADHVGYLGYVPKLVAAVAFEGRRETMSSGEVNNGRRAEQAYDPDNESAENAQTPQERVRLSCLRVLHQLAASTTCAEAMAATSVGTPQVVPLLMKAIGWQGGSILALETLKRVVVAGNRARDALVAQGLKAGGRNGFCSQMKWNESEASIGRVLAIEVLHAFATEGAHCTKVRELLNNSDVSLNSNLTWLFELLALASWHFRCGFCFCLHPVASILSISKFSPSTTAFQVWSAYKDQRHDLFLPSNAQSAAAGIAGLIENSSSSRLTYALTAPPQSTASRTPPPSSPDFNGKQDQPL

SEQ ID NO: 131384 - protein, 92 aa, Glycine max
  Coding DNA Sequence Number=SeqID_14606
  Gene Ontology: Mol. function=protein serine/threonine kinase activity; Biological process=protein amino acid phosphorylation
  Homolog annotation: Hit_ID=Q7XIB4; Match level="QueryCoverage=92%, HitCoverage=12%, E-value=7e-22, Identity=59%"; Hit description =Putative cyclin-dependent kinase CDC2C
MQNQWSKFDRLDSFDTCDEYHSQELSVALYNRQDSLSKRSNLSYQDQAEKVEFSGPLLSQMHTVDELLERHESHIRRTVRRSWFQRGKKQGK

SEQ ID NO: 131385 - protein, 77 aa, Glycine max
  Coding DNA Sequence Number=SeqID_14607
  Homolog annotation: Hit_ID=P09315; Match level="QueryCoverage=65%, HitCoverage=12%, E-value=9e-07, Identity=54%"; Hit description =Glyceraldehyde-3-phosphate dehydrogenase A, chloroplast precursor
MVEINCLCISKELRVNLGFEGIPMFVDRKDVGKHIQVRFKKALMVALDKEDILTYLVGVNVDMIFERPMLVGLNLSH

SEQ ID NO: 131386 - protein, 104 aa, Glycine max
  Coding DNA Sequence Number=SeqID_14608
  Subcellular localization annotation: CTP_CleavageSite=52; ConfidenceScore=5.33e-01
MDKAVSRTFPLDLMMKSVHFQLSLAHQWAKCASTAKRSFSALSETEESGRASASRPRAKREISALSTVDVFSQAQHRLVLSPNPLTRAKREGGAKRNVANLEPI

SEQ ID NO: 131387 - protein, 123 aa, Glycine max
  Coding DNA Sequence Number=SeqID_14609
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5GQ66; Match level="QueryCoverage=93%, HitCoverage=18%, E-value=4e-54, Identity=81%"; Hit description=Alpha- dioxygenase
IELIAPREVASQCPLKSFKFYKTKEIPTGFFEIKSGSSNIRTPWWDGSVIYGSNREVLEKVRTFKDGKIKISKDGHLLHNENGTAISGDVRNSWAGVSTLQALFTQEHNAVCDALKVRVEAFE

SEQ ID NO: 131388 - protein, 221 aa, Glycine max
  Coding DNA Sequence Number=SeqID_14610
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5GQ66; Match level="QueryCoverage=99%, HitCoverage=34%, E-value=1e-103, Identity=80%"; Hit description =Alpha-dioxygenase
  Pfam annotation: Domain name=An_peroxidase; Domain location=1-203; Score=-209.1; E_value=1.9e-09; Accession=PF03098.6; Description =Animal haem peroxidase
MENLIGVQGEEALTKIGVERQLVSMGHQACGALELWNYPLWLRDLVPQNIDGTERKDHIDLAALEIYRDRERSVARYNQFRRALLLIPISKWEDLTDDQEAIQVLEEVYGDDIEELDLLVGLMAEKKIKGFAISETAFTIFIFMSSRRLEADRFFTSNFNEDAYTTEGLEWVNTTESLKNVIDRHYPEITHKWLNSSSVFSVWNSPPNTQNPIPLYLRVPH

SEQ ID NO: 131389 - protein, 258 aa, Glycine max
  Coding DNA Sequence Number=SeqID_14611
  Gene Ontology: Mol. function=carboxypeptidase activity
  Homolog annotation: Hit_ID=Q67V99; Match level="QueryCoverage=99%, HitCoverage=68%, E-value=3e-58, Identity=41%"; Hit description=Leaf senescence protein-like
  Pfam annotation: Domain name=DUF231; Domain location=83-258; Score =43.6; E_value=2.3e-11; Accession=PF03005.6; Description=Arabidopsis proteins of unknown function
MQDEIPKDVYKDSEDRFRKWYFPIHDFTLTMLWSRFLIVGEERMVNGTGTSIFDMHLDKVDKDWAKELPNLDYAIISAGHWFFRVMHLHEAGKQVGCVYCNEENITSYNPDFTIRKAFRTAFRHINACKECGRKKMVTVLRTFAPAHFENGVWNTGGYCNRTGPVSESEVDFGKFDWEVRGIQMEEFERARREGTMGKLGHNNNNNNNNNNNRFEMVDVARAMLMRPDGHPGEHWGNKWMKGYNDCTHWCLPGPVDVW

SEQ ID NO: 131390 - protein, 90 aa, Glycine max
  Coding DNA Sequence Number=SeqID_14612
MAIKVAKIQGLLLFPIVPPPLLIMICECSDKDDAVKCCQMISYCWLLSMYLMMDLACPTNATLDWKRVTQTSRAFHERVEDFDRNKYRME

SEQ ID NO: 131391 - protein, 408 aa, Glycine max
  Coding DNA Sequence Number=SeqID_14613
  Gene Ontology: Mol. function=binding; Cellular component =intracellular; Biological process=thiamin biosynthetic process
  Homolog annotation: Hit_ID=Q1T6P8; Match level="QueryCoverage=97%, HitCoverage=65%, E-value=1e-125, Identity=54%"; Hit description =Pentatricopeptide repeat
  Pfam annotation: Domain name=PPR; Domain location=168-201; Score =22.5; E_value=0.0015; Accession=PF01535.11; Description=PPR repeat
  Pfam annotation: Domain name=PPR; Domain location=240-273; Score=5.6; E_value=1.6; Accession=PF01535.11; Description=PPR repeat
  Pfam module annotation: Pfam domain module=PPR::PPR; Domain location =168-201::240-273
MDGYVKCGIVGEARRGVESGRVVFDEMPVRNEMVFGNQLGLSLAKGASLPERNESRLGEGEISTFHVQECVEHDYFQRKLPLGNQKEKEIVFGCGFGLNSVTLCSVLSACSQSGDVSVGRWVHCYAVKAVGWDLGVMMGTCLADMYAKCGGISSALMVFRHMLRRNVVAWNAMLGGLAMHGMGKVLVEMFGSMVEEVKPDAVTFMALLSSCSHSGLVEQAGRLEEAEDLVKKMPIPPNEIVLGSLLGACYSHGKLRLGEKIMRELVQMDPLNTEYHILLSNMYALCGRVDKENSLRKVLKSRGIRKVPGMSSIYVDGQLHRFIAGDKSHPRTADIYMKLDDMICKLRLAGYGPNTNCQFLFGCPNGDDCMEAMEEIVIVFIVSSKVLVLALTIGELPFNLTDLFGPAD

SEQ ID NO: 131392 - protein, 574 aa, Glycine max
  Coding DNA Sequence Number=SeqID_14614
  Gene Ontology: Mol. function=actin binding; Biological process =protein modification process
  Homolog annotation: Hit_ID=Q2HV31; Match level="QueryCoverage=98%, HitCoverage=97%, E-value=1e-135, Identity=49%"; Hit description =Prefoldin
  Pfam annotation: Domain name=DUF827; Domain location=20-528; Score =290.7; E_value=2.7e-84; Accession=PF05701.2; Description=Plant protein of unknown function (DUF827)
MNGHKKLNSPRGEVGEIDTRAPFQSVKAAVSLFGEVAITRDRFSVKRRSSENVFEKETQLILAQKELNKIKKQVDNAEAIKAKALSELENAKEILQSLTSKLANVRECKQSAMQAAELVRNQSKRFEKTLSLKAVGYEAWRKELEHARKAYTTTITELDSSKQELTKIRQDFDAVLEAKLAALQAAGEAQRSAKLNSERISELSNEIATMKASIEQVRLASEQSQEESEAQLVGYYKTAKEEAQKNLESLKNEYDTELMQSLDAKLAQTSAEIEFLQEQIKKLHASKMDSVRLLTSELKEATKTLEEVAEEKNSLKKLVFSLRTELKQVKKEQDEVKEKGHIAEALAANLTGKLQGSMRDARPKPGTVDDLEANMFYVQSAKIRKLQLETEGAIREAEETRRKVQELKQEVEKSRAVAEEAEEKLELVLVEAKEAKAAEQRAVKEMKILSEVGRVPYSKFNGKIKMSNEEFEALRAKAKECEDLVEKKEAIVMAELQEIYARKNEVDRKVETNLKAIEETKAAEETALWSAEMADSAKVAIESELRRWHQQQQKVIPGAASQKLEHSAAPILTI

SEQ ID NO: 131393 - protein, 116 aa, Glycine max
  Coding DNA Sequence Number=SeqID_14615
MTTMMVVVLNGDADGSSNRMNNSHNSRDNDEGGYGHGNNGGDDKYKRQRYGSGGEVTTTRCDRKIVGVKTTTTRCDRKMVRVETTTIDGERTRMIVVVLIIVVSFVRSPSDFGGNI

SEQ ID NO: 131394 - protein, 157 aa, Glycine max
  Coding DNA Sequence Number=SeqID_14616
  Homolog annotation: Hit_ID=Q9FIK5; Match level="QueryCoverage=60%, HitCoverage=51%, E-value=2e-10, Identity=36%"; Hit description =Arabidopsis thaliana genomic DNA, chromosome 5, P1 clone:MCA23
MHLTQEKGKRKLLLQKFIDLCVDSKVKVEMKLIEGDNAARAIVDLVENLNIRKLVIGITQSNLRNRVRDPYIKSGSRSQNSIAAKVLKTAQGSCDIKIICEGREVIDQMMSDCTSPRSGSMDVKGSSRVSQQKNESRGFVLLSILCPVYGYLGPSPG

SEQ ID NO: 131395 - protein, 85 aa, Glycine max
  Coding DNA Sequence Number=SeqID_14617
MKATCGINFQSKGVGTQKNPDESIGSLSPTFDIRKFRGLCEKNIPNFGCIYQPNRVVKYKNDLLLCKDWGICGNKHLNQGSVTCN

SEQ ID NO: 131396 - protein, 75 aa, Glycine max
  Coding DNA Sequence Number=SeqID_14618
MASEVRETAGNLAGEGRRRFRKRRGCVSFGGGIKTTMQEKRKLVDSEMANDESVYSLSVIGGMEGFVCREFKLLV

SEQ ID NO: 131397 - protein, 290 aa, Glycine max
  Coding DNA Sequence Number=SeqID_14619
  Gene Ontology: Mol. function=transporter activity; Cellular component= intracellular; Biological process=transport
  Homolog annotation: Hit_ID=O48939; Match level="QueryCoverage=84%, HitCoverage=69%, E-value=1e-98, Identity=74%"; Hit description =Polyphosphoinositide binding protein Ssh1p
  Pfam annotation: Domain name=CRAL_TRIO; Domain location=85-258; Score= 14.1; E_value=7.7e-07; Accession=PF00650.10; Description=CRALTRIO domain
MVVEEPLRTTFQNVHQGFVTATLMRFLKARDWDPYKAQKMKPIVPADLYRAVRDSQLIGLSGYSREVLILKHNLFLVPFHHSCALIESVCSSENGLPVFAIGVGLSTFDKASVHYYVQSHIQINEYRERIVLPSASEKQGRPITTCIKVLDMTGLKLSALNQIKLLTIISSIDDLNYPEKTNTYYIVNAPYIFSACWKVVKPLLQERTRRKIQVLPGCGRDELLTIRDSGAINLSLKLCHYFLPHACTLHCNKAPYPHYPVALHGASETSCKMFQTSKTWLLITRNTNSS

SEQ ID NO: 131398 - protein, 317 aa, Glycine max
  Coding DNA Sequence Number=SeqID_14620
  Homolog annotation: Hit_ID=Q9FIK5; Match level="QueryCoverage=39%, HitCoverage=67%, E-value=1e-15, Identity=39%"; Hit description =Arabidopsis thaliana genomic DNA, chromosome 5, P1 clone:MCA23
MDMDGHRSSGTGTGVCEIEEVDENSNERQLHDDDDDDEEYCVYVAVGKSDTSMDALSWALNNFVAQSPSTIIYLIHVFPQINHIPNPLSNVILDKVAKPSRMIKEHTPYGSNLNPGLAPLSWGLAGGKGMIPRNQVSAEQGESYIDQKRGKRRELLQKFLQSCSTSKIKQQNYSEQVKVDTILIESDSVAKAILDLIPILQIKRLVIGANKLHLRKSKSRRGKGIADQILQNAPQSCKVRIICEKKEVNEQMMSLSPFPQPLATCTSANDASITSKKEDHQNDLVSLYMCGCIAAKDKGYRCIAQSSSLTRNVAHHE

SEQ ID NO: 131399 - protein, 706 aa, Glycine max
  Coding DNA Sequence Number=SeqID_14621
  Gene Ontology: Mol. function=ATP-dependent helicase activity; Cellular component=nucleus; Biological process=mRNA processing
  Homolog annotation: Hit_ID=Q1SC30; Match level="QueryCoverage=80%, HitCoverage=85%, E-value=0.0, Identity=92%"; Hit description =Helicase, C-terminal
  Pfam annotation: Domain name=DEAD; Domain location=310-501; Score =231.1; E_value=2.3e-66; Accession=PF00270.19; Description=DEADDEAH box helicase
  Pfam annotation: Domain name=DUF1777; Domain location=61-231; Score= -72.2; E_value=0.0026; Accession=PF08648.2; Description=Protein of unknown function (DUF1777)
  Pfam annotation: Domain name=Helicase_C; Domain location=568-644; Score=136.8; E_value=6.1e-38; Accession=PF00271.21; Description =Helicase conserved C-terminal domain
  Pfam module annotation: Pfam domain module=DEAD::DUF1777::Helicase_C; Domain location=310-501::61-231::568-644
MKRSNDDVAAPVPASTSKPVFLTKAQREQLALQRRQEEVADQKRRQEQLLSRNHSSDPKPSSDRDRDRERDRDHHRDRDRDRDRDRERERERARDRDREAERRNREREREEESRARERARLEKLAEREREKELESIKEQYLGSKKPKKRVIKPSEKFRFSFDWENTEDTSRDMNSLYQNPHEAQLLFGRGFRAGMDRREQKKLAAKNEKDMRDQIRKKDGLEERPEEADAQRRKEAAADLYDTFDMRVDRHWSEKKLEEMTERDWRIFREDYNISYKGSKIPRPMRSWNESKLTNELLKAVEKAGYKTPSPIQMAAIPLGLQQRDVIGIAETGSGKTAAFVLPMLSYITRLPPISEDNEAEGPYAVVMAPTRELAQQIEDETVKFAQYLGIKVVSIVGGQSIEEQGFKIRQGCEIVIATPGRLIDCLERRYAVLNQCNYVVLDEADRMIDMGFEPQVMGVLDAMPSSNLKPENEDEELDEKKIYRTTYMFSATMPPAVERLARKYLRNPVVVTIGTAGKATDLISQHVIMMKEAEKFSKLHRLLDELNDKTAIVFVNTKKNADHVAKNLDKDGYRVTTLHGGKSQEQREISLEGFRTKRYNVLVATDVAGRGIDIPDVAHVINYDMPGNIEMYTHRIGRTGRAGKTGVATTFLTLHDSDVFYDLKQMLIQSNSPVPPELARHEASKFKPGTIPDRPPRRNDTVFAH

SEQ ID NO: 131400 - protein, 985 aa, Glycine max
  Coding DNA Sequence Number=SeqID_14622
  Gene Ontology: Biological process=pollen maturation
  Homolog annotation: Hit_ID=Q5Z6I4; Match level="QueryCoverage=99%, HitCoverage=93%, E-value=0.0, Identity=52%"; Hit description =Putative Osnop
  Pfam annotation: Domain name=C2; Domain location=3-82; Score=97.3; E _value=4.6e-26; Accession=PF00168.20; Description=C2 domain
  Pfam annotation: Domain name=C2; Domain location=550-632; Score=64.6; E_value=3.1e-16; Accession=PF00168.20; Description=C2 domain
  Pfam annotation: Domain name=GRAM; Domain location=701-767; Score =87.1; E_value=5.4e-23; Accession=PF02893.10; Description=GRAM domain
  Pfam module annotation: Pfam domain module=C2::C2::GRAM; Domain location=3-82::550-632::701-767
MKLVVRVIEAKNLATSDSNGLSDLYVRVQLGKQKFKTKVVKSLNPTWDEQFAFWVDDLKDSLVISVMDEDKFFNYDYVGRLKVPISLVFEEEIKSLGTAWYFLKSKNKKCKNKQCGEIHLSIFIYQNNSSGELNDIGEQLLPPRKCPDAVTTSPSMSSTGFSNLFSPVREETTSCSSKEEKSCTQQKSFTDRIAQIFNKGSDVSSMSLSRSIDLDQSVTNKAVVGEIKIEEDQSSNETFEETMKEIQSADQGSEIPNNLLGGVLIDQLYIVAPEDLNVLLFSPDSNFPKSLSDEQGITELQICPWKLENGGETLKRSLTYIKAATKLIKAVKAYEDQTYLKADGKKFAVLASVSTPDVMYGSTFRVEVLYVITPGPELPSGEQCSRLVISWQINFLQSTMMKGMIESGARQGMKDSFDQYASLLCQTVKAVVSKDLGSSKEQALATLRPEPQSILKLAGQYLANFTVFTTFLMVSYVLVHIWLAAPGTIQGLEFVWFDLPDSIGEFVVCIALVLQGERVLGLISRFMQARARARKGSDHGIKAQGEGWMLTVALIEGSNLATVDSSAFCDPYVVFSCNGKTRTSSIKFKKSDALWNEIFEFDAMDDPPSVLDVEVYDFDGPCDGAASLGHVEINFLKTNISDLADIWVSLEGKLALACHSKLHLKIFLNNTRGGDVVKHYISKMEKEVGTKINLRSPQTNSAFQKLFGLPPEEFLINDFTCHLKRKMPLQGRLFVSARIIGFHANLFGHKTKFFFLWEDIEDVQIIPPTFSSMGSPIIVITLWPGRGVDARHGAKTQDEEGRLKFRFQSFVSFNVANSIILNLIGEAVSAGNYKSQCTRTIMALWKARSLSPEQKVKLVEEDSETKSLRSEESGSFIGLGDVSMSEASFFMELFSGGELDRMFMEKSGCVNYSYTPWVSENSDVYERAIYYKFEKRISRYRVEVTSTQQRSLLEGKGWLLKEVKNFHGVPLGDFFNVSKSNLACS

SEQ ID NO: 131401 - protein, 131 aa, Glycine max
  Coding DNA Sequence Number=SeqID_14623
MAAFFAPPLHTQFPTLLTSCDFDIAALISHLRLCKSSLKPHRHPRHELHQNLHIAKTNLFQGEGEEILEYRSQVINFVYKNVIGAGEISTTVTRMISWKKKLSSEVVGGDGVAGSDRRAAENGGERGKENE

SEQ ID NO: 131402 - protein, 1463 aa, Glycine max
  Coding DNA Sequence Number=SeqID_14624
  Gene Ontology: Cellular component=mitochondrion
  Homolog annotation: Hit_ID=Q5VMT5; Match level="QueryCoverage=61%, HitCoverage=54%, E-value=1e-153, Identity=38%"; Hit description =Putative Spo76 protein
  Pfam annotation: Domain name=C2; Domain location=979-1053; Score =41.2; E_value=3.4e-09; Accession=PF00168.20; Description=C2 domain
  Pfam annotation: Domain name=Thiolase_C; Domain location=1398-1463; Score=8.9; E_value=3e-07; Accession=PF02803.8; Description=Thiolase, C-terminal domain
  Pfam annotation: Domain name=Thiolase_N; Domain location=1122-1345; Score=261.4; E_value=1.9e-75; Accession=PF00108.13; Description =Thiolase, N-terminal domain
  Pfam module annotation: Pfam domain module=C2::Thiolase_C::Thiolase _N; Domain location=979-1053::1398-1463::1122-1345
MANWNCELRVIVSVKCKSFHMLKLLGECLAIVKALQAQCAQSSNLALHPLLLRGSEEELVNLLKDDNDTIQEGVLNVLAKAGGTIREQLAVTSSSVDLILERLCLEGSRRQAKYAVHALAAITKDDGLKMSLGVMVMLLPCDLEVSGSNPGDSLYAFSDKAAYKLVDMLEDKTHLPAVLQSLGCIAQTAMPVYETRENEIVEFILNKILKSDSKEDNMKTSWDDKSDLCMLKIYGIKAFVKSYLPVKDAHIRPNIDSLLDILRNILLYGEISKDLKSSSVDMAHLKLASAKAVLRLSRLWDHKIPVDLFHLTLRVSEISFPQAKKIFLSKIHQYIKDRLLDAKYGCAFLFNIFGSKPDEFAEDKQNLFDIIQMYHQLKARQLSVQSDANSLITYPEYILPYLVHALAHNSCPNVDDCEDVGAYDDIYRQLHLILSMLLQREEDAKSEVTTDKEKELISTITSIFLSIKHSEDMVDTSKSKNSHALCELGLAITKRLVQKDVDLQGLSHLVSLPPLLYKASEKEGDDTLEKTFPSNYASSSYCLIDVIRVTEVKSWLADESSLTHFESLELEMVQSQSAEDEASKEDEKDGNEIPLRKMLKNIKSQGTSGKKVKRNKSVPAETKKAENDFDILNMVREINVDNLETPTNFEPSNGHDHSLSKKELKDPESATGKKRKARETTPAPVPKRRRSSSAHGKLRLSTSISKASRRVSGEDSPQPKLLLDEEVNPDADSKTMQRKMVKGSEKDLSLSSLKRKVKGSDSYHNDELNKHDELDMMSPDSTQLSDKTVGNNNKSSTGSAKKGKRKSISGLAKCMTKEGEIDTEDLIGCRIKVWWPTDKKLSEDRESVPQGSSEEKEVDESSGALRQNINGEEESDSEGHHDNSDAGSNPREMEKSHLEPSKSPHDDDNKTIPEISDDVPLVNNSAVASLIVNGSVGRGRKAQGKNNEQFSYCYLSVKNAAELMLWYKYSIMDEQLRILKVIVVQGKKLVIRDSRAVTLMLLSSWGIRVIHCCLNPVWNEELNFTVTEPLGVLNLEVFDKDFLKADDKMGNSYLNLQPLNSAARLRDILKVSSGETTLRKVTPDSENCLARESSINCVNDIKRPSFLISDARSPSMSTCVKSRDVCIVGVARTPIGGLLGTLSSLSATELGSIAIKTALKRANVDPSLVQEVFFGNVLSANLGQAPARQAALGAGIPTSVICTTINKVCASGMKATMLAALTIQFGLNDVVVAGGMESMSNAPKYIAEARKGSRYGHDTIMMDSYAIRSFERGISAQNAGHFAWEIVPVEVSTGRGRASKIVDKDEGLGKFDAAKLRKLRPSFKEVGGSVTAGNASSIRVVSSRCKKFANKLILMPCNSYGSKLHALLLIMDWFIGLTSDGAAALVLVSEEKARELGLHVIAKIKGYGDAAKAPELFTTAPSLAIPKAISNAGLDASQIDYYEINEAFSVVALANQKLLGLDP

SEQ ID NO: 131403 - protein, 243 aa, Glycine max
  Coding DNA Sequence Number=SeqID_14625
  Gene Ontology: Mol. function=sequence-specific DNA binding; Cellular component=intracellular; Biological process=regulation of transcription, DNA-dependent
  Homolog annotation: Hit_ID=Q8LJQ5; Match level="QueryCoverage=97%, HitCoverage=97%, E-value=9e-76, Identity=75%"; Hit description=LEC1 -like protein
  Pfam annotation: Domain name=CBFD_NFYB_HMF; Domain location=71-136; Score=125.9; E_value=1.1e-34; Accession=PF00808.13; Description =Histone-like transcription factor (CBFNF-Y) and archaeal histone
  Pfam annotation: Domain name=Histone; Domain location=65-139; Score =7.3; E_value=0.024; Accession=PF00125.14; Description=Core histone H2AH2BH3H4
  Pfam module annotation: Pfam domain module=CBFD_NFYB_HMF::Histone; Domain location=71-136::65-139
  Subcellular localization annotation: CTP_CleavageSite=46; ConfidenceScore=5.19e-01
METGGFTATASSPTPPLYYSYQESKQGKLKVSSLRLKLSVSDMNMRQQVASSDHSAATGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLGVATAFVPPPYHHHNGYFGAAMPMGTYVREAPPNTASSHHHHHHHHHHARGISNAHEPNARSI

SEQ ID NO: 131404 - protein, 474 aa, Glycine max
  Coding DNA Sequence Number=SeqID_14626
  Gene Ontology: Mol. function=protein serine/threonine kinase activity; Cellular component=nucleus; Biological process=protein amino acid phosphorylation
  Homolog annotation: Hit_ID=Q9XF25; Match level="QueryCoverage=89%, HitCoverage=79%, E-value=0.0, Identity=88%"; Hit description=SNF-1 -like serine/threonine protein kinase
  Pfam annotation: Domain name=Pkinase; Domain location=1-202; Score =121.6; E_value=2.3e-33; Accession=PF00069.15; Description=Protein kinase domain
  Pfam annotation: Domain name=Pkinase_Tyr; Domain location=1-151; Score=-146.5; E_value=0.0017; Accession=PF07714.7; Description =Protein tyrosine kinase
  Pfam annotation: Domain name=UBA; Domain location=224-263; Score =31.9; E_value=2.3e-06; Accession=PF00627.21; Description=UBATS-N domain
  Pfam module annotation: Pfam domain module=Pkinase::Pkinase_Tyr::UBA; Domain location=1-202::1-151::224-263
MEYVKSGELFDYIVEKGRLQEDEARHFFQQYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKKIPDLMGWVQVPKDRLLVIGTLERKSISLDKEGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCWKKIGHYNMKCRWVAGTAGHHEGMINNSLHSNHYFGNDSGIIENEAVSKSNVVKFEVQGPGPTVSFLGSVRCFPFTATCSLVKLTSRKGDLELLDPCGGMYCYVMTDEYIFREDLMSYMIHQAA

SEQ ID NO: 131405 - protein, 54 aa, Glycine max
  Coding DNA Sequence Number=SeqID_14627
MKVVLYKTLETGFDRLQLKRARGERNWRGFPTHSLMPKAMGLEHGNTSGPTSLG

SEQ ID NO: 131406 - protein, 412 aa, Glycine max
  Coding DNA Sequence Number=SeqID_14628
  Gene Ontology: Mol. function=transcription factor activity; Cellular component=nucleus; Biological process=regulation of transcription, DNA-dependent
  Homolog annotation: Hit_ID=Q1T6R1; Match level="QueryCoverage=99%, HitCoverage=100%, E-value=1e-122, Identity=57%"; Hit description =Pathogenesis-related transcriptional factor and ERF
  Pfam annotation: Domain name=AP2; Domain location=40-104; Score =130.2; E_value=5.8e-36; Accession=PF00847.10; Description=AP2 domain
MARKRKVAEVVEERDLCEGTLGWDEMMKQAAALGGVQRARKRFVGVRQRPSGRWVAEIKDTIQKIRVWLGTFDTAEEAARAYDEAACLLRGTNTRTNFWPCSQSSTSPALSSKITNLLLQRLKERNNNNTCSSSSSSSTSLLINHQQMHQQVGAYGEGSTQFSIDQFTDFLNDPEDYSTSNNDFINNSAQIDYITSSFESCLTEKDGGTKIDMQYKSRNVTPQTSSNDSNSGVEDSEEEGSDLGVQSTNLDVHDFKFLDNIAPPSYYSPFEMAEEMEEEPVEPENENYGDEPSMLRAVMKRMTYERKFSASLYAFNGIPECLKLKLESGNMKGRGLADQLTSLQMACSKNILEKNKEEKEYIGTMDRRQEEEHQQTSPDMDSSSVDGELLLWNSLDLPPICFVNLLENGSFN

SEQ ID NO: 131407 - protein, 43 aa, Glycine max
  Coding DNA Sequence Number=SeqID_14629
MKLSDISAHVVKESINSFVIKKLVASSSVTSLYKETKQKELLI

SEQ ID NO: 131408 - protein, 99 aa, Glycine max
  Coding DNA Sequence Number=SeqID_14630
  Gene Ontology: Mol. function=hydrolase activity; Cellular component =cytosol; Biological process=response to other organism
  Homolog annotation: Hit_ID=Q67V42; Match level="QueryCoverage=88%, HitCoverage=29%, E-value=1e-22, Identity=54%"; Hit description=MutT domain protein-like
MSFFEKSDLLFVCLLRPLSFSIQIQEVEIEVANWMPFDEYAAQTFMEKFELLKYTNDIYLAKIDGQYFGFTPVSITSNFFENKNYLYLNVGGLKMCKSL

SEQ ID NO: 131409 - protein, 106 aa, Glycine max
  Coding DNA Sequence Number=SeqID_14631
MNKRHTYNIKITSFSQRDLALSSFFTYGSKQGYQHVVVLKNTKVVDEDTVEALQQLPRRTISGTNQQQYRQQAGTSDIMQQADRVLDTNQRPKRKTTKPQHLKDFV

SEQ ID NO: 131410 - protein, 277 aa, Glycine max
  Coding DNA Sequence Number=SeqID_14632
  Gene Ontology: Mol. function=nucleotide binding; Cellular component =nucleus; Biological process=fatty acid biosynthetic process
  Homolog annotation: Hit_ID=Q7XYX7; Match level="QueryCoverage=98%, HitCoverage=99%, E-value=1e-109, Identity=68%"; Hit description=AKIN beta2
  Pfam annotation: Domain name=AMPKBI; Domain location=183-273; Score =119.3; E_value=1.1e-32; Accession=PF04739.5; Description=5'-AMP -activated protein kinase, beta subunit, complex-interacting region
MGNVNVTPEEEEVSASARATDENAMPQSPPTSPTAIHFPLIFAPQVPVVPLQRPDEMHVPSCSWMETTSGYEDVYREVGIPTVITWSYDGKEVAVEGSWDNWKTRFLYSLFIRMPLERSGKDFAIMKVLPSGVYLYRFIVDGRMRYTPDSPWAQDDAGDAYNILDLQDYVPEDIGSISSFEPPQSPDSSYDNLYLSSEDYAKEPPLVPPLLQMTLLNVPATNMKIQPPMSRPRHGVLNHLYAQKGKSSPSVVGLGTTHRFLAKYVTVVLYKSLQGKP

SEQ ID NO: 131411 - protein, 33 aa, Glycine max
  Coding DNA Sequence Number=SeqID_14633
MGLQGRSVCNGFPTPKFSWQVHGIRVATTFYGG

SEQ ID NO: 131412 - protein, 647 aa, Glycine max
  Coding DNA Sequence Number=SeqID_14634
  Gene Ontology: Mol. function=protein serine/threonine kinase activity; Cellular component=nucleus; Biological process=protein amino acid phosphorylation
  Homolog annotation: Hit_ID=Q1RZY7; Match level="QueryCoverage=93%, HitCoverage=99%, E-value=0.0, Identity=68%"; Hit description=Protein kinase
  Pfam annotation: Domain name=Pkinase; Domain location=104-388; Score =313.9; E_value=2.8e-91; Accession=PF00069.15; Description=Protein kinase domain
  Pfam annotation: Domain name=Pkinase_Tyr; Domain location=104-388; Score=42.6; E_value=4.4e-15; Accession=PF07714.7; Description =Protein tyrosine kinase
  Pfam module annotation: Pfam domain module=Pkinase::Pkinase_Tyr; Domain location=104-388::104-388
MGCISSKNAVARTCSPSPAVLDIAEPNPAYAKGHSWLPVLESKTGSEDERSNSKFRKNSSKKSSGSFSFRHVEAEQNAAGWPPWLIATAAEAIQGWIPLKADSFQKLEKIGEGTYSSVFRAREVETGKMFALKKVRFDNFQPESIRFMAREITILRRLDHPNIMKLEGIITSRLSNSIYLVFEYMEHDLAGLVSRPDIVFSESQIKCYMRQLLSGLEHCHMRGIMHRDIKLSNILLNNEGVLKIGDFGLANTISTNSKHHLTSRVVTLWYRPPELLMGSTNYGVSVDLWSVGCVFAELFLGKPILKGRTEVEQLHKIFKLCGSPPEEFWKKTKLPHATMFKPQTNYESSLRERCADFPASAVNLLETLLSIDPGNRGTASSALMSEYFSTKPYACNASSLPKYPPSKEMDAKSMGDSSRSSLNAMIRLLPCDMKVMGLNLEKSLFICENKSLCTLRKKTGGKMREVATSRRQQRRDTQNISENARRDDGKAHLTKGKGGAMHKDYTKSHLDAMSETSQMNVANGNGYSVGSNNTFTWVKRRKQDASSTLSDGSRSKISALDPNFAKRTYDLTTLRVSMDLDPEELMNAQGDRGRAVRKSRFGRVTIGTTDRGLSKEHKDLEVLHELKGPKTRSKVKLLERDGQEDQG

SEQ ID NO: 131413 - protein, 76 aa, Glycine max
  Coding DNA Sequence Number=SeqID_14635
  Subcellular localization annotation: CTP_CleavageSite=40; ConfidenceScore=5.17e-01
MAHTTGMEVASLPPTTMGGGGFPPRALCSSHIMMNLTSISKSNGAKSHAGVLPRIQEASYYRAVNQDKRLNQIENS

SEQ ID NO: 131414 - protein, 195 aa, Glycine max
  Coding DNA Sequence Number=SeqID_14636
MAWIASTTHVSKFLVRSTTHLSHEDPSSDIVFLGHYYSASPLSYRWPQDLDGWCDAHEWEGDSISTQKVFWECQTLQDYRHTSDVDKILLDNGNAFGSNDDSVFVYRDDATKEEMQEQCESNWLSEFYPLSEEVSSLSEYKTLENAESVSSTLSTQPTCQMKILSLLALSASKPLSSQPLTLAQRDMLAEHAFVS

SEQ ID NO: 131415 - protein, 185 aa, Glycine max
  Coding DNA Sequence Number=SeqID_14637
  Gene Ontology: Mol. function=nucleoside-triphosphatase activity; Cellular component=integral to membrane; Biological process=transport
  Homolog annotation: Hit_ID=O81016; Match level="QueryCoverage=88%, HitCoverage=12%, E-value=3e-54, Identity=63%"; Hit description =Probable pleiotropic drug resistance protein 4
MWNSAENAFARSPSFREEGEDEEALRWAALQRLPTYKRARRGIFKNVIGDMKEIDVRDLQAQEQRLLLQRLVDCVDNDPERVALEFPKIEVRFQNLTVETYVHVGSRALPTIPNFICNMTEALLRQLRIYRRKRSKLTILADISGIIRPSRLTLLLGPPSSGKTTLLLALAGRLGPGLQKSTMTL

SEQ ID NO: 131416 - protein, 222 aa, Glycine max
  Coding DNA Sequence Number=SeqID_14638
  Gene Ontology: Mol. function=sequence-specific DNA binding; Cellular component=nucleus; Biological process=regulation of transcription
  Homolog annotation: Hit_ID=Q7XAA5; Match level="QueryCoverage=95%, HitCoverage=21%, E-value=5e-68, Identity=60%"; Hit description=WRKY11
MSELFVFIEPSPWLTQNLKLPSRRPSVVCENCLYSLERDMRARAFHILEPKGTVDMLILFLEERSDGAPPLLDSYRDAKSRIIPFLGKWKGHSITKRSGVYGSTIANADTVVLHDMDDNGQLMQDVTSSSTFDGENVTTNVHWTGTVSDYLVTFDGGYQMILLPGGMYMGCPCDVAKSVAESKSFHLEFCWLETPDKRQRLVRTYDVQGLAVSSTYFLETKL

SEQ ID NO: 131417 - protein, 81 aa, Glycine max
  Coding DNA Sequence Number=SeqID_14639
  Gene Ontology: Mol. function=acid phosphatase activity
  Homolog annotation: Hit_ID=Q1RZZ0; Match level="QueryCoverage=64%, HitCoverage=9%, E-value=2e-18, Identity=83%"; Hit description =Metallophosphoesterase; Purple acid phosphatase, N-terminal
MVFACRDTTRSHEVPAEESGFKSKFYYSFDAGGIHFIMLGAYVDYNSTGAQFAWLKKDLLSVDGSVIIYTHHNDTNKRIKI

SEQ ID NO: 131418 - protein, 212 aa, Glycine max
  Coding DNA Sequence Number=SeqID_14640
  Gene Ontology: Mol. function=hydrolase activity; Cellular component =extracellular space; Biological process=biological_process
  Homolog annotation: Hit_ID=Q1RZZ0; Match level="QueryCoverage=88%, HitCoverage=32%, E-value=4e-86, Identity=79%"; Hit description =Metallophosphoesterase; Purple acid phosphatase, N-terminal
MKICTTFFMPLAMVLVMMAVAESHIPTTLDGPFDPVTHRFDPSLRQDSEDLPVTHPRLRKNVTSNFAEQIALAISSPTSMWVSWVTGDAQIGLNVTPIDSASVESEVWYGKESGKYISVRKGDSVVYSLLYPFEGLWNYTSGIIHHVKLKGLEPSTRYYYKCGDSSTPAMSREFIFETFPKPSPNNYPARIAVIGDLGLTSNSTSTIDHLKF

SEQ ID NO: 131419 - protein, 101 aa, Glycine max
  Coding DNA Sequence Number=SeqID_14641
MIMLRVFLNSEQKGQGVFGDRIPSKLNLSKRQIHLEDQDLLCVFCHERVEDTSHVFFIYTVTQQLWWRWYNLLGFSMAHPQSAEAHFRQNSCGLLGAKSKD

SEQ ID NO: 131420 - protein, 264 aa, Glycine max
  Coding DNA Sequence Number=SeqID_14642
  Gene Ontology: Mol. function=metal ion binding; Biological process =metal ion transport
  Homolog annotation: Hit_ID=Q8S6Y3; Match level="QueryCoverage=87%, HitCoverage=88%, E-value=6e-32, Identity=37%"; Hit description =Putative ATFP3
  Pfam annotation: Domain name=HMA; Domain location=31-94; Score=47.6; E_value=4.1e-11; Accession=PF00403.16; Description=Heavy-metal -associated domain
MGEEKKDEGNKEEAKEEKKEEEKKEEPPPEIVLKVDMHCEACARKVAKALKGFQGVEEVSADSRTSKVVVKGKAADPIKVCERLQKKSGKKVELISPLPKPPEEKEEPPKEEPPKEEKKYEFCIAIQSRVSADMKVTKQSDVPPKGTRNEGNGGVESVETDLANDQVIVKGVVDPAKLVDHVYKRTKKQASIVKDGEKKEEEKKEEEKKEEKEEEKRGEEENKGGEDNKTEIKRSEYWPSKNYIDYAYDPEIFSDENPNACSVM

SEQ ID NO: 131421 - protein, 69 aa, Glycine max
  Coding DNA Sequence Number=SeqID_14643
  Homolog annotation: Hit_ID=Q2R4C3; Match level="QueryCoverage=61%, HitCoverage=8%, E-value=2e-07, Identity=74%"; Hit description=Gpi16 subunit, GPI transamidase component family protein, expressed
MKDGVDLIPISSRNAKPPSVELWAVLDVPPFTIRSLLCFNQLPGIFYHLFCNAKPPGVELWAVLDVPVH

SEQ ID NO: 131422 - protein, 84 aa, Glycine max
  Coding DNA Sequence Number=SeqID_14644
METLLDDALSISVAFSECNLSLLEKKLPKVLKCEVVFGVPCQTYKQPPTRFWACKYYLPFDIRTMPYLEVSGLSGDGELKGLEF

SEQ ID NO: 131423 - protein, 33 aa, Glycine max
  Coding DNA Sequence Number=SeqID_14645
MQARASLVISLGEKVDLESQATDRNMVLAKGNQ

SEQ ID NO: 131424 - protein, 81 aa, Glycine max
  Coding DNA Sequence Number=SeqID_14646
MLGRMYVIVVRKKQDRASFGCTAKSGILFCSSMTSLVYSSQEGEMEDGNTCYGMLRVGVCGMLGTTSISFVRTNSLMAHRF

SEQ ID NO: 131425 - protein, 605 aa, Glycine max
  Coding DNA Sequence Number=SeqID_14647
  Gene Ontology: Cellular component=nucleus
  Homolog annotation: Hit_ID=Q1S808; Match level="QueryCoverage=100%, HitCoverage=98%, E-value=1e-164, Identity=53%"; Hit description=Plus- 3
  Pfam annotation: Domain name=Plus-3; Domain location=272-381; Score =158.1; E_value=2.3e-44; Accession=PF03126.8; Description=Plus-3 domain
MADLENLLLEAAGRTGTAGRNRHSLPPSRRRHDGAYSDGGSDYRDDDSDDELNYASRKPSGSQVPLKKRLDPTERDDDLGSQEEADDDGRNDHDGDSSDESNIGDDLYKDEDDRRKLSEMTELQREMILSDRATKKDDKNVLGKIASKREKGKAAAPRKQSPPMSSSRMCASARSADRSAKNDALNELRAKRLKQQDPEAHRRLREASRNAGPRHFSPPKRKTFTSTSLSSSSHSESESRSHSDDEGSIGDGGIADSDDDRALAGSEGPSFQNIKEITIRRSKLAKWFMKPFFEELIVGCFVRVGIGRSKTGPIYRLCMVKNVDASEPDRQYKLENKTTYKYLNVVWGNESSAARWQMAMVSDSAPIEEEFKQWVKEVDCSGVRMPKKKSASTRPLNVAAEKDRLRRELEIAQSKHDEAEVERIKTRLQELEASRQAKQKDAKALKLAEMNRKNRFENFKNASELKPVNIGLKAGEAGYDPFSRRWTRSRNYYAAKPGEKAAAGNNIVNGNVAGAGSNGTGAPVTVEAGMVAIAAAVDTSAPVDQGTESNMLHNFELPISLALLQKYGGAPGAQAGFMARKQRIESTVGFRVSENDGRRHALTLT

SEQ ID NO: 131426 - protein, 75 aa, Glycine max
  Coding DNA Sequence Number=SeqID_14648
  Subcellular localization annotation: CTP_CleavageSite=22; ConfidenceScore=5.11e-01
METFKSIFSGFHIQAFTNNHPRAATSSQSHNLQEVLALRGSLKAVWLLWNARNGILFREQTSDGAAILETIRSFS

SEQ ID NO: 131427 - protein, 544 aa, Glycine max
  Coding DNA Sequence Number=SeqID_14649
  Gene Ontology: Mol. function=protein serine/threonine kinase activity; Cellular component=nucleus; Biological process=protein amino acid phosphorylation
  Homolog annotation: Hit_ID=Q7XIB4; Match level="QueryCoverage=100%, HitCoverage=78%, E-value=1e-174, Identity=56%"; Hit description =Putative cyclin-dependent kinase CDC2C
  Pfam annotation: Domain name=Pkinase; Domain location=98-382; Score =301.8; E_value=1.3e-87; Accession=PF00069.15; Description=Protein kinase domain
  Pfam annotation: Domain name=Pkinase_Tyr; Domain location=98-382; Score=37.0; E_value=9.7e-15; Accession=PF07714.7; Description =Protein tyrosine kinase
  Pfam module annotation: Pfam domain module=Pkinase::Pkinase_Tyr; Domain location=98-382::98-382
MGCVVAKQAVSVTPAIEHSVESEKNRKKKTESVGASRSELGESGRASSNGGSESLSFRLGNLSKYVEGEQAAAGWPAWLSAVACEAIHGWVPLRADAFEKLDKIGQGTYSSVFRAKEIQTGKIVALKKVRFDNFEPESVRFMAREIMILRRLDHPNIIKLEGLITSRLSCSIYLVFEYMEHDITGLLARPEIKFSESQIKCYMKQLLSGIEHCHSRGVMHRDIKGSNLLVNNEGILKVADFGLANFSNSGNKQPLTSRVVTLWYRPPELLLGSTAYGASVDLWSVGCVFAELLIGKPILQGRTEVEQLHKIFKLCGSPPEEYWKKTRLPHATLFKPQQPYDSCLRETFKDFHASSVNLLQTLLSVEPSKRGTASSALSLEYFKTKPYACDPSSLPIYPPSKEIDAKNEEESRRLGKIWIVTYQPVSLAMYYLLSGWKKIGGRACRAESRKPSRNPLALSKLAPAEDLSSQTQTSQKMDDRSVHIIKEENTNTCEEAPKQSSGKPEDASSYMKNASQVDIPFPGPLQVSKSGGFAWAKRRRDDTS

SEQ ID NO: 131428 - protein, 116 aa, Glycine max
  Coding DNA Sequence Number=SeqID_14650
  Subcellular localization annotation: CTP_CleavageSite=78; ConfidenceScore=5.29e-01
MHNPPSSESIRASSLKRNINSKSKLARLLLLLLLLKTLDSKTLDQARRRRSPPPIRHRGRISVFLCVFPIIKERGSSSSSSRSRSSDRGRNSGNPAISCEGNATDERERDWLGERE

SEQ ID NO: 131429 - protein, 52 aa, Glycine max
  Coding DNA Sequence Number=SeqID_14651
MSYTPPTFATRSIVTVKEDRDIIHQIGMYLKILQEQEAQLTEHGLSHEQNYR

SEQ ID NO: 131430 - protein, 1541 aa, Glycine max
  Coding DNA Sequence Number=SeqID_14652
  Gene Ontology: Mol. function=DNA binding; Cellular component=nucleus; Biological process=transcription
  Homolog annotation: Hit_ID=Q53J12; Match level="QueryCoverage=99%, HitCoverage=96%, E-value=0.0, Identity=40%"; Hit description=BAH domain-containing protein, putative
  Pfam annotation: Domain name=BAH; Domain location=7-122; Score=36.0; E_value=1.3e-07; Accession=PF01426.8; Description=BAH domain
  Pfam annotation: Domain name=TFIIS; Domain location=295-382; Score =52.4; E_value=1.5e-12; Accession=PF08711.1; Description =Transcription factor S-II (TFIIS)
  Pfam module annotation: Pfam domain module=BAH::TFIIS; Domain location=7-122::295-382
MVSQDGRKIRAGDCALFKAPRDSPPFIGIIRKLTFDKEESPSLEVNWLYRPADLKLAKGIVLEAAPNEVFYSFHKDETPAASLLHPCKVAFLRKGVELPSGISAFVCRRVYDIENNCLWWLTDKDYLNERQEEVNQLLDKTKLEMHGAVQSGGRSPKPLNGPTSTQSLKSGSDNVQNSSSFGAQGKGKKRERGDQVSDSSKKERLFKVEDGDSGQFRLESMLKSEIAKITDNKGGLVDFEGVERLVQLMQPDSGDKKIDLAGRMMLVDVIALTDRYECLCGFVQHRGLPVLDEWLQEVHKGKIGEGNMPKESDKSVDEFLLALLRALDKLPVNLHALQTCNVGKSVNHLRTHKNYEIQRKARSLVDTWKRRVEAEMNMNDSKSGSNRTMSWPAKSANSESPQVGNRKTGGSSDNVAKSSSVQPSISKNSQSKLSSGEALSKSSSSPGSTKLMTTSAVSNSKDQNSKVLVGAATSDLPLTPIKEERSSSSSQSQNNSISCSSEHAKTIGSSREDSKSSTAVSASGGKIPGGASRTRKSSNGLHVTGVAVGPKEHSSAKNSARNSPSEKVSPTRVPHEKSADQPLTDQGNNQRLILRLPNTGHSPSRGASGGSYEEPGITCSKASSPADRNENQDRRMKTRPECLLTHVSNMMNEACDASEALLGVDEGKGPQTVDERCRANEDGDKVAESSKPASLSSGFVSRSGQTYDLSPMNALVESCVKISEASASVSHGDDGMNLLATVAAGEISRSENASPMVSPERKSPPADELSSGNDFKLKHSGEAAVCSLSQSDGGATAEHPLNIFDSLQIKNDLRHPATTSGDGDTISSSCVERSGDGRSQINSSPTDFLQAEGPCLRPETKEDTSETILPVKKETNADPGDCKLKSRTSFDDDQKVDHMNEETAEDEKMLVPKAVASVKSENESGEKHPELSSGVDNENQISAEKSTGTGILVQKASPVSENCESLYLKKESPTSGNAVMVSRDENADDTKSVVIEPDERRTGQDLSVSDDVNERADTMGRKEAIGQCSGSSVHSDLPTVPREENDAFKASERKLDTNKSEVAGERHACSAAGSDTAVKLDFDLNEGFPVDDVSQGEIARQEDPTTSSAVHVPCPMPFPMTSISGVFHASITVASAAKGPVVPPENPLRIKGELGWKGSAATSAFRPAEPRKNAETPPTTNDIASVDVTSIKQGRAPLDFDLNVADERCFEDVGSCASLEAGPHDRSTGGFDLNKFDETPEIGTFLISKLDIPSLPSKPSLSSGLSNGGSVSRDFDLNNGPGLDEVGSEVPTRSQPMKSTVPFPTAVHGTRANNAEFGNYSAWFPPGNTYSAITVPPLLSGRGEQSYVAGAGAQRIMGPTGSAPFGPEIYRGPVLPSSPAVAYPPTTPFPYPGFPFETNFPLSSNSLSVCSTAFMDSSTVGGLCFPTMPSQPVGSGGVVSSTYPRPYVMSLPGGTSNVIPDSRKWGSQSLDLNSGPGGTDTERRDDRLPSGLRQMSVPNSQASMEDHLKMFQMAGALKRKEPDGGWGEGAERFGYTQHSWQ

SEQ ID NO: 131431 - protein, 197 aa, Glycine max
  Coding DNA Sequence Number=SeqID_14653
  Gene Ontology: Mol. function=carboxypeptidase activity
  Homolog annotation: Hit_ID=Q5VQ36; Match level="QueryCoverage=41%, HitCoverage=19%, E-value=3e-18, Identity=50%"; Hit description=Leaf senescence protein-like
  Subcellular localization annotation: CTP_CleavageSite=30; ConfidenceScore=5.08e-01
MLEKTMKTSSTMFQDKYHNHSTGKRERCLSLTLGKGVPFVLTSLLMASIFSFFFLYNPYPLTLAPHQGHDMLENPSPKQEEHVITTTTKVSPSKPQKEQKTCDLSKGHWVPALGGSSTYYTNSSCTTIPDSKNCFKQGRMDSDFLNWKWKPEQCDLPRFHARTFLHMVRAKKMAFIGDSVARNHVDSLLCLLSQVSV

SEQ ID NO: 131432 - protein, 377 aa, Glycine max
  Coding DNA Sequence Number=SeqID_14654
  Gene Ontology: Mol. function=transcription factor activity; Cellular component=nucleus; Biological process=regulation of transcription, DNA-dependent
  Homolog annotation: Hit_ID=Q1T2D5; Match level="QueryCoverage=31%, HitCoverage=9%, E-value=3e-10, Identity=38%"; Hit description=Chromo
MAWLVVREEGKVEGVWNRDAKWVSNLVISRYWVVSKGQGTLATEPPRPSPLRKGVGHGGPQKIGCMGCALRPRERTSRSCTKLSVLPPSMRMTTSTGVNIRDCAWVVPFLFRVHDEKKDMRGTLVPSSKLLIEIEAKALLLVHGEGKSREVGGGGDSKVEKGWGRAHGGHRGYRDIGPPNSPPRDAQDPPPGPGSEDEGLELNAGFLGPNPIQSSLEGTMSISRLFDWLTFQTGPSMAKEAITRHSGSGIELEGMDGVLGLAEEEDGANLAMASSIRSILVLERVASAMTTVLNESTKLLWAEQFLGIRGRGLLQKNKIRENEILFLLEFALHEFKDVSIADRIFPSHYSCTSSTTLVRVGYEILEVMWPGAVPLAP

SEQ ID NO: 131433 - protein, 401 aa, Glycine max
  Coding DNA Sequence Number=SeqID_14655
  Gene Ontology: Mol. function=RNA-directed DNA polymerase activity; Cellular component=chromatin; Biological process=chromatin assembly or disassembly
MTAMKKWRQYLLGHHFIILTDHRSLKELMSQVIQTSEQQIYLACLLGYDYSIQYQSGKANSIVDALSRDLKKELHNHAGYRELWQSIVDNPQAHPTYEVTQDFILQQNRIWLPQGCNFISLLLAEFHSTPTGGHIWLTKTLNRIDQNFTWPRIKKDARNFVLACLPCQKTKYDHQKSPGLFCPLPVPLRPWEDLSLDFIGGLPISRGYTVILVVVDRFSKGGKFIIWAEWSYNTSVHAATGLTLFKITFGEKPSSIPDYLANTSNIDVVDDFLVNRDAVFAMLRKKLLKAQQTMKKFVDENRQEVHYQEGDWNREAPNWPRDTTTHFKSQRKLAQLLISSCFPQNREYTMFFIAHSSSLSTNPNTLTTHIVDLPLQLEDNDVVVTPLTILNTQWVTSDIGP

SEQ ID NO: 131434 - protein, 80 aa, Glycine max
  Coding DNA Sequence Number=SeqID_14656
  Homolog annotation: Hit_ID=Q9FPS8; Match level="QueryCoverage=65%, HitCoverage=5%, E-value=2e-11, Identity=60%"; Hit description =Ubiquitin-specific protease 16
MEKYVKENKEKYLEGRMRGRDLAPFMSGTSDLPIYRLYGVVVHLDIMNTAFSGHCVCYVKNFQSRWFKVDHSVFTLCLVK

SEQ ID NO: 131435 - protein, 256 aa, Glycine max
  Coding DNA Sequence Number=SeqID_14657
  Homolog annotation: Hit_ID=Q1T2D5; Match level="QueryCoverage=17%, HitCoverage=2%, E-value=1e-08, Identity=62%"; Hit description=Chromo
MNSLRETFYDHQDSGVSTKHQQADNEVERKVFPQLEWDRRCCLSSSKNGRQGTDKRNIELEAGSRSLDKAFAAIFNFPERNLGLKGLLKKAIGCPPFDSTTLTPMLEASVSNVKGREKSGKSRTRVMGKCAPSATLNLPRLQFHVYENEGNDRGRRSQVQSLEGGVYSGWEVYRYNVNMKVGIAFILANQMTKLGWGDEIKRRGSGFDDVGSKGEEDDATEKEGGDKVVKDGIGVGPELHGESLGSGKAVIVSLSP

SEQ ID NO: 131436 - protein, 225 aa, Glycine max
  Coding DNA Sequence Number=SeqID_14658
  Gene Ontology: Mol. function=nucleic acid binding
  Homolog annotation: Hit_ID=Q5QIV3; Match level="QueryCoverage=92%, HitCoverage=55%, E-value=3e-53, Identity=48%"; Hit description=Acyl CoA reductase
  Pfam annotation: Domain name=Sterile; Domain location=125-225; Score =101.7; E_value=2.2e-27; Accession=PF03015.9; Description=Male sterility protein
MYLAQDERFFLYACYRTIDSLAVTYGKGKLKCFLGNINGVVDVVPADMVVNAMLVAMVAHAKQPSDIVYHVGSSLRNPLTYLNLQDYGLKYFTAKPWINKDGTPVKVGRVTVLTDMDSFQRYMFIRYLLPLKGLELANTALCQYFRGTYLELHRKIQVVMRMVELYRPYMFFDGVFDDMNTEKLRMAAKQSGTETDLFYFDTKEVNWDDYFMKTHLPGIVKYIFK

SEQ ID NO: 131437 - protein, 58 aa, Glycine max
  Coding DNA Sequence Number=SeqID_14659
MESFRAECKQVCDSSVSWESGTNNSAVIIGSATKKAILSWAVLELNMEMEKLTRSYSI

SEQ ID NO: 131438 - protein, 181 aa, Glycine max
  Coding DNA Sequence Number=SeqID_14660
MEWTFDFGSLFIVFFPAFHFPFFFLQLPKGAIKKPIMDREVISIGSSSSKDTHRGASDSESSSSKKVRASRRIGRGVYHPHGGAQPYEAAREPVLVIVILPLSNFGSMRRGSSGGDLKCWVALSTSGLAGYEWVRDNMLKYKSCLTSATSVVVLQRHVKLANSEDSCKLVVQAYNYDECRC

SEQ ID NO: 131439 - protein, 97 aa, Glycine max
  Coding DNA Sequence Number=SeqID_14661
  Homolog annotation: Hit_ID=Q5QIV3; Match level="QueryCoverage=88%, HitCoverage=24%, E-value=2e-16, Identity=49%"; Hit description=Acyl CoA reductase
MGTKLLDLHYMVCYNLCLYIGYIAYVCGERGGLILEDPYHFGDSLNGVSGLDIEAERTIVCDKLDELREQGATEREIEIAMKNLGISRFVKIYKLTN

SEQ ID NO: 131440 - protein, 99 aa, Glycine max
  Coding DNA Sequence Number=SeqID_14662
MNKEKKTIAALRNELGDDIHEGVKSSLKQLISSRPNKESKREAYLCEHLQGKTTKGHEAEVTVVRKSSQHATRRSRWCNKLGFLCRGRARVVKPKRDAS

SEQ ID NO: 131441 - protein, 269 aa, Glycine max
  Coding DNA Sequence Number=SeqID_14663
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=Q9M1K2; Match level="QueryCoverage=94%, HitCoverage=32%, E-value=7e-96, Identity=69%"; Hit description =Putative phosphatidylinositol-4-phosphate 5-kinase 4 (EC 2.7.1.68) (AtPIP5K4) ...
  Homolog annotation: Hit description=(1-phosphatidylinositol-4 -phosphate kinase 4) (PtdIns(4)P- 5-kinase 4)
  Pfam annotation: Domain name=PIP5K; Domain location=1-266; Score =300.7; E_value=2.7e-87; Accession=PF01504.9; Description =Phosphatidylinositol-4-phosphate 5-Kinase
VFLRMLPGYYKHVRAFENTLVTKFFGLHCVKLTGTAQKKVRFVIMGNLFCSQYAIHRRFDLKGSTFGRTTDKPESEIEPTTTLKDLDLNYIFRLRKSWFQEFCRQVDRDCDFLEHERIMDYSMLVGLHFRGMSCSDNVTPSGYSPGTQTPTGHGNFDDGAPRLSGVDVDHLVVDPSRWVQLGINMPARAESTVRKSCDTPQLVGEPTGELYEIIIFFGIIDILQDYDISKKLEHAYKSFQYDPTSISAVDPRLYSRRFRDFIFRVFVED

SEQ ID NO: 131442 - protein, 980 aa, Glycine max
  Coding DNA Sequence Number=SeqID_14664
  Gene Ontology: Mol. function=nucleoside-triphosphatase activity; Cellular component=integral to membrane; Biological process=transport
  Homolog annotation: Hit_ID=O81016; Match level="QueryCoverage=97%, HitCoverage=88%, E-value=0.0, Identity=55%"; Hit description =Probable pleiotropic drug resistance protein 4
  Pfam annotation: Domain name=ABC2_membrane; Domain location=704-918; Score=221.4; E_value=2e-63; Accession=PF01061.14; Description=ABC-2 type transporter
  Pfam annotation: Domain name=ABC2_membrane; Domain location=85-261; Score=90.4; E_value=5.3e-24; Accession=PF01061.14; Description=ABC-2 type transporter
  Pfam annotation: Domain name=ABC_tran; Domain location=417-607; Score= 102.3; E_value=1.5e-27; Accession=PF00005.17; Description=ABC transporter
  Pfam annotation: Domain name=PDR_assoc; Domain location=266-331; Score=121.8; E_value=2e-33; Accession=PF08370.2; Description=Plant PDR ABC transporter associated
  Pfam module annotation: Pfam domain module=ABC2_membrane::ABC2 _membrane::ABC_tran::PDR_assoc; Domain location=704-918::85-261::417 -607::266-331
MGFSCPERKNVADFLQEVTSKKDQEQYWSILDRPYRYVPVGKFAEAFSLYREGRILSEKLNIPFDRRYNHPAALATLSYGAKRLELLKTNYQWQKLLMKRNSFIYVFKFVQLLLVALITMSVFFRTTMHHNTIDDGGLYLGALYFSMVIILFNGFTEVSMLVAKLPVLYKHRDLHFYPSWAYTLPSWFLSIPTSLIEAGCWVAVSYYASGYDPAFTRFLRQFLLFFFLHQMSIDRIPVWWVWGFWISPLMYAQNSASVNEFLGHSWDKKAGNQTTYSLGEAVLKERSLYAESYWYWIGLGAMVGYTILFNILFTIFLANLNPLGRQQAVVSKDELQEREKRRKGESVVIELREYLQRSASSGKHFKQRGMVLPFQPLAMAFSNINYYVDVPLELKQQGIVEDKLQLLVNVTGAFRPGVLTALVGVSGAGKTTLMDVLAGRKTGGVIEGSVYISGYPKRQDSFARISGYCEQTDVHSPCLTVWESLLFSAWLRLSSDVDLETQKAFVEEVMELVELTPLSGALVGLPGIDGLSTEQRKRLTIAVELVANPSIVFMDEPTSGLDARAAAIVMRTVRNIVNTGRTIVCTIHQPSIDIFESFDELLFMKRGGELIYAGPLGPKSCELISYFEAIEGVPKIRSGYNPATWMLEATSSVEENRLGVDFAEIYRKSSLYQYNLELVERLSKPSGNSKELHFPTKYCRSSFEQFLTCLWKQNLCYWRNPQYTAVRFFYTVIISLMLGSICWRFGAKRETQQDLFNAMGSMYSAILFIGITNGTAVQPVVSVERFVSYRERAAGMYSALSFAFAQVVIEFPYVFAQAIIYSSIFYSMASFVWTFDRFIWYLFFMYFTMLYFTFYGMMTTAVTPNHNVAAIIAAPFYMLWNLFSGFMIPHKRIPIWWRWYYWANPVAWSLYGLLTSQYGGDTHLVKLSNGNSMTIREVLKHVFGYRHDFLCVTAVMVAGFCIFFAIIFAFAIKSFNFQRR

SEQ ID NO: 131443 - protein, 851 aa, Glycine max
  Coding DNA Sequence Number=SeqID_14665
  Gene Ontology: Mol. function=DNA binding; Cellular component=nucleus; Biological process=multicellular organismal development
  Homolog annotation: Hit_ID=Q6H976; Match level="QueryCoverage=99%, HitCoverage=100%, E-value=1e-178, Identity=50%"; Hit description =STYLOSA protein
  Pfam annotation: Domain name=LisH; Domain location=10-36; Score=36.2; E_value=1.2e-07; Accession=PF08513.1; Description=LisH
  Pfam annotation: Domain name=SSDP; Domain location=72-312; Score= -9.4; E_value=7.4e-08; Accession=PF04503.4; Description=Single -stranded DNA binding protein, SSDP
  Pfam annotation: Domain name=WD40; Domain location=561-599; Score =29.1; E_value=1.6e-05; Accession=PF00400.22; Description=WD domain, G-beta repeat
  Pfam annotation: Domain name=WD40; Domain location=603-641; Score =47.5; E_value=4.6e-11; Accession=PF00400.22; Description=WD domain, G-beta repeat
  Pfam annotation: Domain name=WD40; Domain location=646-684; Score =26.4; E_value=0.0001; Accession=PF00400.22; Description=WD domain, G- beta repeat
  Pfam annotation: Domain name=WD40; Domain location=688-723; Score =8.5; E_value=3.8; Accession=PF00400.22; Description=WD domain, G -beta repeat
  Pfam annotation: Domain name=WD40; Domain location=727-764; Score =26.2; E_value=0.00011; Accession=PF00400.22; Description=WD domain, G-beta repeat
  Pfam annotation: Domain name=WD40; Domain location=771-808; Score =21.4; E_value=0.0033; Accession=PF00400.22; Description=WD domain, G- beta repeat
  Pfam annotation: Domain name=WD40; Domain location=811-849; Score =28.9; E_value=1.8e-05; Accession=PF00400.22; Description=WD domain, G-beta repeat
  Pfam module annotation: Pfam domain module=LisH::SSDP::WD40::WD40::WD4 0::WD40::WD40::WD40::WD40; Domain location=10-36::72-312::561 -599::603-641::646-684::688-723::727-764::771-808::811-849
MSQFKWEADKMLDLYIHDYLMKRQLHATARTFQAEGNVSTNPIAIDAPGGFLFEWWSVFWDIYIAMVNQKHPEAAVSCSKNQQIKARLMQNQQEQELQNTNQNQQNEQMQLLLQRHAWRQQQQQQFLRGFHLISGSARCPISNDPLMRQNLATSNAMATKTYEDRLKLPLQKDALDDANIQQKVVDDVGQLLNPNHASLLKAAVTTGEQARGQILLSAPSILQGDIQNVQNLNQKLPGSTQDIKSDMNAMMRSQAVVSEGSFIGCHDLLTIILILGSNQGGSNLTQKGWPLEGLDELRSGFLQPNNLMQSSQSFSQLSLRQQLMLQAQQNLISPSASDFESRRPRMLVNDQNMALLKDGQSNSVGDLIPNNRSPAQVCSSVLPHPDSDMYLKQQIQKSSQQLQQYSQHPLLSHQSESLQKQGKDGPGSITVEGSVSNTLQGNKQVSKSITGQKRKPASSSDPANSSGTANTTGPPTNSPSTASTQTPADMMTVSTLHQNVPSSKSSFMFGTDGFGSLSSVQNQLADMDHLGGDGCFGDNVESFLSLDESDVSEKVGKEVAFKNMKHIMASSHKVECCHFSSDGKLLATGGHDNKASLWCTELFNLKSTLEEHSEWISDVRFCPSMLRVATSSADKTVRVWDVDNPSYSLRTFTGHATTVMSLDFHPSQDDLICSCDNSEIRYWSIKNGSCTGVLKGGATQMRFQPGLGRLLAAAVDNSVSIFDVETQGCRLKLQGHTTVVRSVCWDLYGNFLASLSADMVRVWRVVSGGKGECIHELNASRNKFNTCVFHPFYPLLVIGCHETLVLWDFGEKKTVTLHAHDDVVSSLAMSKVTGLVASTSHDKHFKIWKCG

SEQ ID NO: 131444 - protein, 138 aa, Glycine max
  Coding DNA Sequence Number=SeqID_14666
MVIAILVIMVIVIAVLVFMVVRAGYDSDNDDDDDNGVRVVITAVVEVTMTMYRYHITIAIAFSLSLSLLLYAPPRIMIILAYFWPLIASTTVFLAAIIALGGVSKFSTEGHGHGEKAGEGLLDYVTGMPEHTEEARNF

SEQ ID NO: 131445 - protein, 558 aa, Glycine max
  Coding DNA Sequence Number=SeqID_14667
  Gene Ontology: Mol. function=microtubule binding; Cellular component =cortical microtubule, transverse to long axis; Biological process =cytoskeleton organization and biogenesis
  Homolog annotation: Hit_ID=O23565; Match level="QueryCoverage=88%, HitCoverage=84%, E-value=1e-113, Identity=49%"; Hit description =Myosin II heavy chain like protein
  Pfam annotation: Domain name=Myosin_HC-like; Domain location=178-525; Score=377.6; E_value=1.9e-110; Accession=PF07058.2; Description =Myosin II heavy chain-like
MVSCEEKYGEKLTLVQPDPVALEINRLQNQLKEKDKELATCQGEMKALRSTEALKDKAIEELRNGASKLDERLRVTEDHLKQKNLEIKKLTDEKKDALASQYAAEATLRRVHANQKDEDFVPIESVIAPLEAEIKMYRNEITALQEDKKALEQLTKSKESALLEAERILRSALERALVVEEVEKKLLEKNHRQKILEVEKLSKTIQQLEEVILASGATANAVRDCQRQISELQEEKRTLERELARVKVSANRIANVVANEWKDENDKVMPVRQWLEERRIMQGEIQQLKDKLAISERTARAESQLKNTRGGLKHFSSYPITLNVSYASPKAEKSNILAFLTTNGGLRKRSTSQPRASSVGSSLFQTPNIKNNTDIVAGNLKLGSPTKKYGSTENMLKKGMWALRSKVANNGEKENEMQVKTDMTLNRYTDESEATEIKTIVNLDEDAESKKPNGSSRDDVVSGFLYDKLQKEVINLRKSCEIKDSSLLAKDEEIKMLIKKVDVLTKAMEVEWKKMKREAAAREKEASSTKSDDNRKKRSGNSSKRFFNFTFCSVANNC

SEQ ID NO: 131446 - protein, 352 aa, Glycine max
  Coding DNA Sequence Number=SeqID_14668
  Gene Ontology: Mol. function=potassium channel activity; Cellular component=integral to membrane; Biological process=potassium ion transport
  Homolog annotation: Hit_ID=Q9LLM5; Match level="QueryCoverage=99%, HitCoverage=100%, E-value=5e-91, Identity=51%"; Hit description =Outward-rectifying potassium channel KCO1
  Pfam annotation: Domain name=Ion_trans_2; Domain location=194-269; Score=68.6; E_value=2e-17; Accession=PF07885.6; Description=Ion channel
  Pfam annotation: Domain name=Ion_trans_2; Domain location=73-155; Score=91.0; E_value=3.7e-24; Accession=PF07885.6; Description=Ion channel
  Pfam module annotation: Pfam domain module=Ion_trans_2::Ion_trans_2; Domain location=194-269::73-155
MGGDESRESLLSEARDHSHLNEISDLQRRRPRRGKSSDKENNLKEKNVVQNPLHSQYIDPKQEAEFHFKTVLLWLAAYLGGGTLCFLLTSHQIKGIKTNGFLDAIYFCVVTMTTVGYGDLVPDSQLAKLLACIYVFTGMALVGLILSKAADYIVEKQEIFLVRTLFKGENFGPEELSKEVETNKAKYKFILAASVFLVLMISGTIFLHYIENLDFVDALYCVCSTVTTLGYGDKSFSTTIGRAFAVFWILSSTICLAQSFAYLAEFYTEERQKAMAKIVLTRKLSLLDLEAADLDGDHVVSATEFVLYKLKEMGKINQEDILVVMDIFRKLDVDKSGTLTEADLKYSESSKP

SEQ ID NO: 131447 - protein, 689 aa, Glycine max
  Coding DNA Sequence Number=SeqID_14669
  Gene Ontology: Mol. function=binding; Cellular component=plastid chromosome; Biological process=transport
  Homolog annotation: Hit_ID=Q9FSB6; Match level="QueryCoverage=99%, HitCoverage=99%, E-value=0.0, Identity=63%"; Hit description=67kD chloroplastic RNA-binding protein, P67.1
  Pfam annotation: Domain name=PPR; Domain location=167-201; Score =31.9; E_value=2.2e-06; Accession=PF01535.11; Description=PPR repeat
  Pfam annotation: Domain name=PPR; Domain location=202-236; Score =26.7; E_value=8.2e-05; Accession=PF01535.11; Description=PPR repeat
  Pfam annotation: Domain name=PPR; Domain location=237-271; Score =37.3; E_value=5.3e-08; Accession=PF01535.11; Description=PPR repeat
  Pfam annotation: Domain name=PPR; Domain location=272-306; Score =33.4; E_value=7.7e-07; Accession=PF01535.11; Description=PPR repeat
  Pfam annotation: Domain name=PPR; Domain location=307-341; Score =33.9; E_value=5.7e-07; Accession=PF01535.11; Description=PPR repeat
  Pfam annotation: Domain name=PPR; Domain location=342-376; Score =34.6; E_value=3.5e-07; Accession=PF01535.11; Description=PPR repeat
  Pfam annotation: Domain name=PPR; Domain location=377-411; Score =21.8; E_value=0.0024; Accession=PF01535.11; Description=PPR repeat
  Pfam annotation: Domain name=PPR; Domain location=413-447; Score =40.2; E_value=7e-09; Accession=PF01535.11; Description=PPR repeat
  Pfam annotation: Domain name=PPR; Domain location=448-482; Score =30.5; E_value=5.9e-06; Accession=PF01535.11; Description=PPR repeat
  Pfam annotation: Domain name=PPR; Domain location=550-584; Score=8.4; E_value=0.76; Accession=PF01535.11; Description=PPR repeat
  Pfam module annotation: Pfam domain module=PPR::PPR::PPR::PPR::PPR::PP R::PPR::PPR::PPR::PPR; Domain location=167-201::202-236::237-271::272- 306::307-341::342-376::377-411::413-447::448-482::550-584
  Subcellular localization annotation: CTP_CleavageSite=67; ConfidenceScore=5.77e-01
MAYNLCSSPSSLFHDLPSISSSSSSCRKFKLRNSSSFFQPSPSPTPHSKTLLHVSLHEPIPEHLPPHANSSSSSKSNYIWVNPRSPRAKQLERRSYDARYTSLVNLALSLDSCNPSQEDVSLVLKDLWGRVIEQDAVIVINNMSNPRVVPFVLNYFQRRIRPTREVILYNVTLKVFRKSKDLDAMEKLFDEMLQRGVRPDNVSFSTIISCARICSLPNKAVEWFEKMPSFRCEPDDVTYSAMIDAYGRAGNIDMALRLYDRARTEKWRLDSVTFSTLIKMYGLAGNYDGCLNVYQEMKALGVKSNMVIYNTLLDAMGRAKRPWQAKSIYTEMTNNGFLPNWATYASLLRAYGRGRYSEDALFVYKEMKEKGMEMNTHLYNTLLAMCADLGLADDAFKIFEDMKSSATCLCDSWTFSSLITIYSCSGNVSEAERMLNEMIESGFQPTIFVLTSLVQCYGKVGRTDDVLKTFNQLLDLGISPDDRFCGCLLNVMTQTPKEELGKLNDCVEKANPKLGSVLRYLVEGLEEGDGEFRKEASELFNSIADEVKKPFCNSLIDLCVNLNLLDKACELLDLGLTLEIYTDIQSKSQTQWSLHLKSLSLGASLTALHAWINDLSKTLESGEDLPPLLGINTGHGKHRYSDKGLANVVESHLNELNAPFHEAPDKAGWFLTTQVAAKSWLESRKLVTA

SEQ ID NO: 131448 - protein, 381 aa, Glycine max
  Coding DNA Sequence Number=SeqID_14670
  Gene Ontology: Mol. function=metal ion binding; Cellular component =intracellular; Biological process=regulation of transcription, DNA -dependent
  Homolog annotation: Hit_ID=Q9C7E8; Match level="QueryCoverage=96%, HitCoverage=97%, E-value=6e-42, Identity=30%"; Hit description=Zinc finger protein CONSTANS-LIKE 15
  Pfam annotation: Domain name=CCT; Domain location=341-379; Score =70.5; E_value=5.5e-18; Accession=PF06203.4; Description=CCT motif
  Pfam annotation: Domain name=zf-B_box; Domain location=10-57; Score =42.5; E_value=1.5e-09; Accession=PF00643.14; Description=B-box zinc finger
  Pfam annotation: Domain name=zf-B_box; Domain location=58-99; Score =3.3; E_value=0.054; Accession=PF00643.14; Description=B-box zinc finger
  Pfam module annotation: Pfam domain module=CCT::zf-B_box::zf-B_box; Domain location=341-379::10-57::58-99
MMSGSPSPNSKQRTCDYCGDFTALLYCSADSAKLCFFCDRKVHSPNQLFSKHTRAQLCDSCGDSPASVLCSAENSVLCHNCDCEKHKHLASEVHQRKPLEGFSGCPSVTELLTILGLSEKSLLSNEGTSQIDYDLSDLHVWSAPSVNGLEYLITSTASSHKNRKSAFGRHKEEILSQLRELIKLEPDLIHGEVDAERQGQFGNLPTGFERDVEAKMGGRDTSRNKIGSQLCWHPISSYPLKPPRKNLLLKKGKRLYHEVKSSLQIDPTNQIVPSDTSSLRDFGEVVSAEDGSFTIPGTGTQANFNNEGKPSNSFNSENLSPTPKATPYELTSHERDSALLRYREKKKTRRYDKHIRYESRKVRAESRMRIKGRFVKDETQK

SEQ ID NO: 131449 - protein, 243 aa, Glycine max
  Coding DNA Sequence Number=SeqID_14671
  Gene Ontology: Mol. function=bile acid:sodium symporter activity; Cellular component=integral to membrane; Biological process=organic anion transport
  Homolog annotation: Hit_ID=Q672Q4; Match level="QueryCoverage=97%, HitCoverage=58%, E-value=1e-100, Identity=77%"; Hit description =Putative anion:sodium symporter precursor
  Pfam annotation: Domain name=SBF; Domain location=1-143; Score=90.5; E_value=5.1e-24; Accession=PF01758.7; Description=Sodium Bile acid symporter family
  Subcellular localization annotation: CTP_CleavageSite=37; ConfidenceScore=5.25e-01
MYIMHNPLTSISDSQTLKLSAPLATGLILVACCPGCQASNVATFIAKGNVALSVLMTTCSTIGAIIMTPLLTNLLAGQLVPVDAVGLALSTFQVVLVPTIVGVLANELFPKFTSKIITITPLIGVILTTLLCASPIGLASDALKAQGAQLVLPVVFLHAASFALGYWVSRISFGESTSRTISIECGMQSSAFGFLLAQKHFTNPLVAVPSAVSVVCMALGGSALAVFWMNRPIPLDDKDDFKE

SEQ ID NO: 131450 - protein, 506 aa, Glycine max
  Coding DNA Sequence Number=SeqID_14672
  Gene Ontology: Mol. function=oxidoreductase activity; Cellular component=membrane; Biological process=electron transport
  Homolog annotation: Hit_ID=O81974; Match level="QueryCoverage=96%, HitCoverage=98%, E-value=1e-165, Identity=59%"; Hit description =Cytochrome P450 71D8
  Pfam annotation: Domain name=p450; Domain location=34-488; Score =377.5; E_value=2.1e-110; Accession=PF00067.12; Description =Cytochrome P450
MAVLSSLAVITFFLSLLVLFLAKNYKQKSLHKLPPGPWKLPIIGNLLQLAAASSLPHHAIRELAKKYGPLMHLQLGEISAVIVSSPNMAKEIMKTHDLAFAQRPKFLASDIMGYGSVDIAFAPYGDYWRQMRKICTLELLSAKKVQSFSNIREQEIAKLIEKIQSSAGAPINLTSMINSFISTFVSRTTFGNITDDHEEFLLITREAIEVADGFDLADMFPSFKPMHLITGLKAKMDKMHKKVDKILDKIIKENQANKGMGEEKNENLVEVLLRVQHSGNLDTPITTNNIKAVIWDIFAAGTDTSAKVIDWAMSEMMRNPRVREKAQAEMRGKETIHESNLGELSYLKAVIKETMRLHPPLPLLLPRECIEACRIDGYDLPTKTKVIVNAWAIGRDPENWHDADSFIPERFHGASIDFKGIDFEYIPFGAGRRMCPGISFGIANVEFALAKLLYHFNWELQQGTKPEEFDMDESFGAVVGRKNNLHLIPIPYDPSIHDNGKGGTFI

SEQ ID NO: 131451 - protein, 210 aa, Glycine max
  Coding DNA Sequence Number=SeqID_14673
  Subcellular localization annotation: CTP_CleavageSite=77; ConfidenceScore=5.44e-01
MDKEYDQDDIKKKFNKFLKSTLQFVLSVSVFSFFVWYSSGFSILPQCFNAYFSSCLFSMLTRTLERKYMFLICNAILALLAMSPHFDLRVSEEPLGAFRLLENAPLMVEEEAKRHEEYPDQHISQAEENEGRLVSKVSNAEEEGAGGGTGSSTGVIVAQDDDELVAETAMEMETNEELANTDELNRKIEEFIRKMKEEMRIEAQKQPIAV

SEQ ID NO: 131452 - protein, 75 aa, Glycine max
  Coding DNA Sequence Number=SeqID_14674
MYALACFSGTQTCVLLSPALAVGDVLIHKEGRIDAGIEEMFFSRGNRTVITFRKLLQSGDEGVGVYKCEVISHLG

SEQ ID NO: 131453 - protein, 92 aa, Glycine max
  Coding DNA Sequence Number=SeqID_14675
METEERGGGTGQRRKKERWCVILVSQKRVQHIVQRGENQMGKTEPDYDGKDRRIGGDYEGSSLCKGMGKGHCRQPYPCICKDTVSKFEPMTN

SEQ ID NO: 131454 - protein, 280 aa, Glycine max
  Coding DNA Sequence Number=SeqID_14676
  Gene Ontology: Mol. function=ferredoxin hydrogenase activity; Cellular component=periplasmic space; Biological process=electron transport
  Homolog annotation: Hit_ID=Q93YF9; Match level="QueryCoverage=86%, HitCoverage=50%, E-value=1e-112, Identity=83%"; Hit description=Narf- like protein
  Pfam annotation: Domain name=Fe_hyd_lg_C; Domain location=1-272; Score=42.7; E_value=9.5e-20; Accession=PF02906.5; Description=Iron only hydrogenase large subunit, C-terminal domain
MGMPMWISISHAFKKLTRFFKSLGVKAIFDTSCSRDLTLVESCVEFITRYRQNQVVEDERSKSSLPMIASACPGWICYAEKQLGSFVLPYISSVKSPQQTIGVIIKNYVCQELGLRPEEVYHVTVMPCYDKKLEAARDDFVFQFESHAEGRESEINMISEVDSVLTTGEVLELIQSKEVDFKSLDETTLDKILTNINEDGYLYGVSGSSGGYAETIFRYAAKTLFGRQIDGPLTFKNIRNSDFQEVTLEASPFELYNIIFMLVRKVVISIFCVLYLTIKC

SEQ ID NO: 131455 - protein, 136 aa, Glycine max
  Coding DNA Sequence Number=SeqID_14677
MRRKIHHPTVFRSSIVLLQERFRQLQRVKEMRKKRELLKMLTTSEPKPFNSNPTMRQFFHPELIIPSRSSPPHVSLSLGPTSQCMQEYNKSTIEAPVLNNMLSIDSTHNQSIQASCKNIYDWDSGSDSSVDTSLHL

SEQ ID NO: 131456 - protein, 32 aa, Glycine max
  Coding DNA Sequence Number=SeqID_14678
MANDSIDLHASSTWKFVSWRAVYMPVSEDIQK

SEQ ID NO: 131457 - protein, 80 aa, Glycine max
  Coding DNA Sequence Number=SeqID_14679
  Gene Ontology: Mol. function=protein kinase activity; Biological process=protein amino acid phosphorylation
  Homolog annotation: Hit_ID=Q949V3; Match level="QueryCoverage=67%, HitCoverage=8%, E-value=2e-14, Identity=64%"; Hit description =Putative receptor protein kinase
  Pfam annotation: Domain name=LRRNT_2; Domain location=24-61; Score =33.3; E_value=8.5e-07; Accession=PF08263.3; Description=Leucine rich repeat N-terminal domain
MALFITVVVFLLHLSWSVRVNSEPTQDKQALLGFLSQTPHSKRLQWNASESACDWVGVKCDASRSFVYSLRLHRRRFSGS

SEQ ID NO: 131458 - protein, 135 aa, Glycine max
  Coding DNA Sequence Number=SeqID_14680
MTHRIVQENVETSTWKDVFGGIISRLMLCQFVNMSKSPILQVCALGNERADATIAWIDASLMQHNNHPPLIISSISPSSLKHVLANEDYNHNECWLVSASVFVTTRSAALWPLANKAKGTWVSVRMDVTASEEVK

SEQ ID NO: 131459 - protein, 111 aa, Glycine max
  Coding DNA Sequence Number=SeqID_14681
  Gene Ontology: Mol. function=hydrolase activity, hydrolyzing O -glycosyl compounds; Cellular component=membrane; Biological process =carbohydrate metabolic process
  Homolog annotation: Hit_ID=Q9FKH4; Match level="QueryCoverage=97%, HitCoverage=94%, E-value=2e-36, Identity=59%"; Hit description =Similarity to beta-1
  Pfam annotation: Domain name=X8; Domain location=27-111; Score=144.2; E_value=3.5e-40; Accession=PF07983.3; Description=X8 domain
MTSTMLKILMAQLLLSLSFQAYGQFEEWCIADEQTPDEELQRAMEWACGKGGADCSKIQVNQPCYLPNTLKDHASYAFNNYYQRFKNKGGSCYFNSAAITTDLDPSKTSDF

SEQ ID NO: 131460 - protein, 196 aa, Glycine max
  Coding DNA Sequence Number=SeqID_14682
  Gene Ontology: Mol. function=ferredoxin hydrogenase activity; Cellular component=periplasmic space; Biological process=electron transport
  Homolog annotation: Hit_ID=O23488; Match level="QueryCoverage=97%, HitCoverage=28%, E-value=4e-38, Identity=44%"; Hit description=LET1 like protein
  Pfam annotation: Domain name=DUF588; Domain location=25-196; Score =149.3; E_value=1e-41; Accession=PF04535.3; Description=Domain of unknown function (DUF588)
MSYLGLGVSPGTVPVYHGTKLKVLDRRVRITELVLRCVSLGLGVVAIVLVVTDSQVKEFFSFQKKAKFTDMKALVFLVVANGLTVGYSLIQGLRCVVSMVRGNVLFSKPLAWLIFSGDQPEELGTTAAGPHENRRTGETLTTYIVMAYVTVAAVAAALQSGVLGRTGQAELQWMKVCNMYGKFCNQMGEGIASAFV

SEQ ID NO: 131461 - protein, 545 aa, Glycine max
  Coding DNA Sequence Number=SeqID_14683
  Gene Ontology: Mol. function=transcription factor activity; Cellular component=nucleus; Biological process=regulation of transcription, DNA-dependent
  Homolog annotation: Hit_ID=Q00LP7; Match level="QueryCoverage=99%, HitCoverage=100%, E-value=0.0, Identity=60%"; Hit description=GRAS1
  Pfam annotation: Domain name=GRAS; Domain location=151-455; Score =447.6; E_value=1.6e-131; Accession=PF03514.5; Description=GRAS family transcription factor
  Subcellular localization annotation: CTP_CleavageSite=24; ConfidenceScore=5.15e-01
MQTSQKHPSSAGAHFYHQPVQGIYQMLQSNLCQDSSSQGTSVSFETCKEQYFTLESCPAPTNDFMDCDDSPSYASVSSKRTPFSPQGSQSCYSDHHQSSDNTYGSPISGLSSVDDRHQLKHKLRELEISLLAPEESDITDSCGCCVVKGGLHGSSQLAKHNWDQIAENIAQFDLKGALKVCAQAVSDDDVPTARGWIDNVLGKLVSVSGDPIQRLGAYLLEGLRARLESSGNLIYKSLKCEQPTSKELMSYMHILYQICPYWKFAYISANAVIQETMANESRIHIIDFQIAQGTQWHLLIQALAHRPGGPPSLRVTGVDDSQSTHARGGGLWIVGERLSDFARSCGVPFEFHSAAISGCEVVRGNIEIRAGEALAVNFPYVLHHMPDESVSTENHRDRLLRLVKSLSPKVVTFVEQESNTNTSPFFQRFVETLDYYTAMFESIDVACPRDDKKRISAEQHCVARDMVNMIACEGVERVERHELFGKWRSRLSMAGFKQCQLSSSVMVATQNLLKEFSQNYRLEHRDGALYLGWMNRHMATSSAWR

SEQ ID NO: 131462 - protein, 376 aa, Glycine max
  Coding DNA Sequence Number=SeqID_14684
  Gene Ontology: Mol. function=protein kinase activity; Cellular component=integral to membrane; Biological process=protein amino acid phosphorylation
  Homolog annotation: Hit_ID=Q949V3; Match level="QueryCoverage=91%, HitCoverage=50%, E-value=1e-130, Identity=70%"; Hit description =Putative receptor protein kinase
  Pfam annotation: Domain name=Pkinase; Domain location=52-335; Score =60.7; E_value=4.7e-15; Accession=PF00069.15; Description=Protein kinase domain
  Pfam annotation: Domain name=Pkinase_Tyr; Domain location=51-335; Score=36.3; E_value=1.1e-14; Accession=PF07714.7; Description =Protein tyrosine kinase
  Pfam module annotation: Pfam domain module=Pkinase::Pkinase_Tyr; Domain location=52-335::51-335
KPVVAARAVAPAEAGTSSSKEDITGGSAEAERNKLVFFEGGIYSFDLEDLLRASAEVLGKGSVGTSYKAVLEEGTTVVVKRLKDVVVTKKEFETQMEVLGKIKHENVVPLRAFYFSKDEKLLVYDYMSAGSLSALLHALMGGSGLLSKMIMEVGRSRGSGRTPLDWDSRMKIALGAARGLTCLHVAGKVVHGNIKSSNILLRGPDHNAGVSDFGLNPLFGNGAPSNRVAGYRAPEVVETRKVSFKSDVYSFGVLLLELLTGKAPNQASLGEEGIDLPRWVQSVVREEWTAEVFDAELMRFHNIEEEMVQLLQIAMACVSLVPDQRPNMQDVVRMIEDINRGETDDGFRQSSDDPSKGSEGHTPPPESRTPPSSLTP

SEQ ID NO: 131463 - protein, 165 aa, Glycine max
  Coding DNA Sequence Number=SeqID_14685
MEREEERERRRVRDKQRRQSMNKEQRERHLARRRRNYQLRRQRSANNAPLMAEALSTPSNSSFQILQGSSIPLEAFPRRLRLNAIKRLARNLGTPMTVPPSIANHPVAPDLISLSASSADDGSIITKSKPLRLNCVKRLARSLSFPAEKTAPQNNHNGIIVSGIL

SEQ ID NO: 131464 - protein, 66 aa, Glycine max
  Coding DNA Sequence Number=SeqID_14686
MEHARLWLWWCECGPNSHGHRKWWERNLVRELQCCPWCGVSICEEKKKGVENRLAGVDNSVLRVLI

SEQ ID NO: 131465 - protein, 425 aa, Glycine max
  Coding DNA Sequence Number=SeqID_14687
  Gene Ontology: Mol. function=binding; Cellular component=ubiquitin ligase complex; Biological process=intracellular signaling cascade
  Homolog annotation: Hit_ID=Q1S238; Match level="QueryCoverage=96%, HitCoverage=92%, E-value=1e-141, Identity=67%"; Hit description=IMP dehydrogenase/GMP reductase
  Pfam annotation: Domain name=Arm; Domain location=169-209; Score =35.8; E_value=1.5e-07; Accession=PF00514.13; Description =Armadillobeta-catenin-like repeat
  Pfam annotation: Domain name=Arm; Domain location=210-250; Score =13.1; E_value=0.28; Accession=PF00514.13; Description=Armadillobeta -catenin-like repeat
  Pfam annotation: Domain name=Arm; Domain location=251-291; Score =30.5; E_value=5.8e-06; Accession=PF00514.13; Description =Armadillobeta-catenin-like repeat
  Pfam annotation: Domain name=Arm; Domain location=292-332; Score =10.0; E_value=0.68; Accession=PF00514.13; Description=Armadillobeta -catenin-like repeat
  Pfam annotation: Domain name=Arm; Domain location=333-373; Score =19.7; E_value=0.01; Accession=PF00514.13; Description=Armadillobeta -catenin-like repeat
  Pfam annotation: Domain name=Arm; Domain location=375-415; Score =16.0; E_value=0.12; Accession=PF00514.13; Description=Armadillobeta -catenin-like repeat
  Pfam module annotation: Pfam domain module=Arm::Arm::Arm::Arm::Arm::Ar m; Domain location=169-209::210-250::251-291::292-332::333-373::375 -415
MVSAEKDSNETHRTIIGKSMRTVRSKIFQHDHATCVSDNLTGSLMELASRNNKSVKSSITEEQLLELSQALSDFSACSSDISGELQRLATVSSSQPPAAAADIHGQPQPEPEPCLGFLQRESFSTEIIESISPEDLQPTVKICVDGLLSPSLAVKRSAAAKLRLLAKNRADNRALIGESGAVAALVPLLRCSDPWTQEHAVTALLNLSLLEENKALITNAGAVKSLIYVLKRGTETSKQNAACALMSLALVEENKRSIGTCGAIPPLVALLLGGSQRGKKDALTTLYKLCSVRQNKERAVSAGAVRPLVELVAEQGSGMAEKAMVVLNSLAGIEEGKEAIVEEGGIAALVEAIEVGSVKGKEFAVLTLYQLCAETVTNRALLVREGGIPPLVALSQSSPVRAKLKAETLLGYLRESRHEASCSSP

SEQ ID NO: 131466 - protein, 310 aa, Glycine max
  Coding DNA Sequence Number=SeqID_14688
  Gene Ontology: Mol. function=sugar porter activity; Cellular component=integral to membrane; Biological process=carbohydrate transport
  Homolog annotation: Hit_ID=Q1S240; Match level="QueryCoverage=92%, HitCoverage=68%, E-value=2e-53, Identity=63%"; Hit description=Sugar transporter superfamily
  Pfam annotation: Domain name=Sugar_tr; Domain location=1-285; Score= -145.5; E_value=0.026; Accession=PF00083.14; Description=Sugar (and other) transporter
MAPGTRRWMLGVAGIPALLGFILMLSLPESPRWLYIKKEEAEEILLRIYRPSEIEEEMRAMQDSVETEKEEEELNGKLSLTQKLKGAFKNDVVRRGSSCSAVCGHQHSHAAQNAPCISNHDTSLLVETLRARLTQMPLLSLHGTACNAYRQIVPTVIIKNQSRPWTRNDLRLSNIFPPGACLAAEKSVRGVCRAAYAPGMGTVPWVLNSEIYPLRYRGLGGGIAAVSNWCANLIMSNSFLSMTESLGAAGTFLLFAGFSLVPIVAIYLLVPETKGLQFEEVEKLLQDGLDLSHLTRRTTKSRKRRMTPSN

SEQ ID NO: 131467 - protein, 150 aa, Glycine max
  Coding DNA Sequence Number=SeqID_14689
  Subcellular localization annotation: CTP_CleavageSite=27; ConfidenceScore=5.50e-01
MASFWPFLAMFMALMACNCSSLASASRQSMHVSTISAAPTTLPGAPLYYSPTMSPDIEPLFPTPGGSAFSPSESSIPTIPSSPSPPNPDVTNSPGSVLAFPPSESMPAMAPSSKGASLPVYSVLHLAILIDVGVSGYVLEACYDSINCSV

SEQ ID NO: 131468 - protein, 424 aa, Glycine max
  Coding DNA Sequence Number=SeqID_14690
  Gene Ontology: Cellular component=integral to membrane
  Homolog annotation: Hit_ID=Q9FGK4; Match level="QueryCoverage=84%, HitCoverage=89%, E-value=1e-100, Identity=50%"; Hit description =Arabidopsis thaliana genomic DNA, chromosome 5, P1 clone:MNJ7
  Pfam annotation: Domain name=Cytochrom_B561; Domain location=208-406; Score=-81.1; E_value=0.056; Accession=PF03188.6; Description =Cytochrome b561
  Pfam annotation: Domain name=DUF568; Domain location=115-240; Score =166.8; E_value=5.4e-47; Accession=PF04526.4; Description=Protein of unknown function (DUF568)
  Pfam module annotation: Pfam domain module=Cytochrom_B561::DUF568; Domain location=208-406::115-240
  Subcellular localization annotation: CTP_CleavageSite=40; ConfidenceScore=5.62e-01
MEPPHAPTLKRQGKPTKTLWSSTKSSISMLRLVLGLSVLSCVLVTSSAQTCRNQTFSNRVFATCRDLPQLTAYLHWTYDQASGRLEIAFKHAGITSTNRWVAWAINPRNTLDPAMIGAQALVAIPQSNGSPRAYASSITSTSTTLEEGAISYPLSGLSATFENNEVTIFATLTLPNGTTSFVHVWQDGPLSGTTPREHSHETSHQNSKEILDLLSGSSTQPTGNSRQRRRNTHGVLNAVSWGILMPTGAIIARYLKVFKSADPTWFYLHITCQASAYIVGVSGLGTGLKLGSDSEGVDYDTHRALGIVLVCLGTLQVFALFLRPNKDHKYRVYWNVYHHLVGYATIIISVVNIFEGFETIEKYVGDRYNSWKHAYIGIIGALAGIAVFLEAFTWIIVFKRRKSENKIPHGANGANGYGSRPQQV

SEQ ID NO: 131469 - protein, 884 aa, Glycine max
  Coding DNA Sequence Number=SeqID_14691
  Gene Ontology: Mol. function=hydrolase activity; Cellular component =intracellular; Biological process=metabolic process
  Homolog annotation: Hit_ID=Q9ZUW3; Match level="QueryCoverage=92%, HitCoverage=93%, E-value=0.0, Identity=42%"; Hit description =Putative selenium-binding protein
  Pfam annotation: Domain name=PPR; Domain location=169-203; Score =31.8; E_value=2.5e-06; Accession=PF01535.11; Description=PPR repeat
  Pfam annotation: Domain name=PPR; Domain location=204-238; Score=0.7; E_value=6.2; Accession=PF01535.11; Description=PPR repeat
  Pfam annotation: Domain name=PPR; Domain location=270-304; Score =33.0; E_value=1.1e-06; Accession=PF01535.11; Description=PPR repeat
  Pfam annotation: Domain name=PPR; Domain location=305-339; Score=3.4; E_value=2.9; Accession=PF01535.11; Description=PPR repeat
  Pfam annotation: Domain name=PPR; Domain location=372-406; Score =52.6; E_value=1.3e-12; Accession=PF01535.11; Description=PPR repeat
  Pfam annotation: Domain name=PPR; Domain location=469-503; Score =41.7; E_value=2.5e-09; Accession=PF01535.11; Description=PPR repeat
  Pfam annotation: Domain name=PPR; Domain location=571-605; Score =55.3; E_value=2.1e-13; Accession=PF01535.11; Description=PPR repeat
  Pfam annotation: Domain name=PPR; Domain location=606-639; Score=7.1; E_value=1.1; Accession=PF01535.11; Description=PPR repeat
  Pfam annotation: Domain name=PPR; Domain location=642-675; Score=9.2; E_value=0.61; Accession=PF01535.11; Description=PPR repeat
  Pfam annotation: Domain name=PPR; Domain location=68-102; Score=6.7; E_value=1.2; Accession=PF01535.11; Description=PPR repeat
  Pfam annotation: Domain name=PPR; Domain location=708-742; Score=0.0; E_value=7.4; Accession=PF01535.11; Description=PPR repeat
  Pfam module annotation: Pfam domain module=PPR::PPR::PPR::PPR::PPR::PP R::PPR::PPR::PPR::PPR::PPR; Domain location=169-203::204-238::270 -304::305-339::372-406::469-503::571-605::606-639::642-675::68 -102::708-742
MTLNMTLRALTNTSTNPILRIRRYQLHCHANPLLQSHVVALNARTLLRDSDPRFAQQLFDQTPLRDLKQHNQLLFRYSRCDQTQEALHLFVSLYRSGLSPDSYTMSCVLSVCAGSFNGTVGEQVHCQCVKCGLVHHLSVGNSLVDMYTKTGNVRDGRRVFDEMGDRDVVSWNSLLTGYSWNRFNDQVWELFCLMQVEGYRPDYYTVSTVIAALANQGAVAIGMQIHALVVKLGFETERLVCNSLISMLSKSGMLRDARVVFDNMENKDSVSWNSMIAGHVINGQDLEAFETFNNMQLAGAKPTHATFASVIKSCASLKELGLVRVLHCKTLKSGLSTNQNVLTALMVALTKCKEIDDAFSLFSLMHGVQSVVSWTAMISGYLQNGDTDQAVNLFSLMRREGVKPNHFTYSTILTVQHAVFISEIHAEVIKTNYEKSSSVGTALLDAFVKIGNISDAVKVFELIETKDVIAWSAMLAGYAQAGETEEAAKIFHQLTREGIKPNEFTFCSIINACTAPTASVEQGKQFHAYAIKLRLNNALCVSSSLVTLYAKRGNIESAHEIFKRQKERDLVSWNSMISGYAQHGQAKKALEVFEEMQKRNLEVDAITFIGVISACAHAGLVGKGQNYFNIMINDHHINPTMEHYSCMIDLYSRAGMLGKAMDIINGMPFPPAATVWRIVLAASRVHRNIELGKLAAEKIISLEPQHSAAYVLLSNIYAAAGNWHEKVNVRKLMDKRRVKKEPGYSWIEVKNKTYSFLAGDLSHPLSDHIYSKLSELNTRLRDVGYQPDTNYVFHDIEDEQKETILSHHSERLAIAFGLIATLPEIPLQIVKNLRVCGDCHSFIKLVSLVEKRYIVVRDSNRFHHFKGVTGEYDDVGSPLLDRPL

SEQ ID NO: 131470 - protein, 467 aa, Glycine max
  Coding DNA Sequence Number=SeqID_14692
  Gene Ontology: Mol. function=1-phosphatidylinositol-4-phosphate 5 -kinase activity; Biological process=phosphatidylinositol metabolic process
  Homolog annotation: Hit_ID=Q9SFB8; Match level="QueryCoverage=92%, HitCoverage=60%, E-value=1e-179, Identity=68%"; Hit description =Phosphatidylinositol-4-phosphate 5-kinase 6 (EC 2.7.1.68) (AtPIP5K6) ...
  Homolog annotation: Hit description=(1-phosphatidylinositol-4 -phosphate kinase 6) (PtdIns(4)P-5-kinase 6)
  Pfam annotation: Domain name=MORN; Domain location=109-131; Score =31.8; E_value=2.4e-06; Accession=PF02493.10; Description=MORN repeat
  Pfam annotation: Domain name=MORN; Domain location=132-154; Score =27.7; E_value=4.2e-05; Accession=PF02493.10; Description=MORN repeat
  Pfam annotation: Domain name=MORN; Domain location=155-177; Score =34.1; E_value=4.8e-07; Accession=PF02493.10; Description=MORN repeat
  Pfam annotation: Domain name=MORN; Domain location=178-200; Score =30.8; E_value=4.9e-06; Accession=PF02493.10; Description=MORN repeat
  Pfam annotation: Domain name=MORN; Domain location=201-223; Score =18.5; E_value=0.02; Accession=PF02493.10; Description=MORN repeat
  Pfam annotation: Domain name=MORN; Domain location=225-246; Score =10.4; E_value=0.29; Accession=PF02493.10; Description=MORN repeat
  Pfam annotation: Domain name=MORN; Domain location=62-85; Score=22.6; E_value=0.0014; Accession=PF02493.10; Description=MORN repeat
  Pfam annotation: Domain name=MORN; Domain location=86-108; Score =26.2; E_value=0.00011; Accession=PF02493.10; Description=MORN repeat
  Pfam module annotation: Pfam domain module=MORN::MORN::MORN::MORN::MOR N::MORN::MORN::MORN; Domain location=109-131::132-154::155-177::178 -200::201-223::225-246::62-85::86-108
MNKELTSFVKAWEAAVRKSAGPKKRANSIFTPMSVAHVDDDDDARNVIVGEVEKILPNGDFYTGQWLDNNGPHGQGKYLWTDGCMYVGEWQKGGIMGKGRFSWPSGATYEGDFKSGYMDGKGTYIGSSGDTYKGCWVMELRHGQGTQSYPNGDFYDGEWRKGLQNGHGRYQWKNGNHYIGQWRNGLFYGNGTMMWSNGNRYDGCWEEGLPMGNGTFRWGGDGSFYVGVWSKDPKEQSGTYYPSGSCAGHLEWDPQELFSVDLVECSVCSLEKVAIYPSQKSLNMLEVDKMCKKGTDGNGRPKRMSVDARISNYSSEDGSYSSYDVSRSSQVDNSIPRVPHLRLKAPKRQGETISKGHKNYELMLNLQLGIRHAVGRPAPSTSLDLKSSAFDPKEKVWTKFPPEGSKHTPPHPSCEFRWKDYCPVVFRALRKLFKVDPADYMISLCGNDALRELSSPGKSGSFFLFDQ

SEQ ID NO: 131471 - protein, 262 aa, Glycine max
  Coding DNA Sequence Number=SeqID_14693
  Gene Ontology: Mol. function=nucleoside-triphosphatase activity; Cellular component=membrane; Biological process=proteolysis
  Homolog annotation: Hit_ID=Q93WX4; Match level="QueryCoverage=99%, HitCoverage=74%, E-value=7e-73, Identity=58%"; Hit description =Suppressor of K+ transport growth defect-like protein
  Pfam annotation: Domain name=AAA; Domain location=1-179; Score=-23.0; E_value=0.012; Accession=PF00004.19; Description=ATPase family associated with various cellular activities (AAA)
  Pfam annotation: Domain name=Vps4_C; Domain location=194-259; Score =135.1; E_value=1.9e-37; Accession=PF09336.1; Description=Vps4 C terminal oligomerisation domain
  Pfam module annotation: Pfam domain module=AAA::Vps4_C; Domain location=1-179::194-259
MARESAPSIIFIDEIDSLCGQRGEGNESEASRRIKTELLVQMQHLSLLFKQFQVMIANNYIHLRFKVPLSVYAACPVLSCACLMRCSYFTNKVAYFQLGFGSSKVRECTLEDKGVGHNDQKVLVLAATNTPYALDQVHLGDTPHNLTESDFEYLASRTEGFSGSDISVCVKDVLFEPVRKTQDAMFFLKNPEGMWIPCGPKQQGAVQTSMQELAAKGLASKILPPPITRTDFEKVLARQRPTVSKADLDVHERFTKEFGEEG

SEQ ID NO: 131472 - protein, 1042 aa, Glycine max
  Coding DNA Sequence Number=SeqID_14694
  Gene Ontology: Mol. function=transcription regulator activity; Cellular component=nucleus; Biological process=regulation of transcription
  Homolog annotation: Hit_ID=Q652L2; Match level="QueryCoverage=94%, HitCoverage=99%, E-value=0.0, Identity=70%"; Hit description =Putative HIRA
  Pfam annotation: Domain name=Hira; Domain location=697-898; Score =248.6; E_value=1.3e-71; Accession=PF07569.2; Description=TUP1-like enhancer of split
  Pfam annotation: Domain name=WD40; Domain location=115-153; Score =47.3; E_value=5.3e-11; Accession=PF00400.22; Description=WD domain, G-beta repeat
  Pfam annotation: Domain name=WD40; Domain location=157-195; Score =41.5; E_value=2.8e-09; Accession=PF00400.22; Description=WD domain, G-beta repeat
  Pfam annotation: Domain name=WD40; Domain location=262-333; Score =27.4; E_value=5.1e-05; Accession=PF00400.22; Description=WD domain, G-beta repeat
  Pfam annotation: Domain name=WD40; Domain location=338-376; Score =10.0; E_value=2.5; Accession=PF00400.22; Description=WD domain, G -beta repeat
  Pfam annotation: Domain name=WD40; Domain location=4-41; Score=22.0; E_value=0.0022; Accession=PF00400.22; Description=WD domain, G-beta repeat
  Pfam annotation: Domain name=WD40; Domain location=56-94; Score=36.0; E_value=1.3e-07; Accession=PF00400.22; Description=WD domain, G-beta repeat
  Pfam module annotation: Pfam domain module=Hira::WD40::WD40::WD40::WD4 0::WD40::WD40; Domain location=697-898::115-153::157-195::262 -333::338-376::4-41::56-94
MIAEKPSWVRHEGMQIFSIDVQPGGLRFATGGGDHKVRIWNMKSVSTDIENDASSQRLLATLRDHFGSVNCVRWAKHGRYVASGSDDQVILIHERKPGSGTTEFGSGEPPDIENWKVAMTLRGHTADVVDLNWSPDDSALASGSLDNTIHVWNMSNGICTAVLRGHSSLVKGVAWDPIGSFIASQSDDKTVIIWRTSDWSLAHRTDGHWAKSLYFLINLSSHQLGSTFFRRLGWSPCGHFITTTHGFQKPRHSAPVLERGEWSATFDFLGHNAPIIVVKFNHSMFRRNLTNAQEVKPVPVGWTNGASKTGSKEPQPYNVIAIGSQDRTITVWTTASPRPLFVAKHFFTQSVVDLSWSPDGYSLFACSLDGSVATFHFEVKELGQRLGDAELDELKRSRYGDVRGRKANLAESPAQLLLEAASAKQTPSKKVVSDVQQNQTKAAYVDAVVNAKNAEPQNDDGKKSGGPVGDVSNKAATAGRISSPVKQREYRRPDGRKRIIPEAVGMPVQQENISGAVQQALDFPIVSSDHRKDTERALSSDDGARVSTLGGAHGRNTDLKERSGVTARATISESLMIEKVPASAGDGSVNVEQSGNLMSSSSLAACSGTLSIRVFDKKSGEDSSPIHLEARPREHAVNDIVGLGNTSIMKETEIVCSKGPQTLWSDRISGKVTVLAGNGNFWAVGCEDGCLQIYTKCGRRAMPTMMMGSATTFVDCDECWTLLLVTRKGSLYMWDLFNQTCLLQDSLTSLVASSPNSYGKDAGTIKVISVKLSKSGSPLVVLATRHAFLFDMNVKCWLRVADDCFPASNFSSSWSLGSIQSGELAALQVDLRKYLARKPGWTRVTDDGVQTRAHLETQLASSLALGSPNEYRQCLLSYVRFLAREADESRLREVCESFLGPPTGMVEETSSDSKNLAWDPFVLGMRKHKLLREDILPSMASNRKVQRLLNEFMDLLSEYEIIDANQEQTNPTVPNSSLPETNPIESSSLATDREHTAPPKLEHNTPLEKEQINFPPALANEASADTPMTDQANQDAQVKESA

SEQ ID NO: 131473 - protein, 196 aa, Glycine max
  Coding DNA Sequence Number=SeqID_14695
MFVIRAGGEVVDNDNPGLDVGEVAGAEHEAEEGGSVERVVDLGDGDSEEVEAVGVEAVKLAFIAEAHDDGLGTHEKRECVLVRELKDQATEVGGVREVHGVGVSEPSFFSVVVVKEGEKLVQVPRRLLSLEGREWGFLKKVQLRVGSGATWCTDYLGAWAQKGRLYFRLASSTIETVDIEILRGIDSSSSYEINVK

SEQ ID NO: 131474 - protein, 110 aa, Glycine max
  Coding DNA Sequence Number=SeqID_14696
MEILEVVAGLKKMMKKPGMTKESIGAEKRKGNEVDDIDNVGIGNIFKRRAVSSQDTNNPMFKKGLDVANLDLDAPIQDENLVEDQEIEDRDEDLVQDQVGEETLGDHDMI

SEQ ID NO: 131475 - protein, 586 aa, Glycine max
  Coding DNA Sequence Number=SeqID_14697
  Gene Ontology: Mol. function=nucleic acid binding; Cellular component= intracellular; Biological process=DNA integration
MVEKDKKVLLEKAHSVIILSLGDEMVTQVSKEKTVKNIGVIIDDEDQALLLLCSLPRSHVYFKESLMFGRDSLSLEEVQATLNSKELNERKDLKASFMREGLVVKGKSHKKENKGHTKKYCPERQNINGGNDRQKDLRDVANKRNGSWTLDVPGFVFLGANKSSKIAGIGSIRFKLHDGNERLLTEVSAHLPKTFWAETVVIATYLITRCYSTTFDMKTLEEIWSSHPPKLDQLQVFGCVAYAHIRKHDQVVENYLLSDEDDEESEQQTSELDNYQLASDRVRIETKVPKRYGYADLIAFALISASKVLEEKPKSYEEAHASKEKGKWLTTLNEEIKSLHDNNTWELIRKPHGSKLVSCKWIYKRKEGILGFTQKKGINYNEVSSPVVKHRSIRLLLAVVTKLDIEFEQMDVKTSFLYGELKETILMKQLEGFVVKGKENYVSKGTFVILLLYVDDILIASNFKLQINKVKESYLKKVLEKFGITNLKSVITALCQQFKLSAYQSPKTAEEVNYMDNVPYENLVESLRPDIAHVVSLVSRFMSNPRRAQWQALKRILRYIKGSLSRVLVYGGAKEGEQDYKCLMFF

SEQ ID NO: 131476 - protein, 88 aa, Glycine max
  Coding DNA Sequence Number=SeqID_14698
MEFPRRMNIKVVLNLPYSGDVEKALEEKEKGRKQQEVCKKKTLNVEEPTTKGRNVDVIHPQNNEEPITNVDVSNKHMEKSTTTTPPNP

SEQ ID NO: 131477 - protein, 163 aa, Glycine max
  Coding DNA Sequence Number=SeqID_14699
METKFMASLEDKRKLVKALNEKNSFMIRKIEIIKGLQNKIIDHEKMVSMKVVENEKLVKEIKSMNMNFYFAVKDLAETKNILQQAFMIGHEDGFKNALRQLGLFTSNINLEKFNVLKDVKDEELVRESQMESSEEASNNEMISKADDVEATSNFVLPLNPLMT

SEQ ID NO: 131478 - protein, 76 aa, Glycine max
  Coding DNA Sequence Number=SeqID_14700
ILLSLGLRVVYFRPSDLLFQWWVEYLKRDTVLVLGEGSIAASEVVIAHDIHEDVVWTTFMKMKELKDNMSYASEAT

SEQ ID NO: 131479 - protein, 222 aa, Glycine max
  Coding DNA Sequence Number=SeqID_14701
MITTLKLGAFVDSLCKKRLTSMNELRRYAASSIHMEELSEFHDRDKIEELVQRGCINNFVKEINYNHGSYRGGGRGGYIGSRGNNNQKVVREGEQRQQKNSPGVVRGVINTIVSGFTGGGYTNSTIKRHVQALKSVNVDAHECYVKSYKIELYNVMKETDKGKALISSINAIVTTLEDLDPNQILKIDDQHPLRMLTPSQSTRMCINAHKSTSKKKMQCDKK

SEQ ID NO: 131480 - protein, 130 aa, Glycine max
  Coding DNA Sequence Number=SeqID_14702
MSLTNLSWLALGSLKGSSHHIRMALHLHSDDLIFLAQCLQPSFSHFELIFQWWVEYLKRNSNAKVSVCFGETTPKVVITHNVHEDIVWVSGSRLAESDGGVRGWLRVVIWTKPKHSPRASSYKEWKSLMS

SEQ ID NO: 131481 - protein, 298 aa, Glycine max
  Coding DNA Sequence Number=SeqID_14703
  Gene Ontology: Mol. function=nucleic acid binding; Cellular component= intracellular; Biological process=regulation of transcription
  Homolog annotation: Hit_ID=Q1SHX5; Match level="QueryCoverage=76%, HitCoverage=65%, E-value=4e-85, Identity=62%"; Hit description=Zinc finger, C2H2-type
  Pfam annotation: Domain name=zf-C2H2; Domain location=134-156; Score =21.1; E_value=0.0039; Accession=PF00096.16; Description=Zinc finger, C2H2 type
  Pfam annotation: Domain name=zf-C2H2; Domain location=218-240; Score =21.1; E_value=0.0039; Accession=PF00096.16; Description=Zinc finger, C2H2 type
  Pfam annotation: Domain name=zf-C2H2; Domain location=244-269; Score =8.7; E_value=1.2; Accession=PF00096.16; Description=Zinc finger, C2H2 type
  Pfam module annotation: Pfam domain module=zf-C2H2::zf-C2H2::zf-C2H2; Domain location=134-156::218-240::244-269
WLKPSSSSSLTSLISSSPPSYSLTQHEQLAQETIQFLPFKEDQHIRVQKEGFEVKEEKKVEQVTVALHIGLPNTGGHDPDDDNDHDADDEKKVFHVKEEEEPLKKGFQGNCSFNQERRFWIPTPAQILVGPMQFACSICSKTFNRYNNMQMHMWGHGSEFRKGPDSLKGTQPAAMLRLPCYCCAQGCKNNINHPRAKPLKDFRTLQTHYKRKHGAKPFMCRKCSKSFAVKGDWRTHEKNCGKLWYCTCGSDFKHKRSLKDHIRSFGKGHSPHPSLEGFVEDEKECVTGSDDEDDVAHT

SEQ ID NO: 131482 - protein, 117 aa, Glycine max
  Coding DNA Sequence Number=SeqID_14704
MASQLKTMKVEAGKAKQLGLELTKCRGTDIDKKIEDLTLEKKTTEAELGTAMDKMTKMKEALAKMENELRETQRVESALKVELDETKRLIKMNHREGFKKAQRKVKVLLSLTLHNSM

SEQ ID NO: 131483 - protein, 97 aa, Glycine max
  Coding DNA Sequence Number=SeqID_14705
MEKANVGGGFASEMRTEKGAEMEVETIIAEDLMDAAKEKGVKVVKKSVSIVSGDTPSVGLLRSNKVMLHYHKDNERVLHQRFSRTSQPRGLAFHYKK

SEQ ID NO: 131484 - protein, 135 aa, Glycine max
  Coding DNA Sequence Number=SeqID_14706
MADDSKKLAKKDLSRIQTLHRTHIVHHIAIGLAQESGPIKSMFQSDIMLGATEMWPIFKPKEEKVLVADVSLSEADPLSEWHPLSEAYNSLSGLENPRKGSVRDVLAQRTISSPSESVVALNAPSSLSQNSLTLA

SEQ ID NO: 131485 - protein, 178 aa, Glycine max
  Coding DNA Sequence Number=SeqID_14707
MTVVVIAATTVNGDDGGHDSDHGSGGCSDYSNYDTITITISATTSTMIVAMTTVVATNMIAIAVVGTIDNDGDDNNHSNVGGDDDDHSGDHSIGGGGSNDNNNHVGDAKEEKVKVANDLLSEADPLSEMHLLNKASSSLSGWETLEENNSKICSPSAQPIHLARTFSLLALSAPMLAK

SEQ ID NO: 131486 - protein, 236 aa, Glycine max
  Coding DNA Sequence Number=SeqID_14708
  Gene Ontology: Mol. function=adenosine deaminase activity; Biological process=RNA processing
  Homolog annotation: Hit_ID=UPI0000162BF0; Match level="QueryCoverage =59%, HitCoverage=43%, E-value=4e-43, Identity=60%"; Hit description =RNA binding / adenosine deaminase
  Pfam annotation: Domain name=A_deamin; Domain location=4-195; Score= -158.8; E_value=0.014; Accession=PF02137.9; Description=Adenosine -deaminase (editase) domain
MAASFQLDCVSPVTMAAPSHVSSFLVTADGGALLSYFLQPVYLSSITVGLPLDILENFRLEDSLKRALYERMLPLSNELTSPFLVNQPIFHAAPVPPKDFQQSESAANTLTCGYSICWNECGLHDVIMGTTGRKQGTSAKGALYPSTQSSLCKKRLLEVFLSLGPENLIGSLPNGITYRELKAHLWLCKLNWMQESNFCQLAHAPSLSSPVDHQDVFRLDSSMESIVTHRWIVSSH

SEQ ID NO: 131487 - protein, 408 aa, Glycine max
  Coding DNA Sequence Number=SeqID_14709
  Gene Ontology: Mol. function=diacylglycerol kinase activity; Cellular component=intracellular; Biological process=protein kinase C activation
  Homolog annotation: Hit_ID=Q8GRU0; Match level="QueryCoverage=96%, HitCoverage=61%, E-value=2e-87, Identity=41%"; Hit description =Pentatricopeptide (PPR) repeat-containing protein-like
  Pfam annotation: Domain name=PPR; Domain location=141-175; Score =37.1; E_value=6.3e-08; Accession=PF01535.11; Description=PPR repeat
  Pfam annotation: Domain name=PPR; Domain location=176-210; Score=3.9; E_value=2.6; Accession=PF01535.11; Description=PPR repeat
  Pfam annotation: Domain name=PPR; Domain location=212-246; Score =14.1; E_value=0.16; Accession=PF01535.11; Description=PPR repeat
  Pfam annotation: Domain name=PPR; Domain location=278-312; Score =12.5; E_value=0.24; Accession=PF01535.11; Description=PPR repeat
  Pfam annotation: Domain name=PPR; Domain location=38-72; Score=41.7; E_value=2.5e-09; Accession=PF01535.11; Description=PPR repeat
  Pfam module annotation: Pfam domain module=PPR::PPR::PPR::PPR::PPR; Domain location=141-175::176-210::212-246::278-312::38-72
MPQRDLVSCNAMIDGYGKHGMCELAEEVFMDMGVRDVVTWTSMISAFVLNHQPRKGLCLFREMLSLGVRPDAPAVVSVLSAIADLGFLEEGKWVHNYIFTNKVHQSCSFIGSALINMYAKCGRIENAYHVFRSLCHRQNIGDWNSMISGLALHGLGREAIEIFQDMERVELEPDDITFLGLLSACNHGGLMDEGQFYFETMQVKYKIVPKIQHYGCIVDLFGRAGRLEEALGVIDEMPFEPDVLIWKAILSASMKHNNVVMGHTAGLRAIELAPQDSSCYVLLSNIYAKAGRWDDVSKVRSLMRKRRVRKIPGCSSILADGKVHEFLVGKAMDVGYNQSVLSMLEEIVCKLKSEGYEPDLNQVFIDIEGGEKESQLTLHSEKMALAFGLLNSHQGSCSWFQKSTTVEL

SEQ ID NO: 131488 - protein, 315 aa, Glycine max
  Coding DNA Sequence Number=SeqID_14710
  Gene Ontology: Mol. function=hydrolase activity; Cellular component =cellulose and pectin-containing cell wall
  Homolog annotation: Hit_ID=Q6ESF3; Match level="QueryCoverage=98%, HitCoverage=89%, E-value=1e-89, Identity=46%"; Hit description =Hydrolase, alpha/beta fold protein-like
  Pfam annotation: Domain name=Abhydrolase_1; Domain location=93-311; Score=5.6; E_value=0.0029; Accession=PF00561.10; Description =alphabeta hydrolase fold
MVIPIAVSLVVILIGLAYKAVKPPPPKICGSVGGPEVASPRVKLSDGRHLAYREFGVPKEEARYKIIVIHGYDSSKDTSLPVSQELVEDLGIYFLHFDRAGYGESDPHSLRSVKSEAYDIQELADKLEIGHKFYIIGAALVAPFISYWWPSYPENLLREAFLMLPHSDQWTFRVSHYAPWLFYWWMTQKWFPSLTLTNLLSPDDIEIVKSLSELQNTGQERITQQGEYESLHRDIMSAFGKWEFGPTDITNPFPDNNGSVHIWQGFEDRIIPYTLNRYISHKLPWIRYHELPHAGHLFLFKKNECESIIRALVLT

SEQ ID NO: 131489 - protein, 379 aa, Glycine max
  Coding DNA Sequence Number=SeqID_14711
  Gene Ontology: Mol. function=hydrolase activity; Cellular component =cellulose and pectin-containing cell wall; Biological process =electron transport
  Homolog annotation: Hit_ID=UPI000034F44F; Match level="QueryCoverage =80%, HitCoverage=96%, E-value=1e-109, Identity=60%"; Hit description= catalytic
  Pfam annotation: Domain name=Abhydrolase_1; Domain location=118-359; Score=26.2; E_value=7.2e-05; Accession=PF00561.10; Description =alphabeta hydrolase fold
MATDRQKKMLLIWNLSKDILKEMTSKSQKHKYKRTHNTILFYFKEEGTQLSPNHNGSSDDFPVVSPRIKLRDGRHLAYIERGVPKDIAKYKIVIVHGFGSSKEMNFLAPQELIDELGIYLLQYDRAGYGESDPNPKRSLKSEALDIQELADQLQLGPQFYVIGVSMGSYATWSCLKYLPHRLAGLALIAPVINYRWPSFPKRLIREDYRRKLVQWCMWLANHWPRLLHWWVTQKWLPSTAVIEKNPAFFNKSDVDILKTIPGFPMLPKDSLREKAVFDTLRHDWRVAFGKWEFDPMKLSNPFPHNTGSFHIWHGYEDKVVPSELQRFVSGKLPWIQYHEVPDGGHLIIYYRGLCEAILKALLLGQENVAYRSKAPLFES

SEQ ID NO: 131490 - protein, 250 aa, Glycine max
  Coding DNA Sequence Number=SeqID_14712
  Homolog annotation: Hit_ID=UPI0000610B0D; Match level="QueryCoverage =54%, HitCoverage=46%, E-value=1e-07, Identity=31%"; Hit description =PCTP-like protein (PCTP-L) (StAR-related lipid transfer protein 10) (StARD10) ...
  Homolog annotation: Hit description=(START domain-containing protein 10) (Serologically defined colon cancer antigen 28) (Antigen NY-CO -28).
  Pfam annotation: Domain name=START; Domain location=23-246; Score= -13.2; E_value=0.0011; Accession=PF01852.10; Description=START domain
MILLKRSISEDSLRRYVQFASESCIQELLAASVTNKGNGNDGWKVLTLENGVEISKRRSDSLHTFRSRWVLRSVSPQQFITVANAIDAAKVNTNFLMGGEREKRGKENQQWDSDLVEARYIKDLEDNLSIIRLRFGDNSKPLFRNREFIVYERRETMEDGTLVVAVASLPKEIAAGLHPKQSNAIRGLLLQSGWVVEKLEDDSCVVTYVVQLDPAGWLPKCFVNRFNTKLVMIIENLKKLAQACPSEGEI

SEQ ID NO: 131491 - protein, 574 aa, Glycine max
  Coding DNA Sequence Number=SeqID_14713
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=90%, HitCoverage=94%, E-value=1e-126, Identity=47%"; Hit description =Protein kinase
  Pfam annotation: Domain name=LRRNT_2; Domain location=15-51; Score =10.5; E_value=0.069; Accession=PF08263.3; Description=Leucine rich repeat N-terminal domain
  Pfam annotation: Domain name=Pkinase; Domain location=305-526; Score =55.9; E_value=1.3e-13; Accession=PF00069.15; Description=Protein kinase domain
  Pfam annotation: Domain name=Pkinase_Tyr; Domain location=305-520; Score=43.9; E_value=3.6e-15; Accession=PF07714.7; Description =Protein tyrosine kinase
  Pfam module annotation: Pfam domain module=LRRNT_2::Pkinase::Pkinase _Tyr; Domain location=15-51::305-526::305-520
MYKISVTESYSLAVISNAGIKLLSLMDTWKNTPPNWVGSDPCDDWEGIKCKNSRITSITLASTGLAGQLSGDIGSLSELETLLKDNPVCQENGELESYRSSSQPNFSYSTPPNNCQPCTCSSEQIPSPNCICAYPYSGTLTFRSLPFSDFDNKTYSSMLEEGLMQSFKSHFLPVDSVLLSHLRKDSTQYLELSLQTFKPPEVFGPFCFRGDKYEHFGNSEGLSESSKSSSIGIIIGAAVGGLVLLVLLLLSGLYAFRQKKRAEKAIGQSNPFRRWDTASSNREIPQLKEARIFSFEKLKKYTKIFSQVNDIGSGGFGKGKLEFKGEIERLSRVHHKNLVSLMGFCFEHEEQMLVYEYVQNGSLKDALSGKSGIRLDWIRRLKIALGTARGLAYLHELVNPPIIHRDIKSNNILLDDRLNATVADFGLSKSMVDSEKDHVTTQVKGTMGYLDQEYDMSQQLTEKSDVYSFGVLMLELISARRPLERGKYIVKEVKNALDKTKGLYESGSDRPEMSEVVREIENILKSAGANPTEESPSISSSYEEVSRGSSSHPYNTNDTFDFSAGPPYPKLGPK

SEQ ID NO: 131492 - protein, 123 aa, Glycine max
  Coding DNA Sequence Number=SeqID_14714
  Homolog annotation: Hit_ID=Q75LE1; Match level="QueryCoverage=81%, HitCoverage=32%, E-value=2e-22, Identity=57%"; Hit description =Expressed protein
  Pfam annotation: Domain name=DUF901; Domain location=1-117; Score= -11.3; E_value=2e-07; Accession=PF05991.2; Description=Protein of unknown function (DUF901)
MEDVLESPACLAFECEIQTVINELVAALKEDGCPKVWVVTSDHCHQQAAHGAIYTAADFQGAFIWSCKALVTEIKASQKEVERMLQEQRSTSFQGRLLKHNLDAEVVDALKDLRLKLSENELK

SEQ ID NO: 131493 - protein, 191 aa, Glycine max
  Coding DNA Sequence Number=SeqID_14715
  Homolog annotation: Hit_ID=Q2A9T4; Match level="QueryCoverage=45%, HitCoverage=27%, E-value=3e-21, Identity=58%"; Hit description=MO25 protein-related
DQHLHRHDLVIVVVMVVMTIATIMMVTVDDNDDDDKKVMVTEVMTMMIYGDECKDAHGNDNVNHDGDGNIERDRQSDVGERKKGMNERGMAVLYSPPDSPTMKSLFKPKPRTPSDIVKQTRDLLLRLTSRDDDNMPDLTKNLRDLKSILYGNSESEPVPEACAQLTQEFFADNTLRLLIQYLPKLNLEAIH

SEQ ID NO: 131494 - protein, 100 aa, Glycine max
  Coding DNA Sequence Number=SeqID_14716
MRLTPVPVRLWRYPKEREEKEVTASRLTNRHIITRDNKPPRITYNLLISVFLGVEEEWKNTSDCVLRSFSTQHKGRGTRNKLYMTSSNHQHNEQHLANEL

SEQ ID NO: 131495 - protein, 373 aa, Glycine max
  Coding DNA Sequence Number=SeqID_14717
MTNKARNEICRLSPQKLIHIKHSRGNFTIGILITCVTFFIALHIRFFLQTSPPPSSWESSIFNTTHNELNSTVHKLGSSVTFLPLKDLRYARAPLEGHTWFMSSMYDTHEVGEVQYQQFPSEPSHGKLLCLKGCDTHVGSWNSYALAWPEALPYNTTFMRFKMGLWVDTLMEAMFNGPPIIERFDGVDEDGPLCFEEAVVMRHNEGGMSKKEEWKTGPRSFKNDTIVAEIFRKECAKIEVCRFMVAHSNNLTFCEQVKLMSLTDILISPHGAQLTNMFLMERNSSVMEFFPKGWLKLAGVGQYVYRWISSWSGMKHQGSWRDPSGDECPYSEEDRRCMSIYKNGRIGHNETHFSEWARSVLAEIKTRKIKKLR

SEQ ID NO: 131496 - protein, 404 aa, Glycine max
  Coding DNA Sequence Number=SeqID_14718
  Gene Ontology: Mol. function=isomerase activity; Cellular component =intracellular; Biological process=proteolysis
  Homolog annotation: Hit_ID=Q1S064; Match level="QueryCoverage=95%, HitCoverage=99%, E-value=2e-68, Identity=40%"; Hit description =Cyclin-like F-box; F-box protein interaction domain
  Pfam annotation: Domain name=F-box; Domain location=1-46; Score=34.2; E_value=4.5e-07; Accession=PF00646.23; Description=F-box domain
  Pfam annotation: Domain name=FBA_1; Domain location=195-362; Score= -27.7; E_value=0.00055; Accession=PF07734.3; Description=F-box associated
  Pfam module annotation: Pfam domain module=F-box::FBA_1; Domain location=1-46::195-362
MANLPVEVVTEILSRLPVKSVIRLRSTCKWWRSIIDSRHFILFHLNKSHTSLILRHRSQLYSLDLKSLLDPNPFELSHPLMCYSNSIKVLGSSNGLLCISNVADDIALWNPFLRKHRILPSDRFHRPESSLFAARVYGFGHHPPSNDYKLLSITYFVDLHKRTFDSQVQLYTLKSDSWKNLPSMPYALCCARTMGVFVSGSLHWLVTRKLQPDEPDLIVAFDLTSETFCEVPLPATVNGNFDMQVALLGGCLCVVEHRGTGFHVWVMRVYGSRDSWEKLFSLTENHHHEMGSGKLKYVRPLALDDGDRVLFEHNRSKLCWYDLKTGDVSCVKLPSGIGNTIEGTVCVQSLVPPTLLSLRDESQEKNRKKSFFGRDDFLSKGFKLTLIEGEPKCYSSQFSIPRKR

SEQ ID NO: 131497 - protein, 730 aa, Glycine max
  Coding DNA Sequence Number=SeqID_14719
  Gene Ontology: Mol. function=signal transducer activity; Cellular component=membrane; Biological process=response to light stimulus
  Homolog annotation: Hit_ID=Q1SGA7; Match level="QueryCoverage=92%, HitCoverage=100%, E-value=0.0, Identity=82%"; Hit description =BTB/POZ; NPH3
  Pfam annotation: Domain name=BTB; Domain location=93-199; Score= -11.2; E_value=0.042; Accession=PF00651.21; Description=BTBPOZ domain
  Pfam annotation: Domain name=NPH3; Domain location=282-574; Score =461.2; E_value=1.3e-135; Accession=PF03000.5; Description=NPH3 family
  Pfam module annotation: Pfam domain module=BTB::NPH3; Domain location= 93-199::282-574
  Subcellular localization annotation: CTP_CleavageSite=45; ConfidenceScore=5.42e-01
MWGSSSLFISFLSLLIHFALWFTPSLFFFSHLEATFLGKTSLPCSCVVSSGLVLSMWESESESGAGREYGSGLLTSTKHSVKTEGFQQRGNSWYVSADIPSDLLVQIGDANFHLHKYPLLSRSGKLNRIIYDSRDPDLSKIVMDDLPGGPEAFELASKFCYGIAIDLTSGNISGLRCAAEYLEMTEDLEEGNLIFKTEAFLSYVVLSSWRDSIVVLKSCEKLSPWAENLQIVRRCSESIAWKACANPKGIRWSYTGRAPKVASPKWNDMKNSSPSRNQQVPPDWWFEDVSILRIDHFVRVITAIKVKGMRFELIGAGIMHYATKWLPGLMNIGTAIPGEEGSNSSTSNSSSSNGGGGGSWKGGLHMIVAGPRDDTSTLQAKDQRMIVESLVSIIPPQKDSVSCSFLLRLLRMANNMLKVAPALITELEKRVGMQFEQATLADLLIPCYNKNETTYDVDLVQRLLEHFLVQEQTESSSPSRPPFSDKHVSSNINAKTRVARLVDSYLTEVSRDRNLSLTKFQVLAEALPESARTSDDGLYRAVDSYLKAHPTLTEHERKRLCRVMDCQKLSIDACMHAAQNERLPLRVVVQVLFSEQVKISNALANSSLKEGAESHYQPMIPNRKTLLEGTPQSFQEGWTAAKKDINTLKFELETVKTKYLELQNDMENLQRQFDKLLKQKHTSAWTSGWKKLSKLTKMTNEENHDISPQIPTSEEQNRKTTTRRWRNSIS

SEQ ID NO: 131498 - protein, 65 aa, Glycine max
  Coding DNA Sequence Number=SeqID_14720
KLLPEDNENLPEEASSGNIPDDVLPEVVCEYFRKTQIILPEEGSSGKVPEIIFPESFRKNLLPEE

SEQ ID NO: 131499 - protein, 145 aa, Glycine max
  Coding DNA Sequence Number=SeqID_14721
MVSKLSHGESNDSTAEYDKREAETVDEDPTSTWAQFEEASITIRSHQPQGWCLGPYQLEMTKIELIKLGQSSLYKPIFEVELSPKSKFLDFPMMGKDFSLTVWEAKEVLAMMDNEKAKESAVALELVLQTSPVLGMRMAWQFPRT

SEQ ID NO: 131500 - protein, 196 aa, Glycine max
  Coding DNA Sequence Number=SeqID_14722
  Gene Ontology: Mol. function=Rho GDP-dissociation inhibitor activity; Cellular component=cytoplasm; Biological process=actin cytoskeleton organization and biogenesis
  Homolog annotation: Hit_ID=Q705X3; Match level="QueryCoverage=94%, HitCoverage=75%, E-value=6e-74, Identity=75%"; Hit description=Rho GDP dissociation inhibitor 2
  Pfam annotation: Domain name=Rho_GDI; Domain location=1-195; Score= -9.1; E_value=3.7e-08; Accession=PF02115.7; Description=RHO protein GDP dissociation inhibitor
MSEGSIAATEDEDEDVERRIDLGPQCTLKEQLEKDKDDESLRRWKEQLLGSVDMTSVGDHLDLKQESSQSLEPEVKILSLAIKAAGREDIVLPIPESGNPSGLWFTLKEGSRYSLMFTFQVSHNIVSGLKYTNTVWKTGLKVDSTKEMIGTFSPQAEPYTHEMPEETTPSGLLARGQYSARSKLVNIPTYGLIKRF

SEQ ID NO: 131501 - protein, 411 aa, Glycine max
  Coding DNA Sequence Number=SeqID_14723
  Gene Ontology: Mol. function=transcription regulator activity; Cellular component=nucleus; Biological process=regulation of transcription
MVCQAASQTRFRALKHEYGIDGAATIIVRVIACFQPLHFCQKSSKFPKISYKSTITSTGHLFCWMVKADESLPRPHHVAWQSPSSNHFSILPKPSLLSLPAYLNSSTSILPAVSTFHGLAAPSIPSLKSMLKNEVQGFLQYCNADTSLKETHFGGALQNANPSLQKRLLIFDRSDNKTRLFYGPVLPLVQSPTVTATKFAQSYGINGEGQASNVGQKHLTRYSLLKESVKDHAITEESENHEDTEEINALLYSDDESPEGDDDDSCDEVTSTDHSPLATNKTYVIQEQFEDTKEEVASSDWPNKRLKLFDGDYNRSSTPADRYSLLRPNETCDCVSDAESKNSCGWAYSVDKTKVDNSVACDIKFKKDKISESLKVLENLIPGAKGKGPLLVIDGTIEYLKILMSQTGALG

SEQ ID NO: 131502 - protein, 210 aa, Glycine max
  Coding DNA Sequence Number=SeqID_14724
  Gene Ontology: Mol. function=oxidoreductase activity; Cellular component=mitochondrion; Biological process=metabolic process
  Homolog annotation: Hit_ID=Q6K447; Match level="QueryCoverage=97%, HitCoverage=98%, E-value=1e-48, Identity=46%"; Hit description =Putative NADPH-dependent retinol dehydrogenase/reductase
  Pfam annotation: Domain name=adh_short; Domain location=10-173; Score= 6.3; E_value=2.1e-06; Accession=PF00106.15; Description=short chain dehydrogenase
METPKRFEGKVAIVTASTQGIGLAIAERLGLEGASVVISSRKQQNVDAAAEQLRAKGIQVLGVVCHVSSAQQRKNLIDKTVQKYGKIDVVVSNAAANPSVDAILQTKDSVLDKLWEINVKATILLLKALAAEMAPNTRVNCVAPGFVPTNFASFITSNDAVKKELEEKTLLGRLGTTEDMGAAAAFLASDDAAYITGETIVVAGGTPSRL

SEQ ID NO: 131503 - protein, 374 aa, Glycine max
  Coding DNA Sequence Number=SeqID_14725
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=99%, HitCoverage=100%, E-value=1e-178, Identity=82%"; Hit description =Serine/threonine-protein kinase HT1
  Pfam annotation: Domain name=Pkinase; Domain location=77-331; Score =229.0; E_value=1.1e-65; Accession=PF00069.15; Description=Protein kinase domain
  Pfam annotation: Domain name=Pkinase_Tyr; Domain location=77-331; Score=262.4; E_value=9.4e-76; Accession=PF07714.7; Description =Protein tyrosine kinase
  Pfam module annotation: Pfam domain module=Pkinase::Pkinase_Tyr; Domain location=77-331::77-331
MGGSCFHALRLRRFKSKALPEPSSSSKTRLDSDLENMERRRFDSLESWSMILDSENVETWEASKEDQEEWTADLSQLFIGNKFASGAHSRIYRGIYKQRAVAVKMVRIPTQDEERRGLLEQQFKSEVALLSRLFHPNIVQFIAACKKPPVYCIITEYMSQGTLRMYLNKKEPYSLSTETILRLALDISRGMEYLHSQGVIHRDLKSNNLLLNDEMRVKVADFGTSCLETRCRETKGNMGTYRWMAPEMIKEKSYTRKVDVYSFGIVLWELTTALLPFQGMTPVQAAFAVAEKNERPPLPASCQPALAHLIKRCWSANPSKRPDFSDIVCTLEKYDECVKEGLPLTHHSGLVSKNVIIERLKGCVPMSSSIPVQA

SEQ ID NO: 131504 - protein, 776 aa, Glycine max
  Coding DNA Sequence Number=SeqID_14726
  Gene Ontology: Mol. function=binding; Cellular component=thylakoid; Biological process=photosynthesis
  Homolog annotation: Hit_ID=Q6K464; Match level="QueryCoverage=60%, HitCoverage=85%, E-value=1e-139, Identity=57%"; Hit description =Putative octicosapeptide/Phox/Bem1p (PB1) domain-containing protein
  Pfam annotation: Domain name=PB1; Domain location=291-383; Score =76.6; E_value=7.7e-20; Accession=PF00564.15; Description=PB1 domain
  Pfam annotation: Domain name=TPR_1; Domain location=124-157; Score =17.3; E_value=0.047; Accession=PF00515.18; Description =Tetratricopeptide repeat
  Pfam annotation: Domain name=TPR_1; Domain location=50-83; Score =17.7; E_value=0.042; Accession=PF00515.18; Description =Tetratricopeptide repeat
  Pfam annotation: Domain name=TPR_1; Domain location=543-576; Score =0.9; E_value=4.1; Accession=PF00515.18; Description=Tetratricopeptide repeat
  Pfam annotation: Domain name=TPR_1; Domain location=88-123; Score =10.6; E_value=0.29; Accession=PF00515.18; Description=Tetratricopepti de repeat
  Pfam annotation: Domain name=TPR_2; Domain location=124-157; Score =15.2; E_value=0.23; Accession=PF07719.7; Description=Tetratricopeptid e repeat
  Pfam annotation: Domain name=TPR_2; Domain location=50-83; Score =21.5; E_value=0.003; Accession=PF07719.7; Description=Tetratricopepti de repeat
  Pfam annotation: Domain name=TPR_2; Domain location=544-576; Score =6.3; E_value=6; Accession=PF07719.7; Description=Tetratricopeptide repeat
  Pfam module annotation: Pfam domain module=PB1::TPR_1::TPR_1::TPR _1::TPR_1::TPR_2::TPR_2::TPR_2; Domain location=291-383::124-157::50 -83::543-576::88-123::124-157::50-83::544-576
MGKSGGRRKKGGSNSNQGGAVDNSGSGAAAAPTANGGVEVLDSSIFLKKANELKEEGNKRFQNKDYAGALEQYESALRLIPKTHPDRAVFHSNRAACLMQMKPIDYEAVIVECTMALQVQPRFVRALLRRARAFEAVGKYEMAVQDVQFLLAADPGNRDALEIAQRLRTALGPRQEAQQDLHSRPSPAALGASAVRGAPIAGLGPCLPARPVGKKGANSVVGSVVLPNNNKPDKSQPVLPTENGPDTKSQLPKLVLKPSNGSVKPPNRKKEDHKELSSTIHGQRLEVAVRWRPLKLVYDHDIRLAQMPVNCHFRVLRDVVSKRFPSSSSVLIKYKDCDGDLVTITSTDELRLAESSVDSHLMKEPGEDKSDSVAMLRLHIVEVSPEQEPPLLEEEEEKPVENEGVMGEESGSHSSLSESVSEVADTEVDKTAKDTPKEKPGTTGDTECKEVEMDDWLFEFAQLFRSHVGIDPDAHLDLHELGMELCSEALEETVTSEEAQDLFDKAASKFQEVAALAFFNWGNVHMCAARKRIPLDESAGKEVVAEQLQVAYEWVKEKYSLAREKYEEALSIKPDFYEGLLALGQQQFEMAKLHWSFALAKKIDLSGWDSKETLQLFDSAEEKMKAATDMWEKLEEQRAKELKDPNATKKEELLRRRKKQGATEGESSSVGGQGEISAEEAAEQAAVMRSQIHLFWGNMLFERSQVECKLGMTGWKENLDAATERFKLAGASEADVSMVLKNHCSNGDAKDGDDKKVENPQHNKTVKPEINNANQV

SEQ ID NO: 131505 - protein, 223 aa, Glycine max
  Coding DNA Sequence Number=SeqID_14727
  Homolog annotation: Hit_ID=Q1T670; Match level="QueryCoverage=95%, HitCoverage=94%, E-value=4e-32, Identity=37%"; Hit description =Nitrate-induced NOI
  Pfam annotation: Domain name=NOI; Domain location=153-216; Score=1.3; E_value=0.018; Accession=PF05627.2; Description=Nitrate-induced NOI protein
MTGTNKFQQSQHSHVPKFGNWDCDNIPYTVYFDNARNKKPFINPNDPEQNPEVFNLYMRGVEKSDEAVKASSTRMRMRSYSTSSLEQTSHEHDHEEGRSNTKSHSHHTTESVSERSNSDYSVIQRVKSDFIGSFSSSNHNIKGRGGSHSLINDHVNHEAALVPEFGAWDVTDPKSGEGYTAIFSEIRKEKEIASGRMPSKTPSINNCSSIQNQCGRPSSILSK

SEQ ID NO: 131506 - protein, 51 aa, Glycine max
  Coding DNA Sequence Number=SeqID_14728
MGLARDTFYALSHDLVRENSIILKVHMIIILEPNINYIPPLMSKEPPHLLI

SEQ ID NO: 131507 - protein, 177 aa, Glycine max
  Coding DNA Sequence Number=SeqID_14729
  Homolog annotation: Hit_ID=Q2HRE8; Match level="QueryCoverage=94%, HitCoverage=43%, E-value=2e-52, Identity=53%"; Hit description =Lipopolysaccharide-modifying protein
  Pfam annotation: Domain name=DUF821; Domain location=1-177; Score =79.1; E_value=1.7e-23; Accession=PF05686.3; Description=Arabidopsis thaliana protein of unknown function (DUF821)
MLEGARRTAHFRKYKKAIQTRDVFTLWGILQLLRMYPAKVHDLDCDDRPVISKERFQGSNAPTPPLLRYCSDQWNLDIVFPDWSFWGWAEINIKAWKHVLKEIKEGNEKTKWKDRVPYAYWKGNPFVTPTRKDLMKCNVTEKDDWNTHLYIQDWDQESSQGYKKSNLGDQCTHRYVI

SEQ ID NO: 131508 - protein, 153 aa, Glycine max
  Coding DNA Sequence Number=SeqID_14730
  Homolog annotation: Hit_ID=Q2HRE1; Match level="QueryCoverage=76%, HitCoverage=26%, E-value=1e-28, Identity=45%"; Hit description =Lipopolysaccharide-modifying protein
  Pfam annotation: Domain name=DUF821; Domain location=1-146; Score= -38.7; E_value=2.7e-17; Accession=PF05686.3; Description=Arabidopsis thaliana protein of unknown function (DUF821)
MVPLEHYWPIRDNSKCRSLKFAVEWGNNNTDKAQAIGEAGSKFIHEDMDMDYIYDYMFHLLNEYAKLQRFKPTIPPNAVEYCPETMTCGVDGTQKRFMEDSLVKSPSDSNPCTLPPPYEPINLQDFLEKKANSTRQVETWEDQYWENKKRGQL

SEQ ID NO: 131509 - protein, 236 aa, Glycine max
  Coding DNA Sequence Number=SeqID_14731
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=55%, E-value=2e-32, Identity=39%"; Hit description =Integrase, catalytic region
CHIHNTSWNIGIGTTSYEITFGHKPFNFPEYLSRSSNLDVVDEMLSNREEIFHTIRKKLLKAQAIIKHHADVKRREVTYQPGDWVLLKLRPYQQRSVKGAHAVSGKLAMHFYDPFQILDRARIHPVFHYSMLKPFHGTPNKANLADMPNHFINDQPHITPLAILDYRRSSPAMNAPWEDQLHRDHHFEDKVILQGPKDDSISEATPETKTTTLEAGVQREKTKRMISRPLYLKDHV

SEQ ID NO: 131510 - protein, 338 aa, Glycine max
  Coding DNA Sequence Number=SeqID_14732
  Gene Ontology: Mol. function=protein dimerization activity; Cellular component=nucleus; Biological process=regulation of transcription, DNA-dependent
  Homolog annotation: Hit_ID=Q93XM6; Match level="QueryCoverage=86%, HitCoverage=61%, E-value=1e-107, Identity=66%"; Hit description=BZIP transcription factor
  Pfam annotation: Domain name=bZIP_1; Domain location=45-110; Score =31.8; E_value=2.4e-06; Accession=PF00170.11; Description=bZIP transcription factor
  Pfam annotation: Domain name=bZIP_2; Domain location=45-95; Score =16.8; E_value=0.014; Accession=PF07716.5; Description=Basic region leucine zipper
  Pfam module annotation: Pfam domain module=bZIP_1::bZIP_2; Domain location=45-110::45-95
MADNDAFCYPYHIDGCMPLEKWSKGPQDSEMLPRRKGAGSTSDKPLDAKTLRRLAQNREAARKSRLRKKAYVQQLESSRLKLNQIEQELQRARPQGLFVDCGGVGSTVSSGAAMFDMEYARWLEEDHRLMGELRNGLQAPLSDSDMRVMVDGYLSHYDEIFRLKGVAAKSDVFHLINGMWTSQAERCFLWIGGFRPSDLIMMLIQQLEPLAEQQIMGMYGLKHSSQQAEEALSQGLEQLQQSLVDTIAGGPVVDGVQQMVVAMSKLANLEGFVRQADNLRQQTLHQLCRLLTVRQAARCFIVIGEYYGRLRALSSLWASRPRDFYVHDEEAPTLAEEK

SEQ ID NO: 131511 - protein, 113 aa, Glycine max
  Coding DNA Sequence Number=SeqID_14733
  Homolog annotation: Hit_ID=Q0GPJ2; Match level="QueryCoverage=75%, HitCoverage=56%, E-value=4e-33, Identity=82%"; Hit description=BZIP transcription factor bZIP90
  Subcellular localization annotation: CTP_CleavageSite=25; ConfidenceScore=5.08e-01
LFTARPAATLEMFPSWPMRFQQTPRVGSKSGGESTDSGLSSKTEPPFEAESPISKKASSSDHHQAFDQQHLQHRQQLQQEMASDAPRAASSQNQSAAKSPQEKVSLSLRVFFF

SEQ ID NO: 131512 - protein, 86 aa, Glycine max
  Coding DNA Sequence Number=SeqID_14734
MSKYIKHDTYCKKNLFKPCETSDANAILNQLQKRRGSNGEFHLSVAGTLGAEPPLKEAPPSPSPLRVKGSEREQPRRGFLCSDKIK

SEQ ID NO: 131513 - protein, 200 aa, Glycine max
  Coding DNA Sequence Number=SeqID_14735
  Subcellular localization annotation: CTP_CleavageSite=50; ConfidenceScore=5.55e-01
MKFKKLSFQIYPSTFSEAPPSSITTTPSPALPPPPSFLFVLARLCAMQHSAMEASKFSNSDQNVRCHHCAGPLSKDMETSHWTVSPLIRDSFSMIGSAVGGVASAFYGFNLVMPIVQRRIKGPMWLHFLIGSKPFYSHTDINLSAIQAPPVIVLSSACAGLAGGAVPAAAQLVSSSYHAAYSSPISPPPSKDENIQRSRK

SEQ ID NO: 131514 - protein, 51 aa, Glycine max
  Coding DNA Sequence Number=SeqID_14736
MAAFRKALPENQPDAKCDLILGWNYCSRSDWLAIISNSCNKVARYTIMDRG

SEQ ID NO: 131515 - protein, 249 aa, Glycine max
  Coding DNA Sequence Number=SeqID_14737
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=85%, HitCoverage=48%, E-value=1e-76, Identity=71%"; Hit description =Homeobox protein SBH1
  Pfam annotation: Domain name=ELK; Domain location=198-219; Score =35.2; E_value=2.3e-07; Accession=PF03789.4; Description=ELK domain
  Pfam annotation: Domain name=KNOX1; Domain location=31-75; Score =89.8; E_value=8.6e-24; Accession=PF03790.4; Description=KNOX1 domain
  Pfam annotation: Domain name=KNOX2; Domain location=80-131; Score =109.8; E_value=8.1e-30; Accession=PF03791.4; Description=KNOX2 domain
  Pfam module annotation: Pfam domain module=ELK::KNOX1::KNOX2; Domain location=198-219::31-75::80-131
MEGISSRVMGFGENTSSSGIPNNNYGGSSSSAIKAKIMAHPHYHRLLAAYVNCQKVGAPPEVMGRLEEACASAAVTMAGGTASIGEDPELDQFMEAYCEMLIKYEQELSKPFKEAMLFLQRIECQFKSLTISSSLDTTVKSVNCEVVGNFCPVGNVKFSVQSKELLKRACNEAIDRNGSSDDVDVQTNIIDPQAEDQELKGQLLRKYRGYLGSLKQEFTKKRKKGKLPKEARQQLLEWWSRHYKWPYPS

SEQ ID NO: 131516 - protein, 323 aa, Glycine max
  Coding DNA Sequence Number=SeqID_14738
  Gene Ontology: Mol. function=RNA-directed DNA polymerase activity; Cellular component=extracellular region; Biological process=RNA -dependent DNA replication
MGGTILNLNKVDGVLNKYTQHYQYARQTQGRVRETSCICHELEERDLGRPSLVQASRIEEIRVGSGYQRAFTVDGGRSRWRIGDDEVGGEFFHASITGRRKRNKLVSTVKEDGVVVQTQEEITEVAEDYFKNLFKSKHYNPIHVVDMDEFKVALFQMHPDKSSRPDGLNTAFYQRFWSLFGDEVSAKCVKWLDEGSFLQKINDTNIVLVPKCDQPTSMKDLRLKSLCNVIYKILSKALLNRLKKVIGRCISEQQYAFIQGKSMLDNALIANEVIHHMKCKVRGKQGEIALKKEIIKAYDRVQWYFLKDMMKKMGFHNMDNDVC

SEQ ID NO: 131517 - protein, 153 aa, Glycine max
  Coding DNA Sequence Number=SeqID_14739
  Homolog annotation: Hit_ID=Q8GSM4; Match level="QueryCoverage=37%, HitCoverage=16%, E-value=4e-07, Identity=43%"; Hit description=Ovate protein
  Pfam annotation: Domain name=DUF623; Domain location=88-147; Score =81.6; E_value=2.5e-21; Accession=PF04844.4; Description=Protein of unknown function, DUF623
  Subcellular localization annotation: CTP_CleavageSite=27; ConfidenceScore=5.16e-01
MNNSKQQKQLQQRGCKTFCCSCRFSVSSTEEAESSSASDRFPSVSSLAHAMVQERLDQMIRARHVERRRQHDREGTKFVVMVAMEKSSYDPREDFRESMMEMITAKHLQDAKDLRSLLNYYISMNSDEYHSLILEVFHEGACYFTDKTRECGR

SEQ ID NO: 131518 - protein, 84 aa, Glycine max
  Coding DNA Sequence Number=SeqID_14740
  Gene Ontology: Mol. function=DNA binding; Cellular component=nucleus; Biological process=regulation of transcription, DNA-dependent
  Homolog annotation: Hit_ID=Q1RWS5; Match level="QueryCoverage=60%, HitCoverage=16%, E-value=3e-19, Identity=80%"; Hit description=SBP
MLPLWGTDTCAVVVVRVMFLRRRRSGWWWENGAVCDGSSMSGGGMPRGAGEREGVPQEAQSLRYAFQGTQSSGVRVGAEILSAV

SEQ ID NO: 131519 - protein, 117 aa, Glycine max
  Coding DNA Sequence Number=SeqID_14741
MCLADQHQQLLIAIDEVEEEEKGPHGIEGRKKHWSINIEGKWMYNGKSVILLEFIKIIVLLLVAVMTACFTLPIEKVCSPFAVIAYHSRMPLHFNSKASAGAVEDDAHAKAMFQNSI

SEQ ID NO: 131520 - protein, 153 aa, Glycine max
  Coding DNA Sequence Number=SeqID_14742
  Gene Ontology: Mol. function=receptor activity; Cellular component =spliceosome; Biological process=negative regulation of transforming growth factor beta receptor signaling pathway
  Homolog annotation: Hit_ID=Q3LFT6; Match level="QueryCoverage=74%, HitCoverage=33%, E-value=6e-58, Identity=91%"; Hit description =Putative WD-40 repeat protein
  Pfam annotation: Domain name=WD40; Domain location=51-89; Score=30.9; E_value=4.5e-06; Accession=PF00400.22; Description=WD domain, G-beta repeat
  Pfam annotation: Domain name=WD40; Domain location=6-47; Score=7.8; E_ value=4.5; Accession=PF00400.22; Description=WD domain, G-beta repeat
  Pfam module annotation: Pfam domain module=WD40::WD40; Domain location=51-89::6-47
MEKKKVAVPLVCHGHSRPVVDLFYSPVTPDGFFLISASKDSSPMLRNGETGDWIGTFEGHKGAVWSCCLDTSALRAATASADFSTKVWDALTGDELHSFEHKHIVRACAFSEKTWRFVLLPEMHAESPESCWKFRNFDSVAVPSSNYTDLVNL

SEQ ID NO: 131521 - protein, 55 aa, Glycine max
  Coding DNA Sequence Number=SeqID_14743
MSFLGIFISMSFLVVAITCSQEEQSIYLVLLEGDALAFHEGSRDQDSSTIHPNTN

SEQ ID NO: 131522 - protein, 775 aa, Glycine max
  Coding DNA Sequence Number=SeqID_14744
  Gene Ontology: Mol. function=amylo-alpha-1,6-glucosidase activity; Cellular component=membrane; Biological process=Golgi to plasma membrane transport
  Homolog annotation: Hit_ID=Q5JLH8; Match level="QueryCoverage=98%, HitCoverage=99%, E-value=0.0, Identity=68%"; Hit description =Putative ERD4 protein
  Pfam annotation: Domain name=DUF221; Domain location=303-731; Score =644.2; E_value=1.1e-190; Accession=PF02714.6; Description=Domain of unknown function DUF221
MATLSDIGVAAGLNILSAFIFFVAFAILRLQPFNDRVYFPKWYLKGLRTDPVHGGAFVRKFVNLDWRSYLRFLNWMPAALRMPELELIDHAGLDSVVYLRIYLVGLKIFVPIAFLAWAVLVPVNATSTGLESAGLDNITSSDIDKLSISNVHSTSERFWAHILVAYAFTFWTCYILLKEYEKVASMRLQFLAAEKRRPDQFTVLVRNIPPDPDESVSELVEHFFLVNHPDNYLSHQVVYNANKLAKLVKKKKKLQNWLVYYQNKVERTSERPQIKTGFLGLCGNKVDAIDHHNTEIDKLSKEIALERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIDGIQKRAPWLNPLIEIPFIKSFIQGFLPGIALKLFLIFLPTILMIMSKFEGFGSISSLERRAASRYYLFNFVNIFLGNILTGTAFEQLDSFIHQAANEYPITIGTAIPLKASFFITYIMVDGWAGIAAEVLMLKPLIIYHLKNFFLVKTEKDREEAMDPGSIGFNTGEPRIQLYFLLGLVYASVTPTVLPFIIVFFGLAYVVFRHQIINVYNQEYESGAAFWPDVHFRVIIALIVSQIVLMGLLTTKKAASSTPFLIVLPVLTIWFHIYCKGRFEPAFVRYPLQEAMMKDTLERATDPNFNLKAYLQNAYVHPVFKASLFDEDEDEEVMSLKLETESLTVPTKRQSRRNTPLPSRISGASSPSLPDHGIRNHPEP

SEQ ID NO: 131523 - protein, 260 aa, Glycine max
  Coding DNA Sequence Number=SeqID_14745
  Gene Ontology: Mol. function=zinc ion binding
  Homolog annotation: Hit_ID=Q6YW60; Match level="QueryCoverage=93%, HitCoverage=96%, E-value=7e-80, Identity=51%"; Hit description=Zinc finger (C3HC4-type RING finger) protein-like
  Pfam annotation: Domain name=zf-C3HC4; Domain location=54-94; Score =39.1; E_value=1.5e-08; Accession=PF00097.15; Description=Zinc finger, C3HC4 type (RING finger)
MKGEVQLQPPAVMQNPSDSDPLLHNQEEEDGSPGSSGEIKNEEEDVEAGLLPCCRICLESDSDPEDELISPCMCKGTQQFVHRSCLDHWRSVKVIAAIGGFSYIMDKDGSFRNSFDDGWDRILSRHPIPFYYCIGVLAFFVLIGFFGLILHCSSLNSNDPRMAGCQNCCYGWGILDCFPASMEACFALVVVFVVIFAILGIAYGFLAATMAIQRIWQRHYHILTKRELTKEYIVEDLGGCYFPPKLDPEHEGRLKMLKLL

SEQ ID NO: 131524 - protein, 881 aa, Glycine max
  Coding DNA Sequence Number=SeqID_14746
  Gene Ontology: Mol. function=voltage-gated potassium channel activity; Cellular component=integral to membrane; Biological process=potassium ion transport
  Homolog annotation: Hit_ID=Q9LEG6; Match level="QueryCoverage=91%, HitCoverage=91%, E-value=0.0, Identity=71%"; Hit description =Potassium channel
  Pfam annotation: Domain name=Ank; Domain location=508-540; Score =44.4; E_value=3.9e-10; Accession=PF00023.20; Description=Ankyrin repeat
  Pfam annotation: Domain name=Ank; Domain location=541-573; Score =17.5; E_value=0.049; Accession=PF00023.20; Description=Ankyrin repeat
  Pfam annotation: Domain name=Ank; Domain location=606-638; Score =45.5; E_value=1.9e-10; Accession=PF00023.20; Description=Ankyrin repeat
  Pfam annotation: Domain name=Ion_trans; Domain location=57-257; Score= 144.4; E_value=3.1e-40; Accession=PF00520.21; Description=Ion transport protein
  Pfam annotation: Domain name=Ion_trans_2; Domain location=166-263; Score=60.4; E_value=5.7e-15; Accession=PF07885.6; Description=Ion channel
  Pfam annotation: Domain name=cNMP_binding; Domain location=359-437; Score=39.1; E_value=1.5e-08; Accession=PF00027.19; Description =Cyclic nucleotide-binding domain
  Pfam module annotation: Pfam domain module=Ank::Ank::Ank::Ion _trans::Ion_trans_2::cNMP_binding; Domain location=508-540::541 -573::606-638::57-257::166-263::359-437
HELPSGSSQTMKFDFVSLDMKHPEIWETFLVILVVYTAWVSPFEFGFLKKPQAPLSITDNIVNGFFFVDIVLTFFVAYIDKSTYLIVDDRKQIAWKYARTWLAFDVISIIPSELVQKISPSPLQSYGLFNMLRLWRLRRVSALFSRLEKDKNYNYFWVRCAKLIAVTLFAVHCAACFYYLIAARYHDPKKTWIGATMDNFLERSLWSRYVTSIYWSITTLTTVGYGDLHPVNSREMIFDIFYMLFNLGLTAYLIGNMTNLVVHGTSRTRKFRDTIQAASNFAQRNQLPHRLQDQMLAHLCLKYRTDSEGLQQQETLDSLPKAIRSSISHYLFYSLIDKVYLFHGVSNDLLFQLVSEMKAEYFPPKEDVILQNEAPTDFYILVTGAVVVGEAKTGDLCGEIGVLCYKPQLFTVRTKRLSQLLRLNRTSFLNIVQANVGDGTIIMNNLLQHLKEINDPIMEGVLVDIENMLARGRMDLPVSVCFAAARGDDLLLHQLLKRGMDPNESDNNRRTALHIAASQGKENCVSLLLDYGADPNIRDLEGNVPLWEAIVEGHESMSKLLSENGANLQCGDVGQFACNAVEQNSLNLLKEIMRYGGDITLPNSNTGTTALHVAVSEGNVEIVKFLLDHGASIDKPDKHGWTPRDLADQQAHTEIKALFDSTGEPKVQSSFAIPERNSKIRYLGRFTSEPTMPLPLDGSFHESQSQSQSQSRPRRRSNNYHNSLFGIMSAVHNGEKDLLSAVDMNNNARNGMKSSSASSSALGPTRVIISCPEKGEVVGKLVLLPGSFQELVEIGAKKFGFYPNKVVCKDGGEIEDLEVIRDGDHLVFLGASGVLESNCPAPAPLTNGPVTWHKALLTWKLAIANYCQEGSVTQGSPPSHN

SEQ ID NO: 131525 - protein, 354 aa, Glycine max
  Coding DNA Sequence Number=SeqID_14747
  Gene Ontology: Mol. function=oxidoreductase activity; Cellular component=vacuole; Biological process=hydrogen peroxide catabolic process
  Homolog annotation: Hit_ID=Q9LSP0; Match level="QueryCoverage=97%, HitCoverage=95%, E-value=9e-80, Identity=46%"; Hit description =Peroxidase 29 precursor
  Pfam annotation: Domain name=peroxidase; Domain location=44-318; Score=226.8; E_value=4.7e-65; Accession=PF00141.13; Description =Peroxidase
MEISFPWILVVTVVMAMPLSFRIKANQLSYDYYKFSCPNLESVIKSELLGIFLTDATAPAAFLRLMFHDCQVQTNSVLVSFKVYTKASLVVVVVVVFIFMQGCDASILLDSNYLAHSHSSEMKSSRNFGIRKRETISYIKSILEEECPGQVSCADIIVLAAKESVSFSGGPHIEIPLGRKDSRTCSFHEADAKLPSPTITVDEFISIFMSKGMNIEESVSILGAHTLGIGHCFNIVGRLYDPQLGDKMDFGFEASLRLACPTEIPLTNFTFVPNDMTPVIFDNQYYRDIMMGRGLFGIDSSISRDPRTAPFVMRFAMDQNYFFKAFSSAFLKLSSTNVLTDVQGDVRRQCNQVN

SEQ ID NO: 131526 - protein, 759 aa, Glycine max
  Coding DNA Sequence Number=SeqID_14748
  Gene Ontology: Mol. function=aminoacyl-tRNA ligase activity; Cellular component=mitochondrion; Biological process=tRNA aminoacylation for protein translation
  Homolog annotation: Hit_ID=Q017U6; Match level="QueryCoverage=94%, HitCoverage=92%, E-value=0.0, Identity=48%"; Hit description=[J] KOG0433 Isoleucyl-tRNA synthetase
  Pfam annotation: Domain name=Anticodon_1; Domain location=624-730; Score=1.4; E_value=1.6e-05; Accession=PF08264.3; Description =Anticodon-binding domain
  Pfam annotation: Domain name=tRNA-synt_1; Domain location=52-594; Score=-380.0; E_value=0.00098; Accession=PF00133.12; Description =tRNA synthetases class I (I, L, M and V)
  Pfam annotation: Domain name=tRNA-synt_1g; Domain location=79-613; Score=-254.0; E_value=0.00027; Accession=PF09334.1; Description=tRNA synthetases class I (M)
  Pfam module annotation: Pfam domain module=Anticodon_1::tRNA-synt _1::tRNA-synt_1g; Domain location=624-730::52-594::79-613
  Subcellular localization annotation: CTP_CleavageSite=52; ConfidenceScore=5.53e-01
MAAESETRRRMTSSAKRSIVSYRSLGRILSTKSSPSDSVFGSTIALSEPPMTISTRRNLNTTFSTCSLILAYFCSGAGLHVGHPLGYTATDILARYKRMQGYNVLHPMRWDAFGLPAEQYAIETGTHPKLNTVRNINRFRTQAEVPVNWCPALGTVLAIEEVIDGVSEWGGHPVIRKPVRQWMLKIIAYADCLLEDLDDLDWPESVKEMQRNWIGRSEGAEMEFCILDSDVKERDKKIIVYTARPDTIFGATYLVMAPEHPLLSSLVSIAQSKHVEDYVDFASRKSDLERTELQKTKTGGTELQFAGFLSSKEAALKVIEWAGKSGNGKRKVNYKLRDWLFARQRYWGEPIPVIFMDDNGETVPLCDTELPLTLPELNDFCPSGTGEPPLSKAVSWVKATDSLSGRPATRETNTMPQWAGSCWYYLRFMDPHNSKELVDKTKERYWSPVDVYVGGAEHAVLHLLYARFWHKVLYDIGVVSTKEPFQYVINQGIILGEVQYMACRDQDGNLISADSTGMLNDHKLEIIPVEKVMKSGDSFVLKEHPDIRLIARAHKMSTSSGNVVNPDDVVSEYGADSLRLYKMFMGPLRDSKKTWRLIVGSPLSDGTFKDRTVSVDEEPTIEQLRCHHKCIAKVTEEIEGTRFNTGISAMMEFLNWDKHPRSVIEAFALLLSPYAPHMAEELWSWLGHTKSLAYEPFPKIFQALIPYKSITLKLFTSKANPAYLKDSTVVLPVQINGKTRGTIQVEENMYRRGCFCTSI

SEQ ID NO: 131527 - protein, 689 aa, Glycine max
  Coding DNA Sequence Number=SeqID_14749
  Gene Ontology: Mol. function=metal ion binding; Cellular component =nucleus; Biological process=regulation of transcription, DNA -dependent
  Homolog annotation: Hit_ID=UPI000034F5B3; Match level="QueryCoverage =99%, HitCoverage=73%, E-value=0.0, Identity=55%"; Hit description =transcription factor
  Pfam annotation: Domain name=JmjC; Domain location=527-637; Score =45.6; E_value=1.7e-10; Accession=PF02373.13; Description=JmjC domain
MSVEEIASSCPFCRKNCNCNACLCSKGMIKTANRDISDYEKAQYLQYMIKLLLPFFEQICHEQSQEEQIEAKLLGKSSFEIEIHQSLCGDGERVYCDHCATSIIDLHRSCPNCSYELCLSCCQEIRDGSITPRAELKFPYVNRGYDYMHGGDPLPVPCDLETSEGHIEPSTVWKAKSDGSISCAPKELGGCGSAVLELRCIFPDGWISDLETKACNMLKLWEIKHTTLQQKAASSSYTFLRKEAIKEGINDNNIYCPDSSSTKNEGLLLFQKHWANGEPIIVRDVLKQGTGLSWEPMVMWRALCENMVSEISSKMSEVKAIDCLANCEVEIDTHTFFKGYTEGRTYRDLWPEMLKLKDWPPSDKFEDLLPRHCDEFIRSLPFQEYSDPRTGILNLAVKLPAHVLKPDMGPKTYIAYGIKEELGRGDSVTKLHCDMSDAVNILTHTAEVILTDEQHFTISKLKEAHRAQNEREQCAQERVADHLEDRPYKDNKEHIENKEVLEAKSMKKQPIEIDGNIFPNNVLERYTSPATENESMETGSALWDIFQREDSEKLETYLRKHSKEFRHTYCSPVEQVVHPIHDQCFYLTWEHKKKLKEELGVEPWTFEQKLGEAVFIPAGCPHQVRNLKSCTKVAVDFVSPENIHECLRLTKEFRQLPKNHKAREDKLEDYMVTCFILDGTDKEDDSLCR

SEQ ID NO: 131528 - protein, 360 aa, Glycine max
  Coding DNA Sequence Number=SeqID_14750
  Gene Ontology: Cellular component=integral to membrane
  Homolog annotation: Hit_ID=Q8L4G8; Match level="QueryCoverage=88%, HitCoverage=50%, E-value=2e-42, Identity=32%"; Hit description=C4 -dicarboxylate transporter-like protein
  Pfam annotation: Domain name=C4dic_mal_tran; Domain location=47-309; Score=153.6; E_value=5.1e-43; Accession=PF03595.8; Description=C4 -dicarboxylate transportermalic acid transport protein
MGDTEIKPSVEVVVCASMNNNNSANNHTLPTDITKPSQLPILTRLHAGYFFICLSFGAQALLWKSLSKHNKDSQSLWHGFNLMPSIAFLLLWCVSLLTATSLSLLYVLKCIFHLEMVKEEFSHHVGVNCMYAPWISWLLMLQSAPTILHSTSCYQVLCLAFSFVILLLDIKLYGQWFTTKKRFLSVVANPTSQVSVIGNLVSAQVVAEIGWKESAVLMFSLGLRLTSGSQFPTVLRPTYLLFFAAPSIASLAWKSITGAFVTPSKMLLFLSLFLFMSQACRPAMFKKSMKRLNVTWWAYSFPLTFLGLACAEYAQEVESGMASWLMLVICMVSVLVFIALMIITVLKIERLFHKNAPIMT

SEQ ID NO: 131529 - protein, 590 aa, Glycine max
  Coding DNA Sequence Number=SeqID_14751
  Gene Ontology: Mol. function=sequence-specific DNA binding; Cellular component=nucleus; Biological process=regulation of transcription, DNA-dependent
  Homolog annotation: Hit_ID=Q9C519; Match level="QueryCoverage=73%, HitCoverage=81%, E-value=4e-94, Identity=46%"; Hit description=WRKY transcription factor 6
  Pfam annotation: Domain name=WRKY; Domain location=339-399; Score =142.0; E_value=1.6e-39; Accession=PF03106.6; Description=WRKY DNA -binding domain
MGFCPKWIGWIKVYMESSTLSVLDGLGGLMRMACSKGLSEGYRVDYGNLRILLLQFAYDALFFCEPTMKNVLALKSMLRCFELASVLKEWSLTLDSSLSSSSSTNHNMFPALGFPVNLSPSDPNHRTVLAEVDFLSARNNSSPHTNDHGTPPKSYPHVNTGLQLLTANAGSDQSTVDDGASSDAEDKRAKMTEDLRNMNAENQKLKEMLSHVSSNYANLQMHLAAVLQQQQNQRTESTEQEVVQGKLAEERKHGVGGGTVPRQFLSLVPSEIDDQVSNSSSGERTRSTTPPSNKNDKDNKETDDKLNPSNPTTDPSTSPEAAMRKARVSVRARSEAPMISDGCQWRKYGQKMAKGNPCPRAYYRCTMAVGCPVRKQVQRCAEDRTILTTTYEGTHNHPLPPAAMAMASTTVAATSMLLSGSMSSADGKMNPNLLTGAILPCSNMATLSASAPFPTVTLDLTHNPNALQQYQLRPQTQTPFLPSPPQNFMSGPTTPQLPKLIAQVLYNQSKFSGLQLSQDVGPNNSQAPTPSLLQPSQQVSLTDTVSAITADPNFPAALTAAISSIIGGANPNNNNNSSNPNVINSATINQ

SEQ ID NO: 131530 - protein, 96 aa, Glycine max
  Coding DNA Sequence Number=SeqID_14752
MARTKKTGQMTSEAAKEIAEKIDSLEQQASQGSFVPHGRQDVLTATIGRPEHPGRVRATGVGVTIKQYFGPAQRTSRTSSSIAPEELEQLTQQIKD

SEQ ID NO: 131531 - protein, 398 aa, Glycine max
  Coding DNA Sequence Number=SeqID_14753
  Gene Ontology: Mol. function=pectate lyase activity; Cellular component=anchored to membrane; Biological process=pathogenesis
  Homolog annotation: Hit_ID=O65388; Match level="QueryCoverage=89%, HitCoverage=92%, E-value=1e-146, Identity=69%"; Hit description =Putative pectate lyase 2 precursor
  Pfam annotation: Domain name=Pec_lyase_C; Domain location=131-316; Score=310.5; E_value=3e-90; Accession=PF00544.9; Description=Pectate lyase
MATSTSLLLLSCFMLHLASTFVIVHSTDNKYYNTLPTSKYMIPESPKKALLNVIDSCWRTKPNWASNRQALADCAIGFGKDATGGKYGAIYRVKDPSDDPVNPKPGTLRYGAIQTEPLWIIFDKDMVIRLKNELIMNSYKTIDGRGAKVEITDGPCITIQGVSHVIIHGINIHDCKPAKPGLVRSTPDHVGHRLGSDGDAISIFDSSNIWIDHCFLARSTDGLIDVIHASTAIAISNNYFTQHDKVMLLGHNDQYTADKIMRVTIAFNRFASGLTERMPRVRFGYAHVVNNKYDEWKMYAIGGSANPTILSEGNLYVAPNDPNAKQVTKREGKENWKSWKWRSSKDLFLNGAYFVPSGFGSCAPNYSPTQSFSAAPAYLVPAMTLNAGPTNCVVGRAC

SEQ ID NO: 131532 - protein, 423 aa, Glycine max
  Coding DNA Sequence Number=SeqID_14754
  Homolog annotation: Hit_ID=Q6Z8A8; Match level="QueryCoverage=79%, HitCoverage=78%, E-value=4e-76, Identity=44%"; Hit description=F-box family protein-like
  Subcellular localization annotation: CTP_CleavageSite=32; ConfidenceScore=5.64e-01
MASFQTTAIFSSSFSSSPGKVNASIHVPNPPRVTYPVPKVPTRKLQIEEFNGSPVDSTPLEKNGITTHIYEGLFSPGKKSNKATTVQLYSILEAVADRIEMHRNIGEQRNNWNTLLLNSINMITLTATAMAGVAAATSGDTEPLLAMKLSSTLLFSAATGMSLIMNKIQPSQLAEEQRNATRLFKQLHSQIQTIIALGNPTEEDVKGSMEKVLALDRAYPLPLLGAMLDKFPAKYKPAVWWPSSHQFQRRSKTQESNNGWSEDLEMEMREVIEVVKNKDLEDYDRLGNIALKLNKTLAIAGPLLSGIAAVGSSFVGNGSWAALVPLMAGSLASAVNAFEHGGQIGMVFEMYRNCGGFFTLLEQTIQATLEEKNLDNRENGQVFEMKVAMKLGRSVSELRRLASKSASCRMEGIAVDEFSSKLF

SEQ ID NO: 131533 - protein, 120 aa, Glycine max
  Coding DNA Sequence Number=SeqID_14755
MKLCFYRFESIHLHNRLQFFDNAYGYSTQLSSSHSSSYRSSIIAEFDIPEASNIRTKNKILQTVGERWRQFKFDLTSKWALAVDKDSVDDTVCEKYGCVKKGTGHLEAKHYPPRVVSWGL

SEQ ID NO: 131534 - protein, 315 aa, Glycine max
  Coding DNA Sequence Number=SeqID_14756
  Homolog annotation: Hit_ID=Q9FGR6; Match level="QueryCoverage=75%, HitCoverage=73%, E-value=3e-19, Identity=28%"; Hit description =Arabidopsis thaliana genomic DNA, chromosome 5, TAC clone:K6A12
MLLLLLLLIHSLLITQSTPCRTSCGDIPIEYPFGIDDGCGSPYYRYILVCSDSGKLQVRTPSGRYNVHNVSYADPHILITDPFMWNCDDGENYRPTRPFSLDTSTRFKLSPHNEYLFFNCSEDHVIVKPKPIFCERFPERCDSSCDSGSYLCRHMPGCSFAMSGSSCCSYSPRATESLRLMLKYCTSYTSVYWRNVGAPQPYDQVPEYGIRIDFDIPVTRRCLQCQDPYKGGGTCGFDTGTQSFMCLCKEGNSTTHCKDYDATRHNRKVHVIAGTVSGVSAAGAFGIGAGIWYLKKVRAKAPVTCGVQSNENRLF

SEQ ID NO: 131535 - protein, 419 aa, Glycine max
  Coding DNA Sequence Number=SeqID_14757
  Homolog annotation: Hit_ID=Q6Z8A8; Match level="QueryCoverage=80%, HitCoverage=79%, E-value=9e-72, Identity=43%"; Hit description=F-box family protein-like
  Subcellular localization annotation: CTP_CleavageSite=47; ConfidenceScore=5.59e-01
MASLQTTSSFSSSLRKFNASIHLPKPSRVTYSVPKVPTRKLLVEEFNASIQTSPLKKNAVTTHIHPDLFSPSSSKKSNKAIVQLYAVLDEVADRIEMHRNIGEQRNNWNSLLLNSINMITLTATAMTGVAAATSGDTEPLLAMKLSSTLLFSAATGMSLIINKIQPSQLAEEQRNATRLFKQLHTQIQTIIALGNPTEEDVKSSMEKVLALDSAYPLPLLGAMLDKFPEKYEPAVWWPSSHQFQRRSKTQESNNGWSEDLEMEMREVIEVVKNKDLEDYERLGNIALKVNKSLAIAGPLLSGIAAVGSSFVGNGSWAALVPLVAGSLASAVNAFEHGGQVGMVFEMYRNCGGFFTLLEQTIQATLEEKNLDKRENGQVFEMKVAMKLGRSVSELRRLASKSASCRMEGIAVDEFASKLF

SEQ ID NO: 131536 - protein, 121 aa, Glycine max
  Coding DNA Sequence Number=SeqID_14758
  Pfam annotation: Domain name=Stig1; Domain location=2-94; Score=-0.8; E_value=1.4e-05; Accession=PF04885.4; Description=Stigma-specific protein, Stig1
MKSLKTLFLLAMLMALAVFVSGISPGSGEPKGKINRFLSDRVVLKCDKYPKVCHIKGSAGSDCCKNKCVNLSTDVSNCGKCGKKCSYGKICCEAMRSTYMKWTSMSVLLLGPMHATTSLCD

SEQ ID NO: 131537 - protein, 510 aa, Glycine max
  Coding DNA Sequence Number=SeqID_14759
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=99%, HitCoverage=100%, E-value=0.0, Identity=94%"; Hit description =Aspartic proteinase 1
  Pfam annotation: Domain name=Asp; Domain location=89-509; Score =521.0; E_value=1.3e-153; Accession=PF00026.14; Description =Eukaryotic aspartyl protease
  Pfam annotation: Domain name=SapB_1; Domain location=381-419; Score =67.5; E_value=4.3e-17; Accession=PF05184.5; Description=Saposin-like type B, region 1
  Pfam annotation: Domain name=SapB_2; Domain location=318-352; Score =59.5; E_value=1.1e-14; Accession=PF03489.7; Description=Saposin-like type B, region 2
  Pfam module annotation: Pfam domain module=Asp::SapB_1::SapB_2; Domain location=89-509::381-419::318-352
MGNKMNAIALCLLVSTLLVSAVYCAPNAGLRRIGLKKIKLDPKNRLAARVGSKDVDSFRASIRKFHLQNNFGGTEETDIVALKNYLDAQYYGEIAIGTSPQKFAVIFDTGSSNLWVPSSKCTFSVACYFHAKYKSSKSSTFKKNGTAAAIQYGTGAISGFFSYDSVRVGEIVEFIEATREPGVTFLAAKFDGILGLGFQEISVGNAAPVWYNMVDQGLLKEPVFSFWFNRNPEEEEGGEIVFGGVDPAHYKGKHTYVPVTRKGYWQFDMGDVLIGGKPTGYCANGCSAIADSGTSLLAGPTTVITMINHAIGASGVMSQECKTIVAEYGQTILDLLLAETQPKKICSRIGLCAFDGTHGVDVGIKSVVDENERKSLGGHHGAACPACEMAVVWMQNQLSRNQTQDQILSYINQLCDKMPSPMGESAVDCGNISSLPVVSFTIGGRTFDLSPEEYVLKVGEGPVAQCISGFTAIDIPPPRGPLWILGDVFMGRYHTVFDFGKLRVGFADAA

SEQ ID NO: 131538 - protein, 156 aa, Glycine max
  Coding DNA Sequence Number=SeqID_14760
  Homolog annotation: Hit_ID=Q9ZQ71; Match level="QueryCoverage=96%, HitCoverage=85%, E-value=7e-39, Identity=51%"; Hit description =Expressed protein
  Pfam annotation: Domain name=DUF538; Domain location=51-156; Score =57.2; E_value=5.6e-14; Accession=PF04398.3; Description=Protein of unknown function, DUF538
MDKALTKLGSAWISKKAKAEISHITDDLSCKHFNILCTRMFIPCLQFQSLPNTVEEKAKLFINKLKGKTQKALPDLLREYNLPTGLFPRNITSYEFDASKGKLIVYLSSPCEGHYQRGSSLLYIDGMKTKVLVWVKVTSVAVESYKSDKVWFATIE

SEQ ID NO: 131539 - protein, 232 aa, Glycine max
  Coding DNA Sequence Number=SeqID_14761
  Gene Ontology: Mol. function=glutathione transferase activity; Cellular component=cytoplasm; Biological process=aromatic amino acid family metabolic process
  Homolog annotation: Hit_ID=Q9FQD3; Match level="QueryCoverage=73%, HitCoverage=78%, E-value=1e-92, Identity=98%"; Hit description =Glutathione S-transferase GST 25
  Pfam annotation: Domain name=GST_N; Domain location=8-83; Score=87.6; E_value=3.9e-23; Accession=PF02798.10; Description=Glutathione S -transferase, N-terminal domain
  Pfam annotation: Domain name=Glutaredoxin; Domain location=10-70; Score=2.5; E_value=0.083; Accession=PF00462.14; Description =Glutaredoxin
  Pfam module annotation: Pfam domain module=GST_N::Glutaredoxin; Domain location=8-83::10-70
MASASVGKELTLYSYWRSSCSHRVRIALNLKGLKYEYKPVNLLKGEQSRPEFLQLNPVGCVPVLVDDHVVLYDSFAIIMYLEDKYPHNPLLPHDIYKRAINFQAASVVSSTIQPLHNLSLLNYIGEKVGPDEKLPWAQSIIRRGFKALEKLLKDHTGRYATGDEVFLITPFQGYNSLNILTGIIRIPMSESDHGMGHHNKCFYALIFCITIRMSFNSKVNDNKILKISRISC

SEQ ID NO: 131540 - protein, 67 aa, Glycine max
  Coding DNA Sequence Number=SeqID_14762
  Homolog annotation: Hit_ID=Q9LTT4; Match level="QueryCoverage=76%, HitCoverage=12%, E-value=2e-15, Identity=80%"; Hit description=WD domain protein-like
MSNRVGLRRSRRSIFLGEISGVSFSPDTESLFVGVWDRTYGSLLQYNRRRNYMYLDCMNLRIVAPPD

SEQ ID NO: 131541 - protein, 124 aa, Glycine max
  Coding DNA Sequence Number=SeqID_14763
  Gene Ontology: Mol. function=sodium:hydrogen antiporter activity; Cellular component=integral to membrane; Biological process=sodium ion transport
  Homolog annotation: Hit_ID=Q93YH1; Match level="QueryCoverage=85%, HitCoverage=69%, E-value=6e-19, Identity=61%"; Hit description =Na+/H+ antiporter, isoform 2
MSFSAACSYLGGLMYLMYRLPFVECLMFGALISATDPVTVFSIFQELGTDVNLYALVFGESVLNDANFEGNNGYLSPDDQEPSSGNKIKMKLQEFQRSAASFTALDKNYPTPFLTSQNGDEEDE

SEQ ID NO: 131542 - protein, 347 aa, Glycine max
  Coding DNA Sequence Number=SeqID_14764
  Gene Ontology: Mol. function=protein binding
  Homolog annotation: Hit_ID=Q9ZVQ5; Match level="QueryCoverage=81%, HitCoverage=87%, E-value=2e-91, Identity=58%"; Hit description =Expressed protein
  Pfam annotation: Domain name=SNARE_assoc; Domain location=146-267; Score=112.1; E_value=1.6e-30; Accession=PF09335.1; Description=SNARE associated Golgi protein
MGSKETRFVVVWLGKETLVKAKLSGISMMTQESSEVLGKHASSGSHVRGSSEYIRLVISDEQRVVEAETLLTRAESRIKSFWWWMKSFLWCVVFVILVFILVKWGVPLFFVKVLYPIMEWEATAFGRPVLALVLVASLALFPVFLIPSGPSMWLAGMIFGYGLGFFIIMVGTTIGMVLPYLIGLLFRDRIHQWLKRWPQNAAMIRLAGEGNWSRQFQVVALFRVSPFPYTIFNYAVVVTNMRFWPYLCGSVAGMVPEAFIYIYSGRLIKTLADAQYGKHHLTTVEIVYNIISFIIAIVTTIAFTVYAKRTLNQLKMAELNDEVTFVSVEMEKLPLERPKQLSLSKFS

SEQ ID NO: 131543 - protein, 62 aa, Glycine max
  Coding DNA Sequence Number=SeqID_14765
  Homolog annotation: Hit_ID=Q1T1E6; Match level="QueryCoverage=91%, HitCoverage=14%, E-value=7e-08, Identity=45%"; Hit description=Zinc finger, CCHC-type; Peptidase aspartic, catalytic
  Subcellular localization annotation: CTP_CleavageSite=48; ConfidenceScore=5.01e-01
MNLIYVSQLCQTNNVYKLSPRSPTPHTSLATTANSIQLWHHCLSNSSSCTQDQQHLLYWHLQ

SEQ ID NO: 131544 - protein, 271 aa, Glycine max
  Coding DNA Sequence Number=SeqID_14766
  Gene Ontology: Mol. function=DNA binding; Cellular component =mitochondrion; Biological process=DNA integration
  Homolog annotation: Hit_ID=Q1SIP9; Match level="QueryCoverage=86%, HitCoverage=27%, E-value=6e-55, Identity=47%"; Hit description =Integrase, catalytic region
MSDEFTTLIENARLVAKGFHQCRGIDFKETFSPVIKPQTIKLVLCIAISNHWTLSQMDVNNALLHGTLTEEVYISQPTGFVHPNFPHVCKMHKALYGLKQAPRAWYNELKSFLVAYGFFNSRFEPFLFIYKQGFVTAYFLVYVDDLLVIIPIFLSPLKVPWLSNSPSNTWGPQVTSLVLSYYRHNLKASMIDAKPVCTPLSTSCSLSSVGDDSTCDVTSYRSITGSLHYLSITRPNVAVVVNKLTIYEDSYCHPHAGSQASTSLSQVYNIT

SEQ ID NO: 131545 - protein, 1090 aa, Glycine max
  Coding DNA Sequence Number=SeqID_14767
  Gene Ontology: Mol. function=protein serine/threonine kinase activity; Cellular component=integral to membrane; Biological process=protein amino acid phosphorylation
  Homolog annotation: Hit_ID=Q9CA77; Match level="QueryCoverage=94%, HitCoverage=95%, E-value=0.0, Identity=58%"; Hit description =Putative receptor protein kinase; 10992-14231
  Pfam annotation: Domain name=APH; Domain location=802-986; Score=2.1; E_value=0.0039; Accession=PF01636.13; Description=Phosphotransferase enzyme family
  Pfam annotation: Domain name=LRRNT_2; Domain location=30-74; Score =24.7; E_value=0.00033; Accession=PF08263.3; Description=Leucine rich repeat N-terminal domain
  Pfam annotation: Domain name=LRR_1; Domain location=102-124; Score =17.7; E_value=0.041; Accession=PF00560.23; Description=Leucine Rich Repeat
  Pfam annotation: Domain name=LRR_1; Domain location=126-146; Score =8.4; E_value=7.6; Accession=PF00560.23; Description=Leucine Rich Repeat
  Pfam annotation: Domain name=LRR_1; Domain location=148-170; Score =10.8; E_value=2.7; Accession=PF00560.23; Description=Leucine Rich Repeat
  Pfam annotation: Domain name=LRR_1; Domain location=173-195; Score =6.2; E_value=19; Accession=PF00560.23; Description=Leucine Rich Repeat
  Pfam annotation: Domain name=LRR_1; Domain location=197-216; Score =8.6; E_value=7; Accession=PF00560.23; Description=Leucine Rich Repeat
  Pfam annotation: Domain name=LRR_1; Domain location=218-241; Score =6.9; E_value=15; Accession=PF00560.23; Description=Leucine Rich Repeat
  Pfam annotation: Domain name=LRR_1; Domain location=243-265; Score =14.1; E_value=0.5; Accession=PF00560.23; Description=Leucine Rich Repeat
  Pfam annotation: Domain name=LRR_1; Domain location=267-289; Score =16.9; E_value=0.072; Accession=PF00560.23; Description=Leucine Rich Repeat
  Pfam annotation: Domain name=LRR_1; Domain location=291-313; Score =14.7; E_value=0.33; Accession=PF00560.23; Description=Leucine Rich Repeat
  Pfam annotation: Domain name=LRR_1; Domain location=315-337; Score =14.8; E_value=0.32; Accession=PF00560.23; Description=Leucine Rich Repeat
  Pfam annotation: Domain name=LRR_1; Domain location=339-362; Score =0.6; E_value=2.2e+02; Accession=PF00560.23; Description=Leucine Rich Repeat
  Pfam annotation: Domain name=LRR_1; Domain location=364-386; Score =12.3; E_value=1.4; Accession=PF00560.23; Description=Leucine Rich Repeat
  Pfam annotation: Domain name=LRR_1; Domain location=388-410; Score =17.0; E_value=0.066; Accession=PF00560.23; Description=Leucine Rich Repeat
  Pfam annotation: Domain name=LRR_1; Domain location=412-434; Score =17.7; E_value=0.041; Accession=PF00560.23; Description=Leucine Rich Repeat
  Pfam annotation: Domain name=LRR_1; Domain location=436-458; Score =13.4; E_value=0.85; Accession=PF00560.23; Description=Leucine Rich Repeat
  Pfam annotation: Domain name=LRR_1; Domain location=460-482; Score =13.8; E_value=0.64; Accession=PF00560.23; Description=Leucine Rich Repeat
  Pfam annotation: Domain name=LRR_1; Domain location=584-606; Score =2.7; E_value=89; Accession=PF00560.23; Description=Leucine Rich Repeat
  Pfam annotation: Domain name=LRR_1; Domain location=607-629; Score =8.7; E_value=6.8; Accession=PF00560.23; Description=Leucine Rich Repeat
  Pfam annotation: Domain name=LRR_1; Domain location=631-653; Score =13.3; E_value=0.91; Accession=PF00560.23; Description=Leucine Rich Repeat
  Pfam annotation: Domain name=LRR_1; Domain location=655-677; Score =3.4; E_value=66; Accession=PF00560.23; Description=Leucine Rich Repeat
  Pfam annotation: Domain name=LRR_1; Domain location=78-100; Score =5.4; E_value=28; Accession=PF00560.23; Description=Leucine Rich Repeat
  Pfam annotation: Domain name=Pkinase; Domain location=800-1073; Score= 154.9; E_value=2.1e-43; Accession=PF00069.15; Description=Protein kinase domain
  Pfam annotation: Domain name=Pkinase_Tyr; Domain location=800-1073; Score=99.4; E_value=1.1e-26; Accession=PF07714.7; Description =Protein tyrosine kinase
  Pfam module annotation: Pfam domain module=APH::LRRNT_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::Pkinase::...
  Pfam module annotation: Pfam domain module=Pkinase_Tyr; Domain location=802-986::30-74::102-124::126-146::148-170::173-195::197 -216::218-241::243-265::267-289::291-313::315-337::339-362::364 -386::388-410::412-434::...
  Pfam module annotation: Domain location=436-458::460-482::584 -606::607-629::631-653::655-677::78-100::800-1073::800-1073
MSEQETHSCGLLLFFFWILLSGKDVVGESLDKDKEVLLKLKLYLDSKILADRGGYIYWNTNSSNPCEWKGISCSATKRVVGIDLSNSDITGEIFKNFSQLTELTHLDLSQNTLSDEIPEDLRHCHKLVHLNLSHNILEGELNLTGLISLCTLDLSNNRFYGDIGLNFPAICANLVIANVSGNKLTGRIESCFDQCVKLQYLDLSTNNLSGSIWMKFARLNEFYVAENHLNGTIPLEAFPLNCSLQELDLSQNGFVGEAPKGVANCKNLTSLNLSSNNLTGTIPIEIGSISGLKALYLGNNSFSRDIPEALLNLTNLSFLDLSRNQFGGDIPKIFGKFKQVSFLLLHSNNYSGGLISSGILTLPNIWRLDLSYNNFSGPLPVEISQMTSLKFLMLSYNQFSGSIPPEFGNITQLQALDLAFNNLSGPIPSSLGNLSSLLWLMLADNSLTGEIPLELGNCSSLLWLNLANNKLSGSLPSELSKIGRNATTTFESNRRNYQMAAGSGECLAMRRWIPADYPPFSFVYSLLTRKTCRELWDKLLKGYGVFQICTPGERIRRTQISGYIQLSSNQLSGEIPSEIGTMVNFSMMHLGFNNFSGKFPPEIASIPIVVLNITSNQFSGEIPEEIGSLKCLMNLDLSYNNFSGTFPTSLNNLTELNKFNISYNPLISGVVPSTRQFATFEQNSYLGNPLLILPEFIDNVTNHTNTTSPKEHKKSTRLSVFLVCIVITLVFAVFGLLTILVCVSVKSPSEEPRYLLRDTKQWHDSSSSGSSSWMSDTVKVIRLNKTVFTHADILKATSSFSEDRVIGKGGFGTVYKGVFSDGRQVAVKKLQREGLEGEKEFKAEMEVLSGHGFGWPHPNLVTLYGWCLNGSEKILIYEYIEGGSLEDLVTDRTRFTWRRRLEVAIDVARALIYLHHECYPSVVHRDVKASNVLLDKDGKAKVTDFGLARVVDVGESHVSTMVAGTVGYVAPEYGHTWQATTKGDVYSFGVLVMELATARRAVDGGEECLVEWARRVMGYGRHRGLGRSVPLLLMGSGLVGGAEEMGELLRIGVMCTTDAPQARPNMKEVLAMLIKISNPKGDSSYGPYLI

SEQ ID NO: 131546 - protein, 390 aa, Glycine max
  Coding DNA Sequence Number=SeqID_14768
  Gene Ontology: Cellular component=microtubule
  Homolog annotation: Hit_ID=Q9FKS9; Match level="QueryCoverage=98%, HitCoverage=81%, E-value=1e-142, Identity=63%"; Hit description=WD -repeat protein-like
  Pfam annotation: Domain name=WD40; Domain location=326-364; Score =29.0; E_value=1.7e-05; Accession=PF00400.22; Description=WD domain, G-beta repeat
MAQQQEDEMEYVADDNEMAEVEDDMYFRGRVFGDSESESDDDDEYDSMENRMTDTSAAEARKGKDIQGIPWDRLSISREKYRQTRLEQYKNYENIPQSGEQSEKECTPTHRGGKYYDFWQNTRSVKSTILHFQLRNLVWATSKHDAYLVSSYSIIHWSSLNSKRSEILNVSGHVAPCEKHPGSLLEGFTQTQISTLAVRDKLLIAGGFQGELICKYVDRPGVSFCSRTTYDDNAITNAVEIYDHPSGAVHFMASNNDCGVRDFDMERFQLSKHFSFSWPVNHTSLSPDGKLVVIVGDNPEGILVDSQTGKVVFSFGLCYKFRMHCVWTVKPLCGHLDYSFASAWHPDGRIFATGNQDKTCRVWDVRNLSKSVTVLKGNLGAIRSIRFTSD

SEQ ID NO: 131547 - protein, 457 aa, Glycine max
  Coding DNA Sequence Number=SeqID_14769
  Gene Ontology: Mol. function=oxidoreductase activity; Cellular component=intrinsic to endoplasmic reticulum membrane; Biological process=electron transport
  Homolog annotation: Hit_ID=Q9FLK4; Match level="QueryCoverage=97%, HitCoverage=96%, E-value=1e-173, Identity=66%"; Hit description =Dimethylaniline monooxygenase (N-oxide-forming)-like protein
  Pfam annotation: Domain name=DAO; Domain location=10-283; Score= -33.1; E_value=0.00085; Accession=PF01266.14; Description=FAD dependent oxidoreductase
  Pfam annotation: Domain name=FMO-like; Domain location=8-429; Score= -241.3; E_value=8.4e-13; Accession=PF00743.9; Description=Flavin -binding monooxygenase-like
  Pfam annotation: Domain name=Pyr_redox_2; Domain location=10-291; Score=-28.2; E_value=0.015; Accession=PF07992.4; Description =Pyridine nucleotide-disulphide oxidor
  Pfam module annotation: Pfam domain module=DAO::FMO-like::Pyr_redox _2; Domain location=10-283::8-429::10-291
MASETNQSKNVCVIGAGPSGLLAARELRKEGHKVVVLEQNHDIGGQWLYDPNVQEEDPLGRDPWLKVHSSIYESLRFMSPREIMGSTDFPFLVKKGRDTRRFPSHTEFLLYLKDFCEWFKLSEMIKLNTKVHYVGPLNYGVPSEDLKWVVRSKENKSEEEVEQVFDAVVVATGHFSNPRLPCIQGMDTWKRKQMHSHIYRSSEPFRGEIVVVVGNFLSGQEISMELVKVAKEVHLSSKSLIIFEGLSKVISKNENFHLRPQIDTLQEDGTVIFTDGSNIIADTILYCTGYNYSYPFLDTKGIVVVDDNRVGPLYEHTFPPSLAPSLSFVGIPRKILGITFFESQGKWIAQLLSGKKVLPSYEEMMESIEEFYHSNEVAGIPKRYTHVVDAFDYCDKYGENVGFPKTEEWRKELCISAGMNAFANLETYRDSWNDDIDEKLQEALRSPYFTQLEQLSL

SEQ ID NO: 131548 - protein, 1698 aa, Glycine max
  Coding DNA Sequence Number=SeqID_14770
  Gene Ontology: Mol. function=nucleic acid binding; Cellular component= intracellular
  Homolog annotation: Hit_ID=Q67V89; Match level="QueryCoverage=62%, HitCoverage=98%, E-value=1e-173, Identity=40%"; Hit description=Zinc finger protein-like
MEDNEVVDDQNSGWFQVKKKHRNTSKFSLQSWVGGLSGKNASNSLHTQHSMTKTDDNSHSQQKTHLSRSGENFSQNPVPGSVASSISESNEKEGTNCLNTSVVRHNTGSQKSSTLLTMDSQGKHEEVRKLDQTDKPDLAQKTRWGDLEEGGLALPHENLIGVGIKFGSIGDDSLLSCRKNGNIPDPCDSYHPPEKNLTATTIDAEAVSGQIPPVRCEDEKLGENGKDVKNISLEHLNIQETNGERIGPEDDILHCVMKNDDVNKTTDSAINNDILSAKDATAVANQVHASINVVSDINISEVAEQNGSLSVALTAQGTESQVPEIVNDSVASAEVVSDPQDDIVENVVSTSHNMSSLEEGGSNESKERFRQRLWCFLFENLNRSVDELYLLCELECDLEQMKEAILVLEESASDFRELITRVEEFEKVKKSSQTIDGVPVILKSDHRRPHALSWEVRRMTTSPHRADILSSSLEAFRKIQEQRASLQSGTTENAMSKCLTSESIGNMNKSRVNDGTDDAKYSVTKSRKHVGSSDAKQGNPNEKNHSIDGGKPFDSVTVQNGCNPPESILTAEGKLSKLSLLENSSASATTKGKRDQLGFGSDKTLYKKDKAPTEVVNEKNARCTDNLRRQMPVPEKDKEKRSSAPGKSLNAWKEKRNWEDILSSPFRVSSRVPYSPSLSRKSAERVRTLHDKLMSPDKKKKTTSDLKREAEEKHARAMRIRSELENERVQKLQRTSQKLNRVNEWHAVRHMKLREGMYARHQRSESRHEAFLAQVVKRAGDESSKVNEVRFITSLNEENKKLMLRQKLHESELRRAEKLQVLKSKQKEDLAREEAVLERRKLIEAEKLQRLAEIQRRKEEAQVRREEERKASSAAREARAIEQLRRKEERAKAQQEEAELLAQKLAERLNESEQRRKIYLEQIRERANLRDQSSPLLRRSINKEGQGRSTPTNSSDDSQTNIVSGIGSSLRIGNVTLQHSIKRRIKRIRQRLMALKYEFLEPLLGGESASLGYRVAVGAARAKVGRWLQELQRLRQARKEGATSIGLIISEMIKYLEGKDPELQASRQAGLLDFIASALPASHTSKPEACQVMLHLLKLLRVVLSTPANRSYFLAQNLLPPIIPMLSAALENYIKIAASLSIPGNVSLPSSKALVENFESISEILNNFLWTVTAIFGHISSEERQLQMRDGLLELLISYQVIHRLRDLFALHDRPQMEGSAFPTPILLSIQLLVVLTSRSGRLSYIDWESSLVAMEQEIGSEGAKFADAAHFVVNNSWENFNPLSVTTGSSVVHLPDVPEDRPLEEMIKVNKSDESISIGKDCELEHDSSVKLKNDDMEKIDDLDESKKNQNGDITNLSVLQKDEKHTVVSVTVQKNERISNLAQPAVFLLSAISETGLVSLPSLLTAVLLQANNRSSSEQASYILPSNFEEVAAGVLKVLNNVALLDLVFLQQMLARPDLKMEIFHLMSFLLSHCACKWKAPNDQVGSLVLESLSLLGHFALFHPGNQAVLRWGKSPTILHKVCDLPFVFFSDPELMPILAGTLVAACYGCEQNKFVVQQELSVDMLLSLLRSCRNAAPATQLNSTLDNSTTDESSECNQLGTEVKKPQVDIPVKNSRSNGKGPRASSGKSGASGNNIKNGRIRSQRDGKTTKNSEEVAPKHGEPSNLMLHCRFPPSFIDKVEQFFSAEIANRVDEL

SEQ ID NO: 131549 - protein, 585 aa, Glycine max
  Coding DNA Sequence Number=SeqID_14771
  Homolog annotation: Hit_ID=Q10Q34; Match level="QueryCoverage=29%, HitCoverage=16%, E-value=3e-14, Identity=35%"; Hit description =Expressed protein
  Pfam annotation: Domain name=CaM_binding; Domain location=437-549; Score=60.3; E_value=6.2e-15; Accession=PF07839.2; Description=Plant calmodulin-binding domain
MAEESDVNQLKSEKIEPEDVDEKANPNERLTITKVPPKSLSRYLSPRKSSCHDLCKYGIPHEAKPWSPTQKRVTKKERKTKVPQEMTSLEGTKKSGSSSKPSQTSKIEKANIPVDTKEVTYEKTVTSGKNSPPYEETHVSSEHNNSDLKQEQSEPSLPVKESAESQTKREIVKNKSPSDSSSRKKTESRSKQKKTSLTGVKEKPTPPSLPLSPKHNVKKSQSLSSKSFMNMARESSLKPQDNVEEVTPELASSDNLPDNILHVTEPASANSSEDPTVACDATRLSSPSPSSSEEKSLKHTNEKTGKSAVSASSRKGLGSVAGNKEKVNTRSVSRSPSVSSYVSSSVSSLRKQNNATSKSNNRIHHHQGENVKMGYKIRPKMSTKVGAANKAVVTARKLNFRRGKVIELQPQCNNVPRRLKFKPTRILGDDMRKDINVARKKTIVDNKVGGDGEVNAATTKSEKDVAKLQTVEGSKRRIVGRKVGGDRSKIQGSKSGSDEKVVLRHQKVEGKKQNPRLYNNVIEETASMLTELRKSKVKALVGAFETVISLDSLREATATESDNLHMGQRGRRGYESNFGLKPWPL

SEQ ID NO: 131550 - protein, 226 aa, Glycine max
  Coding DNA Sequence Number=SeqID_14772
  Gene Ontology: Mol. function=oxidoreductase activity; Cellular component=intrinsic to endoplasmic reticulum membrane; Biological process=electron transport
  Homolog annotation: Hit_ID=Q9FF12; Match level="QueryCoverage=79%, HitCoverage=48%, E-value=8e-50, Identity=42%"; Hit description =Dimethylaniline monooxygenase-like protein
  Pfam annotation: Domain name=FMO-like; Domain location=17-226; Score=- 451.2; E_value=0.0064; Accession=PF00743.9; Description=Flavin -binding monooxygenase-like
MIKFNTKVLYVGPLNYGVPSEDLKWVVRSKEKKREEVEQVFDAVVVATGHHSKPRFPCMQGMDTWRRKQMHSHIYRSPEPFRGEWTRNIDGACESSEGGTPLLRVYLKSYPNTRTFTFIRRYNYSFPFLDTKGMVVVDDNRVGPLYEHTLPPLLAPPLSFIGIPKKILGLPFFESQGKWIAQLLSGKKALPSCEEMMKSIEEFYHSKEVVGIPKRFTHEIGAIGFE

SEQ ID NO: 131551 - protein, 280 aa, Glycine max
  Coding DNA Sequence Number=SeqID_14773
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ9; Match level="QueryCoverage=96%, HitCoverage=58%, E-value=1e-120, Identity=73%"; Hit description =Glycoside hydrolase, family 1
  Pfam annotation: Domain name=Glyco_hydro_1; Domain location=1-279; Score=128.7; E_value=1.6e-35; Accession=PF00232.9; Description =Glycosyl hydrolase family 1
LQPFVTLFHWDLPQTLEDEYGGFLSPRIINDFQDYTELCFKEFGDRVKHWITINEPWSYSIFGYATGMMPPSRCSKWLNPNCMDGDSGKEPYLVSHHLLLAHAAVVKMYKKKYQASQKGVIGITIVSNWFEAYSNNKLDKYAAQRAIDFMFGWFMEPLTSGNYPQSMRSLLGRRLPKFTKQQVKLINGSFDFLGLNYYTSNYVVNAPKLSNGKPNYATDSNANLTTQRNGTPIGPMAASNWLYVYPKGIRELLLYTKEKYNNPLIYITENGNYTKSYLLS

SEQ ID NO: 131552 - protein, 523 aa, Glycine max
  Coding DNA Sequence Number=SeqID_14774
  Pfam annotation: Domain name=LTV; Domain location=10-498; Score= -121.0; E_value=0.00077; Accession=PF04180.4; Description=Low temperature viability protein
MGGRKKKFIDKKNSATFQLIARDTSDPSFSQSDRVFVRVDNNPVSFPVADDSAFDDAPDDYYYDDDAGVSGGPLPEDVRREILELGFPDDGYNYLNHLREIKNSGAGAAFYHNPKFKLQHLPRDVKAFDASRLQIAEADGEPEENTIYSVASKTTSVRVQKAVDPEVAALLDDDDLSRLGSDVEDLEEDFVVQANLLEDEDEDEEEKDCIFNETSFSEESAIHRNGNSAHALQVSSYSRVTDDSGPLDGVTDGVPGEDCVGEKQRARRLLDEQFDLLERQEYGTDDDDGDYYENYEADEDESLAEKLKHSLNNHVLDDLELDDDKYKVPADLLKNKDAPHEEQEDSAADVIRRCKEYAEEYEVEDDHKDVVLVQESSDESEVWDCETIVSMYSNLDNHPGKIEAPGVTRKKKLSETVSAVLSSSSQIIPLRGKEKLPVDFLPGGRKPATEKVKGQSIAKTEQYKRKQHGLESKEEKKERKAAVKEERHEARRNKKEMKELYKCEAHRAQRAAAVSGPSSIHLL

SEQ ID NO: 131553 - protein, 257 aa, Glycine max
  Coding DNA Sequence Number=SeqID_14775
  Homolog annotation: Hit_ID=Q2HVE6; Match level="QueryCoverage=31%, HitCoverage=22%, E-value=8e-39, Identity=66%"; Hit description=Zinc finger, C2H2-type
MKVQLGMKVLEEVGGHVLNPEQGSAVASVFSGTASFHMSLPIGVYGVFLRTAFALPLFLTVFSAEVLLDAGEVAERPCGVVVDAGRFGTHVLIALEAFVADLSASRTSGFEGFLGFQGAEWTRRGEEQTPRNEEAVTPTRRLNIEYNGSDLCDSFEFKQITLQLNEAIQTSNESSPAYKEMTHRHKLKKAIQGSNGSSPSLVFHLNSPIYRRHLKRLYKESTKAPRRIFSPPVPDKPACVRGIREKGFVTRLWLKVY

SEQ ID NO: 131554 - protein, 386 aa, Glycine max
  Coding DNA Sequence Number=SeqID_14776
  Gene Ontology: Mol. function=diacylglycerol kinase activity; Cellular component=integral to membrane; Biological process=intracellular signaling cascade
  Homolog annotation: Hit_ID=Q39017; Match level="QueryCoverage=95%, HitCoverage=49%, E-value=1e-116, Identity=64%"; Hit description =Diacylglycerol kinase 1
  Pfam annotation: Domain name=DAGK_acc; Domain location=276-386; Score= -3.7; E_value=8e-07; Accession=PF00609.10; Description=Diacylglycerol kinase accessory domain
  Pfam annotation: Domain name=DAGK_cat; Domain location=85-214; Score =147.3; E_value=4e-41; Accession=PF00781.14; Description =Diacylglycerol kinase catalytic domain
  Pfam module annotation: Pfam domain module=DAGK_acc::DAGK_cat; Domain location=276-386::85-214
MEMNYLLNLGIVRALVKCPQKALVILIKYRMVIMKWVKKVARIRGFNIKIMNLRRNSSINQKDESHSLGVKQKYDLIDLPLDARPLLVFINKKSGAQRGDSLRMRLNILLNPVQVFELSSTQGPEMGLYLFRKVSHFRVLVCGGDGTVGWVLNAIDKQNFVSPPPVAILPAGTGNDLARVLSWGGGLGPVERQGGLTTFLHHIEHAAVTVLDRWKGVGWVIDGEKDVFRSLEHGLELVVMQRLLWTFIICVKRIQISFITSLSSSDLDLSDTLPWEMNDLSFQFMNKVLYAREGAKSIMDRTFADLPWQIRVEVDGVEIEVPEDAEGVLVANIGSYMGGVDLWQNEDENYDNFDQQSMHDKILEVVSISGTWHLGKLQLKGLLLEF

SEQ ID NO: 131555 - protein, 62 aa, Glycine max
  Coding DNA Sequence Number=SeqID_14777
MRMRRTRCFHLLHALVLTIGSCVAYLPNGIRVASQTHSIQASLLGTLEDFKVPHVNHVSRPS

SEQ ID NO: 131556 - protein, 273 aa, Glycine max
  Coding DNA Sequence Number=SeqID_14778
  Gene Ontology: Mol. function=oxidoreductase activity; Cellular component=mitochondrion; Biological process=aromatic compound catabolic process
  Homolog annotation: Hit_ID=Q2X9J2; Match level="QueryCoverage=93%, HitCoverage=100%, E-value=1e-128, Identity=92%"; Hit description =Oxidoreductase, short-chain dehydrogenase/reductase family
  Pfam annotation: Domain name=KR; Domain location=16-152; Score=-90.8; E_value=0.043; Accession=PF08659.1; Description=KR domain
  Pfam annotation: Domain name=adh_short; Domain location=12-180; Score= 111.9; E_value=1.8e-30; Accession=PF00106.15; Description=short chain dehydrogenase
  Pfam module annotation: Pfam domain module=KR::adh_short; Domain location=16-152::12-180
MSKTHLFDLDGKIAFVSGASRGIGEAIAHLLAQQGAHVIVSSRKLDGCQQVAEAIIAAGGKATAMACHIGELEQIQQVFAGIREQFGRLDILVNNAATNPQFCNVLDTDPGAFQKTVDVNIRGYFFMSVEAGKLMREQGGGSIINVASINGVSPGLFQGIYSVTKAAVINMTKVFAKECAPFGIRCNALLPGLTDTKFASALVNNDAIRNAALQQIPLKRVADPKEMVGDRVVPGQRCLQLYHRHGAQCQWRVSVLIMLWLPSAYSSVASAQA

SEQ ID NO: 131557 - protein, 121 aa, Glycine max
  Coding DNA Sequence Number=SeqID_14779
MVGYTPSSFADMVFAGKRIEVGLKRGKFGHPALIKTGANEEDENEGETHVVAAIPIWPSFPPIQQCHYSANNNPSPYPPQNPPTTRPMLNTTFSTNQNTNQEMSFAAKKTCRIHPNFGVLC

SEQ ID NO: 131558 - protein, 132 aa, Glycine max
  Coding DNA Sequence Number=SeqID_14780
MGIAEEVQEKVKADMEAMKEQMATMMEAMMSMKKIMEANAVAVAATSAVAKVNPMPPSDLNQMNHPTSDMVDKDLGSADDPMMCKFKTSTSSCHMACLPTIHHPIWRTLPIRISITPLPYSLKCLSTHGGGT

SEQ ID NO: 131559 - protein, 173 aa, Glycine max
  Coding DNA Sequence Number=SeqID_14781
MFKIESRTLQDSRGKLKNTSRFKRKVKFRNQESRIKIQDSRFKNQESRKDLMKISMKRSFQKLSSTWIFLKTCLPKSFYSLEHEMELQRINQNEENDKKKRSITLKASSSMQEEKEEEDSDDEEYFSFFVKKFQKFIKKRRIDRRQNFNNGRKSQDDSQVLRCYKCNQIGHIK

SEQ ID NO: 131560 - protein, 180 aa, Glycine max
  Coding DNA Sequence Number=SeqID_14782
MEVNMATVIAASTATEVDPTHPSGLNQSKHSFPPYGLPPNYTPLNVAHASDENVDNSAPIPIENQQPQSDHAHVSQPIGETHEVPHHTLADFEPHLGYATEGQAFGGIPLPNTLGGPQYHPQPQPLHFALERLPPAIVEREKFNHIEERLRTIKGGGDYAFTDMAKLCLVPDVIIPPKFK

SEQ ID NO: 131561 - protein, 309 aa, Glycine max
  Coding DNA Sequence Number=SeqID_14783
  Gene Ontology: Mol. function=DNA binding
  Homolog annotation: Hit_ID=Q1S0F5; Match level="QueryCoverage=93%, HitCoverage=57%, E-value=1e-32, Identity=34%"; Hit description=IMP dehydrogenase/GMP reductase
MGTNQIGKRFYQVKIKGLYVTSLKELGQLMGQLQRQAFRKAYGKIWDLAMVEVSTEAIVSLAQYYDQPLRCFTFGDFQLSPMVEEFEEILGCPLGGRRPYLFSGFYPSLARISKIVQIPAQELDHGKQVKNGVVGIPRKCLEAKTRTLAGRGEWAPFIDILALLIFGGVLFPNVDGLVDLAAIDAFLAYHDHKESPVVAMLADLYDTFDRRCEKSSTRIVCCTPALYVWLVLHLFRQEVRHACPLESHRSCTEKGGANWDRLLAIKEGASVNWFPRWKEGRTGVLISCRGFLNVPLMGTRGCISYNPVL

SEQ ID NO: 131562 - protein, 61 aa, Glycine max
  Coding DNA Sequence Number=SeqID_14784
MQQGQADILIARFPDPSYGVKTITFTKSLSLEFFKGNVKHAMTVPKSEKIQRQAETNKKQA

SEQ ID NO: 131563 - protein, 97 aa, Glycine max
  Coding DNA Sequence Number=SeqID_14785
  Gene Ontology: Mol. function=structural constituent of ribosome; Cellular component=ribonucleoprotein complex; Biological process =translation
  Homolog annotation: Hit_ID=Q2QW49; Match level="QueryCoverage=59%, HitCoverage=12%, E-value=2e-09, Identity=55%"; Hit description =Ribulose bisphosphate carboxylase large chain, putative
YSGEQISSGDDGVGPVAQRIRARGYEPRCRGFESLLAHNRPKKGRIFPSGGRKIMIGLADPKLWNFPGLWNKGVSRTYTEVLTAILKYRRTEQNGIR

SEQ ID NO: 131564 - protein, 184 aa, Glycine max
  Coding DNA Sequence Number=SeqID_14786
  Homolog annotation: Hit_ID=Q9AVH2; Match level="QueryCoverage=53%, HitCoverage=46%, E-value=3e-47, Identity=71%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFT

SEQ ID NO: 131565 - protein, 59 aa, Glycine max
  Coding DNA Sequence Number=SeqID_14787
MAEINQGETMTGHDWSHIIWLLLAGDGLRPRVHPEAMGHTTLPPLSCYSCLNMCPPSAR

SEQ ID NO: 131566 - protein, 304 aa, Glycine max
  Coding DNA Sequence Number=SeqID_14788
  Gene Ontology: Mol. function=transcription factor activity; Cellular component=nucleus; Biological process=regulation of transcription, DNA-dependent
  Homolog annotation: Hit_ID=Q8RZ73; Match level="QueryCoverage=78%, HitCoverage=45%, E-value=2e-63, Identity=54%"; Hit description =Gibberellin response modulator-like protein
  Pfam annotation: Domain name=GRAS; Domain location=42-304; Score =144.0; E_value=4.2e-40; Accession=PF03514.5; Description=GRAS family transcription factor
MAPSSGITKGSREPSSRNSIPKLHFRDHIRTYTQRYLAAEPVEEASEDTNSSESSGGEEDGCADGVRLVQLLIACAEAVACRDKSHASILLSELKANALVFGSSFQRVASCFVQGLTERLNLIQPIGSAGPMMAPAMNIMDAASDEMEEAYRLVYELCPHIQFGHYLANSTVLEAFEGESFVHVVDLGMSLGLRHGHQWRALIQSLANRASGERVRRLRITGVGLCVRLQTIGEELSVYANNLGINLEFSVVNKNLENLKPEDIEVREEEVLVVNSILQLHCVVKESRGALNSVLQMIHGLGPK

SEQ ID NO: 131567 - protein, 433 aa, Glycine max
  Coding DNA Sequence Number=SeqID_14789
  Gene Ontology: Mol. function=RNA-directed DNA polymerase activity; Cellular component=nucleus; Biological process=RNA-dependent DNA replication
YHWESCWQLDYDDKAEGVINLDDLLMQFKDTVESMQQAFRRTTTHISKLVDDMANTAAREEEERIEIETYQESIFQVTSIHNQMTTEEETSIISSTPEYSCSAFAGYVRGTEKGRLKLTVEDQKESFDLFEAMKHSDMGDACSEEEEVEQEIVLTTSTMKQHFPFEKELGGEIDSLVDNEECDDPKDNCVDRVVFEKLEKIRPPVKPKAELKTLPAHLKYIFLEDDETRSVIISNSLKKEEEDQLPQRRLNPIMKEEVRKEVLKLLEAGLIYPISDSSWVSPVQVVPKKGGMTVVKNDQNELIPTRTVTGWRMCIDYRKLNEATRKYHYLLRFMDQMLERLVGQSFYYFLDGYSGCNQIVVDPQDQDNTAFTCPFGVFAYRRMPFGLCNAPATFQRCMMAIFADMVEKCIEFFMDDFSVFGASFENFLANLDK

SEQ ID NO: 131568 - protein, 95 aa, Glycine max
  Coding DNA Sequence Number=SeqID_14790
MYTDSHSGISAHQRDSKVSMTDLVSAEDDVNLRVSTGLSAAIDEGRRRRRADNRKVSPRATRFLGHGNKSGVVDKSEAVAPTYPQMRNSDLRSSG

SEQ ID NO: 131569 - protein, 42 aa, Glycine max
  Coding DNA Sequence Number=SeqID_14791
MIKASRVRPIPENAMRCWEMVEVGPVYYSSLAPISPWGVGSQ

SEQ ID NO: 131570 - protein, 91 aa, Glycine max
  Coding DNA Sequence Number=SeqID_14792
MPKLLIFVLLCASTQCGSMTEMQALMSIKLNLLIIIVHTYNFILNSKQLCHFLLNYCYVWPHLVRIYLLLGTAHSMSRPVAHLLAKRTSTS

SEQ ID NO: 131571 - protein, 105 aa, Glycine max
  Coding DNA Sequence Number=SeqID_14793
METYEPETEIEEEKSISRKDSLNTPMQNQTPSKVEADSFEKIASTNQTLSTTKQSLWKMDLHALGISYKIKRLKQQLVLVERLIGRQANDELAEITDDSKVGMKE

SEQ ID NO: 131572 - protein, 244 aa, Glycine max
  Coding DNA Sequence Number=SeqID_14794
  Gene Ontology: Mol. function=isomerase activity; Biological process =cell redox homeostasis
  Homolog annotation: Hit_ID=Q1RTP5; Match level="QueryCoverage=86%, HitCoverage=75%, E-value=9e-77, Identity=64%"; Hit description =Thioredoxin domain 2; Thioredoxin fold
  Pfam annotation: Domain name=Thioredoxin; Domain location=7-112; Score=-2.0; E_value=0.00024; Accession=PF00085.10; Description =Thioredoxin
MQDKAQIVPGPVDGNFIEGVLSGRKRVGYISILFYASWCRFSRRMLPEFEILSSMFPQVQHVALEQSSALPSLYSKYGIHSLPAILLVNQTSRVRYHGPKNLNSLVEFYERNTGLEAKDNAVVGQPSNFLSDEHSTMKGFSLKEIFNREPYLALSILFLCLRIILFVFPTIMPRLKAFWTSYASHLNLQIFGQVMERVLNVIDVKRIWTKLRLCKTRNFHERVRSARVWASSLASVSLGGSSAR

SEQ ID NO: 131573 - protein, 409 aa, Glycine max
  Coding DNA Sequence Number=SeqID_14795
  Gene Ontology: Mol. function=binding; Cellular component=nuclear pore; Biological process=protein import into nucleus, docking
  Homolog annotation: Hit_ID=Q2HVN9; Match level="QueryCoverage=91%, HitCoverage=32%, E-value=1e-165, Identity=80%"; Hit description =Armadillo-like helical
  Pfam annotation: Domain name=HEAT; Domain location=205-241; Score =31.9; E_value=2.2e-06; Accession=PF02985.12; Description=HEAT repeat
  Pfam annotation: Domain name=HEAT; Domain location=42-79; Score=6.3; E_value=7.3; Accession=PF02985.12; Description=HEAT repeat
  Pfam module annotation: Pfam domain module=HEAT::HEAT; Domain location=205-241::42-79
MKKLGRQQFQVFSWLSMPELLSSAKSAVVKGQSQGRDETYVKQLSDYIIPNLVEALHKEPEVEICASMLDALNECIQLARICSQVSGSHLDEKQVRSIVDEIKQVLTASSSRKHERAERAKEEDFDAEERELLNEENEQEEELFDQVGDCLGTLIKTFRTSFLPFFDELSSYLTPLFGKDKTSEERRIAICIFDDVAEHGREAALKYYDSFLPFLLEACNDEYPDVRQAAVYGVGVCAEFGGSVFSPLVGEALSRLDAVIRHPNALHADNIMAYDNAVSALGKICQFHRDSINAAQLNLRIKVVPAWLSCLPIKGDLIEAKVVHDQLCSMVERSDRELIGPNNQYLSKIVAVFAEILCAGNDLATEQTVSRMINLLRQLQQTLPPSTLASTWSSLQPQQQLALQSILSS

SEQ ID NO: 131574 - protein, 261 aa, Glycine max
  Coding DNA Sequence Number=SeqID_14796
  Gene Ontology: Mol. function=transferase activity; Cellular component= membrane
  Homolog annotation: Hit_ID=Q2HVN7; Match level="QueryCoverage=98%, HitCoverage=47%, E-value=1e-100, Identity=82%"; Hit description =Exostosin-like
MLPSPQNLLRLSNWGMASDRKVNGVCLCHRNSAQRENLRMLVGPADTCTMLYLEPGFCLTSAWYCVFYGVDEGKFENNDVFHDRDVFLEDYKEMNRSLKIYVYPHREDDPFANVLLPVESEPGGNYTSESYFKKVLMKSHFITKDPPEADLFFLPFSMARLWHDRRVGVGGIQDFIRDYIHNISHRYPYWNNTGGADHFYVACHSIGRSAMDKAPDEKFNAIQVVCSSSYFLTGYFAHKDACLPQIWPRKGNPPNLVSSQR

SEQ ID NO: 131575 - protein, 676 aa, Glycine max
  Coding DNA Sequence Number=SeqID_14797
  Gene Ontology: Mol. function=binding; Cellular component=nuclear pore; Biological process=protein import into nucleus, docking
  Homolog annotation: Hit_ID=Q2HVN9; Match level="QueryCoverage=95%, HitCoverage=58%, E-value=0.0, Identity=79%"; Hit description =Armadillo-like helical
  Pfam annotation: Domain name=HEAT; Domain location=141-177; Score =17.0; E_value=0.069; Accession=PF02985.12; Description=HEAT repeat
  Pfam annotation: Domain name=HEAT; Domain location=229-265; Score =7.9; E_value=4.7; Accession=PF02985.12; Description=HEAT repeat
  Pfam annotation: Domain name=HEAT; Domain location=375-411; Score =6.3; E_value=7.3; Accession=PF02985.12; Description=HEAT repeat
  Pfam annotation: Domain name=HEAT; Domain location=417-452; Score =30.9; E_value=4.4e-06; Accession=PF02985.12; Description=HEAT repeat
  Pfam annotation: Domain name=HEAT; Domain location=458-495; Score =10.4; E_value=2.3; Accession=PF02985.12; Description=HEAT repeat
  Pfam annotation: Domain name=HEAT; Domain location=501-537; Score =14.8; E_value=0.32; Accession=PF02985.12; Description=HEAT repeat
  Pfam annotation: Domain name=HEAT_PBS; Domain location=396-432; Score= 1.2; E_value=68; Accession=PF03130.6; Description=PBS lyase HEAT-like repeat
  Pfam annotation: Domain name=HEAT_PBS; Domain location=437-474; Score= 10.6; E_value=3.4; Accession=PF03130.6; Description=PBS lyase HEAT -like repeat
  Pfam annotation: Domain name=HEAT_PBS; Domain location=522-558; Score= 5.1; E_value=20; Accession=PF03130.6; Description=PBS lyase HEAT-like repeat
  Pfam annotation: Domain name=IBN_N; Domain location=42-115; Score =8.5; E_value=0.01; Accession=PF03810.9; Description=Importin-beta N -terminal domain
  Pfam module annotation: Pfam domain module=HEAT::HEAT::HEAT::HEAT::HEA T::HEAT::HEAT_PBS::HEAT_PBS::HEAT_PBS::IBN_N; Domain location=141 -177::229-265::375-411::417-452::458-495::501-537::396-432::437 -474::522-558::42-115
MASDSIQQSEAQVALILGPDSAHLESLISQLMSSSNDQRSQAESLFNLCKQARPEALLLGLAHLLHSSPNPETRTMSAILLRRHLTRHHDSFLWPLLSPPARSSLHSLLLSSLHNEPLKSITKKLCDTVSELAAATLPDDSAAWPDLLPLLFQWVTSPDPRLQEISLLIFAQLAHYIGQTLLPQISTLHSVFLRSLHSSTPADVRIAALAAAINFIQCLTNSSDRDRFQDLLPLMMQTLTEALNSGQEAVAQEALELLIELAGTEPRFLRRQIVDVVGSMLQVAEAETLEEGTRHLAIEFVVTLAEARERAPGMMRKFPQFVRKLFGVLMNLVLDIEDDPAWHGAVDEDEDAGETSNYGFGQECLDRLSISLGGNTIVPVASELLPTYLAAPEWEKHHAALIALAQIAEGCSKVMIKNLEQVLSMILNSFRDPHPRVRWAAINAIGQLSTDLGPDLQVKFHHLVLPALAGAMDDFQNPRVQAHAASAVLNFTENCTPDILTPYLDGIVSKLLVLLQNGKQMVQEGALTALASVADSSEVQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEDDDRCPFSYYY

SEQ ID NO: 131576 - protein, 73 aa, Glycine max
  Coding DNA Sequence Number=SeqID_14798
  Subcellular localization annotation: CTP_CleavageSite=23; ConfidenceScore=5.21e-01
MWLRMPPDSWVTVTKSGVVDKSRAFAPKYPQFVMRNSDLRKRQNFQLIRATYAFWMKNNVSIGEGEYADEIFS

SEQ ID NO: 131577 - protein, 416 aa, Glycine max
  Coding DNA Sequence Number=SeqID_14799
MEISHDIKIKDDKLGGVKEEKIKVEVELKNKSVEKEHTKSKEEKKHKDEDKSKKKKKEKGEEEDEEGEKKEKDVKDKGEDGEEKEKKEKDKKERKKEKKDKDDKTDVEKVKGKEHDGEDAEEKKEKKKKEKKDKDDKTDVEKVKGKEDKEKKKKEKKVKDDKTDAEKVKGKEDDGEDNEEKEEKKKKKKKEKDDKIDVEKVKGKEDDGEDEGKKEKKKKEKKDKDEETDTLKGKGKNGDGEEKKEKKEKEKKKEKKDKDEETDTLKEKGKNDEGEDDEENKKNKKKDKKEKEKDHKKEKKEDGKEEGEKEKSKVEVSVRDIDIEETTKEGEKEDKEKDDGKEVKEKKKKEDKDKKEKKKVTGKDKTKDLSALKQKLEKINGKIQPLLEKKADIERQIKEAEAEGHVVNGKDKDEVQ

SEQ ID NO: 131578 - protein, 182 aa, Glycine max
  Coding DNA Sequence Number=SeqID_14800
  Gene Ontology: Mol. function=transferase activity; Cellular component= membrane; Biological process=RNA-dependent DNA replication
  Homolog annotation: Hit_ID=Q2HVN7; Match level="QueryCoverage=86%, HitCoverage=32%, E-value=1e-70, Identity=79%"; Hit description =Exostosin-like
  Pfam annotation: Domain name=Exostosin; Domain location=1-139; Score=- 71.7; E_value=0.00014; Accession=PF03016.6; Description=Exostosin family
MKLHHNNDFFFQYIKKRLAFFAGGVNSPVRVKLLETWKNDSEIFVHHGRLKTPYADELLGSKFCLHVKGFEVNTARIGDSLYYGCVPVIIANYYDLPFADVLNWKSFSVVVTTLDIPLLKKILKDIISSNKYLMLQSNVLKVRKHFQWHSPPQDFDAFYMVMYELWLRRSSIKNTWVDSFRV

SEQ ID NO: 131579 - protein, 67 aa, Glycine max
  Coding DNA Sequence Number=SeqID_14801
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=85%, HitCoverage=25%, E-value=2e-14, Identity=55%"; Hit description =Protein ULTRAPETALA2
MTHASLYCIQITCDDDEERSSLKASRGCSRSSTCQGCSTCYYEGCIKCRFEDCNCQECRDFMLYAEP

SEQ ID NO: 131580 - protein, 153 aa, Glycine max
  Coding DNA Sequence Number=SeqID_14802
  Homolog annotation: Hit_ID=UPI00006A17C9; Match level="QueryCoverage =76%, HitCoverage=27%, E-value=4e-07, Identity=29%"; Hit description =UPI00006A17C9 related cluster
MIGTSKPYTGAMRGIVHEPQGYTPSPWVLVTLTVERTTRPRLERTTRPHHHRAARPHLQRTISPRLERATRPHLGGLHVLALRGLHVLTIRGLHALTSRGQHVLALRGLHALTLGTSYPHRQRTTRPRLERTTRPRLERTTRPHHQRAARPHL

SEQ ID NO: 131581 - protein, 352 aa, Glycine max
  Coding DNA Sequence Number=SeqID_14803
  Homolog annotation: Hit_ID=Q9ZEL8; Match level="QueryCoverage=42%, HitCoverage=92%, E-value=1e-62, Identity=78%"; Hit description =Transcriptional activator
  Pfam annotation: Domain name=ALAD; Domain location=1-79; Score= -161.3; E_value=1.9e-06; Accession=PF00490.11; Description=Delta -aminolevulinic acid dehydratase
MVMVKPGMPYLDVVRRVKDTFGVPTFAYQVSGEYAMHMAAIQNGWLQEQPAVMESLMCFKRAGADGVLTYFAKRVAQRLRAPFALHLLELSVVDALADLFVDQVQQQHGAGLAVRLGVDRLQPFEHAVDDQDGIPRLRGFRIDIGFAGVRAQLIDHLARDDARQRAEAHEVADAAGGADGGGVNALRVELHKQIVGKQGFADRDTLAAHDLFQRDDRAEAVYLLPFQMFLRPQQLTAASGYIVMQVSACNITYLYEYAAISEGSHTYRYGAVWQGVAPPAVTLFIVFDRGKINGAVSVEQRQAVWRSRAAGVCQKPTAGDDCASRHQIRRFYPLCADPLRLRPACAGAGANA

SEQ ID NO: 131582 - protein, 102 aa, Glycine max
  Coding DNA Sequence Number=SeqID_14804
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=99%, HitCoverage=31%, E-value=1e-35, Identity=63%"; Hit description =Photosystem II 44 kDa reaction center protein precursor
QRLGANVGSAQGPTGLEPLRGPNGLDLSRLKKDIQPWQERRSAEYMTHAPLGSLNSVGGVATEINAVNYVSPRSHLWHAGRARAAAAGSKKELIEILNQFFP

SEQ ID NO: 131583 - protein, 210 aa, Glycine max
  Coding DNA Sequence Number=SeqID_14805
  Gene Ontology: Mol. function=protein binding; Biological process =defense response
  Homolog annotation: Hit_ID=Q1SWW3; Match level="QueryCoverage=91%, HitCoverage=16%, E-value=1e-16, Identity=33%"; Hit description =Disease resistance protein
  Pfam annotation: Domain name=LRR_1; Domain location=142-164; Score =10.8; E_value=2.7; Accession=PF00560.23; Description=Leucine Rich Repeat
  Pfam annotation: Domain name=LRR_1; Domain location=18-45; Score=7.3; E_value=12; Accession=PF00560.23; Description=Leucine Rich Repeat
  Pfam module annotation: Pfam domain module=LRR_1::LRR_1; Domain location=142-164::18-45
MTTKQSVLPENAISNLSSLEHLSIEFCNNVESLFSGIKLPFLKALYVSSGNRLKSMRLESKHFPALEILAVRNCEKLELSNDQEDQNFNLRLKTIFFYSLPQLVTLSHWLQGSKHFNILGTNRVLQSCNLEVLPDWLPALTSLKLLFIKDCPKLRSLPDGIHCLTALEHLKIEDCPELCNKYKPQVGENWNQISHIKQIRIGEQNIWKKS

SEQ ID NO: 131584 - protein, 631 aa, Glycine max
  Coding DNA Sequence Number=SeqID_14806
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HVM0; Match level="QueryCoverage=96%, HitCoverage=96%, E-value=0.0, Identity=80%"; Hit description =Glycoside hydrolase, family 3, N-terminal; Glycoside hydrolase, family 3, C-terminal
  Pfam annotation: Domain name=Glyco_hydro_3; Domain location=103-340; Score=304.4; E_value=2.1e-88; Accession=PF00933.12; Description =Glycosyl hydrolase family 3 N terminal domain
  Pfam annotation: Domain name=Glyco_hydro_3_C; Domain location=412 -624; Score=197.9; E_value=2.4e-56; Accession=PF01915.12; Description= Glycosyl hydrolase family 3 C terminal domain
  Pfam module annotation: Pfam domain module=Glyco_hydro_3::Glyco_hydro_ 3_C; Domain location=103-340::412-624
MAKISILLVGLWLLGSWTGLLDAEYMKYKDTKESIDTRVEDLVSRMTLEEKIGQMLQIERKYASADLVKKYFIGSVMSEGGSVPAPQASAETWIDMVNEFQKGALSTRLGIPMFYGIDAVHGHNTINNATIFPHNIGLGATRDPELVKRIGAATALELRATGIQYTYAPCIAVCRDPRWGRCYESYSEDPKLVQAMTEIIPGLQGDIPDNLPKGVPFMTGKEKVLACAKHYVGDGGTINGIDENNTVIDRDGLMRIHMPGYFNSISKGVASIMVSYSSWNGVKMHANNDLITGYLKNTLHFKGFVISDFEGIDRITLPPHANFTYSIEAGVSAGIDMFMNPKLYIEFIEDLIMLVKNKFIPMSRIDDAVRRILWVKFMMGIFETPFADYSLVGYLGIQKHRQLAREAVRKSMVLLKNGESADKPLLPLPKKVPKILLAGSHADNLGYQCGGWTIEWQGVSGNNLLKGTTILTAVKNTVDPETTVVYKENPDAEFVKSNEFSYGIVVVGENPYAEMHGDNMNLTIPDHGPETIANVCGAIKCVVIVISGRPVVIEPYVDSVDALVAAWLPGSEGQGVADVLFGDYGFTGKLLSTWFKTVDQLPMNVGDPHYDPLFPFGFGLSTKPTKGFYSE

SEQ ID NO: 131585 - protein, 616 aa, Glycine max
  Coding DNA Sequence Number=SeqID_14807
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HVM0; Match level="QueryCoverage=99%, HitCoverage=97%, E-value=0.0, Identity=81%"; Hit description =Glycoside hydrolase, family 3, N-terminal; Glycoside hydrolase, family 3, C-terminal
  Pfam annotation: Domain name=Glyco_hydro_3; Domain location=103-340; Score=294.6; E_value=1.8e-85; Accession=PF00933.12; Description =Glycosyl hydrolase family 3 N terminal domain
  Pfam annotation: Domain name=Glyco_hydro_3_C; Domain location=412 -616; Score=175.8; E_value=1.1e-49; Accession=PF01915.12; Description= Glycosyl hydrolase family 3 C terminal domain
  Pfam module annotation: Pfam domain module=Glyco_hydro_3::Glyco_hydro_ 3_C; Domain location=103-340::412-616
MAKISILLVGLWLLVNWSGLLDAKNMKYKNPKHSTDTRVEDLVSRMTLEEKIGQMLQVERKYVSADLLKKYFIGAVLSEGGSIPAPQASAETWIDMVNEFQKGALSTRLGIPMFYGIDAVHGHNTVHNATIFPHNIGLGATRDPELVKRIGAATALEVRATGIQYVYSPCIAVCRDPRWGRCYESFSEDPELVQAMTEIIPGLQGDIPNDSPKGVPFITGKEKVIGCAKHYVGDGGTINGIDEHNTVIDRDGLMKIHMPGYFSSISKGVATIMASYSSWNGVKMHAHHDLITGFLKNTLHFKGFVISDFEGLDRITSPPRANITYSIEAGVSAGIDMFMVPKHYTEFIDVLTMLVKNKHIPMSRIDDAVGRILWVKLMMGIFENPFADYSLVKYLGIQEHRNLAREAVRKSMVLLKNGESADKPLLPLPKKSPKILVAGSHADNLGYQCGGWTIEWQGVSGNNLLKGTTILTAVKNTVDPETTVVYKENPDVEFVKSNGFSYAIVIVGEHPYAEMYGDSMNLTIPEPGPKIITNVCGAIKCVVIIISGRPVVIEPYVGLIDALVAAWLPGSEGQGVADVLYGGYGFTGKLPRTWFKTVDQLPMNVGDPHYDPLFPF

SEQ ID NO: 131586 - protein, 118 aa, Glycine max
  Coding DNA Sequence Number=SeqID_14808
MQVVVGWNTGNEDDNDDGGSGMVNGGCGGDGSDGMVVVVATTTIGGIVVEAVHDNDNGGDIMVVAVAAAGIWRWWWWNSDDGGGNNGVWWQWKWNGGVGGDDNNVVVTTTVLVGVVVV

SEQ ID NO: 131587 - protein, 116 aa, Glycine max
  Coding DNA Sequence Number=SeqID_14809
MKNTISSTETTLDTHCSLLLNADRTPSMHYFETQSQRLTEKHYKTYLSCIILVVIIHTLSLCGKGSLPKMSLHKMKQQPSLKTLTFIVKAWKEELVAVAEFRKEDDFPVTESVKTY

SEQ ID NO: 131588 - protein, 83 aa, Glycine max
  Coding DNA Sequence Number=SeqID_14810
MKVQVQKDKALEWRMIKTSQSNPCGIYPDLSYFTGSGVYPDLSYFTGSGVYLDLSSFFKSDVIQISVVCIKRSAPTFTSTNYD

SEQ ID NO: 131589 - protein, 81 aa, Glycine max
  Coding DNA Sequence Number=SeqID_14811
MEAPCVIRGAQDSEVSSETLSVIGYLATVFMHTYREVNVCADPLAKMGSLSNRHFVALEVCPASLICKVAVDAAGTIFLGL

SEQ ID NO: 131590 - protein, 342 aa, Glycine max
  Coding DNA Sequence Number=SeqID_14812
  Gene Ontology: Mol. function=RNA-directed DNA polymerase activity; Biological process=RNA-dependent DNA replication
  Pfam annotation: Domain name=zf-CCHC; Domain location=77-94; Score =10.1; E_value=0.022; Accession=PF00098.13; Description=Zinc knuckle
MNWEEVAGFEILDIGRDYYMSLSIWRIEKTLVWIQFPWLNLVYYDESILLALARAVGKPVKVNINTKDASGEASLHRICGSCGCYGHLTRDCKKELVIAQPSPSAEKFSFTEQPQQPAIDTIVRGFIWGSNASHWVDWVTITKPKSKGGLGIRKARQKNISLLRKHARAFMNDPGKLWVCILSDKYLCNSSIFQATQHPRSSILQAFDMLKNGFSFRIGHGDFSLWFKYWFEGKKLCDMVLYVHTMDNQLRLCDVFHNGSWNWKRKTLAIDIPNEVRQKTQHIFVFMKISRRPTFGVPFGCDGVEETRTHTLRDFPKAKVIWCQLHFDDNNEFFSIVSILEE

SEQ ID NO: 131591 - protein, 990 aa, Glycine max
  Coding DNA Sequence Number=SeqID_14813
  Gene Ontology: Mol. function=RNA-directed DNA polymerase activity; Cellular component=chromatin; Biological process=chromatin assembly or disassembly
  Pfam annotation: Domain name=Chromo; Domain location=940-988; Score =18.9; E_value=0.0058; Accession=PF00385.14; Description='chromo' (CHRromatin Organisation MOdifier
  Pfam annotation: Domain name=rve; Domain location=649-805; Score =85.1; E_value=2.2e-22; Accession=PF00665.16; Description=Integrase core domain
  Pfam annotation: Domain name=zf-H2C2; Domain location=594-631; Score =19.5; E_value=0.00093; Accession=PF09337.1; Description=His(2) -Cys(2) zinc finger
  Pfam module annotation: Pfam domain module=Chromo::RVT_1::rve::zf -H2C2; Domain location=940-988::136-305::649-805::594-631
MKFNHLGQAIELRADVKNGPEPVSAPQVKHLIRTGSTSALFHLSLLPTSRLDPPNHHLPHPVPAIESLLHHYQHIFQTPPTLPPPPPREVTHRINLLPSTSLVNVRPYRYPYFQKTEIERQVSDLLSADLIRPSTSSYSSPVLLVKKKDDTWQMCVDYHALNVVIIRDHFLIPTIDELLDELSQASWFSKLDLRKGFHQILMHEPDIEKIAFRTHQGHYEYGVMPFGLSNAPSTFQAAMNNLLTPFLKCFATVFFDDILVYSKSLSSHIQHLEMIFQALLQGQFYPKHTKCIFARNQVEYLGHVVSGRGVEPEPSKVQAMVQWPTPTSVKELRGFLGLTGFYPKFIRNYASITTPLTTLLCKDAFEWTEDSQAAFDQLKMAMTRAPVLALPNFSEPFVIETDASRTAMGAVSMQKDHPIAFFNKVFGPRLTHASTYIRKLHAIVTAVRKWRQYLLGRSFTILTDHKSLQELMTQVIQTLEQHYYLFKLLGFDYTIRYKADASNIVADALSRLPSTSGQLLLLSVPHLDFIEDLRRTLHAEPEFQALLSKVRANPASHIDYQIHNGLLFFQGHIWIHKTNPYISTILLENPATPLDGHMGVAKTTHRLESSFFWHGLKDDVKCFIRECKICQQKKSSTRWPTGLLQPLPILAGIWEDISMDFVIHLPPSHGFTVILVIVDRYSKGVHLGTLPTHFSAFKVVTLFLDLVCKHHGFPHSIVSDRDPVFLSSFWRELFQLSGTFLRMSTAYHPQIDGQTEVMNRVLEQYLRSFVHSQLTNWFRYLALTEWSYNMSLHTNSGFTHFEVIYGKPPLALPHYIPGMTNNEAVETLVSSRQEIQTKLQQRLMKAQAAMKQQAGTKHDDITYAVGQWVYVKLKPFCQQSITGTTHPKLSKYQVAYRLQLPDNARIHPVFHCSLLRAHHGPPPLSLDTWPLQVVDHKPVPRPFCFLDSKLDNSTSPLTHLVLTQWVGQPPEDTTWEPWPELRGAYHLEDK

SEQ ID NO: 131592 - protein, 1077 aa, Glycine max
  Coding DNA Sequence Number=SeqID_14814
  Homolog annotation: Hit_ID=Q2HVL8; Match level="QueryCoverage=99%, HitCoverage=99%, E-value=0.0, Identity=78%"; Hit description =Regulator of chromosome condensation, RCC1; Ankyrin
  Pfam annotation: Domain name=Ank; Domain location=62-94; Score=38.5; E_value=2.4e-08; Accession=PF00023.20; Description=Ankyrin repeat
  Pfam annotation: Domain name=Ank; Domain location=96-128; Score=27.2; E_value=5.7e-05; Accession=PF00023.20; Description=Ankyrin repeat
  Pfam annotation: Domain name=RCC1; Domain location=155-202; Score =15.0; E_value=0.017; Accession=PF00415.9; Description=Regulator of chromosome condensation (RCC1)
  Pfam annotation: Domain name=RCC1; Domain location=205-260; Score =10.0; E_value=0.059; Accession=PF00415.9; Description=Regulator of chromosome condensation (RCC1)
  Pfam annotation: Domain name=RCC1; Domain location=264-312; Score =24.6; E_value=0.00035; Accession=PF00415.9; Description=Regulator of chromosome condensation (RCC1)
  Pfam annotation: Domain name=RCC1; Domain location=316-366; Score =23.5; E_value=0.00074; Accession=PF00415.9; Description=Regulator of chromosome condensation (RCC1)
  Pfam module annotation: Pfam domain module=Ank::Ank::RCC1::RCC1::RCC1: :RCC1; Domain location=62-94::96-128::155-202::205-260::264-312::316 -366
MEVALSPQVQKPNLQTTGRKISCTGSQKDLWLVVREGSLSDVELALASLKKSGGNINLRNTFGLTPLHIATWRNHIPIVGRLLAAGADPDARDGESGWSSLHRALHFGHLAAASILLQHGASITLEDSKSRIPVDLLSGSVFQVLGNDHSSVATEVFSWGSGTNYQLGTGNAHIQKLPCKVDSLGGSFIKLISAGKFHSVALTARGEVYTWGFGRGGRLGHPDFDIHSGQAAVITPRQVTSGLGSRRVMAIGAAKHHMVIATQGGEVFTWGSNREGQLGYPSVDTQPTPRRVSSLRSRIVAVAAANKHTAVVSDLGEVFTWGCNREGQLGYGTSNSASNYTPRVVESLKGKTLTRVSAAKYHTIVLGSDGEVFTWGHRLVTPKRVVVSRNLKRSGSTLLKFHRKERLSVVSIAAGMVHSMALTDDGALFYWVSSDPDLRCQQLYAMCGRNMVSISAGKYWTAAVTATGDVYMWDGKKGKDKPLVATRLHGVKKATSVSVGETHLLIVASLYHPVYPPNMIENSQKLKLDNKDDMEELNEDILFEDIDSSNMISSVQNDTFSQRSIPSLKSLCEKVAAECLVEPRNAVQLLEIADSLGADDLKKYCEEIVMRNLDYIFAVSSHTVASASPDILANLERLFDQRSSEPWSHRRLPTPTATFPAIINSEEDDSEIEFQRTCDKPMKLEKVHRLDSFLHPKDDPNKEISKVVRAIRKKLQQIEMLEDKQSNGHLLDDQQIAKLQSKSALESSLAELGVPVETSQNKESSSMLPEGKGSKKGKLSKKQRRKSGKSNIEQTEIEFVYSKSEAIPKSEDLLDIDIMGFPDSKVEEDAVCEQITADQGAKDLAFVVQKKDALELLKAKGPSPKASKKKSKKGGLSMFLSGALDEAPKEVATPPPTPKHEGPAWGGAKFMKGSASLREIQDEQSKIKVNKPAGSKDKVEDLPDFGSGGKIKLSSFLPSSPIPVTSSRSSQVSDGETSTPPWAASGTPPQPSRPSLRDIQMQQGKKQQSLSHSPKTTTAGFSIPTCQGSPSETTGVSRWFKPEVETPSSIRSIQIEEKAMKDLKRFYSSVKIVRKQS

SEQ ID NO: 131593 - protein, 339 aa, Glycine max
  Coding DNA Sequence Number=SeqID_14815
  Homolog annotation: Hit_ID=Q1S175; Match level="QueryCoverage=75%, HitCoverage=75%, E-value=9e-82, Identity=50%"; Hit description=MtN19- related
  Pfam annotation: Domain name=SURNod19; Domain location=26-339; Score =224.2; E_value=2.9e-64; Accession=PF07712.3; Description=Stress up -regulated Nod 19
MEFISNAMILSFSILLLLPSASYSLYQKPENHIKTAIFVTGSFEMGPGSIATKTFENIKFPKGHVGIKSFDAELVDQEGNSIPSYETYLHHWFAIKYHQNITMSPNPKLRRPEDAFFQRNEGTCNGGILPHYWGFGVESRGTTSKIPDPFAIEQGNPTKIKNGYEEKWLLNIMVIDTRGAQDKKACTQCRCDQMNLPKDFYNVTRDIHNQKLTTNYKGGLFCCQDNLQCKQIEGFQGSRRMVSFRYKISWVDWNIYQIPVKVYILDSTDKVRSNGSKILHDCLVDKFFKTAEYTIPATGGGGDSPHVQKANIPMEKGGYLIYGTAHMHSGVVNATLYGQ

SEQ ID NO: 131594 - protein, 202 aa, Glycine max
  Coding DNA Sequence Number=SeqID_14816
MLATSNRLLPSVFGIIKIILESIASTKCVVDIGDHNLEMSVEDQKATFNLFEAIKHPSDNKTCFKPLPLSPGAKASQGSNLSKRSTSGNLSSSHLFYSRQAFFLLFPARASSLDDVDPPSWSLPRYPKPTPTIHSSFYGASTNDAKGSSTEGCLAKSPALFCRGETPLAWVMMELMMITLRTSLLHKKLGIQGQHRIGADFD

SEQ ID NO: 131595 - protein, 100 aa, Glycine max
  Coding DNA Sequence Number=SeqID_14817
METCLMKLKTKFREDPTVNEGWEAFSPRSFIKRLLEHSRYLLEDLNGQIIDKCLVKSKTKFREDLTVNEGWAAFLPRQLHVAFSRSFIKRLPPKASSWLL

SEQ ID NO: 131596 - protein, 151 aa, Glycine max
  Coding DNA Sequence Number=SeqID_14818
  Gene Ontology: Mol. function=zinc ion binding
  Homolog annotation: Hit_ID=Q2HV40; Match level="QueryCoverage=71%, HitCoverage=30%, E-value=2e-32, Identity=65%"; Hit description=Zinc finger, RING-type
MNYKPKSVANKPQYLQDYAREVQQTNLCICKIMVFVSFYFHYNITILFFAKEGEGCILTPMKENVLPPVTVNFQQGLGQKFKQPAGTGIYFSTFEDSELLKVGDMDIYPVAIKADASSSDHDESKSNETPSSGSSNSQITQAMFEKEKGQF

SEQ ID NO: 131597 - protein, 145 aa, Glycine max
  Coding DNA Sequence Number=SeqID_14819
  Gene Ontology: Mol. function=protein serine/threonine kinase activity; Cellular component=integral to membrane; Biological process=protein amino acid phosphorylation
  Homolog annotation: Hit_ID=Q9SHI2; Match level="QueryCoverage=80%, HitCoverage=52%, E-value=5e-32, Identity=36%"; Hit description =Similar to leucine-rich receptor-like protein kinase
  Pfam annotation: Domain name=LRR_1; Domain location=38-60; Score=0.4; E_value=2.4e+02; Accession=PF00560.23; Description=Leucine Rich Repeat
  Pfam annotation: Domain name=LRR_1; Domain location=62-84; Score =10.3; E_value=3.4; Accession=PF00560.23; Description=Leucine Rich Repeat
  Pfam annotation: Domain name=LRR_1; Domain location=86-108; Score =16.4; E_value=0.1; Accession=PF00560.23; Description=Leucine Rich Repeat
  Pfam module annotation: Pfam domain module=LRR_1::LRR_1::LRR_1; Domain location=38-60::62-84::86-108
MSGALAPSICNLPKLLELNLSKYFIFGPILNGFVDCFDLEVLDLCTNRVHGPLLTPIWKITTLRKLYLCQNYMFGEVPEELGNLVSLEELVIYSNNLTGRIPSSIGKLKQLRVIRAVSVRAWRYWEDSSRKILETIQLISDAKQE

SEQ ID NO: 131598 - protein, 128 aa, Glycine max
  Coding DNA Sequence Number=SeqID_14820
  Subcellular localization annotation: CTP_CleavageSite=33; ConfidenceScore=5.06e-01
MATPPSSAPHLSLDASQSTYKKSKQSRTTKKIVCQAFGGAEATEKVDILYHNWKQVPKVKGTTDLGRHSEIPARVVHPGYLCTPKDVKMYSLLPLDDQSTLIVFVLLKSVSPSTITLEDHVAPRLHHC

SEQ ID NO: 131599 - protein, 74 aa, Glycine max
  Coding DNA Sequence Number=SeqID_14821
MSQPTLLRVSEARLTGASSMGGKCAESPPTFIERKTLEKNQRKLVIKNILDSGVMFTLEEDINTSHVCPKGQQP

SEQ ID NO: 131600 - protein, 248 aa, Glycine max
  Coding DNA Sequence Number=SeqID_14822
MTNSEKERVFHSFSLSKTLTKTLEPPPPPPTTTNDRHEPPPLIARPPHGEEHFNQRGISKTQLEDSRSHHVEKKGYPGPAEVYPTLKPTMGLKNSLLLPNLLHNPYLQHRPPPQKAPAQPLQCPPEKLGWPLEYPLDQPLEQRPLALAEAPRLWRPHLPQKKKAGHLVRPPKMKTPSCSQWDDAEPKHGYSASPEVPRVASTDGGKGVGAVEVGGSDEDGPSDPLALALWVPGNVIEGSSRFQQFFFM

SEQ ID NO: 131601 - protein, 65 aa, Glycine max
  Coding DNA Sequence Number=SeqID_14823
MTLSWAKRASIAKHNLSALSVTEESGRALISSLRAKHEISALRATVVFSQVQGMTGTKLKSTYSC

SEQ ID NO: 131602 - protein, 144 aa, Glycine max
  Coding DNA Sequence Number=SeqID_14824
MAPTRHPLDQEKSNRALGFSTLITGLCQSYGVPVTPSTIIRPLITQAFIKKYCMPRQAQGDAHQDVGALPPPRRPTTVDRCRYMSVSTGSASVSRGQVPPLLYALPRSSLGLRSHGLETGPMPRPGRSLQEPPMRRMNPIWMRI

SEQ ID NO: 131603 - protein, 84 aa, Glycine max
  Coding DNA Sequence Number=SeqID_14825
  Gene Ontology: Biological process=multicellular organismal development
  Homolog annotation: Hit_ID=Q9SHE9; Match level="QueryCoverage=69%, HitCoverage=34%, E-value=4e-24, Identity=84%"; Hit description=LOB domain-containing protein 4
  Pfam annotation: Domain name=DUF260; Domain location=13-81; Score =70.0; E_value=7.5e-18; Accession=PF03195.5; Description=Protein of unknown function DUF260
MKESGRKQGTMSPCAACKLLRRRCTRDCVFAPYFPADEPQKFGSVHKVFGASNVNKMLQHSYDDDSSFAKLRNFVIKKDSILPM

SEQ ID NO: 131604 - protein, 63 aa, Glycine max
  Coding DNA Sequence Number=SeqID_14826
MVTSKKTAKGSSRCGVSTENYGSSWWLLVVVGGEEEAWDVANGFGRKKEKGMVVFQGYTKNKT

SEQ ID NO: 131605 - protein, 277 aa, Glycine max
  Coding DNA Sequence Number=SeqID_14827
  Homolog annotation: Hit_ID=Q9AV79; Match level="QueryCoverage=89%, HitCoverage=60%, E-value=6e-13, Identity=25%"; Hit description =Putative flowering-time gene protein
  Pfam annotation: Domain name=CCT; Domain location=182-220; Score =75.4; E_value=1.7e-19; Accession=PF06203.4; Description=CCT motif
MASIPQFYQNYTFTTHDLSDYPTPLLNGGGGSNDIVNASVMDTTTVWGGGQDSLINIPVLDMNNGALDHIVSLDCDTMACAANWMPSFSEQLGGFSDLAISDCKMGFYGGFQSFNNSRSYQPHVGEFGDECCGFVEDVKPPAYPNAARENWGIQGNQMAAIEEPNIKVGRYSEEERKERILRYLKKRNQRNFNKTIKYACRKTLADRRVRVRGRFARNNELCEEDMATKKHQNHHHHKGDFYGGDSIQFQLKNDEEDWLQEAMASLVYLSHSSPEDM

SEQ ID NO: 131606 - protein, 60 aa, Glycine max
  Coding DNA Sequence Number=SeqID_14828
MSSNFEDFSIPVVDWEAMKPCSLSDNPLWRPNHSSDREFNDEVNEKQKEEIGVLESEGFG

SEQ ID NO: 131607 - protein, 86 aa, Glycine max
  Coding DNA Sequence Number=SeqID_14829
MPFYRCMRSPTTSPPSFDSYLTARSMLRHDNSPHSRPCGQEKIPHGNEDGDEKPPTANLGTGTGLCSLPRRVPVSPSIQNFTYIPL

SEQ ID NO: 131608 - protein, 348 aa, Glycine max
  Coding DNA Sequence Number=SeqID_14830
  Gene Ontology: Mol. function=binding
  Homolog annotation: Hit_ID=Q6ZPD0; Match level="QueryCoverage=41%, HitCoverage=90%, E-value=2e-09, Identity=29%"; Hit description=CDNA FLJ26027 fis, clone PNC04328, highly similar to Homo sapiens translocase of outer ...
  Homolog annotation: Hit description=mitochondrial membrane 34
  Pfam annotation: Domain name=TPR_1; Domain location=108-141; Score =12.6; E_value=0.17; Accession=PF00515.18; Description=Tetratricopepti de repeat
  Pfam annotation: Domain name=TPR_1; Domain location=3-36; Score=8.9; E_value=0.47; Accession=PF00515.18; Description=Tetratricopeptide repeat
  Pfam annotation: Domain name=TPR_2; Domain location=108-141; Score =16.9; E_value=0.076; Accession=PF07719.7; Description=Tetratricopepti de repeat
  Pfam annotation: Domain name=TPR_2; Domain location=3-36; Score=20.0; E_value=0.0086; Accession=PF07719.7; Description=Tetratricopeptide repeat
  Pfam module annotation: Pfam domain module=TPR_1::TPR_1::TPR_2::TPR _2; Domain location=108-141::3-36::108-141::3-36
MAAPNRIERAHQMYRDGRYEEALGFYTEAIAMAKTNPQKIALHSNRAACYLKLHDFKKKSKFSLLWNPGVCVMCSYEALLKREELFDWLKVEAAEECTSVLELDHKHSGALMLRAQTLVTLKEYHSALFDVNRLLELNPSSEVYQNLQARLKTQLVGNAISSVLYFHCTCTCMHCTLLAGRTLIKHRKALTPIPESEEEEFEEQEDEEPEVISQRENENKEMGEKYSSISNIGTDQKVELGKGIIIADCAPHETDLKFSSKQGRNQNNEPKKSTADAIAPKAPNKESTEQHSKGWQTIPKPKGHSALDYARWDSVEDDSSDDDDEDEDEESLPQYRFRVRTVGVRPVK

SEQ ID NO: 131609 - protein, 694 aa, Glycine max
  Coding DNA Sequence Number=SeqID_14831
  Gene Ontology: Mol. function=protein kinase binding; Cellular component=nucleus; Biological process=regulation of cyclin-dependent protein kinase activity
  Homolog annotation: Hit_ID=Q9FKE6; Match level="QueryCoverage=99%, HitCoverage=99%, E-value=1e-106, Identity=52%"; Hit description =Similarity to cyclin
  Pfam annotation: Domain name=Cyclin_N; Domain location=110-257; Score= -22.6; E_value=0.014; Accession=PF00134.13; Description=Cyclin, N -terminal domain
MAGLLLGDASHHGTSQGVSQRYSEEKLEDGSRWYFARKEIEEYSPSKHDGIDLKKETYLRKSYCTFLQDLGMRLKVPQVTIATAIIFCHRFFLRQSHAKNDRRLKFGIKKVVHYMIHMVQVVMKLKSQNSTPKKSKCVCSEGFFWNQYIVPATTAIQPAIWSATINCSSTAVTLNCSAILLSVLGKTIATVCMFLAGKVEETPRPLKDVILISYEIIHKKDPAAIMRIKQKDVYEQHKELILLGERVVLATLGFDLNVHHPYKPLVEAIKKFKVAQNALAQVAWNFVNDGLRTSLCLQFKPHHIAAGAIFLAAKFLKVKLPSDGEKVWWQEFDVTPRQLEEVSNQMLELYEQNRMPPSNDVEGGGTSNQTTAKAPITNDETAAAKSNSQSGATRLETSKPVSSMAMFDSSVPNHVGRPISNHGRSGDYGSTEMKHRVEGDAKGNQYPERESLPFKENSHEAQDVVKSRSDNGEKEHESNAGGTETKELTELKDKHNSRNLDHREDAFSRPPQEAVKKIDTDKVKAALEKRRKAAVHITKKTDVMDDDDLIERELEDGIELAPQNEKNKEKRQSWSKPSDRSDYDNMHGRHQDHEDEQYHGVKGLSSYEPDLSAVEEGEVSALDDIGVGLPSPKSSNRKRKAGSSPERGVEGKRHNYGPGPHHNNRFDYMEDRNKVSRLGHTERDSKRHVQENHV

SEQ ID NO: 131610 - protein, 115 aa, Glycine max
  Coding DNA Sequence Number=SeqID_14832
  Homolog annotation: Hit_ID=Q9STM3; Match level="QueryCoverage=95%, HitCoverage=9%, E-value=4e-13, Identity=46%"; Hit description =Putative zinc finger protein
MNCKSEPLALKTALMFHGVSANELGFTVHGEGFVQHGLLEQRLCLQRAQTRARAWALLGMAFEVCLLEGLGLGLELIEGVAIAALPDGTLDGPGPAGAEADLPLVRAECRADFRE

SEQ ID NO: 131611 - protein, 126 aa, Glycine max
  Coding DNA Sequence Number=SeqID_14833
MQSQGLVLPPEAKVGPSAAHVSTKESCVNPSGGLVRGRALNTFLAWLTHLVKPYSKHDKQVAEGLEKPVDMLDPDVDPLYLITLTIPQLFLKPLQVSWDSSMFGVYNDNFPLYIKHEDLSEIAHGG

SEQ ID NO: 131612 - protein, 151 aa, Glycine max
  Coding DNA Sequence Number=SeqID_14834
  Gene Ontology: Mol. function=cysteine protease inhibitor activity; Biological process=defense response
  Homolog annotation: Hit_ID=Q1SRH3; Match level="QueryCoverage=83%, HitCoverage=95%, E-value=2e-15, Identity=41%"; Hit description =Proteinase inhibitor I25, cystatin
MPPTNTRGRARKRHPRTASSSLQKQVMLLCGRELVAKARVKGSSREKEPLLGRWSPIKNINDPKVIEIANYAIATFDKRFGTKKKLEKMIEGETRTVEGLKYKTRIVAGMDYFLIFRANDEYGEFQNYGATVRVIESLHFRNLTGFVPANS

SEQ ID NO: 131613 - protein, 274 aa, Glycine max
  Coding DNA Sequence Number=SeqID_14835
  Homolog annotation: Hit_ID=Q47522; Match level="QueryCoverage=13%, HitCoverage=45%, E-value=7e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSKNGSVSVLDIAIVLDAAKDCKDASDRSGDPLEIAKSKLLLLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131614 - protein, 242 aa, Glycine max
  Coding DNA Sequence Number=SeqID_14836
  Gene Ontology: Mol. function=oxygen transporter activity; Cellular component=flagellin-based flagellum; Biological process=flagellum organization and biogenesis
  Homolog annotation: Hit_ID=Q4ACL1; Match level="QueryCoverage=98%, HitCoverage=50%, E-value=5e-79, Identity=61%"; Hit description =Flagella (R) hook associated protein HAP2
  Pfam annotation: Domain name=FliD_C; Domain location=1-230; Score =248.4; E_value=1.5e-71; Accession=PF07195.2; Description=Flagellar hook-associated protein 2 C-
DAEIVVNGTKIKRSTNSIADALQGVTLDLKTTTKPGEPQNLVIGIDKSGSADKIKEWVDNYNSLLDTFNSLTKYTPVKSGEAQNAKNGALLGDNTLRGIQSSIKSALSSAQDNPELKGLGNLGITTNVKTGKLEIDSTKLNKAIDEKPDQVANFFAGNGKDTGMATEIHNEIQNYVKSGGIIENSTKSINTNLDRLNIQITTVTASIQNTIDRYKQQFVQLDTMMSKLSSTGNYLQQQFSTK

SEQ ID NO: 131615 - protein, 188 aa, Glycine max
  Coding DNA Sequence Number=SeqID_14837
  Gene Ontology: Mol. function=oxidoreductase activity, acting on NADH or NADPH, NAD or NADP as acceptor; Biological process=electron transport
  Homolog annotation: Hit_ID=Q390T2; Match level="QueryCoverage=97%, HitCoverage=92%, E-value=4e-71, Identity=71%"; Hit description=FMN -dependent NADH-azoreductase 4
  Pfam annotation: Domain name=FMN_red; Domain location=3-188; Score= -40.0; E_value=0.039; Accession=PF03358.6; Description=NADPH -dependent FMN reductase
  Pfam annotation: Domain name=Flavodoxin_2; Domain location=3-188; Score=73.0; E_value=9.8e-19; Accession=PF02525.7; Description =Flavodoxin-like fold
  Pfam module annotation: Pfam domain module=FMN_red::Flavodoxin_2; Domain location=3-188::3-188
MGNDSQTSNLIDRYLAERRAKGYEDQIVEHDLTALDLPVLDGELFSALRGADNISPRAKAAVALSDRLIAELKGSDLLLIGAPMYNLNVPTQLKNWFDLVARARLTFNYTAAYPVGLVEGVNAVVFSSRGGVHAGQPTDAVTPYLRSVLGLMGIGEVQFIYAEGLDMKPHGLTQGLANAHQRIVALVG

SEQ ID NO: 131616 - protein, 172 aa, Glycine max
  Coding DNA Sequence Number=SeqID_14838
  Gene Ontology: Mol. function=structural molecule activity; Cellular component=flagellin-based flagellum; Biological process=ciliary or flagellar motility
  Homolog annotation: Hit_ID=Q66BR6; Match level="QueryCoverage=58%, HitCoverage=98%, E-value=2e-31, Identity=69%"; Hit description =Flagellar hook-basal body complex protein FliE
  Pfam annotation: Domain name=FliE; Domain location=4-104; Score =120.6; E_value=4.3e-33; Accession=PF02049.8; Description=Flagellar hook-basal body complex protein FliE
MAIQGIEGVLQQMQTMAVQAGKMGQNTAPQGVSFASELTAALGKISETQQTARKQAQDFELGVPGISLNDVMVDLQKSSVSLQLGVQVRNKLVAAYQDIMNMPDRMMCKSLYLAVGIMALSGCAGQNDDYSSAHKNAAHQEAGKEWKAFVAPLSVKTQSPGEREMKRAARHD

SEQ ID NO: 131617 - protein, 154 aa, Glycine max
  Coding DNA Sequence Number=SeqID_14839
  Gene Ontology: Mol. function=transporter activity; Cellular component= outer membrane; Biological process=protein transport
  Homolog annotation: Hit_ID=Q6GW09; Match level="QueryCoverage=100%, HitCoverage=30%, E-value=5e-64, Identity=83%"; Hit description=TolC -like protein
  Pfam annotation: Domain name=OEP; Domain location=25-154; Score=37.2; E_value=5.5e-08; Accession=PF02321.8; Description=Outer membrane efflux protein
MKKLLPLLIGLSLGGFSAMSQAENLLQVYKQARESNPDLRKSAADRDAAFEKINEARSPLLPQLGLTAGYDYTNGYRDSNGVNSNVTSGSLALTQTIFDMSKWRQLTLQEKTAGISDVTFQTAEQQLILNTATAYFNVLKAIDTLSYTQAQKDA

SEQ ID NO: 131618 - protein, 138 aa, Glycine max
  Coding DNA Sequence Number=SeqID_14840
  Gene Ontology: Mol. function=DNA binding; Cellular component=nucleus; Biological process=regulation of transcription
  Homolog annotation: Hit_ID=Q7Y0B7; Match level="QueryCoverage=93%, HitCoverage=36%, E-value=6e-34, Identity=56%"; Hit description =Putative Myb-like DNA-binding protein
  Pfam annotation: Domain name=Myb_DNA-binding; Domain location=17-68; Score=40.1; E_value=7.4e-09; Accession=PF00249.21; Description=Myb -like DNA-binding domain
SSAPSPLRQPQSGRKQRRCWSPELHSRFVKALEELGGSQATTPKQIRELMRVDGLTNDEVKSHLQKYRLHTQRVPVAKAANSNRSAVALGGLWMHNESLKGRSSGSPQGPLQLATQSGEATSRTEGDNMIDDDVKSDL

SEQ ID NO: 131619 - protein, 326 aa, Glycine max
  Coding DNA Sequence Number=SeqID_14841
  Homolog annotation: Hit_ID=Q2HTB8; Match level="QueryCoverage=26%, HitCoverage=37%, E-value=4e-17, Identity=62%"; Hit description =Harpin-induced 1
  Pfam annotation: Domain name=6PF2K; Domain location=77-248; Score= -81.0; E_value=0.0032; Accession=PF01591.8; Description=6 -phosphofructo-2-kinase
VSNAAVEGDHCRRRRCPGQPLKLPSGEEGYWLHMGDDSRTIENTREHDETVCKPDDDEEPGYNASGFAAASTPGEAKLGVVSPLIEGMPLPVLVEVSHWLAVDEAYGVVGLRLIFQGRVRLKAGAIKIAHYGFYVKRTPKTGGEHLAFEDMISWMREGGQVGIFDATNSSKERRNMLMKLVEEDARCKVLGSVEDRLHKCLTTKRLNLQAFKAIVYMLTFITITSPERAPGVQQQQVPPLSVNTLITPQCAGNDLAALAISSSFSMRDSEKKLNNKGSKKSRPLKVHKKGQGKKEEVKVGSKSHTKTACTDISRKRVISSLKVKGP

SEQ ID NO: 131620 - protein, 112 aa, Glycine max
  Coding DNA Sequence Number=SeqID_14842
MSTFSLGTHKFLLIVVFFTVISIGWSLRVIPNHDKLASLQEEKATIRDKKEEENMGMELYPTGSTIPDCSHACGPCSPCKRVMVSFKCSIAESCPIVYRCTCKGKYYHVPSN

SEQ ID NO: 131621 - protein, 532 aa, Glycine max
  Coding DNA Sequence Number=SeqID_14843
  Homolog annotation: Hit_ID=Q1SHD0; Match level="QueryCoverage=61%, HitCoverage=95%, E-value=5e-49, Identity=38%"; Hit description =Leucine Rich Repeat, putative
  Pfam annotation: Domain name=FBD; Domain location=431-480; Score =36.5; E_value=9.5e-08; Accession=PF08387.1; Description=FBD
MVGEEAKNISVTEGKDLISALPDPLVGAIISLLPNTEGVRTCVFSKRWKKAWMHMSHLNIDQVQMMKPFIQANLCGVHHKRCVDVPFQHQRVDPNENYDLDVIDKTERLIISVLNSHSHPLESCNIRHLPESCASGNVVLLMKKLLKEKNLKKLSMEQTDPIHWDILQNAPQGVKYHEMTIDLPFEIFSSFEELELKNYYLKTKPSSGDFAQVLKKLTFKNMMVDKDDWEGIMSYCLCLENLTIDNCMMEIIKINNPRLKFLRICRMEVIKIDVSAINLEIIEIDTVVCKPQKVTFETPKVHFLRSCFDAIGGQNDCWVRSKLLQSENILHACCSNKIPQGSTSSFANIFENLATLCIGLDLEKLNNAMSLYSTLKSCPMLQTLEINIQADDDAWDYHGDEDEEEADGDARDYDGDEHNEEGYFPYPKIFFWMNMDPCDCINHKLKTLSIKGFAGEELEVEFLKYIITTAKVMKKITIWFVDNCSWAQATKTRCLMSFKSISPNLSIILNPGPIYMANGDGNFETWMSTLRN

SEQ ID NO: 131622 - protein, 766 aa, Glycine max
  Coding DNA Sequence Number=SeqID_14844
  Gene Ontology: Mol. function=endonuclease activity; Cellular component=mitochondrion; Biological process=positive regulation of transcription, DNA-dependent
  Homolog annotation: Hit_ID=Q6ZHJ5; Match level="QueryCoverage=94%, HitCoverage=87%, E-value=0.0, Identity=49%"; Hit description =Pentatricopeptide (PPR) repeat-containing protein-like
  Pfam annotation: Domain name=LAGLIDADG_2; Domain location=560-727; Score=79.2; E_value=1.3e-20; Accession=PF03161.4; Description =LAGLIDADG DNA endonuclease family
  Pfam annotation: Domain name=PPR; Domain location=170-204; Score =10.1; E_value=0.48; Accession=PF01535.11; Description=PPR repeat
  Pfam annotation: Domain name=PPR; Domain location=322-356; Score =11.6; E_value=0.31; Accession=PF01535.11; Description=PPR repeat
  Pfam annotation: Domain name=PPR; Domain location=357-391; Score=4.3; E_value=2.3; Accession=PF01535.11; Description=PPR repeat
  Pfam annotation: Domain name=PPR; Domain location=392-426; Score =12.2; E_value=0.27; Accession=PF01535.11; Description=PPR repeat
  Pfam annotation: Domain name=PPR; Domain location=461-494; Score=8.8; E_value=0.67; Accession=PF01535.11; Description=PPR repeat
  Pfam annotation: Domain name=PPR; Domain location=497-531; Score =19.9; E_value=0.0092; Accession=PF01535.11; Description=PPR repeat
  Pfam module annotation: Pfam domain module=LAGLIDADG_2::PPR::PPR::PPR: :PPR::PPR::PPR; Domain location=560-727::170-204::322-356::357 -391::392-426::461-494::497-531
  Subcellular localization annotation: CTP_CleavageSite=43; ConfidenceScore=5.36e-01
MRSSSTLLHSLALSLSHLHHPFLSAPPLFPRLAVTVPEREVLRSAEAEARGLRGPEVEVGELSAVPEEWRRARVAWLCKELPAHKAGTLVRILNAQKKWMWQEDATYVLVHCLRVRENETAFKQFNSRVSVYGKRSDGRGIDKNPRLSTGGYLWVYKWMMQRNWYRFDFALATKLADYMGKEGKFSKCREVFDDIINQGRVPSESTFHILVVAYLSAPVQGCLDEACSIYNRMIQLGGYQPRLSIHNSVFKALVSNPGILSKNYLKQAEFIYHHLVTTGLDVHKEIYGGLIWLHSYQDSIDKERIAELREAMLRAGFEEDREVLLSILRACAREGEVEEAEKSWVKLLEFENDPPALAFVYKMEVYSKVGMPMKSLDIFREMQSKLGRTDVAAYNQIIEILCKAQESELAESIMADFVKSDLKPLTPSYVYLLSMYFNLELHDKLEESFYKCLEKCRPNCAIYSIYLNSLVKIGNIDKAEDIFNQMNHDATIGVNARSCNIILSGYLSSGKHLKAEKVYDFMCLKKYEIESSLMEQLDYILSLKRKVVKRPISMKLSKEQREIMIGLLLGGLRIDSDDRRRNHIIRFDFDGNSGSHYVLKSHIYHLFFEWLHPTCKPGDNSENIPDKFCTIASSHFGFYADQFWSKGEPSIPKLVHRWLSPCVLAYWYMYGGHRNSSGDILLKVKGSREGVENIVRKFKGMSMDCKVKRKGRVFWIGILGSNSTWFWKLVEPYVIENKDFAEAGDETKEQDAKETEDINFNSDSDE

SEQ ID NO: 131623 - protein, 287 aa, Glycine max
  Coding DNA Sequence Number=SeqID_14845
  Gene Ontology: Mol. function=transcription factor activity; Biological process=regulation of transcription, DNA-dependent
  Homolog annotation: Hit_ID=Q48JC0; Match level="QueryCoverage=58%, HitCoverage=93%, E-value=1e-42, Identity=53%"; Hit description =Transcriptional regulator, TetR family
PEEGAEPPTLTPVDAQHVLIAALCWRGAYNEGYGFWLLDNALQGTPQLITDSGSDYHDGVISEAQKGRGIGDCWSTAAWVWDGRQFVQSSEATTGMCRAIRAGGAWQLPTLVTEVKPAGFCRIPHGHDVGDGGIDLRAVDAIAHQHRHAQQKSVEGDGEGGGIGVGAQFAAVDAALHAGRHACQRRPYIPADGQTHTACWPSAAARSPLRYGAAGCYPIAAPPPARKSTDSAAHTPETAPASSQRPRKSSVRKYRRQFPPSAALTMSTHSRAARKSSSPVQWPHHDR

SEQ ID NO: 131624 - protein, 172 aa, Glycine max
  Coding DNA Sequence Number=SeqID_14846
MTGSQSITTTTTTSLRGIIELLEGHPSRNVVEIISHTSWGPKPFPGRVKLIFKVHNVPRIVAMKSHATAGLVEGNNGEENARYIIDRNEVEGLEEWEVVVVVVVMVYDEWARVTHWVEDEFGDMSGSRNDDLAPEVVGELVVEEVVALVEGEYVADSTMTNNEIVEAARKRN

SEQ ID NO: 131625 - protein, 366 aa, Glycine max
  Coding DNA Sequence Number=SeqID_14847
  Gene Ontology: Mol. function=oxidoreductase activity; Cellular component=proton-transporting two-sector ATPase complex; Biological process=ethylene biosynthetic process
  Homolog annotation: Hit_ID=Q9LE86; Match level="QueryCoverage=98%, HitCoverage=99%, E-value=1e-112, Identity=55%"; Hit description =Arabidopsis thaliana genomic DNA, chromosome 3, P1 clone:MJM20 (Oxidoreductase ...
  Homolog annotation: Hit description=2OG-Fe(II) oxygenase family protein)
  Pfam annotation: Domain name=2OG-FeII_Oxy; Domain location=207-313; Score=139.8; E_value=7.5e-39; Accession=PF03171.10; Description=2OG -Fe(II) oxygenase superfamily
MALSFNTSNSLYDFVVREGNGVKGVSDLGLPEVPDRYIQPPEERINKQESRTCDAPPIDLSKLNGLEHEKVVDEIVRAAETLGFFQVVNHGVPLELLESLKHTAHKFFSLPLEKKTLYRAGVSPAGPVTRLATSFVPEKEKTWEWKDYISMIYRSDEEALQYWPNLCRELVLEYLKLSSKMVRGIVEILIRNLGVTIDDSKTEQIMGDKVVNFNYYPPCPNPELTVGLGRHSDLGTITVLLQDEIGGLYVKMEEDNDAGKEEWLLIPPIPGALVINIGDILQILSNGKYKSAEHRTTTTSTRARVSVPLFILPIATERIGPFPEAVKNVGFARYREVLMQDYMSKYFGNAHEGKKKIIDFARINSA

SEQ ID NO: 131626 - protein, 478 aa, Glycine max
  Coding DNA Sequence Number=SeqID_14848
  Gene Ontology: Mol. function=oxidoreductase activity; Cellular component=proton-transporting two-sector ATPase complex; Biological process=ATP synthesis coupled proton transport
  Homolog annotation: Hit_ID=Q9LE86; Match level="QueryCoverage=98%, HitCoverage=99%, E-value=1e-121, Identity=61%"; Hit description =Arabidopsis thaliana genomic DNA, chromosome 3, P1 clone:MJM20 (Oxidoreductase ...
  Homolog annotation: Hit description=2OG-Fe(II) oxygenase family protein)
  Pfam annotation: Domain name=2OG-FeII_Oxy; Domain location=206-290; Score=77.9; E_value=3.1e-20; Accession=PF03171.10; Description=2OG -Fe(II) oxygenase superfamily
  Pfam annotation: Domain name=2OG-FeII_Oxy; Domain location=338-427; Score=3.8; E_value=0.05; Accession=PF03171.10; Description=2OG -Fe(II) oxygenase superfamily
  Pfam module annotation: Pfam domain module=2OG-FeII_Oxy::2OG-FeII _Oxy; Domain location=206-290::338-427
MSPSFNSSNSLYDFVVREGNGVKGLVDLGVSEVPERYKQHPQERINKQDSRTCDAPPIDLSKLNGPDHEKVVDEIARAAETLGFFQVVNHGVPLELLESLKDAAHTFFSLPPEKKAVYCTGVSPSPRVKYGTSFVPEKEKALEWKDYISMVYSSDEEALQHWPNQCKEVALEYLKLSSKMVRDIVEALISKLGVALDDSKIEGLLGLKMVNMNYYPACPNPELTVGVGRHSDMGAITVLLQDGIGGLYVKVEEDEDAGKGECNGKYKSAEHRVRTTSTQSRVSVPVFTMPIATDRIGPLPEVVKKDGLARYREVVLQDYMNNFFGNAHAGKKSLDFARINYKAINKLHLAMALSFNTSNSLYTLWLVPLELLESLKDAAHTFFSLPPEKKAVYCTGILSNGKYNSAEHRTRATNTKARVSVPVFILPMATEKIGPLPEVVKNDGLAQYREILIKDYMKNYSANALDGKKFDFARINSA

SEQ ID NO: 131627 - protein, 87 aa, Glycine max
  Coding DNA Sequence Number=SeqID_14849
MRWHDVEDKVVAVACEGGVVTTPTVYDSNDSIKRESVKLKVEPNATNRMHPLKRIEKCGADHANPENNRAQNFSSGQSMQGSWPLGR

SEQ ID NO: 131628 - protein, 303 aa, Glycine max
  Coding DNA Sequence Number=SeqID_14850
  Gene Ontology: Mol. function=oxidoreductase activity; Cellular component=proton-transporting two-sector ATPase complex; Biological process=ethylene biosynthetic process
  Homolog annotation: Hit_ID=Q9LE86; Match level="QueryCoverage=98%, HitCoverage=99%, E-value=5e-92, Identity=50%"; Hit description =Arabidopsis thaliana genomic DNA, chromosome 3, P1 clone:MJM20 (Oxidoreductase 2OG-Fe(II) ...
  Homolog annotation: Hit description=oxygenase family protein)
  Pfam annotation: Domain name=2OG-FeII_Oxy; Domain location=145-251; Score=121.1; E_value=3.1e-33; Accession=PF03171.10; Description=2OG -Fe(II) oxygenase superfamily
MALSFNSSNSLYDFEIREGNGVKGVADLGLSELPERTCDAPPIDLSKLNGPEHEKVVDEIVRASETLGFFQVVNHGVPLELLESLKDAAHTFFNLPQEKKAVFRTAIRPGLVTKLSMVHTSDEDALQNWPNQCREVALEYLKLSHKMIVNMNYYPPFPNPELTVGVGRHSDLGTITALLQDEIGGLYVKMEEENDAGKGEWLEIPPIPGALVINIGDILEILSNGKYKSAEHRTKTTSIKARVSVPLFTLPIATERIGPLPEAVKNDGFAQYREVAMQDYTKNFFGNAHQGNKTLDFARINSA

SEQ ID NO: 131629 - protein, 47 aa, Glycine max
  Coding DNA Sequence Number=SeqID_14851
MVEDESKDCVNYLFCRSNQNIFNIGFDDYDEMDPSTLPDRRVQGGRM

SEQ ID NO: 131630 - protein, 234 aa, Glycine max
  Coding DNA Sequence Number=SeqID_14852
  Pfam annotation: Domain name=zf-CCHC; Domain location=94-111; Score =7.1; E_value=0.068; Accession=PF00098.13; Description=Zinc knuckle
MARFLCGLNRDIRCFVKLQHYESLEDMVHQAKKAERPLERKHSYKKTYHYDSSSDKDKSKKEGYSPSKQQGSKSQSGKHVPNHDTSSTSRSGSIKCFKWLGKGHIALHCPNKKTNFLRENEIAISDFSSISSSYISSDNDSRCGTKYLDDGLMMCKRLLGIQFTLMCPTQGWLADLTLKPPTCHNPYCLKFPCKEASNHAKSYVLMPKEELYIKDQWTRQFGEEVDVYEDQVNH

SEQ ID NO: 131631 - protein, 216 aa, Glycine max
  Coding DNA Sequence Number=SeqID_14853
MASKKRKAPTTPSQAWERYTDIVVPRKLLPERNVVIYHSEFDEFKEELERRKWDKELTSFDEGSIDVAIVKEFYASLYDPEDKSPKQVRVRGHLVKFDEDTLNTFLKTLVIIKDRDTLLAYSRFALLRPDPQELAAMLCIPGRGFELNVDGLPLKILRKNMTTLVQTWSFLSYSNLVPTSHTSDITLDRAKLIYGIIMKMDMNLGYLISHQISIIA

SEQ ID NO: 131632 - protein, 109 aa, Glycine max
  Coding DNA Sequence Number=SeqID_14854
MVEKFRLQCRWGHDGLEKTTVMKGSIRRGLKLVTLRHDIILAATVVLCSGNIDCILNERRRTKENLVNKDWQIGEEEEAGLENKIDVRCTILLHAEAIDDEIKLEEEPE

SEQ ID NO: 131633 - protein, 421 aa, Glycine max
  Coding DNA Sequence Number=SeqID_14855
  Gene Ontology: Mol. function=DNA binding; Biological process =regulation of transcription
  Homolog annotation: Hit_ID=Q9SQQ9; Match level="QueryCoverage=99%, HitCoverage=92%, E-value=6e-99, Identity=51%"; Hit description =Transfactor-like
  Pfam annotation: Domain name=Myb_DNA-binding; Domain location=31-112; Score=22.3; E_value=0.0018; Accession=PF00249.21; Description=Myb -like DNA-binding domain
MPIPSERHMFLQTGNGSGDSGLVLSTDAKPRLKWTPDLHARFIEAVNQLGGADSEYTHQLLDHQILRNIEFEFTNAIYNLSIAEATPKTVMKLMGIPGLTLYHLKSHLQKYRLSKNLHGQSNNVTYKITTSASTGERLSETNGTHMNKLSLGPQANKDLHISEALQMQIEVQRRLNEQLEVQRHLQLRIEAQGKYLQSVLEKAQETLGRQNLGVVGIEAAKVQLSELVSKVSSQCLNSAFTEPKDLQGFFPQQTQTNPPNDCSMDSCLTSSDRSQKEQEIQNGLRHFNSHVFMEHKEATEAPNNLRNPELKWCEDGKKNTFLAPLSKNEERRNYAAESSPNNLSMSIGLERETENGINLYPERLITESQSDGEFQHRNRIKPETLKPVDEKVSQDYRLPASYFAAARLDLNTHGDNEAATT

SEQ ID NO: 131634 - protein, 240 aa, Glycine max
  Coding DNA Sequence Number=SeqID_14856
  Gene Ontology: Mol. function=peroxidase activity; Cellular component =vacuole; Biological process=response to oxidative stress
  Homolog annotation: Hit_ID=Q1SGC7; Match level="QueryCoverage=99%, HitCoverage=77%, E-value=1e-111, Identity=80%"; Hit description=Haem peroxidase, plant/fungal/bacterial
  Pfam annotation: Domain name=peroxidase; Domain location=1-211; Score= 211.3; E_value=2.2e-60; Accession=PF00141.13; Description=Peroxidase
MTSEKLAGPNLNSLCGFEVIDKIKYLVKEECPITVSCVDILAMAARDVVELRGGPRWDALLGRKDALESSFSGANILIPAPNSSLEVLIDNFKQQGLDIEDLVTLSGSHTIGRARCLSFRQRIYNAKEEYHYGYDHYKRYTSFRRILRSICPVEGRDTKFAPLDFQTPKRFHNHYFINILEGKGLLGSDNVLISHDLDGKTTEQVWAYASNEKLLIKMGNINVLTGNEGEIRRNCRFVDA

SEQ ID NO: 131635 - protein, 69 aa, Glycine max
  Coding DNA Sequence Number=SeqID_14857
MEEFEEILGCPLGGRKPYLFYGFYPSVARIAKVVKIMAQDLDRVKKNRNGIVGIPRKHLEEKAKGIGGS

SEQ ID NO: 131636 - protein, 63 aa, Glycine max
  Coding DNA Sequence Number=SeqID_14858
MEDLSLFPNTECLAEYTDSRDLWNWKREAGPAYSFCIDSSWTAPRHGLNKDVYVKEAKNNKKQ

SEQ ID NO: 131637 - protein, 78 aa, Glycine max
  Coding DNA Sequence Number=SeqID_14859
MHARISPCMLAIYAWDRTRGCSASATGEIVGIVVFATLTGDLGAEGTYMMNSVITVLYFNGRENMLLCKFVMTKMLKL

SEQ ID NO: 131638 - protein, 52 aa, Glycine max
  Coding DNA Sequence Number=SeqID_14860
MAGNHGLEVKTKIIYSVHHLRRERKSSRFHHQVKGDNTMGQKGKKLVMRGSS

SEQ ID NO: 131639 - protein, 74 aa, Glycine max
  Coding DNA Sequence Number=SeqID_14861
  Subcellular localization annotation: CTP_CleavageSite=65; ConfidenceScore=5.51e-01
MAFGTMATHPGELMLTPTVTGSPRRAENSLKRPFSPNLLVSFASLTKTPNDLSSCAVTGVEQHSSASENQNISE

SEQ ID NO: 131640 - protein, 87 aa, Glycine max
  Coding DNA Sequence Number=SeqID_14862
MQIFRVLLQEPNLQHGDLESVSSHMPFWKYKFLAGVQFEKEFKLLSEVDRPHAIIHLANENLQEELDGLKLEVAQLQAALDGLKPLK

SEQ ID NO: 131641 - protein, 129 aa, Glycine max
  Coding DNA Sequence Number=SeqID_14863
  Homolog annotation: Hit_ID=Q67X40; Match level="QueryCoverage=85%, HitCoverage=59%, E-value=7e-28, Identity=56%"; Hit description =Integral membrane family protein-like
  Pfam annotation: Domain name=DUF588; Domain location=22-124; Score =44.0; E_value=5e-10; Accession=PF04535.3; Description=Domain of unknown function (DUF588)
MKAGAVESGEISKGAPPRKGLIRGLSIMDFILRIVAAIATLGSALGMGTTRQTLPFSTQFVKFRAVFSDVPTFVFFVTSNSIVCGYLVLSLVLSFFHIVRSAAVKSRVLQVFLDTVNTLILLEFSSHRM

SEQ ID NO: 131642 - protein, 117 aa, Glycine max
  Coding DNA Sequence Number=SeqID_14864
MKAPTLIYNTPPSHCWEKLDGRKYRGDSFTRCGTSSHTCTPTHLPLKCESLPHGSLPLRAKVIIHDYLRYLHRRSICGTRCLDSPPGRLSIQGIPKAEIHHRHLTRLSRSPSRTTWL

SEQ ID NO: 131643 - protein, 102 aa, Glycine max
  Coding DNA Sequence Number=SeqID_14865
MVKAPKQFKSKNSLKYLSFNFFEIHTKIELIKRNGFQFALCSKTCGCLEGLCSSDCAAARSKRKGRLYGIGDLAHTCKCRNDNFMQHMQGSFSRVEDVAKIN

SEQ ID NO: 131644 - protein, 259 aa, Glycine max
  Coding DNA Sequence Number=SeqID_14866
  Homolog annotation: Hit_ID=Q2QXI9; Match level="QueryCoverage=73%, HitCoverage=83%, E-value=5e-23, Identity=34%"; Hit description =Expressed protein
MANNKSWLSYFYTKYQTLASKKGMATCGSLHHIFDTLLPEKSTLLESLSWNQIKPLKSTDQTHSFTEIFGELHFKESPISSPFTPHVSTSSSSSSTEITNNTNRHKNSDSFSSLSSESLHLCTEGLGFESSDDVEDFKDGMSESCEVYKEKEGVKRCVSSRVSEYPPPISCIGRSGKPWVCFRSYRSEGRFVLEEIRIPTHEFLHACREDGRLKLHFVHHEDEPIEEEEEEEDDDDDDIGVETMDEEEEEENMEEKNDD

SEQ ID NO: 131645 - protein, 272 aa, Glycine max
  Coding DNA Sequence Number=SeqID_14867
  Gene Ontology: Cellular component=intracellular; Biological process =signal transduction
  Homolog annotation: Hit_ID=Q9FMR1; Match level="QueryCoverage=77%, HitCoverage=47%, E-value=1e-52, Identity=54%"; Hit description=Rac GTPase activating protein
  Pfam annotation: Domain name=RhoGAP; Domain location=1-80; Score= -24.8; E_value=0.0005; Accession=PF00620.17; Description=RhoGAP domain
AWFRELPTGILDSLSPEQVMQCQTEDECSELVRHLPHTEASLLDWAINLMADVVLHEHVNKMNARNIAMVFAPNMTQMADPISALMYAVQVMNFLKTLILRTVRERKDSVVESCPRFYLQPSVDNENRRILESFRQDTPAENEEAQENFVLEKTALDRSPESLQNNSTGGEPGSLTNSSENLVCNEDLYCEFPPVGNMGKSKTGQSRSSNKFWSDDSNETCYAFRHQVHKGRPMARSFMEGHETLVYKRATLPAMFNLAEPLGQLQQVKTVN

SEQ ID NO: 131646 - protein, 140 aa, Glycine max
  Coding DNA Sequence Number=SeqID_14868
  Gene Ontology: Mol. function=nutrient reservoir activity; Cellular component=apoplast; Biological process=auxin mediated signaling pathway
  Homolog annotation: Hit_ID=Q84XR7; Match level="QueryCoverage=94%, HitCoverage=64%, E-value=2e-42, Identity=64%"; Hit description =Germin-like protein 1
  Pfam annotation: Domain name=Cupin_1; Domain location=52-140; Score= -14.7; E_value=0.011; Accession=PF00190.13; Description=Cupin
MSPPIFKVLTLIISVFAIMQISTAGDPDILTDFIVPPNTIPDGNFFTFTGFRVIFSPNNTVSDFKVLKATKVEFPALDGQSVSYAILEFPGGSINPPHTHPRSAELLFTVEGSLQVGFVDTTNKLFTQTLQTGDLFVFPK

SEQ ID NO: 131647 - protein, 308 aa, Glycine max
  Coding DNA Sequence Number=SeqID_14869
  Gene Ontology: Mol. function=hydrolase activity, acting on carbon -nitrogen (but not peptide) bonds; Cellular component=cytosol; Biological process=nitrogen compound metabolic process
  Homolog annotation: Hit_ID=Q9XGI9; Match level="QueryCoverage=99%, HitCoverage=99%, E-value=1e-149, Identity=82%"; Hit description=N -carbamoylputrescine amidase
  Pfam annotation: Domain name=CN_hydrolase; Domain location=8-190; Score=160.3; E_value=5e-45; Accession=PF00795.12; Description=Carbon- nitrogen hydrolase
MEKGRTVVVSALQFACTDDVSTNIATAERLIRAAHKQGANIILIQELFEGYYFCQAQRVDFFQRAKPHKDHPTILRMQKLAKELGVVIPVSFFEEANNAHYNSIAIIDSDGTDLGIYRKSHIPDGPGYEEKFYFNPGDTGFKCNIEAFAEQVFQTKFAKIGVAICWDQWFPEAARAMVLQGAEILFYPTAIGSEPHDGSIDSRDHWKRVMQGHAGANLVPLVASNRIGKEIIETEHGKTEITFYGNSFIAGPTGEIVSVADDKEEAVLIAQFDLDKIKSTRHCWGVFRDRRPDLYKVLLTLDGNNPVQ

SEQ ID NO: 131648 - protein, 142 aa, Glycine max
  Coding DNA Sequence Number=SeqID_14870
  Subcellular localization annotation: CTP_CleavageSite=41; ConfidenceScore=5.47e-01
MRGSGEFVPFLDTTSRGSKMPQRTFLRRRHGPSVGSRQNPYAMPVQKTQCGNVHSIKRKQSPVESPTVATYPSAGGRRVTRGMRVPRKEYARSRHQRLFEENVGKTGKDAIYELLSERFGSCIYARGKVLAPHTPVPRDGSL

SEQ ID NO: 131649 - protein, 80 aa, Glycine max
  Coding DNA Sequence Number=SeqID_14871
MHGSKLQGGGHTNENAIHGAPKKGREWRVALSNHYAWLQTRRWRTHERKRNSWGSEKGLRMENCTKQSLRMAPNSKVEDI

SEQ ID NO: 131650 - protein, 128 aa, Glycine max
  Coding DNA Sequence Number=SeqID_14872
MFHPATTIPISPYGRIAPTRHPVDSEKPNKALGFPAQVTGLCQSYRVPVPPARSCHRDIGIAPIRHPVDSKKSNRVLAFPALIMGLCQFYGVPVAVNKVIKPLINQAFIKKYCAPQAGAGRDTTAAWG

SEQ ID NO: 131651 - protein, 347 aa, Glycine max
  Coding DNA Sequence Number=SeqID_14873
  Gene Ontology: Mol. function=helicase activity; Biological process =viral genome replication
  Homolog annotation: Hit_ID=Q1SRJ5; Match level="QueryCoverage=98%, HitCoverage=42%, E-value=1e-85, Identity=47%"; Hit description =Probable helicase [imported]-Arabidopsis thaliana-related
MDDVLSKPSISDSKFISWMNTNQNSVEGRNLTYAEFVSKFVYNQKKRCWHLRKKGYTIGRLLWVPPITGELFYLRMMLTICKGPTSFEDLRTVDNVQYSTYKEACFVVGFLQDDKEFIEAIKEAKDWGSAHYIRKLFVLLLLTATMSKPEQVWDQTWHWMADDIVYNYKKSSTSPALQLDDRTLQNLVLLEIQQLLQANQRSLRDYPSMPYLEDANCPTYLDNSLILAELNYNNEELRSEFEHLFSHMTDEQASIYNQIVEAVNKDEGGMFFLCGYGGTGKTYIWKALASSLRADNKIVIMVASSGIASQLLPGGRTAHSKFKIQVPVFEDSTCNIHQRTQLAKLLN

SEQ ID NO: 131652 - protein, 274 aa, Glycine max
  Coding DNA Sequence Number=SeqID_14874
  Gene Ontology: Mol. function=acetyl-CoA C-acyltransferase activity; Cellular component=peroxisome; Biological process=protocatechuate catabolic process
  Homolog annotation: Hit_ID=Q7W812; Match level="QueryCoverage=88%, HitCoverage=60%, E-value=1e-102, Identity=77%"; Hit description =Putative acetyl-CoA acyltransferase (Thiolase) protein
MQVESHPHQARAPGRRQAFEPIGLHRFTSPRSHGLEQAGRAHAGADAHRHHAVLAAGAAHAVHQRGGADRAGRAQRVAQRDGAAQRVDLGWIELEFADHRQRLRGEGLVQFDPVQVVLGDAGARQHLGDGGHGADAHDFRRHAGHRIADEARHRAEVELAQHALGHQHHGGGAVRHLRAVAGGDAAARGEHGLEPRQPLGAAVGARAFIDLDQAAGFAHVALGAAGQARHHLERRGLGAEVAGGDGGVGLLLRGQREGVLVFARHLPLLGHFLA

SEQ ID NO: 131653 - protein, 59 aa, Glycine max
  Coding DNA Sequence Number=SeqID_14875
MLLCHCLAVAPEHHVHEVRSQPTIAKNITTKGWEEEEEEEASKREGVNLSEQEKSLMTT

SEQ ID NO: 131654 - protein, 339 aa, Glycine max
  Coding DNA Sequence Number=SeqID_14876
  Homolog annotation: Hit_ID=Q5N7G7; Match level="QueryCoverage=30%, HitCoverage=45%, E-value=3e-17, Identity=51%"; Hit description =Prolyl 4-hydroxylase alpha subunit-like
  Pfam annotation: Domain name=DUF584; Domain location=123-242; Score =89.2; E_value=1.3e-23; Accession=PF04520.4; Description=Protein of unknown function, DUF584
MDLLDPNRFRNRKQPTLSSRERFLGVPSHAPRLENPSSDDVVFSNNDDLIEDDVVFSNNVDSTEPSSSSSPIPNHHNHNHNSHHKGFAYGPSDASFGILAALPENDHASPNGSHFFHHKPSVSVSVSLSSSSSSSSARLIPAIPKPPPDRTPSSSLKFHQSAPVNVPLMPMRRHHHREFDDDDGNEDAAEEEMLPPHEIVARNSAQSPMLAYSVLEGVGRTLKGRDLRQVRNAVWRQTVFGKSQVIENETNVKEELLLQALELGKPLWPHHGGMVWWWIANHHRQFVKEDLLWRRHKMQWHVYMAEFRPSTIRHQSTLFETWVFILCMLGMAKDGTEDE

SEQ ID NO: 131655 - protein, 140 aa, Glycine max
  Coding DNA Sequence Number=SeqID_14877
KLLGAKPHSRGNGRSKLLDEPNWLEALHSVYWGHDVKKLRGVEMFDEGVFVWSEGRSTLKKPLSSVVAIARFFTPSHFTETLMPENMKRVVHFKMIVKLSSSVREYFDEGANSGYENKMLGLEDMREVEGVEQVVTLSEC

SEQ ID NO: 131656 - protein, 148 aa, Glycine max
  Coding DNA Sequence Number=SeqID_14878
MKNKEKDKTTSFQLGDAPNNRDAPFCYVHHTCLESLTKHKPEPPNPLISVLSSRRRPPRLWCLDSRTRHRSSHCTELFLRRAAALVASGGFPRRSTPFSGLRNFVFQEEFYCSLISYVVSSIMKEETMSALKFVMQNYTALLFDMFFL

SEQ ID NO: 131657 - protein, 362 aa, Glycine max
  Coding DNA Sequence Number=SeqID_14879
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q9SEA0; Match level="QueryCoverage=82%, HitCoverage=66%, E-value=1e-116, Identity=64%"; Hit description =Capsanthin/capsorubin synthase, chloroplast precursor
  Pfam annotation: Domain name=Lycopene_cycl; Domain location=12-339; Score=216.4; E_value=6.5e-62; Accession=PF05834.3; Description =Lycopene cyclase protein
  Subcellular localization annotation: CTP_CleavageSite=59; ConfidenceScore=5.49e-01
MGHYFMLFSRTASVDQASPTPHPSIPSSSNPSHSIKKTHQRRQEGPQHQQAQGSRSKCPSMELRVSRRKLKERLVEGCVSNGVRFHKAKGSLVVDVSGFGSSFVAYDKVKNHGFQIAHSVLAEVDDHPFDLDKMVLVDWRDSHLGNEPYLRASSSRFPTFLYAMPFSSNLIFLEETSLVSRPVLYYMEVKRRMDEKCLIPMGGPLPRTPQEVMAIGSTSGVVHPSTGYMVARTMAVAPVVAFAIAECLGSTRMIRGKQLSGKVLNSMWPIENRLVREFYSYGMETLLKVDLNGNRSFFDAFFDLKPYYWQGFLSSRLTLNELVWLSISLFGHASNPSRFDILTKCHVPLAKMMGNIALEYIG

SEQ ID NO: 131658 - protein, 91 aa, Glycine max
  Coding DNA Sequence Number=SeqID_14880
MVIKGFVSGCFFFFTLPTSSLLLFQPPSPLHQKCFPLYWIYCIPKSWDPLITTRLQHDLKGEQECSSSLVAVMDETIRYMCDVTRFGIAIQ

SEQ ID NO: 131659 - protein, 215 aa, Glycine max
  Coding DNA Sequence Number=SeqID_14881
  Gene Ontology: Mol. function=nutrient reservoir activity; Cellular component=apoplast; Biological process=auxin mediated signaling pathway
  Homolog annotation: Hit_ID=Q1S4W4; Match level="QueryCoverage=87%, HitCoverage=87%, E-value=1e-71, Identity=68%"; Hit description=Cupin, putative
  Pfam annotation: Domain name=Cupin_1; Domain location=59-209; Score =150.0; E_value=6.1e-42; Accession=PF00190.13; Description=Cupin
  Pfam annotation: Domain name=Cupin_2; Domain location=94-171; Score =32.5; E_value=1.4e-06; Accession=PF07883.2; Description=Cupin domain
  Pfam module annotation: Pfam domain module=Cupin_1::Cupin_2; Domain location=59-209::94-171
MVTRVHFFCLLALTFTLALEADHSPLQDFCVADTKSQVLVNGFSCKDPTLVEANDFFFRGLDIEGNTSNPVGSKVTPVTVSQLPGLNTLGISLARIDYAPWGTNPPHTHPRATEILNVIQGTLEVGFVTSNPGNRHVTKVLQKGDVFVFPVGLVHYQRNVGYGNAVAVAALSSQNPGVITIANAIFGATPDIASDVLVKAFQVDKDVVANLKSKF

SEQ ID NO: 131660 - protein, 400 aa, Glycine max
  Coding DNA Sequence Number=SeqID_14882
  Gene Ontology: Mol. function=hydrolase activity
  Homolog annotation: Hit_ID=Q9SJF3; Match level="QueryCoverage=99%, HitCoverage=99%, E-value=1e-71, Identity=44%"; Hit description=mRNA decapping enzyme-like protein
  Pfam annotation: Domain name=DCP1; Domain location=12-168; Score =115.3; E_value=1.8e-31; Accession=PF06058.4; Description=Dcp1-like decapping family
MSQNGKLMPNLDQHSTKLLNLTVLQRIDPFVEEILITAAHVTFYEFNIDLSQWVRFLSIYHFFFIHSISIPYQFSSSLSSAIASQSRKDVEGSLFVVKRYCIDTKLGGGELPNVHASENLVENLLGDFEYEVQVPYLLYRNAAQEVNGIWFYNARECEEVANLFSRILNAYAKVPPKSKVSSTKSEFEELEAVPTMAVIDGPLEPSSSTTSNVADVPDDPSFVNFFSAAMAIGNTSNAPINGQPCQSSATISSSSVPTNAATPTVPTLQIPTLSASTPLIPQLDAAELISSSNRTAKLVKPSFFVPPPSSAMMIPPVSSSTPSAPPLHPAVNVQRPYGAPLLQPFPPPNPPPSLAPAPSPSPSYGPVISREKVRDALLVLVQDNQFIDMVYRALLNAHQS

SEQ ID NO: 131661 - protein, 271 aa, Glycine max
  Coding DNA Sequence Number=SeqID_14883
  Homolog annotation: Hit_ID=Q53QH2; Match level="QueryCoverage=85%, HitCoverage=78%, E-value=2e-25, Identity=35%"; Hit description=F-box domain, putative
  Subcellular localization annotation: CTP_CleavageSite=80; ConfidenceScore=5.74e-01
MATMSIALSLLIFLSLISLFTMENFSNLSFAFSASSFSLFPFSIASCKITTPSLPITCLPSVSSMHLELRREPVAPRRNRAAAGEVRGAFSGRVDDDPAEGEILHEVVEQFDFVVGLGEFQGSGDHLGGVEEVHPEGGAEEPPLVGFGSDDAGKDGFALVVYVHGGDELRRRRCRWLCWDGIGRGVVEGGEGVGEDGAVGGGEGGDGGRGEGIVERRPRGGADVTPEVVFGAEAAEVRGGGSGGSEGGAVEAIKDVGLKDVGVDGGDVRRG

SEQ ID NO: 131662 - protein, 234 aa, Glycine max
  Coding DNA Sequence Number=SeqID_14884
  Gene Ontology: Mol. function=DNA binding; Cellular component=nucleus; Biological process=regulation of transcription
  Homolog annotation: Hit_ID=Q9XIN7; Match level="QueryCoverage=97%, HitCoverage=55%, E-value=4e-62, Identity=53%"; Hit description=NAM (No apical meristem)-like protein
  Pfam annotation: Domain name=NAM; Domain location=17-175; Score =209.0; E_value=1.1e-59; Accession=PF02365.6; Description=No apical meristem (NAM) protein
MEGVSREAQMSIAASSMFPGFRFCPTDEELISYYLRKKMDGHQESVQVISEVELCKYEPWDLPGLLGPYLGRPSPSSSNGSWVTVTAVKIGDVMAKSFIQSDNEWFFFSPRGRKYPKGSQSKRATECGYWKATGKERNVKSGSNVIGTKRTLVFHLGRAPKGERTEWIMHEYCINEKSQDSLVICRLKKNTEFRLGDSSNRASSSQRHPVNSHESGCAISEGGIDQRDACEQDK

SEQ ID NO: 131663 - protein, 215 aa, Glycine max
  Coding DNA Sequence Number=SeqID_14885
MTGKREVLGKNNEETRSYFTWNLEMKRVLGDVLRYQRNLGNKGDEGWKSGFDWDGTKHMIIVEDENVWNEYCTIGFDFFLFFVPSHKSAKPFQCKVLQNWDDIVDLCAKDRATGHGAETAMDADEAMGVTAVIDLEEPSSNTKEKRQGSTSYGTHSHKRKIGEEEGITTSLDKMANSFDRMVEKMNGKVDDEDIQEVLRGAALRPDNNGLKLLNG

SEQ ID NO: 131664 - protein, 69 aa, Glycine max
  Coding DNA Sequence Number=SeqID_14886
MDVSEVTPNSLSIGNDEFRVGVTWKIKAVIRCGWEHPTLPYASILIKRNPSLTPPSNESKYVSMFSDIL

SEQ ID NO: 131665 - protein, 189 aa, Glycine max
  Coding DNA Sequence Number=SeqID_14887
MSRPMLLVFLLIILIITSQFEWKQQLVADVDSNPSVSQKQHQISKAGETVKEKLELFDVASVSVLCGYLGHLSAVLTHAAFYPAPCIRLHFNYNRVKKISQNMREVLIEIITQMRTVYMLAFIAVLSKADGGKWWKAEIRPYKHAIAPYGAAMVSLPSQIAYGSWQKIHHAIPPWWHHDTDLQPSVFLC

SEQ ID NO: 131666 - protein, 165 aa, Glycine max
  Coding DNA Sequence Number=SeqID_14888
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=O22856; Match level="QueryCoverage=88%, HitCoverage=27%, E-value=2e-37, Identity=55%"; Hit description =Putative sterol dehydrogenase
  Pfam annotation: Domain name=3Beta_HSD; Domain location=1-165; Score=- 23.3; E_value=2.6e-11; Accession=PF01073.9; Description=3-beta hydroxysteroid dehydrogenaseisomerase family
MVQGAKNVISACQECRVRCLIYNDSVDVVDGGLHDIHDGDEWLVSTWKTNNTLNDLKAQVEALILSANDIDGVLTCSLRPSNVFGLGDPEFVPYFLKLSRYGFSKISPFSENVTHAYICAEEALNFQKFFVAGKTFFITNLEPMKFWEFFSLLFESLEYQSLWKY

SEQ ID NO: 131667 - protein, 66 aa, Glycine max
  Coding DNA Sequence Number=SeqID_14889
MSLKASLALKNLLGFQALEEGRSKEEDFGESSHHCLGFKMQALEERILEHQRSGEKEEERKWRKKL

SEQ ID NO: 131668 - protein, 265 aa, Glycine max
  Coding DNA Sequence Number=SeqID_14890
  Homolog annotation: Hit_ID=Q1WX71; Match level="QueryCoverage=49%, HitCoverage=58%, E-value=3e-07, Identity=28%"; Hit description =Glycosidases
  Subcellular localization annotation: CTP_CleavageSite=24; ConfidenceScore=5.27e-01
MALMLGYDPCSHLSRAFSHFPSVSSSEANRNVGFTLKACFDANSGDNANRVFVKEKKKPNGFACVPHPPLLGGLEKGIDVEDRSLGGSPTKPFCFSDQQLPQKLVVAVDVDEANTRVHEFFETPYFKSGIQPIPGAQTSLQKLSTFCSLSVVTSRQNVIKDHTLEWIEKHFSGLFQEIHFGNHFALDGMSRPKSEICRSINATVLIDDNPRYAIECAEAGIRVLLFDYENSYPWSKTNSADEHPLVIKVKNWEEVEQQLMSLVAL

SEQ ID NO: 131669 - protein, 65 aa, Glycine max
  Coding DNA Sequence Number=SeqID_14891
SERTSSGRSSVHYRKKFFRKLLSEEALPEADTPYYEKRSSGISSINFRNNFFWKKERLPEEVFTE

SEQ ID NO: 131670 - protein, 316 aa, Glycine max
  Coding DNA Sequence Number=SeqID_14892
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=85%, E-value=6e-71, Identity=32%"; Hit description =Leucine-rich repeat
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=128-150; Score =8.7; E_value=6.7; Accession=PF00560.23; Description=Leucine Rich Repeat
  Pfam annotation: Domain name=LRR_1; Domain location=152-175; Score =12.3; E_value=1.4; Accession=PF00560.23; Description=Leucine Rich Repeat
  Pfam annotation: Domain name=LRR_1; Domain location=177-199; Score =9.1; E_value=5.6; Accession=PF00560.23; Description=Leucine Rich Repeat
  Pfam annotation: Domain name=LRR_1; Domain location=201-223; Score =17.3; E_value=0.057; Accession=PF00560.23; Description=Leucine Rich Repeat
  Pfam annotation: Domain name=LRR_1; Domain location=273-295; Score =7.6; E_value=11; Accession=PF00560.23; Description=Leucine Rich Repeat
  Pfam annotation: Domain name=LRR_1; Domain location=297-316; Score =7.7; E_value=10; Accession=PF00560.23; Description=Leucine Rich Repeat
  Pfam annotation: Domain name=LRR_1; Domain location=52-73; Score=2.8; E_value=87; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-101; Score =12.2; E_value=1.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=104 -126::128-150::152-175::177-199::201-223::273-295::297-316::52-73::7 -29::80-101
MWEALSQVLYLNLSRNHIHGEIGTTLKNPISIPTIDLRSNHLCGKLPYLSSDVLQLDLSSNSLSESMNDFLCNDQDKPMQLQFLNLASNNLSGEIPDCWMNWTSLVDVNLQSNHFVGNLPQSMGSLADLQSLQIRNNTLSGIFPTSVKKNNQLISLDLGENNLSGTIPTWVGEKLLNVKILRLRSNRFGGHIPNEICQMSHLQVLDLAQNNLSGNIPSCFSNLSAMTLKNQSTDPRIYSQGHYGTFYSSMESLVIVLLWLKGREDEYRNILGLVTSIDLSSNKLLGEIPREITSLNGLNFLNLSHNQVIGHIPQGI

SEQ ID NO: 131671 - protein, 173 aa, Glycine max
  Coding DNA Sequence Number=SeqID_14893
MWYRIRCLQDCLSAMKARTKASSFPSMKKCPTDNRKSNLELDVDDAWTFWNQTMWNETKNIGPSNSDKRSWKPVSSTCMNNRRLTGLSIRILGKQGWQLRKNRNLMQKPDARPLLRKRLKKRLQKLDPEVDVSIPTPIVETPMEKANEAITDPTSHKATSKDTTVVIVHTTTS

SEQ ID NO: 131672 - protein, 53 aa, Glycine max
  Coding DNA Sequence Number=SeqID_14894
MGEEVAAQASSARPHSPSRTLRIAQQCFFFTSEMLRNLTGYLAMGVKYLEAVE

SEQ ID NO: 131673 - protein, 239 aa, Glycine max
  Coding DNA Sequence Number=SeqID_14895
MVGIVSDMINVSRSMKCFFKGSNNSPLLQFSYNSADQSDSGEGGEGGGIPVFTFYSITSHEKFAEELIQMFSLELCLKRLLVLEFMSIGYDTSAVKQLHWSTQLYDEEFKDLRDCNLYCEETHGPVPPRLRDGKSDIDALRFDNQPNPEVLQVYLTTWLAEANIDTPKSQGRQNLHMQMELVQRKGKPNKIGVCKDSMLNNICKNVGEFQECPLKAPHMLMVVSSIPMRVQVMRGLRAY

SEQ ID NO: 131674 - protein, 78 aa, Glycine max
  Coding DNA Sequence Number=SeqID_14896
MKHVTDVHKGVLPSNALAGTLIMDCDGQWYSGEWVKKMEEAATLFKKINVEIAFFGVNNVFWLVLEYRLNAHRLLVLQ

SEQ ID NO: 131675 - protein, 1773 aa, Glycine max
  Coding DNA Sequence Number=SeqID_14897
  Gene Ontology: Mol. function=protein binding; Cellular component =extracellular region; Biological process=chitin metabolic process
  Homolog annotation: Hit_ID=Q9FF08; Match level="QueryCoverage=99%, HitCoverage=100%, E-value=1e-175, Identity=30%"; Hit description =Arabidopsis thaliana genomic DNA, chromosome 5, P1 clone:MXM12
MPGNEVGDRVHNFFGQENLSQGQYHSQEVDGNWPGLSNNLWAGSQRPTVAPFISNLKNFNLQQSDFEQGHTSTPHLRHGLNLAQSNLRPDSGRNQPPNQQTTVNGYMQGHQVFQSRQSEANILGMDTETDLHGMSNLSRGISVLDSQQGSGLEHYKKNLTRSGASESPVNYDFFGSQQQMSGRHSGMLQSFPRQQSGMNDLQLLQQQAMLNQMQELQRQQQFHQLEARQQSSMNPASSISKQTIASHSASLINGIPINEASNLVWQQPEVMATNANWLQHGGSAVMQGSSNGLVLSPEQLRLMGLVPNQGDQSLYGLPISGSRGTPNLYSHVQADKPAVSQVSIQHQHQHQYSRIQGDKPSLPHISASGHSFPVHQYGSISDQTNTNDGTSVSRQDIEGKSMFGSLAQGINSGLNMENLQQVNSEQRDIPIEDFNGRQELAGSSDTSQDKVLAQVPPSQNVATLDPTEEKILFGSDDSLWDGLGWSAGFSMLDSTDSFGGVPSVQSGSWSALMQSAVAETSSSEMGIQEEWSGLSVRNTERSSGSERPSTMDCTKQQSGWADNNLQSAPNINSRPFLRPDDLSRPSTTANYSGLPGFNQSGADTAQEQQDRLQTDSSQRSIPQFLERGKWLDCSPQQKPMAEGSHSYGNATNTSGIEVNEKVISGSWAHQQMLSSPNSRGDPFNRSNGWNAIKSSTPSNNSSMKIRENENVLQPHHDKAMQENMGQVPAIWEPDSDTSSVGLEHAKSSGNMQVCGEDSGMNGIAAIPNSGATWVSRQSSQQFPNADVWRHTDTVGSYRGNEGAGKYRHHMEKNPLVLESLKNEKSEGEAHDMENSNKKDKSATGGLRENPSFDGDLHSPKLSGQGNRRPPVTRKFQYHPMGDVGVDTEPYRNKHAINSQPMPHQPIGGLKGQDQSYTGQSKYSHSDGNYNETEKGDSKTIDDNASKSMLPGHTPKTLTPFDRSVGNYALNKTASPSQNILELLHKVDQSREHVATNTSTSNRPLSSRVMDTESSDGSAAHPQRNQSSLSQGFALQLAPPTQRHPMTSSHATPHVASETGDKGHTWLAATQTFPSRESSHEFRNNISGSSGQIFDKASQYSALGNSPQAFTSGFPFSRIRSQNQNVANLGGQVANTQCDNSTFVDQAASTNQVHEYCDRAQTGQSELQSAQDMSQMDSMSQIRAGDPTMKISSLEAGTAPHASVTSSLQSAPSKVLHNVWTSVSGKQHPNAYRIPSHSQPNNICETTTGPQKPGIEDSEKGNLSEQRVLPESVDAVEETASASQVKEHVKYTPDASQSSPAATSKDIEDFGRSLRPNNFLHHNFSMLNQVQSMKNMEIDPSNRDVKRFKVSDNVMDKQQVDSISNCGQQSYGCNNIVNDVSDNSSSVPPSDPNLLSFSTKPGDARDTSASSQEVVGYGQRNALNVGNNNKVTSVRSEHSVINPQMAPSWFEQYGTFKNGKMLQMYDVGTMTPQKVMEHPLIIRNQSGSLHLANSMEQANSLSEAGQNPMLASVASEHLPSKLLLPPAVEPDLSSMRPKKRKTSTSKLIPWHKELSQGSERLQDISVAELDWAQAANRLVEKVEDDAEVVEELPMMKSKRRLVLTTQLMQQLLNPPPAAILSADVKLHHESVVYSVARLALGDACSSVSRSGNDTFIMSPGSKNLLPDKPKASEKIDQYILKVEDFVGRARKLENDILRLDSRASVLDLRLECQDLERFSVINRFAKFHGRGQNDGAETSSSDATANAQKSCPQKYVTAVPMPRNLPDRVQCLSL

SEQ ID NO: 131676 - protein, 195 aa, Glycine max
  Coding DNA Sequence Number=SeqID_14898
  Subcellular localization annotation: CTP_CleavageSite=57; ConfidenceScore=5.74e-01
METLDSAVSTPSRTSDSKPQTSSPLPPSVLRLWRPAAQRNLRNQWSQLVSCKNRWFSASSVGRSHATALVNFHLSQRYMPDMKLGVLSDMPDIKKRACLKLFKRQKFAVASLILGPLGSKCLQVFGWSEGSQLGLGLFKMIKILRELFLVWYGRGDHLGSREISYRSKKERLGSWKLEICCPKTLLWLICLIIRN

SEQ ID NO: 131677 - protein, 167 aa, Glycine max
  Coding DNA Sequence Number=SeqID_14899
  Gene Ontology: Mol. function=oxidoreductase activity; Cellular component=membrane; Biological process=electron transport
  Homolog annotation: Hit_ID=Q2PEY1; Match level="QueryCoverage=98%, HitCoverage=32%, E-value=6e-59, Identity=64%"; Hit description =Putative flavonoid 3'-hydroxylase
MFSAGIDTSSNTIDWIIAKLIKNPRIMVQVQQELNIVVGQDRLVTELDLPHLPYLQVVVKETLHLHPPTPLSLPRLAKNSCEIFNYHIPKSATLLINVWAIGRDLKEWLDLLEFKPERFFLDGEKVDVDVKGNNFELLPFGVGRKICVGMSLGLKLVQLLIATLTHI

SEQ ID NO: 131678 - protein, 332 aa, Glycine max
  Coding DNA Sequence Number=SeqID_14900
  Gene Ontology: Mol. function=oxidoreductase activity; Cellular component=membrane; Biological process=electron transport
  Homolog annotation: Hit_ID=Q2PEY1; Match level="QueryCoverage=98%, HitCoverage=64%, E-value=1e-141, Identity=73%"; Hit description =Putative flavonoid 3'-hydroxylase
  Pfam annotation: Domain name=p450; Domain location=1-318; Score=66.7; E_value=7.7e-17; Accession=PF00067.12; Description=Cytochrome P450
MARITIGRRIFNDDSCNCDPRADEFKSMVEEHMALLGVFNIGDFIPPLDWLDLQGLKTKTKKLHKRFDILLSSILEEHKISKNAKHQDLLSVLLSLKETPQEGHELVEEEIKSILGDMFTAGTDTSLSTIEWAIAELIKNPKIMIKVQQELTTIVGQNRLVTELDLPHLPYLNAVVKETLRLHPPTPLSLPRVAEESCEIFNYHIPKGATLLVNVWAIGRDPKEWLDPLEFKPERFLPGGEKADVDIRGNNFEVIPFGAGRRICVGMSLGIKVVQLLIASLAHAFDWELENGYDPKKLNMDEAYGLTLQRAVPLSIHTHPRLSQHVYSSLSL

SEQ ID NO: 131679 - protein, 68 aa, Glycine max
  Coding DNA Sequence Number=SeqID_14901
MEIWFLILKTARDEWKELLLFVMTVRRKRNKRWREGKDMILDVGDNKRSVKDRVCNMRGLCVKVKGRC

SEQ ID NO: 131680 - protein, 282 aa, Glycine max
  Coding DNA Sequence Number=SeqID_14902
  Homolog annotation: Hit_ID=Q75J22; Match level="QueryCoverage=81%, HitCoverage=74%, E-value=3e-73, Identity=56%"; Hit description =Expressed protein
MSTSIEDQALSSTGSDLKCDGYGISLVVSSVLFVLYLAVHAKKNLNSLCRRGSYVVVSYFALLWLVTLLNLAWSFLQAWQCSPGKEVAWNLLSLFTASGMLCLEISLMAFLLKDNYMNGMEALAHSFLATGIIVFVDTLLKAIYVFGVGVPLFNHNVRSTHTIKWSLWIIHKLLLAAAYGFILFANFSKWREKLPPRPSFHNYVAVMFVFSVITLFACGLAAIDAGLGNWLYDLTVLCYHSLYLPFLYVTFLADFFQEEDFLLDNAYYSEMKDAGFFDADWE

SEQ ID NO: 131681 - protein, 195 aa, Glycine max
  Coding DNA Sequence Number=SeqID_14903
  Gene Ontology: Mol. function=GPI anchor binding; Cellular component =anchored to membrane; Biological process=carbohydrate metabolic process
  Homolog annotation: Hit_ID=Q9SD84; Match level="QueryCoverage=55%, HitCoverage=56%, E-value=3e-35, Identity=62%"; Hit description =Glucan endo-1,3-beta-glucosidase-like protein 3 precursor
  Pfam annotation: Domain name=X8; Domain location=46-129; Score=154.3; E_value=3.1e-43; Accession=PF07983.3; Description=X8 domain
MAKAVPRFSLHLETPSLPQSQPITILMAALALALLLLAFTGTSSATWCVCKDGSDAILQKTLDYACGAGADCNPLHLNGPCFQPNTVRAHCNYAVNSYFQKKGQAQGSCEFAGTATVTASDPSSSGCVYPSSVRLNNCSKTINNASSKNPTILSQPKPPKHTPSMAGATGRTSSLSSLTRLSHPPSASNPQTLSL

SEQ ID NO: 131682 - protein, 513 aa, Glycine max
  Coding DNA Sequence Number=SeqID_14904
  Gene Ontology: Mol. function=oxidoreductase activity; Cellular component=membrane; Biological process=electron transport
  Homolog annotation: Hit_ID=Q8W3Y5; Match level="QueryCoverage=99%, HitCoverage=100%, E-value=0.0, Identity=66%"; Hit description =Flavonoid 3'-hydroxylase
  Pfam annotation: Domain name=p450; Domain location=34-499; Score =384.6; E_value=1.5e-112; Accession=PF00067.12; Description =Cytochrome P450
MSTWVIGFATIIAAVLIYRVLKPISRPSSSLPLPPGPRPWPIVGNLPHMGPAPHQGLANLAQTHGPLMHLRLGFVDVVVAASASVAEQFLKIHDANFCSRPLNFRTTYLAYNKQDLVFAPYGPKWRFLRKLTTVHMFSAKAMDDFSQLRQEEVARLTCKLARSSSKAVNLRQLLNVCTTNALTRIMIGRRIFNDDSSGCDPKADEFKSMVGELMTLFGVFNIGDFIPALDWLDLQGVKAKTKKLHKKVDAFLTTILEEHKSFENDKHQGLLSALLSLTKDPQEGHTIVEPEIKAILANMLVAGTDTSSSTIEWAIAELIKNSRIMVQVQQELNVVVGQDRLVTELDLPHLPYLQAVVKETLRLHPPTPLSLPRFAENSCEIFNYHIPKGATLLVNVWAIGRDPKEWIDPLEFKPERFLPGNEKVDVDVKGNNFELIPFGAGRRICVGMSLGLKIVQLLIATLAHSFDWELENGTDPKRLNMDETYGITLQKAMPLSVHPHPRLSQHVYSSSSL

SEQ ID NO: 131683 - protein, 168 aa, Glycine max
  Coding DNA Sequence Number=SeqID_14905
MALFSRNVTMHIILLMMIIIGTIEGRKVQNCGSIRNGGGAGGGFNSDKNDSQSGGSGNNIGIGGGGGGSVGAGGGLGGGVGGGGARAGGDVGAGGSVGVGGGGGGAIGGGGGAGGGGTGIGGGAGGGGGAGLGAGGGVGGGGSIGAGGGGGAGARGGVGGGGGVVLGT

SEQ ID NO: 131684 - protein, 588 aa, Glycine max
  Coding DNA Sequence Number=SeqID_14906
  Gene Ontology: Mol. function=hydrolase activity; Cellular component =cytoplasm; Biological process=regulation of transcription, DNA -dependent
  Homolog annotation: Hit_ID=Q8RX28; Match level="QueryCoverage=97%, HitCoverage=85%, E-value=0.0, Identity=60%"; Hit description=Histone deacetylase-like protein
  Pfam annotation: Domain name=Hist_deacetyl; Domain location=18-341; Score=394.3; E_value=1.7e-115; Accession=PF00850.10; Description =Histone deacetylase family
MERENDNSAKSSVNGQRRVGLLYDERMCKHHTPDDEDHPETPNRIRAIWNKLQSTGVPQRCVILEAKEAEDKHLLLVHSENHVNLIKNISSKQFNSRRHKIASKLDSIYFNEGSSEAAYLAAGSAVEVVERVASRELDSAVAIVRPPGHHAEQNEAMGFCLFNNVAVAARYLLDERPELGVKKILIVDWDVHHGNGTQKMFWNDSRVLFFSVHRHEFGSFYPANDDGFYTMIGEGAGAGYNINVPWENGRCGDADYFAVWDHILLPVAKEFNPDIIIVSAGFDAAVGDPLGGCRVTPFGYSVLLEKLMNFAEGRIVLILEGGYNLDSIAKSMHACLEVLLEDKPVIGSSEAYPFESTWRVIKAVLLELSPFWPTLACELPQKLISQMAPPPHTLVSSSDSEAEDDKGAPSSENFVELLEDVIKPLSKLKVDADEDTDVSSTWRSELSNVYIWYASYGSNMWKARLNCYLAGGQILRNDIQVEGMQKGCSGSVNRTLPKEILWKTFPCHIFFGRDSSHSWGMGGVAFLNPEKSFQHNTYMCLYKISLEQFNDILFQENGLSLDAGSPLFDITTLNAISYKEFHSLEVVK

SEQ ID NO: 131685 - protein, 63 aa, Glycine max
  Coding DNA Sequence Number=SeqID_14907
  Subcellular localization annotation: CTP_CleavageSite=45; ConfidenceScore=5.28e-01
MNLLPSAVHASSTNESGAPRIHCLAMFANSPFSNLIWRPMNSLPSAVHVSSVIQRRASEKKKE

SEQ ID NO: 131686 - protein, 70 aa, Glycine max
  Coding DNA Sequence Number=SeqID_14908
MSLPSVVHVFSLIKCEASGDWEARYSVVFQIGSFAKRKKKEVEMRVVIAKRAGRTKSVSYLCFPLISDER

SEQ ID NO: 131687 - protein, 232 aa, Glycine max
  Coding DNA Sequence Number=SeqID_14909
  Homolog annotation: Hit_ID=Q9S834; Match level="QueryCoverage=49%, HitCoverage=48%, E-value=5e-33, Identity=54%"; Hit description=ATP -dependent Clp protease subunit ClpP
  Pfam annotation: Domain name=CLP_protease; Domain location=90-192; Score=-61.5; E_value=0.0004; Accession=PF00574.13; Description=Clp protease
  Subcellular localization annotation: CTP_CleavageSite=57; ConfidenceScore=5.31e-01
MANAPCLRCSSLVLPSLTPTSSSQSLSLASHTYLPSWKLIGNKYSTKKSLGKVKAVYANEFWAPETSSSQGIWDDLRVPSSPYFPAYAQGHEPPPMRIIRCGGAVDDDMSNILVAQLLYLDVLTRILSCMAIFDTMRHIRPDVSTVCIGLAARITYNLNSLPHYLCAMMLERKPTLVRLSVDCRVTYFIPWDHNIHVEGFQDFKFLIIFALIIQQPSLCLLGGVGHIDQMTP

SEQ ID NO: 131688 - protein, 576 aa, Glycine max
  Coding DNA Sequence Number=SeqID_14910
  Gene Ontology: Mol. function=transcription factor activity; Cellular component=nucleus; Biological process=regulation of transcription, DNA-dependent
  Homolog annotation: Hit_ID=Q1SG54; Match level="QueryCoverage=79%, HitCoverage=80%, E-value=1e-114, Identity=47%"; Hit description=GRAS transcription factor
  Pfam annotation: Domain name=GRAS; Domain location=179-483; Score =161.2; E_value=2.7e-45; Accession=PF03514.5; Description=GRAS family transcription factor
MEIDQFSSTDLNFKGVQVGYGSTQEDVFQGKERFSGMEFLGEIDPLPTEDGKGAKLFNDQDQKQLQEPKIDNFMLEEVNFNPDMQMQPTQLFQETTGLMKHVRVNSELVEYNKQVPPTPSLASLELLRNYGSRFKRLSEQNISTLSNIETSFDRQKMSTEEIIRVAGARYLQYSAHWNDSFYIPMHPYGLDLVGFSEEENRDIELAQFLLAAAERVGCQQFERANGLLLHCEWSSSGSASPVQRVIFHFARALRERIYKETGRMTVKGSGKNEERELIQKMDTNISIKCHLKIPFNQVMQFAGVQAIVEHVASETKIHLIDLEIRSGVQCTALMQALSERRDCIVQLLKITAIGLNSLKIKIEETGKSLTSFAESLNLPFSYNAVFVADIAEIRKDHFEIGEDEAVAVYSPYFLRSMVSRPDCMENLMRIIRNIKPVIMIVLEVEANHNSPSLVNRFIEALFFYSAYFDCLETCIKHEIECKMTIEAVLSEGIRDIVAMEGRERTVRNVKIDVWRRFFARYRMVETGFSESSLYHAHLVAKGFAFGKFCTIEKNGKGLVVGWKGTPMHSISAWRFL

SEQ ID NO: 131689 - protein, 288 aa, Glycine max
  Coding DNA Sequence Number=SeqID_14911
MVAMGNNLQQKAKEIFHLFTFTLLTLLLPLSFLLLAKFSDAQYYLQTLTWYHSPQHFPYVLTLALHINPLILYVLLSIISMASLVHGLTGKIIILSDSLSSSSTFLQPRIFTAWIVLCTFQVCVGLGIEGSIEAGLYDSNDESMGFGVERRSLLSRVVFLLGLHETMHVWARVVVRPVVDDTVFGVVGREEKWVERVVEAASLGALWWWRLREDVESLVVMVEAKKEQLIDVRVSDFVGWWLYYLTVTIGMVRVVRGLVWMVTICLYRRPRATGVTSLLEHSEIDDKV

SEQ ID NO: 131690 - protein, 734 aa, Glycine max
  Coding DNA Sequence Number=SeqID_14912
  Homolog annotation: Hit_ID=Q2QNL8; Match level="QueryCoverage=39%, HitCoverage=43%, E-value=6e-49, Identity=49%"; Hit description=PAPA -1-like conserved region family protein, expressed
  Pfam annotation: Domain name=PAPA-1; Domain location=443-531; Score =163.1; E_value=7.2e-46; Accession=PF04795.3; Description=PAPA-1-like conserved region
  Pfam annotation: Domain name=RR_TM4-6; Domain location=365-594; Score= -102.8; E_value=0.029; Accession=PF06459.2; Description=Ryanodine Receptor TM 4-6
  Pfam module annotation: Pfam domain module=PAPA-1::RR_TM4-6; Domain location=443-531::365-594
MEDLGGTQFDGLSNAVRRKRSQTSRRPRPDSQHASEGQELSPLSSTPSEDAGKASSDENVGYDANSKRKEFNLNHCVSQTSSGTGAEDEKSHKKSKKDGGFHTFYSNEPVRSGSNNKRCSEGVLAPANWKGSSKTKDSLDSELRNADLYGGRNPESMSLAQFGGSQDGLGNENRVKKVKLKVGGVTRTIQANSATNGASGSGTTMKSRSSDASRPRQKQQSNSDDNNSPSDKRSRLQGVPWKDFSRGGFGLGKEESLMGKISGKNTTSKLGDKSEPVRKSKRVPKRRVLDGEFGDDDDEDDEIRYLEKLKTSKVSAVYRDEEELNKKHRKLSSVSNLENAAPRSGKDGKKRSRSDRVYEDTDYEDEDESGSDGELEDKKKKKQRKESVDVLMDSKREMTLTTRQRALQSSKDASASSASVIEFPNGLPPAPPRKQKEKLSEVDQQLKKAEAAQRRRMQVEKAARESEAEAIRKILGQDSSRKKREEKIKKRQEELAQERAANALMLASNTIRYTMGPTGTFVTFSEEMGLPSILNSKPVSCSLIFTTTNAGQKFETIVVCLATHQNFTYLLMISLGIVSVIPHLVRSVLVHLVQILISIGIQNQSFLFAVSNATRLSRRRWWLKLPVDVVNDPLSLASSSYMEPSMFLSFTEALVKQLCVERDPVGMTVSLAYSIYVIYYYLEHFSLWIVNLLNLKCRCKSLYDPAFLNSKDNLTALLRLSSAQRKACHYLWRG

SEQ ID NO: 131691 - protein, 223 aa, Glycine max
  Coding DNA Sequence Number=SeqID_14913
  Homolog annotation: Hit_ID=P93569; Match level="QueryCoverage=42%, HitCoverage=52%, E-value=7e-08, Identity=32%"; Hit description=Sts15 protein
  Pfam annotation: Domain name=PMEI; Domain location=62-209; Score =60.0; E_value=7.7e-15; Accession=PF04043.6; Description=Plant invertasepectin methylesterase inhibitor
  Subcellular localization annotation: CTP_CleavageSite=57; ConfidenceScore=5.25e-01
MGFNKSYLLFTVSLSFLLLSTHAISSIIAPSPSPFPTHTNTKTKTIDSIFKKALSKTQNMLKSPNPKVLDFCKSTENPTLCGDTIAPFFQGSFFDPIKALLNEVEATHNQTLKVADVIANTLNDPNTNRNAREPLDICRSRYKSIVSTIKEAVELLNQQNVVDAYYKFSSVISDQTTCEDAFVESPGAQFPFPDDSLTVYQLAGNCLAIMDEIVNSHNQFFFA

SEQ ID NO: 131692 - protein, 490 aa, Glycine max
  Coding DNA Sequence Number=SeqID_14914
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=71%, HitCoverage=59%, E-value=1e-105, Identity=58%"; Hit description=CMV 1a interacting protein 2
  Pfam annotation: Domain name=Pkinase; Domain location=146-421; Score =141.0; E_value=3.2e-39; Accession=PF00069.15; Description=Protein kinase domain
  Pfam annotation: Domain name=Pkinase_Tyr; Domain location=146-421; Score=124.3; E_value=3.5e-34; Accession=PF07714.7; Description =Protein tyrosine kinase
  Pfam module annotation: Pfam domain module=Pkinase::Pkinase_Tyr; Domain location=146-421::146-421
MEPPSLYDSRSPLAFVVVHDLPLTANHHVLKHVLSHGAPIAALSTVNPPLYGPFTSNGHSPASSHLSIPFKKKSEVKPPISVFKNIAPVHSTAAAGPSALAQPPLSPYASKKPRTESAISTVGSLPHPTSTRFIAYEELKEATNNFEPASVLGEGGFGRVFKGVLNDGTHVAIKRLTNGGQQGDKEFLVEVEMLSRLHHRNLVKLVGYFSNRDSSQNVLCYELVPNGSLEAWLHGPLGINCPLDWDTRMKIALDAARGLSYLHEDSQPCVIHRDFKASNILLENNFHAKVADFGLAKQAPEGRSNYLSTRVMGTFGYVAPEYAMTGHLLVKSDVYSYGVVLLELLTGRKPVDMSQPTGQENLVTWARPILRDKDRLEEIADPRLGGKYPKEDFVRVCTIAAACVALEANQRPTMGEVVQSLKMVQRVTEYQDSVLASSNARPNLRQSSSTFEFDGTSSMFSSGPYSGLSAFDNDNISRTVVFSEDLCEGR

SEQ ID NO: 131693 - protein, 57 aa, Glycine max
  Coding DNA Sequence Number=SeqID_14915
MAEATLGARTASNSRKESDLRVKLAIAEWNRRTVISSGDVVIPAGSPESGFFSFKYK

SEQ ID NO: 131694 - protein, 125 aa, Glycine max
  Coding DNA Sequence Number=SeqID_14916
MAYATDNQVVFEDEKTIYGRITLLFRDLESQYEANLKCKEQSEKELECLTKLKAEKANLLTQFKTVEEIRETNMKYQINIFTCRTLLQKSLAKIQNEIAQLLPQLTATVHKVNDCDDPIQDSGRK

SEQ ID NO: 131695 - protein, 77 aa, Glycine max
  Coding DNA Sequence Number=SeqID_14917
  Subcellular localization annotation: CTP_CleavageSite=18; ConfidenceScore=5.27e-01
MAHGYPFHTLWSLLCCVVLAVVMSSLLSKKRNSTSLMMSNDVGMKFIKIGLPVAIVDFSASIFQSSSSSSHSWESSQ

SEQ ID NO: 131696 - protein, 267 aa, Glycine max
  Coding DNA Sequence Number=SeqID_14918
  Gene Ontology: Mol. function=signal transducer activity; Cellular component=membrane; Biological process=response to light stimulus
  Homolog annotation: Hit_ID=Q75H87; Match level="QueryCoverage=75%, HitCoverage=31%, E-value=5e-38, Identity=44%"; Hit description =Putative NPH3 family protein
  Pfam annotation: Domain name=NPH3; Domain location=2-126; Score=3.7; E_value=9.4e-11; Accession=PF03000.5; Description=NPH3 family
  Subcellular localization annotation: CTP_CleavageSite=41; ConfidenceScore=5.16e-01
MSQGQSPPTSPARSRFAFERRRSRSAENINLEFQESRRSSSASHSSKLKVAKLVDRYLQEVARDVNFQLSKFIALAEIIPDFARHDHDDLYRAIDIYLKAHPELNKSERKRLCRILDCKKLSMEACMHAAQNELLPLRVVVQVLFFEQARAAQAGGKVTDLPTNIKALLTAHGIDPSKPTAPLSTTTSIHAEDNWSVSNFKSPKSRSSTLRMKLAEDDDFNQNGLTHDGIGRNSRFKAICAIPTQPKKMLSKFWSTTNRTAAATEKN

SEQ ID NO: 131697 - protein, 109 aa, Glycine max
  Coding DNA Sequence Number=SeqID_14919
MSVESCWSGHEALKEPTRTPVRVSSRHGWSQDLPNVSFCSTCAHFKQTIGGQLLEFEHKLFSHNMSISAHHSQRSMSSSAHAIPNAGIIVAVFTIAYTCHIGTPSLGCV

SEQ ID NO: 131698 - protein, 56 aa, Glycine max
  Coding DNA Sequence Number=SeqID_14920
MDEDCPYAFPKITQQPFFIPCKVKLSGGHLNFWYSNGNGLNGLIWQLRVFFKPWVG

SEQ ID NO: 131699 - protein, 234 aa, Glycine max
  Coding DNA Sequence Number=SeqID_14921
  Gene Ontology: Mol. function=signal transducer activity; Cellular component=membrane; Biological process=response to light stimulus
  Homolog annotation: Hit_ID=Q69P69; Match level="QueryCoverage=99%, HitCoverage=37%, E-value=6e-53, Identity=47%"; Hit description =Putative RPT2
MKFMKLGSRPDTFYTAEAVRSVSSEVSSDLIIQVKGSRYLLHKFPLLSKCLRLQKLCSESPESSSQHQIVQLPDFPGGVEAFELCAKFCYGISITLSPYNIVAARCGAEYLQMTEEVEKGNLIQKLEVFFNSCILRGWKDSIVSLQTTKASPMWSEDLGITSRCIEAVAAKVLSHPSKVSLSHSHSRRVRDDVSCNGNESVRHNKSGNKGWWAEDLAELSIDLYWRTMIAIKSG

SEQ ID NO: 131700 - protein, 136 aa, Glycine max
  Coding DNA Sequence Number=SeqID_14922
  Subcellular localization annotation: CTP_CleavageSite=82; ConfidenceScore=5.58e-01
MPISPCKSISWSVSSRHGDRTHKTPSGPGKVQQGPGVSSSGYGPLSVLQGARTPPARSRHHRDRACKTPSGPEEVQQGLGVASSKYGSLSVLGSVCRPQQSHQTPLPIELSSRSTAPPGRRRAKHHSSIGMAGSGQ

SEQ ID NO: 131701 - protein, 502 aa, Glycine max
  Coding DNA Sequence Number=SeqID_14923
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10MI5; Match level="QueryCoverage=66%, HitCoverage=53%, E-value=1e-144, Identity=68%"; Hit description =Expressed protein
  Pfam annotation: Domain name=DUF231; Domain location=342-499; Score =216.6; E_value=5.8e-62; Accession=PF03005.6; Description=Arabidopsis proteins of unknown function
  Subcellular localization annotation: CTP_CleavageSite=5; ConfidenceScore=5.15e-01
MERQRSFSFKPTRLLVFSFTIFSSILFLSTFTTWLTNYTPSIHQQIHLYFNTSTSSSSVGDGESDSVALPPLTVHSLTKNLTVNVVKVPTLIDNRLARTQKSLSGSKSEPVRHHVGASNVNFTSMEEYGTSPERVPSKEEKKVVAGDLVGKTQVPILKKIEQKKRVEGCDLTKGYWVFDESYPLYSKVSCPFIDEGFDCEGNGRLNRSYTKWRWQPKGCDLPRFNATKMLELIRGKRLVFVGDSINRNQWESMLCMLLGAIKDPTRVYESRGRKITKEKGNYSFRFLDYQCTVEYYVSHFLVHESKARIGQKRRSTLRIDAIDHGSSRWRGADIVVFNTAHWWSHSKTQAGIYYYQERGLVHPQLNVSTAFRKALKTWASWVDKHINHRKTHVFFRSSAPSHFRGGDWNSGGHCTEATLPLNKTLSTTYPEKNIIAEEVIKQMRTPVTLLNITSLSAYRIDGHPSIYGRKTRSSRIQDCSHWCLPGVPDTWNELLYFHLQSR

SEQ ID NO: 131702 - protein, 431 aa, Glycine max
  Coding DNA Sequence Number=SeqID_14924
  Gene Ontology: Mol. function=protein binding; Cellular component =nucleus; Biological process=regulation of transcription, DNA -dependent
  Homolog annotation: Hit_ID=Q76I94; Match level="QueryCoverage=88%, HitCoverage=58%, E-value=2e-53, Identity=45%"; Hit description=PHCLF3
MKQHGEATKDAARRTLKTKIKQLTNQVHAKREKSIKEKVQRHSENLKPLFSKVNSIISRRGTLQNKEKVNMLSSRINKPICKHNGFPKGLVGKDCINKLDIALANEIRIPYLEKLPPYTTWVYLTRNIRMAKDQSVIGKRQIYYDKIGGEIMICSDSEEEMVNLKNDKHDFTEAEDLILRMTLEEYESTEEVLIIVKEFVKTTDSQIQERYEKLKEKHMGSLDNHSEDCHCKGCKCHLEICLEKSLSATLESFDNLFCRQCLIFDCPMHATSQPVMYHDKRINPIEGCHESLKSLVEHTSKKLIVSGSFGHGERDKGVVEGQKDIQLSNSTKVQANEMTNNSDWKHLEKDLYLKGVELFGKNSCLIAHNLLPGFKTCLEVARYMLASGESMPHESIPSSITNRNDKINEDCIMGWEEWFDDDGKLSIVHIT

SEQ ID NO: 131703 - protein, 111 aa, Glycine max
  Coding DNA Sequence Number=SeqID_14925
  Gene Ontology: Mol. function=cytochrome-c oxidase activity; Cellular component=mitochondrial respiratory chain; Biological process =electron transport
  Homolog annotation: Hit_ID=Q9SXX7; Match level="QueryCoverage=55%, HitCoverage=100%, E-value=1e-23, Identity=80%"; Hit description =Cytochrome c oxidase polypeptide Vc
  Pfam annotation: Domain name=COX5C; Domain location=49-110; Score =148.3; E_value=2e-41; Accession=PF05799.2; Description=Cytochrome c oxidase subunit Vc (COX5C)
MGNDKLLPFMISEENCQTIIQVSFLFPVCPDLPFTHQSPCLLKTVKQMAGPRIAHATLKGPSVVKEICIGMVLGLAAGSVWKMHHWNEQRKTRAFYDLLEKDEISVVADEE

SEQ ID NO: 131704 - protein, 241 aa, Glycine max
  Coding DNA Sequence Number=SeqID_14926
  Homolog annotation: Hit_ID=Q339I7; Match level="QueryCoverage=51%, HitCoverage=79%, E-value=2e-29, Identity=47%"; Hit description=UMUC -like DNA repair family protein, putative
  Subcellular localization annotation: CTP_CleavageSite=61; ConfidenceScore=5.36e-01
MTLLWPPSGMNLCHNAFLSLNPPLQTRTQLPVPANIPISHPLTSISPHFNSHSLQKPRFPPASAKATTNETLSEILDSSRAQKLDLELKTLEPFFRITARSVVTDKELGKAEGFIRFWVGGKILHLDSIKLQRETLGMEKSIFGLGLFIGAVAIRHGYDSGCKTAQLLSINDSDLYHSKVLFSPTLSKTSHLFIYLWAATVTGSSVEDVGHMLVWGGVGTRMDASVEELMKKWCTRFKAPH

SEQ ID NO: 131705 - protein, 873 aa, Glycine max
  Coding DNA Sequence Number=SeqID_14927
  Gene Ontology: Mol. function=serine-type peptidase activity; Biological process=proteolysis
  Homolog annotation: Hit_ID=Q10MJ1; Match level="QueryCoverage=99%, HitCoverage=91%, E-value=0.0, Identity=76%"; Hit description=Prolyl oligopeptidase family protein, expressed
  Pfam annotation: Domain name=Abhydrolase_3; Domain location=640-796; Score=-76.1; E_value=0.0092; Accession=PF07859.3; Description =alphabeta hydrolase fold
  Pfam annotation: Domain name=Peptidase_S15; Domain location=565-788; Score=-103.3; E_value=0.015; Accession=PF02129.9; Description=X-Pro dipeptidyl-peptidase (S15 family)
  Pfam annotation: Domain name=Peptidase_S9; Domain location=612-818; Score=34.9; E_value=7.3e-10; Accession=PF00326.11; Description =Prolyl oligopeptidase family
  Pfam module annotation: Pfam domain module=Abhydrolase_3::Peptidase _S15::Peptidase_S9; Domain location=640-796::565-788::612-818
MLDESTVGVRYRVPPSVISDIVDAPPVPALSFSPLRDRIIFLKRRALPPLAEIARPEEKLAGIRIDGKCNTRSRMSFYTGIGIHQILPDGTLGSETEVSGFPVGAKINFVSWSPDGCHLSFSIRVNEEDNDSSKLTVWIADVKTGIARKLFQSPNVHLNAVFDNYVWVNNSSLLVCTIPSSRGAPPKKPLVPSCPKIQSNEERSIIQVRTFQDLLKDEYDEDLFDYYATSQLVLASLDGTTKEIGPPAVYTSMDPSPDHKYILINSLHRPYSFIVPCGRFPKKVELWSADGKLIRELCDLPLAEDIPIAFNSVRKGMRSINWRADKPSTLYWVETQDGGDAKVEISPRDIIYTQPAEPLEGEHPTILHKLDFRYGGVSWCDDSLALVYESWYKTRKIRTWVVSPGSEDVAPRILFDRSSEDVYSDPGSPMMRRTQAGTYIIARIKKESDEGRYIILNGNGATPEGNIPFLDLFDINTGKKMERIWESDKEKYYETVVALMSDQEEGDLYLDKLKILTSKESKTENTQYYFVSWPDKNIVQVTNFPHPYPQLASLQKEMIRYERKDGVQLTATLYLPPGYNPSTDGPLPCLVWSYPGEFKSKDAAGQVRGSPNEFAGIGSTSALLWLARRFAILSGPTIPIIGEGDEEANDRYVEQLVASAEAAVEEVIQRGVADPKKIAVGGHSYGAFMTANLLAHAPHLFCCGIARSGAYNRTLTPFGFQNEDRTLWEATNTYVEMSPFMSANKIKKPILLIHGEEDNNPGTLTMQSDRFFNALKGHGALCRLVILPHESHGYTAKESIMHVLWETDRWLHKYCVSNSSEAGEDHATDTVKEHVSKGTTNAESKVVAPSGGGSREVSDLEYEEFHSLPRSSL

SEQ ID NO: 131706 - protein, 66 aa, Glycine max
  Coding DNA Sequence Number=SeqID_14928
MGEEKKGLYGKISIKANLEGLKRPRHCWLAYAMTTALFHHNMCAFYFFVSKRFKASTMIYIRNDEK

SEQ ID NO: 131707 - protein, 261 aa, Glycine max
  Coding DNA Sequence Number=SeqID_14929
  Gene Ontology: Mol. function=oxidoreductase activity; Cellular component=integral to membrane; Biological process=electron transport
  Homolog annotation: Hit_ID=Q9SBI0; Match level="QueryCoverage=97%, HitCoverage=30%, E-value=6e-61, Identity=46%"; Hit description =Respiratory burst oxidase protein B
MSYFIGMQSSPEFANELLRALRRGKGWKSNITKTDLYHLWFRMKDNSFNSRMRIFFDMCNRNKDGRVTETDIKQTILLTASTNKLSVTHDEAEDYASLIMESLDKKNKGYIEISQMGSLFKATTSLSNSKAHFPMKKVPAAGSSTQNVQNTSGDFCEEREEPMSRTEVLFRTYWRRAWIVLVWLLACLGLFVWKFVQYRHRSGFEVMGYCLSTAKGAAETLKLNMALVLLPVCRNTITWLRKHRPINSVIPFNDNINFHKS

SEQ ID NO: 131708 - protein, 169 aa, Glycine max
  Coding DNA Sequence Number=SeqID_14930
  Gene Ontology: Mol. function=protein dimerization activity; Cellular component=nucleus; Biological process=regulation of transcription, DNA-dependent
  Homolog annotation: Hit_ID=Q0GPF1; Match level="QueryCoverage=75%, HitCoverage=85%, E-value=8e-62, Identity=94%"; Hit description=BZIP transcription factor bZIP41
  Pfam annotation: Domain name=bZIP_1; Domain location=27-89; Score =37.5; E_value=4.5e-08; Accession=PF00170.11; Description=bZIP transcription factor
  Pfam annotation: Domain name=bZIP_2; Domain location=25-79; Score =30.8; E_value=4.9e-06; Accession=PF07716.5; Description=Basic region leucine zipper
  Pfam module annotation: Pfam domain module=bZIP_1::bZIP_2; Domain location=27-89::25-79
MASPIQQQQRSTTTSSGSEGGDPHIIDERKRKRMLSNRESARRSRMRKQKQLEDLTDEVSRLQSANKKLAENIEAKEEACVETEAANSILRAQTMELADRLRFLNSILEIAEEVEGLSVEIPEIPDPLLKPWQIPHPIQPIMATANIIVWSSMHWVPERDECEVQGVDG

SEQ ID NO: 131709 - protein, 48 aa, Glycine max
  Coding DNA Sequence Number=SeqID_14931
MLPYIQGQLQGYRLREYTRKRKHQEALTSEGKMLQRANKKLEEGIKAN

SEQ ID NO: 131710 - protein, 407 aa, Glycine max
  Coding DNA Sequence Number=SeqID_14932
  Gene Ontology: Mol. function=DNA-dependent ATPase activity; Cellular component=nucleus; Biological process=DNA replication initiation
  Homolog annotation: Hit_ID=Q6UEJ2; Match level="QueryCoverage=94%, HitCoverage=59%, E-value=0.0, Identity=78%"; Hit description=Mini -chromosome maintenance 7
  Pfam annotation: Domain name=MCM; Domain location=268-407; Score =27.4; E_value=3.9e-19; Accession=PF00493.13; Description=MCM235 family
PNALSSALAKDFLSNFADANGEAKYMNILQDVANHKTRAVQIDLEDLFNYKDLDEEFLSRVTDNTRRYIGIFSNAIDELMPEPTEDFTDDDHDILMTQRSDEGVEGTDGSDPRQKMPPEIKRYYELYIKASSKGRPSTIREVKASNIGQLVRISGIVIRCSDVKPLMKVAVYTCEDCGFEIYQAKIQELAEHVPKGHIPRTMTVHLRGELTRKVAPGDVVEFSGIFLPIPYTGFRAMRAGLVADTYLEAMSVMHFKKKYEEYEFRGDEEEQIARLAEDGDIYNKLARSLAPEIFGHDDIKKALLLLLVGAPHRTLKDGMKIRGDLHICLMGDPGVAKSQLLKHIINVAPRGVYTTGRGSSGVGLTAAVQKDPVTNEMVLEGGALVMESSFLKYNNNNSFHPYCAYIC

SEQ ID NO: 131711 - protein, 143 aa, Glycine max
  Coding DNA Sequence Number=SeqID_14933
MASGNRLQRGNRSLVIDYQLCVIDYTVHIAGFHVLKMCNSSLVSEEPACTLQRTVEWILHTPTPYRLVEPVQVIEVTSSEEDPEEDPEELPPEPAVDALDFPEGDEDPLPEVDSPEDVMSASEADSTEESGPGGIATSGGSSS

SEQ ID NO: 131712 - protein, 514 aa, Glycine max
  Coding DNA Sequence Number=SeqID_14934
  Gene Ontology: Mol. function=transferase activity, transferring glycosyl groups; Cellular component=integral to membrane; Biological process=cell wall biogenesis
  Homolog annotation: Hit_ID=Q9M5Q1; Match level="QueryCoverage=92%, HitCoverage=84%, E-value=0.0, Identity=80%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=19-482; Score =949.9; E_value=1e-282; Accession=PF03254.4; Description=Xyloglucan fucosyltransferase
MPPCTNPRHSHPSCKSHKLYEVATYFFIVALLDLVNETSDSVELQQDKLLGGLLADGFDEKSCLSRYHFHKGLSEKPSSYLISRLRKYEAQHKQCGPYTDSYNKTVEQLRSGGQFTESSECKYVVWISFSGLGNRILTLASAFLYALLTNRVLLVDPGADMVDLFCEPFPDSSWLLPSDFPLNAQFNNFSQNSDHCYGKMLKSKAVTDSTVASFVYLHIAHDYDDHDKLFFCDEEQRFLQIVPWLIMKTDNYFVPSVFLMPSFEQELNDLFPNKETVFHFLSRYLFHPTNSVWGLVVRYYQAYLSKADERVGIQIRVFDTEPGPFQHVLDQILACTLKKNILPDVNHQQDATNSSGIPKSKAVLMTSLNSGYFEKVRDMYWEYPTVTGEVVGVYQPSHEGYQQTQKQMHNQKAWAEMYLLSLTDVLVTSSWSTFGYVAQGLGGLKPWILYKPENRTAPDPPCRRAMSMEPCFHAPPFYDCKAKRGTDTGELVPYVRHCEDMSWGLKLVDSDSYR

SEQ ID NO: 131713 - protein, 420 aa, Glycine max
  Coding DNA Sequence Number=SeqID_14935
  Homolog annotation: Hit_ID=Q2QN77; Match level="QueryCoverage=99%, HitCoverage=53%, E-value=5e-20, Identity=27%"; Hit description =Expressed protein
MDKLIELLKQTESLVQDLQQELEMKDSMRVKELHNENYDSQGTCDHSFCDKELNGFSPEKHTDNSPITDYKKSYDQKEEERSESMSKIEAELEAELERLGLNMNESSPERPLSELVELILEVGIAQPFISSTLAISVVNVKSQPQEMQCLTWDYGVLMSRKFLQLDPDFVADFAQGELQTDVIPGKDFVHSELNEDDSDTVVPVNYAVSPHELTLCLHEVIQSRLEGRVQELEIALENSQRKLRFMESEHESHPQKYFSSCGQASSLTKDDCEPITEPLVMSLFGDSPGAYIDTSYEEIIKIDDFEENSPSSIHISDYKVDSHSHDLHALGVQHCGANDLLTHSTDKEERLSRELSSGEVTMLEGLSSSNYELNDVTGDENCECDYEVERQLIRQIVERTKKGSPVFQNARRILYAMDED

SEQ ID NO: 131714 - protein, 56 aa, Glycine max
  Coding DNA Sequence Number=SeqID_14936
MPFRGLKSARKQTAFSGKRDELAKRALCAKGVHPYSLYPRAKPSFPELSAIGCGIR

SEQ ID NO: 131715 - protein, 137 aa, Glycine max
  Coding DNA Sequence Number=SeqID_14937
MKHKVSIPNYSTEQPIPKIAIAGGRMVTILTNYNKEIKGTQGQNRARKQGLHLTGNSGRFSRKLSQRSGKTKKNGEAQNQQRSGMAKKTRTVTVGQKNAGNVASKGWVFVRKENNGCHFIKECLQLTEKEGFSVLIQ

SEQ ID NO: 131716 - protein, 130 aa, Glycine max
  Coding DNA Sequence Number=SeqID_14938
  Gene Ontology: Mol. function=nucleic acid binding; Cellular component= mitochondrion; Biological process=translation
  Homolog annotation: Hit_ID=Q9FNR1; Match level="QueryCoverage=80%, HitCoverage=33%, E-value=4e-33, Identity=67%"; Hit description =Similarity to RNA binding protein
  Pfam annotation: Domain name=RRM_1; Domain location=44-116; Score =97.8; E_value=3.4e-26; Accession=PF00076.12; Description=RNA recognition motif. (a.k.a. RRM, R
  Subcellular localization annotation: CTP_CleavageSite=34; ConfidenceScore=5.53e-01
MAFFGRIGNLLRQTASRQVSSELRSSPSFFQAIRSMSSAPSTKLFIGGVSYSTDEQSLREAFSKYGEVVDARIIMDRETGRSRGFGFITYTSVEEASSAIQALDGQFSVGDDEVVMAISGYADPYLNPLF

SEQ ID NO: 131717 - protein, 456 aa, Glycine max
  Coding DNA Sequence Number=SeqID_14939
  Gene Ontology: Mol. function=hydrolase activity; Cellular component =integral to membrane; Biological process=intracellular signaling cascade
  Homolog annotation: Hit_ID=Q9SIK7; Match level="QueryCoverage=98%, HitCoverage=99%, E-value=1e-115, Identity=53%"; Hit description =Presenilin-like protein At2g29900
  Pfam annotation: Domain name=Presenilin; Domain location=8-447; Score= 149.3; E_value=1e-41; Accession=PF01080.8; Description=Presenilin
MAETQTQRPCSSVLDSLGEEIVRIIAPVSICMFLVVILVSTLNTDSSLFDASMSMVTIAYNETTSDSTWDKFLGALLNSLAFVILVTFATFVLVLLFYFRCTRFLKLYMAFSTFIVLLFLGGEVSIFLIQKFSTPIDCITFFLVLCNFAVVGVLTVFISKMAILVTQGYLVVVGILVAYSFTMLPEWTTWALLVAMALYDLAAVLLPIGPLRLLVELAISRDEEIPALVYEARPVNHGSLDPMEVTQRRLWRERRVQNLNANSVLAHGPDNVESHADSGASAGYNRDGADLVRENASLNSILNADSSGGSNGYGNLVSVEEGRVRVQETGSDLSAPLIDRGMNVQLGRGEDAASIENLMLEGIGLGSSGSIKLGLGDFIFYSVLVGRAAMYDYMTVYACYLAIIAGLGITLMLLAFYQKALPALPVSVAMGVLFYFLTRLLLEVFVVQCSLNLLLF

SEQ ID NO: 131718 - protein, 572 aa, Glycine max
  Coding DNA Sequence Number=SeqID_14940
  Gene Ontology: Mol. function=transporter activity; Cellular component= membrane; Biological process=oligopeptide transport
  Homolog annotation: Hit_ID=Q1S4B7; Match level="QueryCoverage=94%, HitCoverage=96%, E-value=0.0, Identity=64%"; Hit description=TGF -beta receptor, type I/II extracellular region; ABC transporter related
  Pfam annotation: Domain name=MFS_1; Domain location=56-488; Score =8.0; E_value=0.00014; Accession=PF07690.6; Description=Major Facilitator Superfamily
  Pfam annotation: Domain name=PTR2; Domain location=118-473; Score =207.9; E_value=2.3e-59; Accession=PF00854.12; Description=POT family
  Pfam module annotation: Pfam domain module=MFS_1::PTR2; Domain location=56-488::118-473
MDEVGRKESEYQIKGGGDNEDSMSMSVACGVINTVDWRGRPSNPNVHGGTRASAFVLGLQACEIMAIAAVGNNLITYVINEMHFSLSKSANVVTNFVGTIFLLALLGGYLSDSYLGSFWTILIFGFVELSGFILLSVQAHLPQLKPPPCNMFFDGEHCTEAKGFKALIFFLAIYLVALGSGCVKPNMIAHGADQFNQENPKQLKKLSTYFNAAYFAFSVGELVALTILVWVQTHSGMDAGFGVSAAVMTMGLISLICGTLYYRNKPPQGSIFIPVAQACIRVQQGTGSSSNDTKESPWILCSVAQVEQAKILLSVIPIFASTIVFNTILAQLQTFSVQQGSSMDTHLTKSFHVPPASLQSIPYILLIVVVPLYDSFFVPFARKITGHESGISPLQRIGFGLFLATFSMISAALVEKKRRDAAVNLNETISIFWITPQFLIFGLSEMFTAVGLIEFFYKQSLKGMQTFFTAITYCSYSFGFYLSSLLVSMVNNISSSSSTGGWLHDNDLNKDKLDFFYWLLAALSFLNFLNYLFWSRWYSYKPSQSQGDTNANESINLFGHSSKNYSGDDNIP

SEQ ID NO: 131719 - protein, 327 aa, Glycine max
  Coding DNA Sequence Number=SeqID_14941
METGVDNKKTGEHDFQQASQLKEEEQERTNNSNLDEAHPSSPSQSRKPSSALESSQSKPSASETIPTNVESQTPAESGEDDVPNSSMPKHEHGDVVVRANNQGAEIQNPPVQVMERSGESGASPRYVFPSHVFSNSNANSTVEWSTASTESLFSIYMGNMSFSNELICFKSGELDKPGDVCMHDQTNASPTHQPDAQAENKFNDISKRTYELQLLHEKSSKAAEAKAAETMREVIMESSQTTENVGKGDDKASNFHRQSNGSASSYAFQSSKGRDRSVSSKGAGEKQNQQKQPDEDEAPSAADQAPKSSTNAPNKWLNCFSCCICCN

SEQ ID NO: 131720 - protein, 69 aa, Glycine max
  Coding DNA Sequence Number=SeqID_14942
MSMYNATCIHLTDSMHHSQDNRPTTSNPLPPESESHTWNVAQQIPNFGTERVAFVRRYPSLGLWSYVAD

SEQ ID NO: 131721 - protein, 432 aa, Glycine max
  Coding DNA Sequence Number=SeqID_14943
  Gene Ontology: Mol. function=protein dimerization activity; Cellular component=nucleus; Biological process=regulation of transcription, DNA-dependent
  Homolog annotation: Hit_ID=Q1SKU0; Match level="QueryCoverage=99%, HitCoverage=81%, E-value=0.0, Identity=80%"; Hit description =Aldehyde dehydrogenase; AUX/IAA protein; Transcriptional factor B3; Auxin response factor
  Pfam annotation: Domain name=AUX_IAA; Domain location=185-400; Score=- 87.7; E_value=0.0034; Accession=PF02309.7; Description=AUXIAA family
  Pfam annotation: Domain name=Auxin_resp; Domain location=1-65; Score =104.4; E_value=3.3e-28; Accession=PF06507.4; Description=Auxin response factor
  Pfam module annotation: Pfam domain module=AUX_IAA::Auxin_resp; Domain location=185-400::1-65
TSRSEFIVSVNKYLEARSHKLSVGMRFKMRFEGDEVPERRFSGTIVGVGDNKSSVWADSEWRSLKVQWDEPSSILRPDRVSPWELEPLVSTPPTNPQPSQRNKRSRPPILPSTMPDSSLQGGSDIHNFSIKFCYSCCFYSNFLFLCASGVWKSPVESAPFSYCDHQHGRDVYPSTNFNSTATGFLGFGGNCYASNKSIYWSSRMENSTESFSPVALKEFGEKRQGTANGCRLFRIQLHDNSNSNEESLPMVTLSGRMGDDGPLPSLDAESDQHSEPSNVNRSDIPSVSCDAEKSCLRSPQESQSRQIRSCTKVHMQGMAVGRAVDLTRFDGYEDLLRKLEEMFDITGELCGSTKKWQVVYTDNEDDMMMVGDDPWLEFCSIVRKIFIYTAEEVRKLSPKIGLPISEEVKPSKMDSEAVANPEDQSSIVGPGC

SEQ ID NO: 131722 - protein, 140 aa, Glycine max
  Coding DNA Sequence Number=SeqID_14944
MEQHAILSTVFVILVETIALFGYSDDYETSREQGNLRLSETDSNSMMEDRAVFVIGVVNKGNTLEGQDLGRWIEKQENRETHCEYTMNSSFDRNRDDNSRSHEEGSDVDWDRMTENEETQESGTEIIGIEETKISEWRCF

SEQ ID NO: 131723 - protein, 583 aa, Glycine max
  Coding DNA Sequence Number=SeqID_14945
  Gene Ontology: Mol. function=nucleic acid binding; Cellular component= nucleus; Biological process=DNA replication
  Homolog annotation: Hit_ID=Q9SD82; Match level="QueryCoverage=98%, HitCoverage=98%, E-value=0.0, Identity=60%"; Hit description =Replication factor A-like protein
  Pfam annotation: Domain name=Rep-A_N; Domain location=5-105; Score =109.6; E_value=9.4e-30; Accession=PF04057.3; Description=Replication factor-A protein 1, N-terminal domain
  Pfam annotation: Domain name=Rep_fac-A_C; Domain location=428-574; Score=203.0; E_value=6.9e-58; Accession=PF08646.1; Description =Replication factor-A C terminal domain
  Pfam module annotation: Pfam domain module=Rep-A_N::Rep_fac-A_C; Domain location=5-105::428-574
MAAKTVTPDAVSTLLANPSPDSTSDLPDIVVQVLDLKATGNKYMFTANDGKTKLKAMIPSDMRSQVLSGAIQNLGLIRVLDYTVNDIPNKSDKYLLAIKCEAVSPALEMEIKSEESGSGILLKPKVEGGVKTEGAAAGILLKPKQEVVTKSANQILREQHGNSAPAARMAMTRRVRPLVSLNPYQGNWTIKVSVTSKGNMRTYKNARGDGCVFNVELTDEDGNFEVANKQFKTVQNDYEMTLNENSEVEEVVGEASFVPETKFNFVQIDQLGPHVNKSELVDVIGVVKNVSSTMSIRRKSDNESIPKRDITIADDTKKTVVVSLWNELATTTGEELLDIVDKSPVVAIKSLKVGDFQGRSVVLVNPDIPEAKNLRSWYDFEGKDAAMDSVGSGSSPISNNGIRSVYTDRIHLSDIISNPSLGDGKPAFFSLRGHITFIKPDQAMWYRACKTCNKKVTESFGSGYWCDGCQKSDEQCSLRYIMVGKVSDGSAETFISVFNQEAEKIVGCSADDLDNLKLQEGEDNPYQMTLKEATWAQHLFRVSVTPNEYNGEKRQRITVRAVVPVDFAAESRFILEELSKMRA

SEQ ID NO: 131724 - protein, 477 aa, Glycine max
  Coding DNA Sequence Number=SeqID_14946
  Gene Ontology: Mol. function=nucleic acid binding; Cellular component= intracellular; Biological process=RNA processing
  Homolog annotation: Hit_ID=Q6ZCC0; Match level="QueryCoverage=93%, HitCoverage=43%, E-value=6e-88, Identity=42%"; Hit description =Putative RNA recognition motif (RRM)-containing protein
MVRQFSPTGISKARDLFESALTAAGLHVAEGSKIWEAYKKYEQDILLTFDDTDEQAKEKQVQRIRSLFHRQLSVPLAGMSSTITAYKTWEMEQGSLQDVESIDLVDIYPHVAASYQKALEMYNARFHLEEQILSPNISDSERLQHYMNYLKFEQSSGMPARIQVLYERAITDFPITPDLWLDCTRNLDNTLKVGNIVSNVYSRATKNCPWVGELWVRYMLSLERGHASEKDLSEREKDGFADYVPKVYCFRIDTVKNSFTVDAKSSYNTVSFLWNSLFGHLVFWMNIEFVPTIFNCPCVFMLEVVLLEMIFEKSLLCTFSTLDEYLDLFLTRVDGLRRRMASSSEEDLEYKIIRETFQRASDYLSPYLKNTEGLLHLHAYWARLETKLGKDITAARGVWENCLKLCGSMLESWTGYIAMEVELGHINEARSIYKRCYSKRFSGTGSECSAVTQERRHEAMNGMGETNKKERQKRNRV

SEQ ID NO: 131725 - protein, 220 aa, Glycine max
  Coding DNA Sequence Number=SeqID_14947
  Gene Ontology: Mol. function=DNA binding; Cellular component=nucleus; Biological process=regulation of transcription, DNA-dependent
  Homolog annotation: Hit_ID=Q1SKT9; Match level="QueryCoverage=90%, HitCoverage=55%, E-value=3e-92, Identity=82%"; Hit description =Transcriptional factor B3; Polynucleotidyl transferase, Ribonuclease H fold
  Pfam annotation: Domain name=B3; Domain location=148-218; Score=17.9; E_value=0.00069; Accession=PF02362.12; Description=B3 DNA binding domain
MASAAPGATNDALYKELWHACAGPLVTLPREGERVYYFPQGHMEQMLPRFTLQFYLENICSFLTCLAFWWEMSLFMLEASMNQGLEQQMPSFNLPSKILCKVVNVHLRAEPETDEVYAQITLLPEADQSEVTSPDDPLPESPRCTVHSFCKTLTASDTSTHGGFSVLRRHADDCLPPLDMTQQPPWQELVATDLHGNEWHFRHIFRECDHWIFLQIEYAK

SEQ ID NO: 131726 - protein, 154 aa, Glycine max
  Coding DNA Sequence Number=SeqID_14948
  Gene Ontology: Mol. function=nucleic acid binding; Cellular component= intracellular; Biological process=transport
  Homolog annotation: Hit_ID=Q9SFV5; Match level="QueryCoverage=62%, HitCoverage=10%, E-value=5e-15, Identity=38%"; Hit description =Putative RNA-binding protein
  Pfam annotation: Domain name=DUF1675; Domain location=21-132; Score= -27.4; E_value=1.6e-05; Accession=PF07897.2; Description=Protein of unknown function (DUF1675)
MTVSSLERKHYKGAGSNFQTPPKKENDSMLSSVAIQEMTPWPSDTMIERPAKKPKHVNSYQESEATDIVRQMPCVITTGGGTTGKRTEGLLYKYKRGQVCIVCVCHGSFLSPTEFVMHAGGKEVADPMKHITVCSDLVYINGDGAGLSPGPWKP

SEQ ID NO: 131727 - protein, 176 aa, Glycine max
  Coding DNA Sequence Number=SeqID_14949
  Gene Ontology: Mol. function=glycerophosphodiester phosphodiesterase activity; Cellular component=periplasmic space; Biological process =glycerol metabolic process
  Homolog annotation: Hit_ID=Q6AUZ6; Match level="QueryCoverage=85%, HitCoverage=38%, E-value=6e-53, Identity=70%"; Hit description =Putative phosphodiesterase family
  Pfam annotation: Domain name=GDPD; Domain location=49-173; Score= -53.4; E_value=0.05; Accession=PF03009.8; Description=Glycerophosphory l diester phosphodiesterase family
MASLPSFTPFVFLLLVIGCNARPLYPLPSKGDDGNRKPLQTFRPYNIAHRGSNGELPEETHPAYLRAIEEGADFIETDILSSKDGVLVCFHDVTLDNTTDIANRTEFANRKRTYEVQGENMTGFFTVDFTLKELKSLRVKQRCSFRDQQFNDFDKNDINTENKMELKEEISSTRKN

SEQ ID NO: 131728 - protein, 298 aa, Glycine max
  Coding DNA Sequence Number=SeqID_14950
  Gene Ontology: Mol. function=RNA-directed DNA polymerase activity; Cellular component=chromatin; Biological process=chromatin assembly or disassembly
MEERLGNVEATVAEIRQLLLEQNERPRRRQGRPLGRGDPRNNDDDGSDSSTLSHGSRFRPRRHGGGNERRYFGGRRKLEIPVFKGDDAYGWLVRVERYFRLNEVREHDKVDAVMIAMEDRALNWFQWWEDQTPLRSWEEFKEAVIRRFQPGILHNPLGPLLSLKQDSTVMEYREKFEMLVAPLRREERGMLDSIFLNGLKEELQAEMKLYDYHDLADMMDRALLLEEKNEALRRRGITGRDRTEWKDKGGGSKFRNPGDFGKDRREILKVSGVSEKVEGKGVEGVRGRRLNPAELEER

SEQ ID NO: 131729 - protein, 481 aa, Glycine max
  Coding DNA Sequence Number=SeqID_14951
  Gene Ontology: Mol. function=nucleic acid binding; Cellular component= intracellular; Biological process=transport
  Homolog annotation: Hit_ID=Q9FME2; Match level="QueryCoverage=96%, HitCoverage=91%, E-value=1e-105, Identity=48%"; Hit description =Similarity to RNA-binding protein
  Pfam annotation: Domain name=NTF2; Domain location=17-133; Score =172.3; E_value=1.2e-48; Accession=PF02136.11; Description=Nuclear transport factor 2 (NTF2) domain
  Pfam annotation: Domain name=RRM_1; Domain location=306-373; Score =37.9; E_value=3.4e-08; Accession=PF00076.12; Description=RNA recognition motif. (a.k.a. RRM, R
  Pfam module annotation: Pfam domain module=NTF2::RRM_1; Domain location=17-133::306-373
MAMPETIPPTTPSAQVVGNAFVEQYYHILHQSPELVHRFYQDSSFLTRSDSNGVMTTVTTVQEIHEKIISLKYEDYTAEIKTADAQESHKGGVIVLVTGCLTGKDNVRRKFSQTFFLAPQEKGYYVLNDVFRFIEENDTPQLNSSTVSVINENAEAVHEPESEDLHALKHLVEDTATLAEGENLNNGAEVYHPQDEEEGSVIDEEVAEPPTDLSQNDIVTVDDSTSAVPDDAPRRSYAAIVMKSHVASGHVYVPSRAARIAYAKSSEQLPTTANAKSTPAPEALAPSSDNASGSSDVHEEAEGHSIYIRNLPFNATVEQLEEVFKKFGPIKHGGIQVRSSKHGFCFGFVEFEELSSMHSALEWYRLALACSNVACNSQGSASDWSSSGAGMFRNRASPITVGERQAVVEEKRTTTRVSGSGRGRYSGRGGFRSDSFRARGKFGSGRGYSRNEFRNQGEFSGQPRSSQRPNQNGGGRGGGRQ

SEQ ID NO: 131730 - protein, 149 aa, Glycine max
  Coding DNA Sequence Number=SeqID_14952
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q85UU0; Match level="QueryCoverage=94%, HitCoverage=54%, E-value=5e-49, Identity=53%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=49-149; Score=-30.9; E_value=1.3e-10; Accession=PF00346.9; Description =Respiratory-chain NADH dehydrogenase,
MFTEAITVNGPEQLGNIQVPKRASYIRVIMLELSRIASHLLWLGPFMADIGAQTPFFYIFRERELIYDLFEAATGPMLRASGIQWDLRKVDNYECYEEFDWEVQWRKEGDSLARYLVRIGEMMESIKIIPQALEGIPGGPYEKFRNSLL

SEQ ID NO: 131731 - protein, 78 aa, Glycine max
  Coding DNA Sequence Number=SeqID_14953
  Homolog annotation: Hit_ID=Q5JLN0; Match level="QueryCoverage=88%, HitCoverage=25%, E-value=7e-14, Identity=37%"; Hit description =Lysine ketoglutarate reductase trans-splicing related 1-like
MAPVFSKKSWQCVWHLIQNDLIHAWGLDRQLGYCAQVQAPSDSPGDNRAKVFGKRWKDAAEKDKCWIDPYEQANKTSH

SEQ ID NO: 131732 - protein, 215 aa, Glycine max
  Coding DNA Sequence Number=SeqID_14954
  Homolog annotation: Hit_ID=Q5JLN0; Match level="QueryCoverage=74%, HitCoverage=32%, E-value=6e-17, Identity=35%"; Hit description =Lysine ketoglutarate reductase trans-splicing related 1-like
  Pfam annotation: Domain name=DUF707; Domain location=36-215; Score= -95.1; E_value=0.013; Accession=PF05212.3; Description=Protein of unknown function (DUF707)
MMVSVSCRMVFVHLSIGSEAVPEGIIARISNLEMQPLWDSGKDNGIRGVRLSQLRVARRKLALEGRALEYLGVRTSCHLGSLSILKRPLNLLAMTVGLKQKEIVDKIVEKSSAWSSCVVLVSAINQTKWWFVKRFLHPDIVAEYIYVFLWDEDLLVLVDNIDTKRTGSLAIVHRSRCNQTPQEIIELKFSVKGGKMQQGDKCWIDSHEQANKTSH

SEQ ID NO: 131733 - protein, 789 aa, Glycine max
  Coding DNA Sequence Number=SeqID_14955
  Gene Ontology: Mol. function=binding; Cellular component =mitochondrion; Biological process=embryonic development ending in seed dormancy
  Homolog annotation: Hit_ID=Q1SRX0; Match level="QueryCoverage=87%, HitCoverage=92%, E-value=0.0, Identity=53%"; Hit description =Tetratricopeptide-like helical
  Pfam annotation: Domain name=Cytadhesin_P30; Domain location=414-693; Score=-149.0; E_value=0.05; Accession=PF07271.2; Description =Cytadhesin P30P32
  Pfam annotation: Domain name=PPR; Domain location=151-185; Score =11.5; E_value=0.32; Accession=PF01535.11; Description=PPR repeat
  Pfam annotation: Domain name=PPR; Domain location=187-221; Score =27.2; E_value=6e-05; Accession=PF01535.11; Description=PPR repeat
  Pfam annotation: Domain name=PPR; Domain location=222-256; Score =32.0; E_value=2.1e-06; Accession=PF01535.11; Description=PPR repeat
  Pfam annotation: Domain name=PPR; Domain location=292-326; Score =23.3; E_value=0.00089; Accession=PF01535.11; Description=PPR repeat
  Pfam annotation: Domain name=PPR; Domain location=332-366; Score=9.2; E_value=0.6; Accession=PF01535.11; Description=PPR repeat
  Pfam annotation: Domain name=PPR; Domain location=371-405; Score =23.1; E_value=0.00098; Accession=PF01535.11; Description=PPR repeat
  Pfam annotation: Domain name=PPR; Domain location=406-440; Score =19.6; E_value=0.011; Accession=PF01535.11; Description=PPR repeat
  Pfam annotation: Domain name=PPR; Domain location=441-475; Score=5.8; E_value=1.5; Accession=PF01535.11; Description=PPR repeat
  Pfam annotation: Domain name=PPR; Domain location=476-510; Score =21.2; E_value=0.0038; Accession=PF01535.11; Description=PPR repeat
  Pfam module annotation: Pfam domain module=Cytadhesin_P30::PPR::PPR::P PR::PPR::PPR::PPR::PPR::PPR::PPR; Domain location=414-693::151 -185::187-221::222-256::292-326::332-366::371-405::406-440::441 -475::476-510
MMLKCDDESVGNGNTTQSSLLGLAEQDVSLPAASPARGRSPPHVLSDPNPFLRLLIRRRSRGRAAATEAASAHRASPERDSTSAAAGPSARPERPSTPGLDLGVGGASAEPPQPRAVPDPRRRPGGGVRHRPALGVLSDTADRSNIVPNIVSYNNVINTHCDQGRVDVALEVYRHVVANAPFSPSPVTYRHLTKGLIHSERISEALDLLREMLSKGHGADSLVYNNLISGFLHLDNFDKAIELFDELKERCLVYDGVVNATFMEWFFSKGRDKDAMDSYRSLLDRQFRMTPATCNVLLEALLNHSKTSEAWSLFDNMLDNHTPPNFQAVNSDSFNIMVNHCFKLGNFELALSTFKKVGSKPNSKPFAMDVAGYNNIIARFCENAMLSQAETLFEELCSKSLSPDVPTHRTLIEVYLRMDRIDDALRIFHRMVDSGLRVVATFGNTVFHELIKNGKAIDCAQILSKMGEKDPKPDPTCYEVVIKGLCADGLLDKSRELLDEVMRYGVGVTSSLREFVTEVFKKAGRGDEIERLLDMNRFAYTPRPSPPRPAYCPPLVRSPSQMAAGAAHSPPSGFPTRMAAQQHPTPPPQMTGARYPPSQMAGAAHNPPSGAPHQVFEHQRPPLPSQMTGMHQPSWGLSPPMTGPHPGSSPNTGQPYHPNASEHHPHVSRVAPQMTAQHYTPSGPSPQMAGHQPYGTPRGPQQWAERQYPPSGLSPPMAGQHHPLAGPTPPMSGWSIPSNGASAKMSPPYHISAGPSSQVTGPYHPSSSTPPHFEESHQQQSEVPEQVAA

SEQ ID NO: 131734 - protein, 78 aa, Glycine max
  Coding DNA Sequence Number=SeqID_14956
  Gene Ontology: Mol. function=structural constituent of ribosome; Cellular component=ribonucleoprotein complex; Biological process =translation
  Homolog annotation: Hit_ID=P49690; Match level="QueryCoverage=98%, HitCoverage=56%, E-value=1e-25, Identity=75%"; Hit description=60S ribosomal protein L23
  Pfam annotation: Domain name=Ribosomal_L14; Domain location=1-78; Score=-3.2; E_value=9.4e-05; Accession=PF00238.10; Description =Ribosomal protein L14pL23e
MATVKKGKPDLRKVLPVVIVLQHRPWHRKDGVLHAFRRLCWVTVNPKGEMKGSTITGPIGKECANLWPRIARVANAIV

SEQ ID NO: 131735 - protein, 135 aa, Glycine max
  Coding DNA Sequence Number=SeqID_14957
  Gene Ontology: Mol. function=3'-5'-exoribonuclease activity; Biological process=RNA processing
  Homolog annotation: Hit_ID=Q6K293; Match level="QueryCoverage=62%, HitCoverage=48%, E-value=1e-15, Identity=45%"; Hit description =Putative exosome component 4
MDSNFEMSQDAGWPRVKIKERGREIVNSNPPIDIFNKINKLTGSFKLHSQFRILIDIYVLVLQADGGTGSACINAATLALADSLIAPLCLMDSKLPIDILENVMQLAIEGCKAITNYIREILLENTKQLEHRRGV

SEQ ID NO: 131736 - protein, 202 aa, Glycine max
  Coding DNA Sequence Number=SeqID_14958
  Gene Ontology: Mol. function=metal ion binding; Cellular component =integral to membrane; Biological process=ubiquitin cycle
  Homolog annotation: Hit_ID=Q8LBA0; Match level="QueryCoverage=78%, HitCoverage=71%, E-value=9e-51, Identity=58%"; Hit description=RING -H2 finger protein ATL1Q
  Pfam annotation: Domain name=zf-C3HC4; Domain location=150-191; Score= 22.9; E_value=0.00068; Accession=PF00097.15; Description=Zinc finger, C3HC4 type (RING finger)
MVGVLVVGVGAIVYKAGALTGAIAGALAAKATKSGLLRGVSLGAIAGSILSVEVLEASRAYWCMEQTGSRGASSMADFIEELVRGRLVEESLTPAILTAYNLQVGIANTGYDEIHDVHGLVAPRGLSGDSLKRLPHHMISKDMKADNTCCAICLQDIEVGEIARSLPRCHHTFHLICVDKWLVKNDSCPVCRQNVQLVPWAI

SEQ ID NO: 131737 - protein, 547 aa, Glycine max
  Coding DNA Sequence Number=SeqID_14959
  Gene Ontology: Mol. function=exonuclease activity; Cellular component= intracellular
  Homolog annotation: Hit_ID=Q9FLJ5; Match level="QueryCoverage=99%, HitCoverage=98%, E-value=1e-134, Identity=50%"; Hit description =Exonuclease-like protein
  Pfam annotation: Domain name=Exonuc_X-T; Domain location=8-172; Score= 89.6; E_value=9.6e-24; Accession=PF00929.14; Description=Exonuclease
MGEERSEIVFFDVETSVPTRAGQGFALLEFGAILVCPRTLTELRDYSTLVRPANLSVITPLSERCNGINAAAVSAAPTFADIAHLVYDLLHGRIWAGHNIIRFDCVRIRDAFAEINQPPPEPKGTIDSLVLLTQKFGRRAGDMKMATLATYFGLGRQTHRSLDDVRMNLEVLKYCATVLFLESSLPDIFTANSWVSPNATTRSRSNGKSPSQWGLLNINKDSVLSSPATESKDKNRPIISFALSSPKGNVSNIADPNMDQSDPFNLSTLEAEIKRESIKSDVALEEKPMQESTDLASSSSVSQPCSSSIAVLEPDGICIPSIDASLVPSFRGSQRIELLHEGFLFQLHCTDLKVRFGINSKFFDSAGRPRLSFVVDPSPSLCNVLDACDRVAQKLTVDSGSSSDWRPVVIRKEGFFNYPTVRLQVNLGAVVRSLPFDLVSWVQILETTSLLAGERLCTSTSPRSHLVVVGIPTAVVADIAIYATEIYQRESSGTVQRLLFSKFDAAELGSLFMPGTFVDAVFSLDPYDYQQNAGIKLVAKKLIIHSK

SEQ ID NO: 131738 - protein, 575 aa, Glycine max
  Coding DNA Sequence Number=SeqID_14960
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=90%, HitCoverage=92%, E-value=0.0, Identity=67%"; Hit description=Timing of CAB expression 1 protein
  Pfam annotation: Domain name=CCT; Domain location=501-539; Score =70.6; E_value=5e-18; Accession=PF06203.4; Description=CCT motif
  Pfam annotation: Domain name=Response_reg; Domain location=37-153; Score=51.3; E_value=3.3e-12; Accession=PF00072.14; Description =Response regulator receiver domain
  Pfam module annotation: Pfam domain module=CCT::Response_reg; Domain location=501-539::37-153
MDAETETEELINLNDKSSNFGGNNSKSGDGFIDRSKVRILLCDNDSKSSEEVFALLLGCSYQVTSVRSARQVIDALNAEGQYIDIILAEVDLPIKKGMKLLKYIARDKELCRIPVIMMSAQDEVSIVVKCLRLGAADYLVKPLRTNELLNLWTHMWRRRRMLGLVENNILTYDFDLVASDPSDANTNSTTLFSDDTDDKSKRSTNPETGVSIQQEQEASIATIAAVVVELPNALLSEYQPDVPGISDRRTVAATPRQHPSSSRTNDGHFLSGPKKSELKIGESSAFFTYVKATTLKRNVEESAHVDNTTTTEVRVEDMNQACTEQGGNDLKTHENEEMFENHSQDDLPSSNSIPDSFSIERSCTPPASTEVSQQKHYKEEHSQGVVHPRNGSHGSGPAQHAYPYYISGVVNHVMMPSSAQLYQKNIQDLQSHAGSSMIAQYNHLPQCPPHANGMTSFPYYPMSICLQPGQISTNSWPSLGSSSSCEVKISKVDRREAALVKFRQKRKERCFDKKIRYVNRKRLAERRPRVRGQFVRKLNGINVDLNGQPASTDYDEDDEEEEDNHGARDSSPEDA

SEQ ID NO: 131739 - protein, 118 aa, Glycine max
  Coding DNA Sequence Number=SeqID_14961
MVHKTTLDKERNPQGPWILPVSMVPNPNWENLVEVAGKIHGAKVVGDATGDLKERGDEFAGGRGDRRWDDKNGEGGAVREIHGEERGGDDDGGELGELRHGGEEADEVVNVWRGGFRE

SEQ ID NO: 131740 - protein, 246 aa, Glycine max
  Coding DNA Sequence Number=SeqID_14962
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=7e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDKVALRGLHVLSFKGLHALAFKGLHVLTIRGLHVPTFRGLHILNFKGLHIHDFTGLHVVTFRGLQALTFKGLHVLTFRGLHVVTFRGLHVPTFRGLHILNFKGGIHALAFRGLHILGIKGSRTLTFRGMHAVAVRRLHVLVFRGLLALPFKGLHILAIRGLHALTLRGLHVVAIRGSRTLTFRGLHVLAFRGLHVLAFRGLHVLAFKGPHVVAFRGLHASPLEDYTTSPLEGYTSSPSEGYTPSP

SEQ ID NO: 131741 - protein, 248 aa, Glycine max
  Coding DNA Sequence Number=SeqID_14963
  Gene Ontology: Cellular component=integral to membrane
  Homolog annotation: Hit_ID=Q1SGC5; Match level="QueryCoverage=92%, HitCoverage=87%, E-value=2e-80, Identity=64%"; Hit description =CD9/CD37/CD63 antigen
  Pfam annotation: Domain name=Tetraspannin; Domain location=6-160; Score=-41.3; E_value=0.0052; Accession=PF00335.10; Description =Tetraspanin family
MACRGCWECLLKLFNFILTLTGLAIVGYGIYLFVEFSKASDDDNTPAISPVSDDSALIQLGRPVLMAVSLSNDFFDNLPRACEINNMKLLEWLVNRMWTCGYEIIGASEELGCAAFIFFDKNWKEEIPTDKTGDFDAIYGFLIENWNIVKWVALGIVIFEALLFLLALIVRAANRPADYDSDEEFINPRQQVRQPLLNRPAASPATGLPVAGTMDQRPSRNDAWSTRMREKPCRYQTFSPYKHRFLAI

SEQ ID NO: 131742 - protein, 166 aa, Glycine max
  Coding DNA Sequence Number=SeqID_14964
  Pfam annotation: Domain name=DUF623; Domain location=103-163; Score =43.1; E_value=9.5e-10; Accession=PF04844.4; Description=Protein of unknown function, DUF623
MELIILAFIFTFLFIFIMVALLRFAIVHFHISTFRLPFVHTDIEWPQPTPIADSIDYVANSTNSIVDSTNTVVDAFSTTSSPPMFEPRIIAVGERISAWEQCSNNPYEDFRQSIQELIEVYPELANSNNMNMLFFQYLEYNPESMHPYIVRAFTDFFFDLTLQGVV

SEQ ID NO: 131743 - protein, 82 aa, Glycine max
  Coding DNA Sequence Number=SeqID_14965
MVIVVVVSLVVNGDTSEYMESNKHEASIKAINEEQQSLSRWRKRHGGGGEFLKSSNGSTKQWRCDTNQTPVKEEDNASRKEE

SEQ ID NO: 131744 - protein, 96 aa, Glycine max
  Coding DNA Sequence Number=SeqID_14966
MKLKDQMKNTVFYELTSLPKIIQRFTKNPRGITLLHRIGIGLIIHIVIMVIASLTERIIKRDILGFYTHVEEEAMHQRRSARTKQLPKHWDIYQLG

SEQ ID NO: 131745 - protein, 511 aa, Glycine max
  Coding DNA Sequence Number=SeqID_14967
  Gene Ontology: Mol. function=DNA binding; Cellular component=nucleus
  Homolog annotation: Hit_ID=Q4SLH4; Match level="QueryCoverage=21%, HitCoverage=4%, E-value=3e-11, Identity=33%"; Hit description =Chromosome 7 SCAF14557, whole genome shotgun sequence
  Pfam annotation: Domain name=Myb_DNA-binding; Domain location=433 -478; Score=32.3; E_value=1.7e-06; Accession=PF00249.21; Description =Myb-like DNA-binding domain
  Subcellular localization annotation: CTP_CleavageSite=56; ConfidenceScore=5.39e-01
LGGSPGPVSPKNHQLKSPLSSHRKASISLNRLRSSIAELLHSDKPVSVDSNPEGFTAMTKLQIWKNVISQVLEQTETEICSLENELEPLQFESGDGMPCYNTKSCDKEIGDYHKVTHRPELSQIGPSNDDNNIEKMMPLSANLHGMHDTTKENDINSPGTTTPKFVEAQPLIKMVSSLGGGSSFSSLMGIEDGMKDHTSTSFYSSIHDDTLPNTIISSNREIAQSACVVFKKFLHNKTGKIISNVGVNSSSLSHIDAFIKDKLAEKNRFARFKEKALTIKYKALDHLWKRDMCLRYPRKCTRTSPRSLKLRLKVVTNCCQKKLSSIHYHCFPFHPVGFYKFAMMCIPIIHVVAGYALIPLLVLAGDQLSLVPTSEMINYTSQLLSKPQDEVNRKILKMPALILDQKDKMFSMFNSSNELVEDPLAVERERAMINCWTSEERKIFSEKFSAFGKDFRRIASFIDHKTTADCVEFYYKDHKPNCLEKDKKKKNKKKGCNSQKSKTLKTIVKGL

SEQ ID NO: 131746 - protein, 286 aa, Glycine max
  Coding DNA Sequence Number=SeqID_14968
MLWDQKGVFKDKKQKRYGSLARQKHSSSHYGFLKFKNLDSTRFQHVGPKTPGCGGGGSGAMHQFPKEPGQGSCSGYGITFRSPRDPRHKFWEITNDASLLLSSKRSIDNVLSTPSHACSMNNGEKPYSRAQCHDNKKKNYERESSSSKRLIDDMLSTPSHACSINTRQKLNSSEQCHDNNKKNYEREDSLGWKPLNKGNNTFERFYSQSNRKGRDKNKNILETGVKNVIEETRKRPRLNWGEGLAKFEKKEIEGDGVSVATAATLASGAFNSFTGILLDSINYSLL

SEQ ID NO: 131747 - protein, 107 aa, Glycine max
  Coding DNA Sequence Number=SeqID_14969
  Subcellular localization annotation: CTP_CleavageSite=44; ConfidenceScore=5.07e-01
ENVELQVKLFQLHESAQPGVSLRHHRRSTRRVERSALAAWNMVRMTKESSVAARARESMFLKQGYESGRATTTGFSLNVASVFILIMIMPPPNLQRRSFSTDVESAM

SEQ ID NO: 131748 - protein, 43 aa, Glycine max
  Coding DNA Sequence Number=SeqID_14970
MQKLIKERIENKVVNFVGLNKVKWWLDRNIEMAITQATGLQMR

SEQ ID NO: 131749 - protein, 222 aa, Glycine max
  Coding DNA Sequence Number=SeqID_14971
VGDTLCVKTQTTDNDVCELGGSPGPVSPKNHQLKSPLSSHRKASISLNRLRSSIAELLHSDKPVSVDSNPEGFTAMTKLHIWKNVISQVLEQTETKICSLENELEPLQFEFGDGMPCYNTKSCDKEIGDYHKVTHRPELSQIGPSNDDNNIEKMMPLSANLHGMHDTTKENDINSPGTTTPKFVEAQPLIKMVSSLGGGSSFSSLMGIEDGMKAHTSISFYS

SEQ ID NO: 131750 - protein, 286 aa, Glycine max
  Coding DNA Sequence Number=SeqID_14972
MLWDQKGVFKDKKQKRYGSPARQKHSSSHYGFLKFKNLESTRFQHVGPKTPGGGGGGSGAMHQFPKEPGQGSCSGYGITFRSPRDPRHKFWEITNDASLLLSSKRSIDNVLSTPSHACSMNNGEKPYSRAQCHDNKKENYERESSSSKRLIDDMLSTPSHACSINTRQKLNSSEQCHDNNNKNYEREDSLGWKPLNKGNNTFERFYSQSNRKGRDKNKNILETGVKNVIEETRKRPRLNWGEGLAKFDKKKIEGDGVSVATAATPASGAFNSFTGILLDSINYSLL

SEQ ID NO: 131751 - protein, 179 aa, Glycine max
  Coding DNA Sequence Number=SeqID_14973
MASRKCKSIGSRPTAQYDTRRFSSLDAWTRYTDNVQGRNILPERKVEIYHSELDEFKAELERRNFHKRLTNLVDGSIDLALVKEFYANLYSYEDHPPKQSRVRGHLVKIDADSLNTFWETPVVAYRLQRDRGCLMHTWPRVHLELRGPFWEDSQEGYDYTSSGVECPLILQVGPHITYF

SEQ ID NO: 131752 - protein, 921 aa, Glycine max
  Coding DNA Sequence Number=SeqID_14974
  Gene Ontology: Cellular component=cytosol
  Homolog annotation: Hit_ID=Q10JI7; Match level="QueryCoverage=88%, HitCoverage=74%, E-value=8e-43, Identity=25%"; Hit description =Expressed protein
AIGLSKERNSPRHFQLSSQFINGKQTPVDLRESLRVLAKLREAPRHYVEAKELPRLSYEVKDGHWHSISKDAPRFSYDGRETSGTTFESHDTFKCPSKLKELPRHSLDSGEGSWHARGSDSKPSNFSRNFNTGGASTSVDNVSSQQQRSASQNRPPSVVAKLMGLEALPESYKASDTKSSLSETGSTQGNDQFLKNGLIKPLRVYNSPKISLKDTTSPRWKNPDLAVKPTLSSRFPIELAPWKQQDGNQTSEKLTSRAIKATERSPDSFLSVYSEIEKRLKDLEFKQSGRDLRALKRILEAMQVKGLLETRKEEQASNVGNKRDYELNPSLIQNSMSVKQQTARGTDSVKAIEPPIVIMKPGKLIEKSGISASSVFPIGEISDSHKLQSGGVHAHDKKGTASNQIATDQSRKNNHWDGSTSFNEKKANSIKTIKSAQSQPRSKQLPKENSPSSVKNSGSVSPRMQQKNLESEKQSRLPTPPSDSNNPRRQSCKQTTESGSPSRKLRPKVANSWYSDDRLSETSNELRSLSSQWDEISLQSDSITVDSKMDIEVTSSLQSDDTIDSQFRSMKANEHLVSGSTHKKSTLRWDEDESIAEPATDASDHPSLDSVDDVSVYKYDMPSPVKSKSNAPKADNGQEYKANDNTDHWNPADGFFVNNTINRKKFQSVDCLIQKLRQLNSSHDETRIDYIASLCENTNPDHRYIAEILLASGLLLRALSSELLTFQHHSSGHPINPELFLVLEQTKLSSLLSKDESSFGKVAYMRLNTEKWHRKLIFDAVNEILGEKLGSFVEPCLKPNGLATKFVSAQKLLKELCFEVQKLQYVKPDCSLEDEGDGLKSMLREDVMCHSENWTGFPGELPGVVLDVERLIFKDLIDEFVIDEMASLRVKFSKHSTLKSSFWTRVPSLSLASVRPPTSLP

SEQ ID NO: 131753 - protein, 391 aa, Glycine max
  Coding DNA Sequence Number=SeqID_14975
  Gene Ontology: Biological process=regulation of transcription
  Homolog annotation: Hit_ID=Q9FME3; Match level="QueryCoverage=94%, HitCoverage=96%, E-value=3e-38, Identity=30%"; Hit description =Arabidopsis thaliana genomic DNA, chromosome 5, P1 clone:MSL3
  Pfam annotation: Domain name=TCP; Domain location=44-254; Score =116.7; E_value=6.8e-32; Accession=PF03634.4; Description=TCP family transcription factor
MMIESSGKVHEAKNQQEGDDDNNIKIEKLLKARPSTSSSSRSWSAFRNPRIVRVSRSLGSKDRHSKVCTIRGLRDRRIRLSVPTAIQLYNLQDKLGFNQPSKVVDWLLEATKSDIDKLPPLQFPHCFAHQFHQQTLLPGTSQFSLGGFYDAANNNSTFIKDGGNQNRLTATKSTRYWDIDSLNNGKELAESVSISQKGQFWIKTNEQENHQGGGIGGSSTTTHNREDNSSVHYKLFPIGTTTNNSYLPGLLNNGMTHNSYHHSEPSRLSLSHFGSHGLFPSHDSHQSSGIGVPFSSSNFSGASSGPQLLFCPTSATPSAFYSVESDPRQSNNNVQIFSSSSQVMKRLPLIQSLHSTNSPISRRLPTSFSSKLLDSDNNDRSQPNKGTSSRS

SEQ ID NO: 131754 - protein, 329 aa, Glycine max
  Coding DNA Sequence Number=SeqID_14976
  Gene Ontology: Mol. function=two-component response regulator activity; Cellular component=nucleus; Biological process=two -component signal transduction system (phosphorelay)
  Homolog annotation: Hit_ID=Q1SGC3; Match level="QueryCoverage=99%, HitCoverage=57%, E-value=1e-133, Identity=75%"; Hit description =Response regulator, RegA/PrrA/ActR type
  Pfam annotation: Domain name=Response_reg; Domain location=18-141; Score=-3.7; E_value=0.0067; Accession=PF00072.14; Description =Response regulator receiver domain
MVCTANDLQEWKDFPKGLRVLLLEGDSSSAAEIREQLEAVDYNDGLSSKPQNFCTVSTFYDENEALSALSSSPEGFHVAIVEVSTSCSLGGFKFLENSKDLPTIMTSKDQCLNTMMKCIALGAVEFLSKPLSEDKLKNIWQHVVHKAFNAGANVLSESLKPVKESVESMLQLQTENGQDKSRISIDLENVSRFSDIDHEQSAVCDKYPAPSTPQLKQGTRLLDDGDCHDQTNCSTEKESVEHDGECKSVETLCENLNAESSPQPREPDKTLIKEEEDFANGSRGESAVSLSPNNKKFLSNADGNTSPNRTGVLNDSCEIKANRKKMKVS

SEQ ID NO: 131755 - protein, 257 aa, Glycine max
  Coding DNA Sequence Number=SeqID_14977
  Homolog annotation: Hit_ID=Q9LS27; Match level="QueryCoverage=65%, HitCoverage=34%, E-value=1e-33, Identity=45%"; Hit description =Arabidopsis thaliana genomic DNA, chromosome 5, BAC clone:F10E10
MKEFKCPDQLAEHYKSYACCIRQWISQHILVVLPICAMLVGCTALFWSVRQKLCMSRRIEELYNKVCEILEENALTSKSANGECEPWVVSSRLRDHLLLPRERKNPLLWKKVASKALVLIFLLLNLPVENSHSIVEDVNKDFLMAYPCNSTELVEKMVQEDSRIDRYPKLVKGESKVVWEWQVEGSLSFSKMKRRDASKTRVNESTDLNHQHRPAMRTAAEGNMCGIGCKCDLHFFTKTSVRFMGPACLLRNVLIEL

SEQ ID NO: 131756 - protein, 89 aa, Glycine max
  Coding DNA Sequence Number=SeqID_14978
MAAKLLHSLADDNTDLQKQIGCMTGVSQLFDRHHIIPPRHVTQKRLPPGNSHFNHDNMERGSNSIPQRQSAAFKISWIMEVLLPDQNLG

SEQ ID NO: 131757 - protein, 49 aa, Glycine max
  Coding DNA Sequence Number=SeqID_14979
MDVTGDNDDSDGRQQRLLLLETKEGECIFLVDACIYTPVAVRLAPIEKW

SEQ ID NO: 131758 - protein, 158 aa, Glycine max
  Coding DNA Sequence Number=SeqID_14980
  Gene Ontology: Mol. function=RNA-directed DNA polymerase activity; Cellular component=exocyst; Biological process=RNA-dependent DNA replication
  Homolog annotation: Hit_ID=Q1S4N5; Match level="QueryCoverage=68%, HitCoverage=21%, E-value=3e-31, Identity=60%"; Hit description =Peptidase M, neutral zinc metallopeptidases, zinc-binding site
MSHPDYESLVTSTWNNSGGDAVFKLDVWELVAKAFHSGVIHDYLTETLIVPIPKVDDPKTLRDFRPISLCNVLLKHILKILVRRMRSFLDDFIGPLQGSFIPNRGTTDNDMIAQELVHFMHKKEGKAEFLMFKVWHSYPPAVSTFLLADAMGIKHIRI

SEQ ID NO: 131759 - protein, 73 aa, Glycine max
  Coding DNA Sequence Number=SeqID_14981
  Gene Ontology: Mol. function=structural constituent of ribosome; Cellular component=cytosolic ribosome (sensu Eukaryota); Biological process=translation
  Homolog annotation: Hit_ID=Q9MAP3; Match level="QueryCoverage=87%, HitCoverage=29%, E-value=8e-24, Identity=81%"; Hit description=50S ribosomal protein L11, chloroplast precursor
  Pfam annotation: Domain name=Ribosomal_L11; Domain location=2-60; Score=83.5; E_value=6.4e-22; Accession=PF00298.9; Description =Ribosomal protein L11, RNA binding domain
MQETWVEKGSKDPKAEMVGKVTIDQLRTIAAEKLPDLNCSSIESAMRIIAGTAANMGIVVDPPVLEPKQKEFV

SEQ ID NO: 131760 - protein, 140 aa, Glycine max
  Coding DNA Sequence Number=SeqID_14982
  Gene Ontology: Mol. function=translation initiation factor activity; Cellular component=chloroplast; Biological process=translational initiation
  Homolog annotation: Hit_ID=Q94KR7; Match level="QueryCoverage=61%, HitCoverage=81%, E-value=4e-21, Identity=54%"; Hit description =Translation initiation factor IF-1, chloroplast precursor
MVVSKVVDSGIRKEGDLEPVNDASFGGVVAGDLDLDSIAGEDPNVVLADFAGDDPLLLAGLVALRGGCGGDGARSRKKRRRDEEGEGVTEGWEGERGELGAGREVGDDDGNMSLCCGMKTKLSGLNDLVGRKMNGVYGGI

SEQ ID NO: 131761 - protein, 426 aa, Glycine max
  Coding DNA Sequence Number=SeqID_14983
  Gene Ontology: Mol. function=protein binding; Cellular component =membrane; Biological process=meiotic recombination
  Homolog annotation: Hit_ID=Q94D04; Match level="QueryCoverage=70%, HitCoverage=49%, E-value=9e-37, Identity=31%"; Hit description =Putative p40
  Pfam annotation: Domain name=Kelch_1; Domain location=126-177; Score =34.2; E_value=4.5e-07; Accession=PF01344.15; Description=Kelch motif
  Pfam annotation: Domain name=Kelch_1; Domain location=182-228; Score =37.1; E_value=6.2e-08; Accession=PF01344.15; Description=Kelch motif
  Pfam annotation: Domain name=Kelch_1; Domain location=233-279; Score =38.9; E_value=1.7e-08; Accession=PF01344.15; Description=Kelch motif
  Pfam annotation: Domain name=Kelch_1; Domain location=25-71; Score =18.8; E_value=0.019; Accession=PF01344.15; Description=Kelch motif
  Pfam annotation: Domain name=Kelch_1; Domain location=76-121; Score =29.3; E_value=1.4e-05; Accession=PF01344.15; Description=Kelch motif
  Pfam annotation: Domain name=Kelch_2; Domain location=126-177; Score =41.8; E_value=2.4e-09; Accession=PF07646.5; Description=Kelch motif
  Pfam annotation: Domain name=Kelch_2; Domain location=182-228; Score =37.3; E_value=5.4e-08; Accession=PF07646.5; Description=Kelch motif
  Pfam annotation: Domain name=Kelch_2; Domain location=233-279; Score =20.6; E_value=0.0058; Accession=PF07646.5; Description=Kelch motif
  Pfam annotation: Domain name=Kelch_2; Domain location=25-71; Score =18.4; E_value=0.026; Accession=PF07646.5; Description=Kelch motif
  Pfam annotation: Domain name=Kelch_2; Domain location=76-121; Score =18.5; E_value=0.025; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=126-177::182-228::233-279::25-71::76-121::126 -177::182-228::233-279::25-71::76-121
MRWEKVEVKAIGTTTKGGGGPGKRWGHTCNAVKSGRLVYVFGGYGKDNCQTNQVHVFDTVKQAWSQPALKGSPPTPRDSHTCTAVGDNLFVFGGTDGMNPLKDLHILDTSLQTWVSPTIRGEGPPAREGHSAAVVGKRLYIFGGCGKSADNNNELYYNDLYILNTETFVWKCATTSGTPPSPRDSHSCSSWKNKIIVIGGEDGHDYYLSDIHILDTDTLIWRELSTSGQLLPPRAGHSTVSFGKNLFVFGGFTDAQNLYNDLYMLDIDTGVWTNVTTATNGPSARFSVAGDCLDPFRSGVLIFIGGCNKSLEALDDMYYLYTGIARESEQRPEKLSLKKQLKLKCLEQNPNPSQNQVLVRYGVGSDVGQIMTVLNYSQSSLALATSMCQILDMECSYGKSVMTKIMIPLKVLILIIYEPGGQKQLK

SEQ ID NO: 131762 - protein, 124 aa, Glycine max
  Coding DNA Sequence Number=SeqID_14984
MKAGMILHYITSQLMTSCAQPYKGLKIAMKSKTLIKPSGHSNKKARNCYSTDSTHNAREKLPRTPRKIVIMAEIEVVSNKIMKTGPATDLEASGRDPEERIEGEVTRDHWLGEKGAKFGGKGAA

SEQ ID NO: 131763 - protein, 275 aa, Glycine max
  Coding DNA Sequence Number=SeqID_14985
  Gene Ontology: Mol. function=intramolecular transferase activity, phosphotransferases; Cellular component=cellular_component; Biological process=carbohydrate metabolic process
  Homolog annotation: Hit_ID=Q1SGB6; Match level="QueryCoverage=99%, HitCoverage=59%, E-value=1e-110, Identity=66%"; Hit description =Phosphoglucosamine mutase
MKGVTSIVGAVATDMGILTTPQLHWMVRARNKGMKASEQDYFEQLSSSFRCLVDLIPAEKCKFDGEGVCDMCKFGEVGGLIESWINADRLVYFTVPPESSGRIDLVDGDKILSLFALFIREQLSFLNEKEDMKNCHQVNLGVVQTAYANGASTNYLKLLRLEVNFTPTGVKYLHEKATEFDIGIYFEANGHGTVLFSESFIESLEARTNEISLGSKGSEGEKAALRLLAVSKLINQAVGDALSGLLLVEVILQHMGWSINKWNELYHDLPSKQLK

SEQ ID NO: 131764 - protein, 660 aa, Glycine max
  Coding DNA Sequence Number=SeqID_14986
  Gene Ontology: Mol. function=ATPase activity, coupled to transmembrane movement of substances; Cellular component=integral to membrane; Biological process=transport
  Homolog annotation: Hit_ID=Q8LKU6; Match level="QueryCoverage=98%, HitCoverage=95%, E-value=0.0, Identity=66%"; Hit description =Putative ABC-transporter-like protein
  Pfam annotation: Domain name=ABC_membrane; Domain location=60-339; Score=212.0; E_value=1.3e-60; Accession=PF00664.13; Description=ABC transporter transmembrane region
  Pfam annotation: Domain name=ABC_tran; Domain location=413-625; Score= 165.1; E_value=1.8e-46; Accession=PF00005.17; Description=ABC transporter
  Pfam module annotation: Pfam domain module=ABC_membrane::ABC_tran; Domain location=60-339::413-625
MNGLRSQRAPLLEAEGAGRGKRDGAAEGQVSDLEHGDAVPAENVGFCRVLSLAKPEAGKLMIGTVALLIAATSSILVQKFGGKIIDIVSREMQTPEEKDEALNAVKNTILEIFLIVVFGSICTALRAWLFYTASERVVARLRKNLFSHLVNQEIAFFDVTRTGELLSRLSEDTQIIKNAATTNLSEALRNFSTALIGLSFMFATSWKLTLLALAVVPVLSVAVRKFGRYLRELSHKTQAAAAVASSIAEESFGAIRTVRSFAQEDYETTRYSEKVNETLNLGLKQAKVVGLFSGGLNAASTLSVIIVVIYGANLTIKGYMSSGDLTSFILYSLSVGSSISGLSGLYTVVMKAAGASRRVFQLLDRTSSMPKSGDKCPLGDQDGEVELDDVWFAYPSRPSHPVLKGITLKLHPGSKVALVGPSGGGKFIIPQCFVFNVLGLKRNRKSTIANLIERFYDPTKGKILLNGVPLVEISHKHLHRKISIVSQEPTLFNCSIEENIAYGFDGKVNDVDIENAAVILSVFILQWDTSLPSPNSFAHNWYTFVGERGVRLSGGQKQRIAIARALLMDPKILLLDEATSALDAESEYLVQDAMESLMKGRTVLVIAHRLSTVKTADTVAVISDGQVVERGNHEELLNKNGVYTALVKRQLQTTKTEISV

SEQ ID NO: 131765 - protein, 327 aa, Glycine max
  Coding DNA Sequence Number=SeqID_14987
  Gene Ontology: Mol. function=protein serine/threonine kinase activity; Cellular component=intracellular; Biological process =protein amino acid phosphorylation
  Homolog annotation: Hit_ID=Q9FLJ6; Match level="QueryCoverage=99%, HitCoverage=74%, E-value=1e-113, Identity=56%"; Hit description =Arabidopsis thaliana genomic DNA, chromosome 5, P1 clone:MFB13
  Pfam annotation: Domain name=PPR; Domain location=132-166; Score =33.8; E_value=5.9e-07; Accession=PF01535.11; Description=PPR repeat
  Pfam annotation: Domain name=PPR; Domain location=167-201; Score =17.0; E_value=0.068; Accession=PF01535.11; Description=PPR repeat
  Pfam annotation: Domain name=PPR; Domain location=18-52; Score=10.4; E_value=0.43; Accession=PF01535.11; Description=PPR repeat
  Pfam annotation: Domain name=PPR; Domain location=202-236; Score=5.9; E_value=1.5; Accession=PF01535.11; Description=PPR repeat
  Pfam annotation: Domain name=PPR; Domain location=237-271; Score =11.0; E_value=0.37; Accession=PF01535.11; Description=PPR repeat
  Pfam module annotation: Pfam domain module=PPR::PPR::PPR::PPR::PPR; Domain location=132-166::167-201::18-52::202-236::237-271
MDILMGDLKKEGRVMDAETFGPVAENLVKLGKEDEALGIFKNLDKYKCPIDEFTVTAIVNALCSKGHAKRAGGVVLHHKDKITGTKPCIYRSILYGWCLCERNLRHNPSGLVSEALNVIMEMRSYNVFPTSISYNILLSCLGKTRRVKESRHILETMKNSGCDPDWLSYYLVAKVLFLSGRFGKGKEMVDQMIGKGLVPNPKFYYSLIGILCGIERVNYALELFEKMKKSSMGGYGPVYDVLIPKLCRGGDFEKGRELWDEATDMGITLLCSEDVLDPSKTEVYKPTRPEKSSLVDSSRVKSPEKVTKFSGKMKMRKRTVAMKKKKN

SEQ ID NO: 131766 - protein, 529 aa, Glycine max
  Coding DNA Sequence Number=SeqID_14988
  Gene Ontology: Mol. function=oxidoreductase activity; Cellular component=membrane; Biological process=electron transport
  Homolog annotation: Hit_ID=Q9C9D1; Match level="QueryCoverage=94%, HitCoverage=95%, E-value=0.0, Identity=64%"; Hit description =Putative cytochrome P-450; 4810-6511
  Pfam annotation: Domain name=p450; Domain location=53-517; Score =272.5; E_value=8.6e-79; Accession=PF00067.12; Description=Cytochrome P450
MSSSELSSFFLLPLSAILSFDALLGVMFLVAVFGYWLVPGGLAWALSKFKPAIPGPCGYPVVGLVWAFIGPLTHRVLAKLAETFDAKPLMAFSVGFTRFIISSHPDTAKEILNSSAFADRPVKESAYELLFHRAMGFAPYGEYWRNLRRISATHMFSPKRIAAQGVFRARVGAQMVREIVGLMGKNDVVEVRKVLHFGSLNNVMKSVFGRSYVFGEGGDGCELEELVSEGYDLLGLFNWSDHFPLLGWLDFQGVRKRCRSLVDRVNVFVGKIIMEHRVKRDAESEDNKARDIDNSGGDFVDVLLDLEKEDRLNHSDMVAVLWEMIFRGTDTVAILLEWILARMVLHPEIQAKAQCEIDSVVGSGCSVTDDDLPNLPYVRAIVKETLRMHPPGPLLSWARLSIHETQIGNHFVPAGTTAMVNLWAITHDQQVWSEPEQFKPERFLKDEDVPIMGSDLRLAPFGAGRRVCPGKAMGLATVELWLAVFLQKFKWMPCDDSGVDLSECLKLSMEMKHSLITKAVARPTSSLAM

SEQ ID NO: 131767 - protein, 86 aa, Glycine max
  Coding DNA Sequence Number=SeqID_14989
MKSWMVELGFSLPSSYEMVQPPKPPNDGGSISTTKLLFKDKVLGDGNFVVSLDVEANREKVINEEPWMFSASESKVGKDFGMDMIS

SEQ ID NO: 131768 - protein, 77 aa, Glycine max
  Coding DNA Sequence Number=SeqID_14990
  Gene Ontology: Mol. function=GPI anchor binding; Cellular component =anchored to membrane
  Homolog annotation: Hit_ID=Q94KT8; Match level="QueryCoverage=74%, HitCoverage=12%, E-value=9e-12, Identity=53%"; Hit description =Protein COBRA precursor
MLSLWFPTAGSVVPRGDFFAILLLPLLLCTTFTSTEAHDALDPTGNITIKWDVISWTPDGYILELHVPASYVSRLSR

SEQ ID NO: 131769 - protein, 121 aa, Glycine max
  Coding DNA Sequence Number=SeqID_14991
ENIELQVKLFQLHESAQPGSRVVTELKLLLLRRVSLRHHRRSTRRVERSALAAWNMVRMTKESSVAARARESMFLKQGYESGRATTTGFSLNVASVFILIMIMPPPNLQRRSFSTDVESAM

SEQ ID NO: 131770 - protein, 380 aa, Glycine max
  Coding DNA Sequence Number=SeqID_14992
  Homolog annotation: Hit_ID=Q1SZU4; Match level="QueryCoverage=39%, HitCoverage=22%, E-value=7e-27, Identity=41%"; Hit description =Protein kinase PKN/PRK1, effector
EVENSRDEEQKSKKAMESLASALHEVSAEATETKENLLHIQPESESYDAQIEDLKLVLKATNEKYNSMLDEAEWEQREVQLVSCIKKNEEEKESLEKEIKILLYLLKETEEEQNAKREEKAQLKEKMKEVEAKAIQLQEALKETTTDNMKLIQCSYQGMVVVASRATRLPIYSSFAKEGNYSDIFAKGEAFSTLFNVIGIGVGSQLASTICVSTQEKNLSPTLFLALCSSLLLLLRFFFAIVSTGSSACLYGLATLPSRGSSKELVCRHYRGLFGVLTLHSVWGAHSCSQGIIFSEESLSHLICWSLCFVFVGFFTSERPRRVYRVHVWGCGCVCPIEPGTASNLVSNSYEICCFSSLNVVALLRPAKETKDLSTLHQDK

SEQ ID NO: 131771 - protein, 67 aa, Glycine max
  Coding DNA Sequence Number=SeqID_14993
  Subcellular localization annotation: CTP_CleavageSite=30; ConfidenceScore=5.55e-01
MKDSMTSQLQFSPTKSSAQQSIQKYQGNVSSSARTSIKSYLSICKITYSKSSKETDDVANKPRTSIS

SEQ ID NO: 131772 - protein, 78 aa, Glycine max
  Coding DNA Sequence Number=SeqID_14994
MRGNLMVTRTFRQPGANEPVGARTLILSSAPFVVVTCDMRGYLVVTRTFHQPGQNEPVDERRLTSSFAPFVVLNCEVK

SEQ ID NO: 131773 - protein, 265 aa, Glycine max
  Coding DNA Sequence Number=SeqID_14995
  Gene Ontology: Mol. function=transcription regulator activity; Cellular component=nucleus; Biological process=regulation of transcription
  Homolog annotation: Hit_ID=Q9LSL1; Match level="QueryCoverage=100%, HitCoverage=75%, E-value=2e-22, Identity=33%"; Hit description =Arabidopsis thaliana genomic DNA, chromosome 5, TAC clone:K21L13
  Pfam annotation: Domain name=HLH; Domain location=165-230; Score =32.9; E_value=1.1e-06; Accession=PF00010.16; Description=Helix-loop -helix DNA-binding domain
MELQDHDFLEELMSLRRETWDTNPCSQENQLFSNGWSFDCFEDQNYHQAFPPNSFSCQQVPQSYNNKGYNYNEIYSSLLHEFSAPQVIDSSSYNTLDTSPFLAQEDYPLSMMEEEDPGFLGEELHCLDLQTTCKMEPSHSTEMPIFNTTSSFVERKNRAKKLQGQPSKNLMAERRRRKRLNDRLSMLRSIVPKISKSIGLKYLNVKPHRTTMMDRTAILGDTIGYMKELLEKINNLKQEIEVDSNMAGIFKDVKPNEIIVRNSPK

SEQ ID NO: 131774 - protein, 288 aa, Glycine max
  Coding DNA Sequence Number=SeqID_14996
MSDSRFQGSMLTSSFICPEMLPSGVTCSEKYGMSDFWRPIKAEHGTGFRNLSSMAATNGHPPSRSLFPSYNGNQFPFLHENSATSTTGSIFCESNSPYPSALGAQNSGLRPLFQDTVGNENFNVFDTSSTVQGLSGISDSCCALSLLSSQSQNSSSQSSGIPLAHSLVIPSSHSHNYNMSQVSEKIGISSQTSSSRVSDSFPSELNHADGSHLSPVLISDNNCIVNFDMADGIFQASDYLNVKDHLSGEDGATIDLLQLSSQLQRVEHERQSLQVKQENDSSCTLRIT

SEQ ID NO: 131775 - protein, 42 aa, Glycine max
  Coding DNA Sequence Number=SeqID_14997
  Homolog annotation: Hit_ID=Q94KT8; Match level="QueryCoverage=83%, HitCoverage=7%, E-value=5e-09, Identity=72%"; Hit description =Protein COBRA precursor
MEPCDDAGMLWGVKLYNDLLTSAGPLGNVQSEVIFRKDKSFI

SEQ ID NO: 131776 - protein, 249 aa, Glycine max
  Coding DNA Sequence Number=SeqID_14998
  Homolog annotation: Hit_ID=Q94JW8; Match level="QueryCoverage=28%, HitCoverage=17%, E-value=1e-22, Identity=71%"; Hit description =Squamosa promoter-binding-like protein 6
  Pfam annotation: Domain name=SBP; Domain location=171-236; Score =80.2; E_value=6.4e-21; Accession=PF03110.5; Description=SBP domain
MESWSYVPEEKECVSNEALSPPNTLGRSKNSFLGWELKTPCGFSNDMLGLGHHSIENQGFEELGFPEMLGKHMSDDLIGSVPTRKVNGNRQQQHSDRITGTVVDAPSGFSQRGDSNSKLSNSNSLIDLKLGRFADHGDFTDRAFSKVLSSSESSTPPKRVRASGLHSQTAYCQVYGCNKDLSSCKDYHKRHKVCEVHSKTAIVIVNGIEQRFCQQCSRLVNLSSSFNSKLLNMYYYGLSSVPIDWNTRT

SEQ ID NO: 131777 - protein, 58 aa, Glycine max
  Coding DNA Sequence Number=SeqID_14999
MALIGTPVSYTIFGEKDMTNEVASILCRNLESQDSCDISHAPRLQEGKNITGTEHKQT

SEQ ID NO: 131778 - protein, 73 aa, Glycine max
  Coding DNA Sequence Number=SeqID_15000
MSRKPKRIRNGSRFEKKDSEVVYAWGRFWFYGKLCEVKQVGDVAWSARNAKKDFEFVVNFARSSKSKTQHDIR

SEQ ID NO: 131779 - protein, 36 aa, Glycine max
  Coding DNA Sequence Number=SeqID_15001
  Gene Ontology: Mol. function=RNA-directed DNA polymerase activity; Biological process=RNA-dependent DNA replication
MAVEDMEKTTFITLWGTFCYKIMSFGLKNEQHINGP

SEQ ID NO: 131780 - protein, 55 aa, Glycine max
  Coding DNA Sequence Number=SeqID_15002
MADPDGDNDSERSIPPNRDIHLGVLFIRILRLRLKIIVSSYMKLRMEMEHLDFRL

SEQ ID NO: 131781 - protein, 295 aa, Glycine max
  Coding DNA Sequence Number=SeqID_15003
  Gene Ontology: Mol. function=RNA-directed DNA polymerase activity; Biological process=RNA-dependent DNA replication
MSDIEQVQEQMKADMKAMKEHMTMMMEAIMSTRKMMEVNIAATVAVGIATEKDPTHPPSFNQESCLVSDVGGGRPPTIVEKENFDHIKKRLRAIEGGGNYDFVDMLELCLVSNVVVPMKFKVLEFDKYKVITFLKNHLEMHSLSGLSWNDLMDAFIKQYQYNSDMTPDRMQLQNMCKRDNESCKEYTQRLRDLTAQVVPPMMKRKMMTMIMDTLSVFYYEKMVGYMHLSFADLVFVGERIEIGLRKEMFDYVASTNSGNRKPVTSGGKKKEGETHDMTAVPTWTNFPLAPYNPLY

SEQ ID NO: 131782 - protein, 112 aa, Glycine max
  Coding DNA Sequence Number=SeqID_15004
  Gene Ontology: Mol. function=sequence-specific DNA binding; Cellular component=nucleus; Biological process=regulation of transcription, DNA-dependent
  Homolog annotation: Hit_ID=Q7Y040; Match level="QueryCoverage=86%, HitCoverage=39%, E-value=7e-27, Identity=70%"; Hit description=MADS -box protein 1
  Pfam annotation: Domain name=SRF-TF; Domain location=9-59; Score =122.2; E_value=1.5e-33; Accession=PF00319.9; Description=SRF-type transcription factor (DNA-binding and dimerisation domain)
MGRGRVELKRIENKINRQVTFAKRRNGLLKKAYELSVLCDAEVALIIFSNRGKLYEFSSTSRDKALTVQTRIYCSDLVSEMGCFDTKTCFTLHYNLRIAQTQRGRETVSFSF

SEQ ID NO: 131783 - protein, 117 aa, Glycine max
  Coding DNA Sequence Number=SeqID_15005
MESDNIVKTYDILMKDTSNMTEDQCKKHKITWAERVGEERKRKKRKEEEKGQRGWVGKEREKTRKMKERKKEEEKQKGQKSHEMTQNFDFDRTWQQIVDEALEDNTNEEIIKAGHDC

SEQ ID NO: 131784 - protein, 140 aa, Glycine max
  Coding DNA Sequence Number=SeqID_15006
MVDSDLPPSPNDFLFPPIDHENLQIASQTPPSPPSPQPFDSRLRGWISISFHILRSKLSSLMQRGPIWSIGLPSAALLMSCWIFISIRKKITLTPNEARLVNIIKDKDRKIAKLLHQIAQMNEILIDRHKALVAKAAAAE

SEQ ID NO: 131785 - protein, 33 aa, Glycine max
  Coding DNA Sequence Number=SeqID_15007
MHALLGSFNSGNWSDSKVLDSMGLSCCAITRDR

SEQ ID NO: 131786 - protein, 55 aa, Glycine max
  Coding DNA Sequence Number=SeqID_15008
  Gene Ontology: Mol. function=sequence-specific DNA binding; Cellular component=nucleus; Biological process=regulation of transcription, DNA-dependent
  Homolog annotation: Hit_ID=Q9ZRA5; Match level="QueryCoverage=95%, HitCoverage=18%, E-value=1e-09, Identity=85%"; Hit description=MADS -box protein 2
  Pfam annotation: Domain name=K-box; Domain location=1-55; Score= -16.4; E_value=0.01; Accession=PF01486.8; Description=K-box region
MKSSRLGWRYYREIKGLLLCFRNFMGEDLDSLNLRGLQSLEQQLDSALKHIRSRK

SEQ ID NO: 131787 - protein, 165 aa, Glycine max
  Coding DNA Sequence Number=SeqID_15009
  Homolog annotation: Hit_ID=Q8TGM5; Match level="QueryCoverage=23%, HitCoverage=58%, E-value=8e-08, Identity=74%"; Hit description =Uncharacterized protein ART3
MGPELTGSHVIWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCSVDFSQRRGQRTAHVAAIRTLHRTIQSVGATGGVYKGQGRSQRELMTRAY

SEQ ID NO: 131788 - protein, 71 aa, Glycine max
  Coding DNA Sequence Number=SeqID_15010
  Homolog annotation: Hit_ID=Q1T1Y0; Match level="QueryCoverage=65%, HitCoverage=10%, E-value=1e-07, Identity=59%"; Hit description =Ankyrin
  Pfam annotation: Domain name=DUF1723; Domain location=1-44; Score =37.7; E_value=3.9e-08; Accession=PF08330.1; Description=Protein of unknown function (DUF1723)
MSAFVERWHKETSSFHLPVGGVTITLDDVALLLHLPNVGAFYFKIKHQESNPRIKIQEKKSRSNKSRLHIG

SEQ ID NO: 131789 - protein, 84 aa, Glycine max
  Coding DNA Sequence Number=SeqID_15011
MGETHEVPHHNLADFDPCLKYSTEGQTVGGVLLVPPAVVERKKLDHLEEKLRAVEGGRDYAFANLEELFLVPNVVILPNFKVPN

SEQ ID NO: 131790 - protein, 114 aa, Glycine max
  Coding DNA Sequence Number=SeqID_15012
  Gene Ontology: Mol. function=sequence-specific DNA binding; Cellular component=nucleus; Biological process=regulation of transcription, DNA-dependent
  Homolog annotation: Hit_ID=Q3KSZ1; Match level="QueryCoverage=99%, HitCoverage=42%, E-value=3e-12, Identity=38%"; Hit description=MADS -box transcription factor
MNESISELQKKDRTLREHNNLLSKKFVQFGFQKSYRTQQHGLSEKQIKEKEKELTPQEQEGLQNNMDVSSVLVTQPLESLTIGGSPEVKSNEETPTSCRPKTILPPLMPLPTNE

SEQ ID NO: 131791 - protein, 212 aa, Glycine max
  Coding DNA Sequence Number=SeqID_15013
  Homolog annotation: Hit_ID=Q9FJG8; Match level="QueryCoverage=74%, HitCoverage=77%, E-value=1e-08, Identity=23%"; Hit description =Arabidopsis thaliana genomic DNA, chromosome 5, P1 clone:MAE1
MAFDRKNEKSFDSISNNNLSRPSKKFHSKKRHSNNPIIKDKDGGGVPIGNKFDYSSWSLSADEDYIVFCFGKDVAKGDKGVNEVHKNSRPVNCKLKYGENEEQVSDLNIHEKISNANQHHDDDIRRAESSNSDQSEGSRSSFAFPVLGWEWIGSPVQMPKSEEFVIRTQLHQQRMKKTQVKRPTYLHDFVWISSEETVKTEASAKSSPNRLA

SEQ ID NO: 131792 - protein, 116 aa, Glycine max
  Coding DNA Sequence Number=SeqID_15014
  Subcellular localization annotation: CTP_CleavageSite=40; ConfidenceScore=5.22e-01
MATPRVQACCASSSSASTTKLAETTGNKIMVVVDSSFEAKGALEWGALSLTLFRARTMLFLFMWPDPPGKVRRTESGSKFNVKSMCEMKRAGVLVNVVMLEGAIVQEAKNKFNFYD

SEQ ID NO: 131793 - protein, 105 aa, Glycine max
  Coding DNA Sequence Number=SeqID_15015
  Homolog annotation: Hit_ID=Q1S594; Match level="QueryCoverage=37%, HitCoverage=11%, E-value=1e-11, Identity=82%"; Hit description =Oxidoreductase family, NAD-binding Rossmann fold, putative
MDMLTPASFLVESGRAVTEIASLYPFAHKEAPMQYHAKSPSTVQFTFSSYWKHARTIIIIAERNIVRTRYFDKNPSPLNEKAHDIAISALGSICEFHRESIDGSR

SEQ ID NO: 131794 - protein, 56 aa, Glycine max
  Coding DNA Sequence Number=SeqID_15016
MNDEHTDWESIWIVKVFFRQLGIRSERNARTFTGRAMLLEFIWDSIFSLSFLAIFC

SEQ ID NO: 131795 - protein, 35 aa, Glycine max
  Coding DNA Sequence Number=SeqID_15017
MEGEPWCSASATNGAKLAKDPLGHSTVAPPFNNNA

SEQ ID NO: 131796 - protein, 353 aa, Glycine max
  Coding DNA Sequence Number=SeqID_15018
  Homolog annotation: Hit_ID=Q1XIT2; Match level="QueryCoverage=31%, HitCoverage=21%, E-value=3e-43, Identity=78%"; Hit description =Lycopene epsilon cyclase
  Pfam annotation: Domain name=Lycopene_cycl; Domain location=1-164; Score=-181.0; E_value=0.0043; Accession=PF05834.3; Description =Lycopene cyclase protein
MPMSRTKVFFEETCLASKDAMPFDLLKKKMFSRLNTMGIRIKKTYEEEWSYIPVGGSLPNTEQKNLAFGATASMFLSTGYSVVRSLSEAPKYVSVIASILKDNHAKDIITQKRRKENLSMQDFSFGLFSGGLSNPRLVAVSNSISFANPKAPVYPRLALGRSWDEVIASDSKPARYIRTLHCSLSSILSLTGPGPITVTIPEARVANAYKSAAHWIPWTMPKLRMWMLEAFSVGELGVRASVIQGLISTNGLGIPQLDPVQFRRGRDTPTGLLREAARGSAEEAATEEEKGRKMRRLRSNKGKGKSFVQEEGVMMRESIQSSESQSEKRKGFKVILEGIFDTRLTIGISNSWS

SEQ ID NO: 131797 - protein, 177 aa, Glycine max
  Coding DNA Sequence Number=SeqID_15019
  Homolog annotation: Hit_ID=Q8S556; Match level="QueryCoverage=59%, HitCoverage=22%, E-value=1e-08, Identity=37%"; Hit description=TMV -MP30 binding protein 2C
MQHFVDLQENSELGESNSWLSAKEQSGAAPNTNLDRVLFNDLVEIVPLVQSLIVIPLTLFTLLSSIFIATQKKGDLFYLCARGKGNKTATWDRKASRSFTRRGSMIYTKTPTRESLSKRTHFVLFISFCLNSHLKRSDFSFSYQCRLEDVTNFESLILLLNMKNCGTKLFPSQAQIP

SEQ ID NO: 131798 - protein, 350 aa, Glycine max
  Coding DNA Sequence Number=SeqID_15020
  Gene Ontology: Mol. function=hydrolase activity; Cellular component =chloroplast; Biological process=RNA processing
  Homolog annotation: Hit_ID=Q8VXF4; Match level="QueryCoverage=71%, HitCoverage=39%, E-value=1e-110, Identity=76%"; Hit description =Putative metallophosphatase
  Pfam annotation: Domain name=Metallophos; Domain location=11-278; Score=14.8; E_value=0.023; Accession=PF00149.18; Description =Calcineurin-like phosphoesterase
MVKNRQLQFHMKIFVEADVIVSPTTGVTAYSIQDDALKTGELDYVNGATVVRYSISGNFLGLPVVTVPVNLQELLASVTLVLYTQGYVLLFSDQLIKDLDYYDIVFHIEDMPYANGYTSQGDQFTAQVQEISSTVPYIIASGNHERDWPNTGSLFDTPDSGGECGVFAETMYYFPAENRAKFWYKADYGLFRFCVADSEHDWREGSEQYKFIEHCLATIDRKHQPWLIFSAHRPLDYSSNDWYGKEGSFEEPMGRESLQKLWQKYKVEIPFYGHVHNYERMCPIYQNQCVNQEKHQLLWHCERNNSCGCWWWGKSLVRLHTNTPYLESLQGSLDYGFGKLTGIQSFISLV

SEQ ID NO: 131799 - protein, 160 aa, Glycine max
  Coding DNA Sequence Number=SeqID_15021
MLDNLLLDIEHFAKASHPNLAKASHPNPVAIVLVLVLSQSRNLSPWNLPWKINRILSTSALKFRQFRRLRCSLLRASSPSSLTLSTSSSPTLVAPPASRLIPNSARRGSDDSGGGRELREEREEEGVEEGFGGEDWGITASYEAIARVSNLRNEYEGGLC

SEQ ID NO: 131800 - protein, 60 aa, Glycine max
  Coding DNA Sequence Number=SeqID_15022
MVVEWLFITLPLACSMAPPASPSSDEERLHAYPHNTTVVESILHYESSVAIILLLSNGTE

SEQ ID NO: 131801 - protein, 76 aa, Glycine max
  Coding DNA Sequence Number=SeqID_15023
MQKMKVVRKFGIGRERGSGRGMQKCGDSIDSTTVVLWGYAWRRSSSLEGDAGGAMLQASGSVMNNHSTTIPPMLLT

SEQ ID NO: 131802 - protein, 261 aa, Glycine max
  Coding DNA Sequence Number=SeqID_15024
  Gene Ontology: Mol. function=protein transporter activity; Cellular component=nuclear pore; Biological process=intracellular protein transport
  Homolog annotation: Hit_ID=Q5ZI43; Match level="QueryCoverage=51%, HitCoverage=38%, E-value=3e-32, Identity=45%"; Hit description =Snurportin-1
MAPHDLHRPFKRPAISDQERRREQSLLRQAQNRQDAQRHARFLASAALSLPPQSSEPESEPKPEPEFELAEFEAEPRLIGASKLKAVEARKWFAKQLMLPEWMIDIPNNLAQDWFVFARPSGKRCFVVSCNGATISRLRNGAVLHRFPSGLPSGARKKDPSYSILDCIFHEADQTYYVIDMVCWRGYPLSDCTAEFRFFWLTSKLAETDAFEPPSHYHKYRHAHYQAGITPLALVWKDENCSQYVLDTDSKGQVPNQQQDF

SEQ ID NO: 131803 - protein, 267 aa, Glycine max
  Coding DNA Sequence Number=SeqID_15025
  Homolog annotation: Hit_ID=Q67YP2; Match level="QueryCoverage=82%, HitCoverage=86%, E-value=8e-42, Identity=39%"; Hit description=MRNA, complete cds, clone: RAFL24-17-M19
  Pfam annotation: Domain name=BSD; Domain location=93-158; Score=59.7; E_value=9.6e-15; Accession=PF03909.7; Description=BSD domain
MELWNRARSFAEEAAKRSQELSLGARATQFTNIIAETTKEIAAQASKHLPRPYAINDVDLHRFGITEELRDFVKGITITTFEDFPLQDDTELSDVPAVSNVRQDLTEWQEKHASLVLSTVKEISGLRYELCPRVMKERKFWRIYFILVNNHTAPYENKYMEDNKLKSCEQVKDHKVMMESLNTELISNQEVQEVKKEAKPSNSSTEQDLDVFLLGEGNSDDEPEFIFANNLFGLSDDGDGGYDDDLEKLMDNSEGSSYSKSNFKGGT

SEQ ID NO: 131804 - protein, 142 aa, Glycine max
  Coding DNA Sequence Number=SeqID_15026
MANLDKESADPAAVINLKLQNDALFHSGEQDMKFQLATDSIDMMLKAMHCIRDQFSTVENIDERPRQGESKVDQSLVGRCVIIRAKASTDQIIWRVGFSLVLPLFSQLNWCKHKHDACTSIVDYFASAKHNVHWITGLELGA

SEQ ID NO: 131805 - protein, 369 aa, Glycine max
  Coding DNA Sequence Number=SeqID_15027
  Gene Ontology: Mol. function=transcription regulator activity; Cellular component=nucleus; Biological process=regulation of transcription, DNA-dependent
  Homolog annotation: Hit_ID=Q9LEZ3; Match level="QueryCoverage=87%, HitCoverage=52%, E-value=2e-52, Identity=42%"; Hit description =Transcription factor BIM1
  Pfam annotation: Domain name=HLH; Domain location=51-135; Score=22.8; E_value=0.00054; Accession=PF00010.16; Description=Helix-loop-helix DNA-binding domain
MMKSARDSAQNEVLESEETFFLKKEPSSNTQRAELLVKVDGKSTDQKPNTPRSKHSATEQRRRSKINDRQVYIACQTDKSFSGCYSRHSLVAKCKLEMQSIRKFQMLRELIPHSDQKRDKASFLLEVIEYIHFLQEKVHKYEGSFQGWSNEPERLMPWRNNDKPAESFQPRGTDNGSSPSPTIPGSTQNVESGLSTATTSKTMDHQAGKMNKAFPIPIPSQLNFFTPTQIGGPGGVVSQLTHRSASDAENTKYQPSVECQTMTATNEKLKEKELTIEGGAISISSVYSKGLLHTLTHALQSSGVDLSQASISVQIELGKQANIRSNVPVSVCGAKDGAVPSNNQKMMRSRVASSGKSDQAVKKLKTCRS

SEQ ID NO: 131806 - protein, 515 aa, Glycine max
  Coding DNA Sequence Number=SeqID_15028
  Gene Ontology: Mol. function=nucleotide binding
  Homolog annotation: Hit_ID=Q5VNG4; Match level="QueryCoverage=89%, HitCoverage=91%, E-value=0.0, Identity=79%"; Hit description =Putative auxin-independent growth promoter
  Pfam annotation: Domain name=DUF246; Domain location=115-463; Score =735.1; E_value=4.7e-218; Accession=PF03138.5; Description=Plant protein family
MCRAEWEGFMGLKKWESKVPKVGMGMGVLGSGSGSGSSRSRMKMWMIRATTSVLLWTCIVQLTALGDMWGPRVLKGWPSCFTHESAVRAMDVELPSPRPPLLPPKRVYKNNGYLMVSCNGGLNQMRAAICDMVAIARYLNVTLIVPELDKTSFWADPSDFQDIFDVDHFITSLRDEVRILKELPPRLKLKVERGFLYTMPPISWSDISYYKDQILPLIQKYKVVHLNRTDARLANNGQPLEIQKLRCRVNFSGLRFTSQIEELGRKVIRLLRQKGPFLVLHLRYEMDMLAFSGCTQGCNSDEVDELTRMRYAYPWWKEKIINSDLKRKDGLCPLTPEETALTLKALDIDQNIQIYIAAGEIYGGERRMASLAKEYPKLVRKETLLEPSDLQFFQNHSSQMAALDYLVSLESDIFVPTYDGNMAKVVEGHRRYLGFKKTILLNRKLLVELIDQYNNGVLNWDEFSSAVKEAHANRMGSQTKRFVIPDKPKEEDYFYANPQECLEPSAYELLALSRT

SEQ ID NO: 131807 - protein, 45 aa, Glycine max
  Coding DNA Sequence Number=SeqID_15029
MAMIVRSRGLVVVVVGSGDRGRGMSATMTIEDESSNDKEKKQRRQ

SEQ ID NO: 131808 - protein, 510 aa, Glycine max
  Coding DNA Sequence Number=SeqID_15030
  Gene Ontology: Mol. function=transcription coactivator activity; Cellular component=nucleus; Biological process=regulation of transcription from RNA polymerase II promoter
  Homolog annotation: Hit_ID=Q1T094; Match level="QueryCoverage=98%, HitCoverage=95%, E-value=1e-163, Identity=61%"; Hit description =SWIB/MDM2
  Pfam annotation: Domain name=SWIB; Domain location=315-390; Score =73.1; E_value=8.6e-19; Accession=PF02201.9; Description=SWIBMDM2 domain
AAIGMNNQAKNIAASSLFGHSGMAPQKHHPNPIQQWNHPNPLLSQSQSHPQTQFPGPFQFSDPQNQVFAKAQYSQAHLHSPAALAHPQPQTHPFAHLHSVNTNTANGTSSPATGSAKRATPKPPLRSHNSLNTNQSMPFKATELTPAARQKKQTPEKVAALLPESALYTQLLDFEAQVDAALARRKIDVQEAKLPPHVQKTLRVYVFNTFSNHAKMDAENRKADESWWSLKITGRILEDGMDSVSGTSQGSSPSYPKFSAFFKKITILLDQSLYPNNHVIVWDSARSPTEQDGFEVKRKGNKEFTALIAIEMNYTPDKFMVSSPLSKLLGIEVETRSRIIATLFNYVKSRKLQSPNDPSFFICDPSLQMVFGEEKMDFTMVSQKLSQHLSQPRPIHLEHNIKLSGHSPAVSACYDIQVDVPFPLEKDMSTFLAGFESQKEIEAYDEAICGSLKKIQEHRRRRAFFLSFSQYPAEFIDTLISSESKDLKLVAGDASHNVEKELRSEFFNQP

SEQ ID NO: 131809 - protein, 151 aa, Glycine max
  Coding DNA Sequence Number=SeqID_15031
MHRKRKRRVRPDTSSFALVLVFRAAKESTQKVIKKGRRYLWCQTLPDSSAVDSTSLLFHLSTLRRTVSSNENQSRKFPLISRGEFTAASSRIPCSFPNSNGIEFYEISSPEGAKFKIPLNYREGKGKQKNGKASYSGFDGASSSTPPWNRR

SEQ ID NO: 131810 - protein, 36 aa, Glycine max
  Coding DNA Sequence Number=SeqID_15032
MEELMYDGRGWGPRELIPTHVHKNKRSMQKITKADQ

SEQ ID NO: 131811 - protein, 414 aa, Glycine max
  Coding DNA Sequence Number=SeqID_15033
  Gene Ontology: Mol. function=actin binding; Cellular component =cytoskeleton; Biological process=actin cytoskeleton organization and biogenesis
  Homolog annotation: Hit_ID=Q1SZ88; Match level="QueryCoverage=82%, HitCoverage=19%, E-value=1e-123, Identity=68%"; Hit description=IMP dehydrogenase/GMP reductase
  Pfam annotation: Domain name=FH2; Domain location=7-344; Score=335.8; E_value=7.3e-98; Accession=PF02181.13; Description=Formin Homology 2 Domain
MTGFMFSLSAPEFDVSELEKLFSANVPKPTDSGKSGGRRKSVGAKTDKITLVDLRRANNTEIMLTKVKMPLPDMMAAVLALDESVLDVDQVENLIKFCPTKEEMDLLKGYTGDKELLGKCEQVPRVESKLRVFAFKIQFNSQVMEFKKSLNTVNSACEEVRNSVKLKDIMKKILYLGNTLNQGTARGSAVGFKLDSLLKLTDTRASNSKMTLMHYLCKVLADKSPGLLDFHLDLVSLESSTKLKETAVEMGLFKFQHQAIIKGLEKVKQEFAASANDGPVSEVFHKTLKEFIAVSESEVASLTNLYSVVGRSADALALYFGEDPARCPMEQVTTTLLNFIRLFRKAHEENIKQAELEKKKAEKEAEMEKAKGINLTKKASPSMMMMTMTTMMWQLAFQADILAGNSEFLRPVEF

SEQ ID NO: 131812 - protein, 376 aa, Glycine max
  Coding DNA Sequence Number=SeqID_15034
  Gene Ontology: Mol. function=protein serine/threonine kinase activity; Cellular component=membrane; Biological process=protein amino acid phosphorylation
  Homolog annotation: Hit_ID=Q9T020; Match level="QueryCoverage=78%, HitCoverage=87%, E-value=7e-30, Identity=45%"; Hit description =Putative receptor-like protein kinase
MEEENKGIIVKLPFVSSLSIFLHLFSFSPLPNVTLLSHLITFKSDRETTSLLSTTEDLQISLDSYLSPSVPSSSSLPLHQTARVFQEESTYSFYIYKSGRLWVRLYFFPLPDPSYNLTSAVFSVQTNQHVLLHEFSVRNNDTSVFKEYLVNVSDSRFSLKFKPKKNSFAFINAIEVVSAPDTLISDSATALSPHGEFKGWDQPIYNKAWTDAIVNRIEVMKMSNDADSLDVLIEVLCARPVIYPTLPREEINLADWAMKQHKRGVLREVIDPRIVKIISPQSFNVFVQTAERCLADCGVERPSMEDVLWHLEYALRLQKDATRIKELEEKSASIFTNECNDNDNIAGHSGDPASDVSDSTDANSALFSQIANFQGR

SEQ ID NO: 131813 - protein, 159 aa, Glycine max
  Coding DNA Sequence Number=SeqID_15035
MVSARSTTTFLLVFILLPLRFSSAHTQHQEGKKTLVVAKLETPRCPVNVEIYHGVPAVAETNQGIRFLPGRKMMSRGVLSKLNVVESENGTNMAKGLTTKWKALCLIGNCNREKGKRILGLKHKDSKRSNGRSTRVKMSGLVPLNADYYVPRPHPPKNN

SEQ ID NO: 131814 - protein, 293 aa, Glycine max
  Coding DNA Sequence Number=SeqID_15036
  Homolog annotation: Hit_ID=Q5VMR7; Match level="QueryCoverage=25%, HitCoverage=9%, E-value=2e-09, Identity=39%"; Hit description=2x PHD domain containing protein-like
MSLKNGRANMIATRTYMPKIAVLAGPRDTPANQHISKTMYNGFIILMEIWQLVRLILILKPNVVFVMLEQMSIFYYFVIYVILLRTHTVLAWAILFLMVIGFVTIVLFPGRPISMKNQTNKNFAPTAEPSVTINIFDIVRETGSRVVNRPRASPLQQNLSSPVIPLPDRLSYLSRLKGKGPVTGVCNMQRNVKVFRENWNALRSGSFQFRCNSFQPGSTVSQKQDSSSLSHHKLDGLHSMASTSLQQSTVQGGPSNKMLNERVFKDADKAWKMMDRAKRIQRLIIEQAAFYRE

SEQ ID NO: 131815 - protein, 91 aa, Glycine max
  Coding DNA Sequence Number=SeqID_15037
MERDEKNMVTMRDLNVPGGRKDAMHREPANVGEPLAENWAYSMMQTKQKCRFFGEPNDDILVGIRITHCSEPGDSSYTVKTTASAKSNTWL

SEQ ID NO: 131816 - protein, 214 aa, Glycine max
  Coding DNA Sequence Number=SeqID_15038
  Gene Ontology: Mol. function=protein dimerization activity; Cellular component=nucleus; Biological process=regulation of transcription, DNA-dependent
  Homolog annotation: Hit_ID=Q9FJH3; Match level="QueryCoverage=40%, HitCoverage=45%, E-value=2e-19, Identity=58%"; Hit description =Arabidopsis thaliana genomic DNA, chromosome 5, P1 clone:MAE1
  Pfam annotation: Domain name=bZIP_1; Domain location=106-168; Score =47.0; E_value=6.3e-11; Accession=PF00170.11; Description=bZIP transcription factor
  Pfam annotation: Domain name=bZIP_2; Domain location=104-158; Score =41.7; E_value=2.6e-09; Accession=PF07716.5; Description=Basic region leucine zipper
  Pfam module annotation: Pfam domain module=bZIP_1::bZIP_2; Domain location=106-168::104-158
MECNEDDELHVAPYASLTQRLHYHSPTQKPIFTSTNLLNVEAGEGHNLNHMDPPHCLHHTPFYCSQFQLPSNSNNPIQIPLHKPSPNISSNNNNNNNSDEAKALLDDRKKKRMFSNRESARRSRMRKKQQIEVLQYHVDNLQTLNHQLSQKIIYLLECNQQIHQQNAQLKEKVFSLQVALSDLLATSGSAEQPHLIPNGFLAESSTRPIASSRT

SEQ ID NO: 131817 - protein, 426 aa, Glycine max
  Coding DNA Sequence Number=SeqID_15039
  Gene Ontology: Mol. function=metal ion binding
  Homolog annotation: Hit_ID=Q9FJH4; Match level="QueryCoverage=45%, HitCoverage=52%, E-value=2e-33, Identity=41%"; Hit description =Similarity to ring finger protein
  Pfam annotation: Domain name=zf-C3HC4; Domain location=364-404; Score= 45.3; E_value=2e-10; Accession=PF00097.15; Description=Zinc finger, C3HC4 type (RING finger)
MEIFKILGVQEAILGMQENKKISKIIYIFSGAQETVCGFPVIQRRQGTDIELRQGHFRHSTEQPVIAPNPTLSIIPHFLTNQPSMADVTTYLRHHRDPDPDPDDDDQTLIPFPYWDLDFDFDPEFPTNTFSFTDRENQINFVMDLFHQRVEQSQLTDPLSNDAVFGVIDGIDLGFPAADDFFIGRRFSVGSDESDGGHSHSHAGIDDGVLGFCAHSDEDYNENDDVASIPLCWDALQLEDNNNNYDDFEWEEVIDERDVLSMLDDTVSVNLGIEAEAAAAAAEEEEAESEASILEWQVLLNSNNLEGPNSEPYFGDNEDFVYTADYEMMLGQFNDDAFNGKPPASASVVRNLPSVVVTEADVVCAVCKDEFGVGEGVKVLPCSHRYHEDCIVPWLGIRNTCPVCRYEFPTDDADYERRKAQRSVVM

SEQ ID NO: 131818 - protein, 139 aa, Glycine max
  Coding DNA Sequence Number=SeqID_15040
MEKLLHKKRYPYHHPVYGSLTRSEVQHYNLSLSTKFTLVTAEEILYKASMLYTRLFGGSFVSERIILISIDWWVIPVVCKYLASKLSCEMLNALDMTQQHNGYTEIIDISKPSRGQFNPVVLIKLELYIIALIFLVKWM

SEQ ID NO: 131819 - protein, 1149 aa, Glycine max
  Coding DNA Sequence Number=SeqID_15041
  Gene Ontology: Mol. function=DNA-directed DNA polymerase activity; Cellular component=DNA polymerase III complex; Biological process =DNA replication
  Homolog annotation: Hit_ID=Q9FK71; Match level="QueryCoverage=96%, HitCoverage=100%, E-value=0.0, Identity=45%"; Hit description =Similarity to DNA polymerase III
  Pfam annotation: Domain name=AAA; Domain location=493-698; Score= -23.8; E_value=0.013; Accession=PF00004.19; Description=ATPase family associated with various cellular activities (AAA)
  Pfam annotation: Domain name=DNA_pol3_delta; Domain location=539-775; Score=-90.2; E_value=0.038; Accession=PF06144.3; Description=DNA polymerase III, delta subunit
  Pfam module annotation: Pfam domain module=AAA::DNA_pol3_delta; Domain location=493-698::539-775
VGVLIMTRAVRSRVLKDANGDISDHLRNHIHLTNCIHLKNHMHKNSPILADRSIMRDLVVLQRSRSLRDPSASPPSWHSPSVVDLLFKRVENDAVSQGGRMSVGAERRKEGRRLSGTSPPLVSIGSSRVAPGEIGRGNDGITAPSERSSRSGLGDGRRVGREESGRKNDRPDFLDVNPEEPLYQGGKSLAEDVISRHSESKARKSKQRGKNVRDAQVKTLSEQLNDVPLDSDDLASSNIHFRGRFPRQEKVIEEVESRMRSHGSGMNKGKRRKFRSVRRTRVATTSRDIGAENEISVASNSLAHHKYHLEEADEFADENVTRAPKNGCGIPWNWSRIHHRGKTFLDLAGRSLSCGLSDSRLKKGTFTANGRNISEMPVASERSSSCTKSDAEALPLLVEASGSHASTENACWDHDYSGELGLFGDNLFKHDVDSDLASEARSGDQRKLRGNRHSRHQSLTQKYMPQTFRDMIGQNLVAQALSNAVMKRKVGLLYVFYGPHGTGKTSCARIFARALNCNSSEHPKPCGFCNYCVAHDMGKSRNIREVGPVSNFDFEGIMDLLDNMTLSQLPSHYRVFIFDDCDTLSTDCWNAISKVIDRVPRRVVFILVSSSLDWIATKEGLEIDKDALKLIASRSDGSLRDAEMTLEQLSLLGQRISVPLIQELVGLISDEKLVDLLDLALSADTVNTVKNLRVIMETGVEPLALMSQLATVITDILAGTYDFTKERRRRKFFRRQPLSKEDMEKLRQALKTLSEAEKQLRMSNDKLTWLTAALLQLAPDQQYVLPTSSDNSFNHSPFALKDADAREAARLTGNPVDIPNKGRRLSMDARIENFHAGSSADGMTRGLGSEKKRHSVSGFTPQHAHSQTTDKIRMSERQILGKNHKEIEEIWLEVLERIQVTGLKEFLFKEGKLISVSFGAAPTVQLMFSSQLTKSTAEKFRGHILQAFESVLGSSITIEIRCELNKDAASAVQQPLTLPATNDSSSQIRDFNGVGTLAHPSVTDSVEKRRGEIVEEAASQVEHMNSEQQVDAHGTSYKSLEGTSIGQSSASQKMPIVKSHLDERKLMEQGQSRSLVRSKVSLAHVIQQAEGQRSGWSKRKAVSIAEKLEQENLASPGAAVKLCLGDLLVMGSNPETMGSNPETTSLHMQ

SEQ ID NO: 131820 - protein, 128 aa, Glycine max
  Coding DNA Sequence Number=SeqID_15042
  Gene Ontology: Mol. function=ribonuclease H activity
  Homolog annotation: Hit_ID=Q2HTL5; Match level="QueryCoverage=75%, HitCoverage=46%, E-value=2e-09, Identity=36%"; Hit description =Ribonuclease H
MGLSYEYPSNFSSTISSIRAWTPSRSYEGIRNLHCESDSTTTPLQFIADAVVRSHPYYPIVLKIQSLITLQWQLHFSHTLREANSCANSLAKTGASEDSHLVILGNAPSNLSTSLMADALGVFFTMNR

SEQ ID NO: 131821 - protein, 167 aa, Glycine max
  Coding DNA Sequence Number=SeqID_15043
  Gene Ontology: Mol. function=signal peptidase activity; Cellular component=integral to membrane; Biological process=signal peptide processing
  Homolog annotation: Hit_ID=Q6Z329; Match level="QueryCoverage=85%, HitCoverage=28%, E-value=8e-50, Identity=52%"; Hit description =Putative protease IV
MAKSTIPLETGKSSLPTSQSSCTARFSPGLSLPQICDNFFKAAYDPRISGIYLHIDVLNCGWAKVEEIRRHILNFRNSENLGIEPEVERIGKYKSVGDQLTRKTMSEDHHEMFTALLDNIYTNWLDKVSSARGKKREDIENFINKGVYQVERLKEEGFISDIIYDDK

SEQ ID NO: 131822 - protein, 69 aa, Glycine max
  Coding DNA Sequence Number=SeqID_15044
MKQRLKERDVTFLPKGGSKKKERNEEKVEGKQLKRLNQKKGRRPVWIIKAQISQQASRERENDSLNSNP

SEQ ID NO: 131823 - protein, 162 aa, Glycine max
  Coding DNA Sequence Number=SeqID_15045
MEPFGAEECHSSESGWTMYIGSSIDDAGGHSTDDGDGDDDNDDDDKEEGTQAHPQDDDESDDSMASDASSGPSHHHGFADFRRDSEEGNHDKYCFEKKASKTQHKQMEGEKVEKKGMLPVDSKDKSPVQGCGKLQLLCSQLHFHSCCDSNGHFTILATACKD

SEQ ID NO: 131824 - protein, 367 aa, Glycine max
  Coding DNA Sequence Number=SeqID_15046
  Homolog annotation: Hit_ID=Q2QN14; Match level="QueryCoverage=16%, HitCoverage=14%, E-value=7e-14, Identity=61%"; Hit description=AP2 domain containing protein, expressed
  Pfam annotation: Domain name=AP2; Domain location=21-87; Score=124.1; E_value=3.8e-34; Accession=PF00847.10; Description=AP2 domain
MGAMSDNGISRSRKKSSSRGHHRFVGVRQRPSGRWVAEIKDSLQKVRLWLGTYDTAEDAARAYDNAARALRGSNARTNFELPESASSGGANKRGGSKFVPECTEPFSFEDVNEPGSDAEGLLGALKAKLLDGKKGKFDQFQFLGNSAAQVVQSGMVSRSSQNCSGKKELLLPIPSSSANDTVLTRMNYGTGTSPVHGVMSTLASSNTCANKSVVIPNHDYHEGAVASTSSGRVNSHQLCQTPPVATWPSEVAYDLPWPTQYMSQVLPDNGLLASSSTAAATLTNIWPLSGVIESTVDMTCMDQGPSSSNKSGQMMNMVSMQLPLVGGANEGLWTLEQQQFVQCDQNNSWFSFNGSWDPLLYVPSELA

SEQ ID NO: 131825 - protein, 152 aa, Glycine max
  Coding DNA Sequence Number=SeqID_15047
  Homolog annotation: Hit_ID=Q9M719; Match level="QueryCoverage=35%, HitCoverage=21%, E-value=7e-09, Identity=47%"; Hit description=An2 protein
MACRWKSATRRLLCIDIILPGRTPNDVKNYWNTYIRRKVSSSHKVVINEKQEKTTVKPHVVIKPKARTFSRPSPSGLRGSNVLREEGGESGAKHCSTHHQACAASSECINNWSTDQWWKTMMHDKGDNLDNNQCLLAYQDEVGKLKFIILLS

SEQ ID NO: 131826 - protein, 230 aa, Glycine max
  Coding DNA Sequence Number=SeqID_15048
  Pfam annotation: Domain name=DUF1685; Domain location=89-178; Score= -11.8; E_value=0.0043; Accession=PF07939.2; Description=Protein of unknown function (DUF1685)
MDAEEVLKLFDSCWFGHQNLKEHTSSSTIPTSLHENSSDHNQIKEPSEPTLLRIQSGHSRSMSDQLSSMTCFKDDSLSPDSVFSPKLQTILSGKDVTDAEAAHVQLQLLVLPKKRERRKKRPSKSLSDLEFEELKGFMDLGFVFSEEDKDSSLASIIPGLQRLGKSDEEEEDSELGSSVQRPYLSEAWKAQERRKKENPLVNWKIPALNNEIDIKDSLRWWAQTVASTVR

SEQ ID NO: 131827 - protein, 563 aa, Glycine max
  Coding DNA Sequence Number=SeqID_15049
  Gene Ontology: Mol. function=GTP binding; Cellular component =intracellular; Biological process=RNA-dependent DNA replication
  Homolog annotation: Hit_ID=Q5QN81; Match level="QueryCoverage=78%, HitCoverage=81%, E-value=3e-65, Identity=29%"; Hit description =Pentatricopeptide (PPR) repeat-containing protein-like
  Pfam annotation: Domain name=PPR; Domain location=154-187; Score =14.3; E_value=0.15; Accession=PF01535.11; Description=PPR repeat
  Pfam annotation: Domain name=PPR; Domain location=188-222; Score =23.7; E_value=0.00066; Accession=PF01535.11; Description=PPR repeat
  Pfam annotation: Domain name=PPR; Domain location=257-291; Score =38.2; E_value=2.8e-08; Accession=PF01535.11; Description=PPR repeat
  Pfam annotation: Domain name=PPR; Domain location=292-326; Score =31.2; E_value=3.6e-06; Accession=PF01535.11; Description=PPR repeat
  Pfam annotation: Domain name=PPR; Domain location=327-361; Score =39.2; E_value=1.4e-08; Accession=PF01535.11; Description=PPR repeat
  Pfam annotation: Domain name=PPR; Domain location=362-396; Score =42.2; E_value=1.8e-09; Accession=PF01535.11; Description=PPR repeat
  Pfam annotation: Domain name=PPR; Domain location=397-431; Score =34.4; E_value=4.1e-07; Accession=PF01535.11; Description=PPR repeat
  Pfam annotation: Domain name=PPR; Domain location=432-466; Score =35.0; E_value=2.6e-07; Accession=PF01535.11; Description=PPR repeat
  Pfam annotation: Domain name=PPR; Domain location=467-501; Score =16.9; E_value=0.073; Accession=PF01535.11; Description=PPR repeat
  Pfam module annotation: Pfam domain module=PPR::PPR::PPR::PPR::PPR::PP R::PPR::PPR::PPR; Domain location=154-187::188-222::257-291::292 -326::327-361::362-396::397-431::432-466::467-501
MAPAASSPPPSFALSIRDDHRKDEESKCAYLVVALCPCLFPFLNSPRTFASNADSGVENDDDDDDGGDGDKGYDGRGVSGESCADPVEVERVCKVIDELFALDRNMEVVLDECGVRLSHDLVVDVLQRFKHARKPAFRFFCWAGKRPGFAHDSRTYNFMMCVLGRTRQFETMVAMLEEMGEKGLLTMETFSIAIKAFAEAKQRKKAVGIFDLMKKYGFKVGVDVINFLLDSLSTAKLGKEAQAVFEKLKDRFTPSLQTYTILLSGWCRLKNLLEAGRVWNEMIDRGFNPDVVAHNVMLEGLLKCKKKSDAIKLFEIMKAKGPSPNVRSYTIMIQDFCKQKLMGEAIEYFDVMVDRGCQPDAALYTCLITGFGRQKKMDMVYSLLKEMRERGCPPDGRTYNALIKLMTSQHMPDDAVRIYKKMIQSGIKPTIHTYNMIMKSYFVTKNYEMGHEIWDEMHQKGCCPDDNSYIVYIGGLIRQDRSGEACKYLEEMLEKGMKAPKLDYNKFASDISKTGNAVILEELARKMNFVGKFEVSNVLASWADMMKKSAKRREPTTSARQFT

SEQ ID NO: 131828 - protein, 99 aa, Glycine max
  Coding DNA Sequence Number=SeqID_15050
GVCYFTTKRLPEERVSPERDTWLVWTGRCDRGGRACLPGATSRAYLPGATTSGSLAGTSTSGGPPDTSLFPIKPSALRFIFTQKSSSFGNLEAELKRTD

SEQ ID NO: 131829 - protein, 355 aa, Glycine max
  Coding DNA Sequence Number=SeqID_15051
  Gene Ontology: Mol. function=phenylalanine-tRNA ligase activity; Cellular component=cytoplasm; Biological process=phenylalanyl-tRNA aminoacylation
  Homolog annotation: Hit_ID=Q1RSG6; Match level="QueryCoverage=88%, HitCoverage=55%, E-value=1e-155, Identity=84%"; Hit description=B3/4
  Pfam annotation: Domain name=B3_4; Domain location=146-303; Score =50.6; E_value=5.4e-12; Accession=PF03483.7; Description=B34 domain
MYPSDSEHLFLRRGCTCTHSIRDQNGAMPTVSVGRDRLFAALGKTYTQEEFEDLCFSFGIELDDVTTEKAIVRKEKHLEEEEADEDEEVIYKIEVPANRYDLLCLEGLAQALRVFCEFQEIPTYKLSKISKDAMLKMHVKPETSLIRPYVVCAVLRGITFDKARYNSFIDLQDKLHQNICRRRTLVAIGTHDLDTLEGPFTYEALPPSSITFTPLKQERNFRADDLMEFYKSDLKLKKFLHIIEDSPVFPVIYDSKRTVLSLPPIINGAHSAITLETKNVTAFSEYCENKFVIEPVEVISSDGKSNIYPDLSVYNMEVSLSYITGLIGVSLEAEEVIILLLHMSGVILYLQIDYS

SEQ ID NO: 131830 - protein, 654 aa, Glycine max
  Coding DNA Sequence Number=SeqID_15052
  Gene Ontology: Mol. function=adenylate cyclase activity; Biological process=cAMP biosynthetic process
  Homolog annotation: Hit_ID=Q6YV21; Match level="QueryCoverage=98%, HitCoverage=98%, E-value=0.0, Identity=64%"; Hit description=Uridine kinase-like protein
  Pfam annotation: Domain name=CYTH; Domain location=256-403; Score =73.1; E_value=8.9e-19; Accession=PF01928.11; Description=CYTH domain
  Pfam annotation: Domain name=PRK; Domain location=66-263; Score=-9.8; E_value=1.4e-06; Accession=PF00485.8; Description=Phosphoribulokinase Uridine kinase family
  Pfam module annotation: Pfam domain module=CYTH::PRK; Domain location= 256-403::66-263
MAQDTVSGVDSPRGRLLRDQVQVVKKKDSDRYEIVPIQDSLSFEKGFFIFIRACQLLAQKNDGIILVGVAGPSGAGKTVFTEKVLNFMPSIAVITMDNYNDSSRIIDGNFDDPRLTDYDTLLENIQGLKAGKPVQVPIYDFKSSSRIGYRANPVATVKLHLDQLVMGSNPEKSLCICKGKTVTVEVPGSRIVIIEGIYALSEKLRPLLDLRVSVTGGVHFDLVKRVLRDIHRAGQEPEEIIHQISETSARTVTVDQIKAVIAAEHTETKEETYDIFLLPPGEDPEACQSYLRMRNRDGKYNLMFEEWVTDSPFIISPRITFEVSVRLLGGLMALGYTIAAILKRSSHVFHDDKVTIKTDWLEQLNRTYVQVQGKDRNYCKFFAEKLGLDGSYVPRTYIEQIQLEKLVNDVMALPDDLKTKLSIDDDLVSSPKEALSRASADRRMKYLNRGISQSYSTQRDKILPKLTKLAINNRRFDGRALESPAPIANQGVITQLSDQISTLNERMDEFTSRIEELNSKFAIRKDSAGSQQNLALQAEACNGSGPTSFFVTGRGNGSLTGSLLPNSSSSSQLAKESPLMEEVLVIARGQRQIMHQLDTLSNLLHEYFGERSRLGRPDHTGRMREAESVAVPLLLTLAIGAVGVLLFRGLTSQK

SEQ ID NO: 131831 - protein, 444 aa, Glycine max
  Coding DNA Sequence Number=SeqID_15053
  Gene Ontology: Mol. function=strictosidine synthase activity; Cellular component=cellulose and pectin-containing cell wall; Biological process=biosynthetic process
  Homolog annotation: Hit_ID=Q1RSG3; Match level="QueryCoverage=68%, HitCoverage=90%, E-value=1e-112, Identity=66%"; Hit description =Strictosidine synthase
  Pfam annotation: Domain name=NHL; Domain location=202-230; Score=7.8; E_value=1.5; Accession=PF01436.11; Description=NHL repeat
  Pfam annotation: Domain name=NHL; Domain location=313-341; Score =13.7; E_value=0.28; Accession=PF01436.11; Description=NHL repeat
  Pfam annotation: Domain name=Ribosomal_L7Ae; Domain location=31-125; Score=80.6; E_value=4.8e-21; Accession=PF01248.16; Description =Ribosomal protein L7AeL30eS12eGadd45 family
  Pfam annotation: Domain name=SGL; Domain location=114-422; Score= -102.3; E_value=0.0078; Accession=PF08450.2; Description=SMP -30GluconolaconaseLRE-like region
  Pfam annotation: Domain name=Str_synth; Domain location=258-346; Score=105.7; E_value=1.4e-28; Accession=PF03088.7; Description =Strictosidine synthase
  Pfam module annotation: Pfam domain module=NHL::NHL::Ribosomal _L7Ae::SGL::Str_synth; Domain location=202-230::313-341::31-125::114 -422::258-346
MGSDSEAEKEKKKMLALAPIAKPLAGKKLCKRTLKLVRRAAEHKCLKRGVKEVVKSIRRGHKGLCVIAGNISPIDVITHLPILCEDSDIPYIYVPSKEDLAGAGATKRPTCCVLVQTKPVKGEIERGEQEKLKLPLPSPVTGPESVAFDRNGGGPYVGVSDGRILKYAGPGEGFKEYAFTSPNRNKTICDGLADFSELQATCGRPLGLRFNHQTNELYVADAYSGLIKIGPNGGAPTQCFKDIQPQQENVNTTLQFLDGLDVDVNTGIVYFTQASANYGFKDAQALQSSRDQSGSLFSLDPKTNQTRVLMRGLALASGVAVSRDGSFVLVSEYLANRIQRFWLRGPRANSSELFLQLTGRPDNIRSNQRGQFWVAVNGVLGPNPPPRPTILPAGVRISENGIILRIVSLVQEFGSEAVSEIHEHNGTLYSGSLQASYVPISAMI

SEQ ID NO: 131832 - protein, 266 aa, Glycine max
  Coding DNA Sequence Number=SeqID_15054
  Gene Ontology: Mol. function=molecular_function; Cellular component =membrane; Biological process=auxin mediated signaling pathway
  Homolog annotation: Hit_ID=Q9LI65; Match level="QueryCoverage=86%, HitCoverage=62%, E-value=7e-65, Identity=51%"; Hit description =Nodulin-like protein
  Pfam annotation: Domain name=DUF6; Domain location=91-220; Score =45.0; E_value=2.6e-10; Accession=PF00892.11; Description=Integral membrane protein DUF6
MVPVVTFMMALPFGLETVKIKCKSGRAKILGSLVCIGGALMLTLYKGKPLFNFSHYESVSPVANSSAVNLASTRTKGKWTIGVIALVLGTIFWSSWFILQSKISKRYPCQYSSTAIMSFFGAIQSAVICFFTDHNLSIWVLKGKIQIIAILYAGMIGSGLCFVGMSWCVKKRGPVFTAAFSPLVQIMAAMIDIPVLHEQLHLGSVMGSILVIIGLYILLWGKSMEMQNRVVKLVQEAEETKEQEPQPQIQQLTVYVHAESCDSQCH

SEQ ID NO: 131833 - protein, 1520 aa, Glycine max
  Coding DNA Sequence Number=SeqID_15055
  Gene Ontology: Mol. function=RNA-directed DNA polymerase activity; Cellular component=chromatin; Biological process=chromatin assembly or disassembly
  Pfam annotation: Domain name=Chromo; Domain location=1410-1455; Score= 18.4; E_value=0.0067; Accession=PF00385.14; Description='chromo' (CHRromatin Organisation MOdifier
  Pfam annotation: Domain name=RVP_2; Domain location=337-468; Score= -32.7; E_value=0.00035; Accession=PF08284.2; Description=Retroviral aspartyl protease
  Pfam annotation: Domain name=RnaseH; Domain location=850-968; Score= -32.9; E_value=0.067; Accession=PF00075.14; Description=RNase H
  Pfam annotation: Domain name=rve; Domain location=1104-1260; Score =107.6; E_value=3.6e-29; Accession=PF00665.16; Description=Integrase core domain
  Pfam annotation: Domain name=zf-H2C2; Domain location=1045-1086; Score=27.5; E_value=4.6e-05; Accession=PF09337.1; Description=His(2)- Cys(2) zinc finger
  Pfam module annotation: Pfam domain module=Chromo::RVP_2::RVT _1::Retrotrans_gag::RnaseH::rve::zf-H2C2; Domain location=1410 -1455::337-468::590-759::97-187::850-968::1104-1260::1045-1086
MTHPSSSDKIEELLVRLTTQQLTLSSKIDDFISHITPLFSPASHMPSSLPRPFPVPAQHHRLKLDVPRFDGTDALGWIFKINQYFEYHGTPEYDRLTIASFYMEGRALAWFQWMTSNGQFTSWPVFLQALQNRFAPSQYEDPTGTLCKLMQKGSVASYLSEFEDLANRVVGIPPAFLLSCFISGLTPEIRREVQAHQPLTLSQAAGLARLQEEKLGDLRPPPSTMRSRPPSLSSSSFSPRPQPLSPLFPSPSAIRPPPPPPSPTQPFKRLTSEEIASRRERGLCFSCDEKYHRGHRCASRVFLFIAEGDAAPDPPHIAPLDPTLEPDPDPTEAHDPHPAQLSLNSMAGHLAPETLRFVASIADVEVVLLVDGGSTHNFIQQQLVEKLGLPSISTTPLRVMVGNGQQLSCSCMCQAVAINIQNNTFIVDLYILPISGANVVLGVQWLKALGPVLTDYNTLSMQFFSDGRLIRLQGDLDAKLHLLTPVQLRRLSRTQGDALFYHITLLSNSTPSLSQEFPAPIQDLLRRFEALFTTPSTLPPARATDHHIHLIPQATPVNVRPYRYPHYQKQEIEQQVDAMLQKGLIQPSTSPFSSSVLLVKKHDGSWRFCVDYRALNALTIRDRFPIPTIDELLDELGGACYFSKLDLLQGYHQIRMNPEDIPKTAFRTHHGHYEFKVMPFGLCNAPSSFQATMNSIFQPYLRRFIIVFFDDILIYSTSMDAHLQHLEITFKVLLTHQFALKLSKCTFAQRQVEYLGHLVSFNGVEPLTDKIEAVRQWPSPRTAKALRSFLGLAGFYRRFIKGYATIAAPLVKATTLDPFQWTDVTQAAFDQLKLALSSAPVLALPDFHLPFTIETDASGVGLGAVLSQKGHPIAYFSKPFSAKLLRSSTYVRELYAITAAVKKWRQYLLGHRFVILTDHRSLKELLTQVVQTPEQHMYLARLMGYDYEIHYRSGASNQAADALSRVPDPDSSLALMLSVPCLTFMDELCSQLDQHSDYVHRRQDIANHPAKHPGFSVVNNLILHRHRIWLPRDIPIIPTLLVEFHATPTGGHSGIAKTIARVSENFYWPGLREDVATFVANCRDCQSTKYETKKLAGLLCPLPVPHRPWEDLSLDFIVGLPPYKGHTVILVVVDRFSKGVHLGMLPTAHTAFMVATLFQDMVVKIHGVPRSLVSDRDPLFLSKFWQELFRRSGTHLRMSSAYHPQSDGQTEAINRIIEQYLRSFVHRRPRIWGRLLPWAEWSHNTSWNSATGATPYEVTFGRKPFNFPEYLAGDSNIDAIDTLLCDREETFLMIRKKLLKAQILMKEKADKHRRDIVFSPGQWVLLRLRPHRQTSARENPTISGKLAKRYYGPFQVLEAIGKVAYRLQLPPDAKIHPIFHVSMLKPFKGDPNDPVANPLPISFHDDHPLVQPAAILASRPSSVSGWDVLVQWHGLSPDETSWEDWSTLCRDYHLEDKVLSQGPRGDTGGNIAEGDNQQNEVQQAMQINNQQDKVQQAISENKEQRPKRRVERPTYLKDYI

SEQ ID NO: 131834 - protein, 1375 aa, Glycine max
  Coding DNA Sequence Number=SeqID_15056
  Gene Ontology: Mol. function=RNA-directed DNA polymerase activity; Cellular component=chromatin; Biological process=one-carbon compound metabolic process
  Pfam annotation: Domain name=Chromo; Domain location=1282-1332; Score= 30.0; E_value=8.6e-06; Accession=PF00385.14; Description='chromo' (CHRromatin Organisation MOdifier
  Pfam annotation: Domain name=RVP_2; Domain location=327-451; Score= -19.9; E_value=3.6e-05; Accession=PF08284.2; Description=Retroviral aspartyl protease
  Pfam annotation: Domain name=rve; Domain location=979-1135; Score =112.4; E_value=1.3e-30; Accession=PF00665.16; Description=Integrase core domain
  Pfam module annotation: Pfam domain module=Chromo::RVP_2::RVT _1::Retrotrans_gag::rve; Domain location=1282-1332::327-451::576 -745::95-185::979-1135
MAEHGTRRTTTDRLEDAISILSEKHSDLASKVNALYEQLSQIHSTSHPSPQHSSHPRPPVKLEVPRFDGHDLLGWIFKISQFFEYQGTPEEDRITVASFYLDGTALSWFQWMYRNGFITSWFDLLQAIENRFAPSFYDDPRGTLFKLMQRGSVTEYLTEFERLANRIVGLSPSILLSCFISGLSPEIRREVQALQPASLPHATALARLQEDKITDRRRSSRPSFSSPHTPTPTLSSQPSTSRPRPKTPFIQRTQEEMTYRREKGLCYNCDEKWNSSHRCKGRVLFFITASDDPPFSDTTSPEVTTHSPNEPSPSFDPTSLHPHISLHAMAGVPATETFRLYGLVNHARVTILVDSGGTHNFIQPRVAKFLNLPLEATTPLRVMVGNGSVLDCRQLCPATKLLIQDHSFTITLRVLPLSGADIVLGVEWLRTLGPIVTDYSAFTMHFSHQGQPITLRADVQSDTDPVSANQVRCMLHTQSTSALFHLSLLPVNSIEAPPDPPHPISAINALLLRFSSLFQQPSTLPPPRNHDHHINLLPSASPINVRPYRYPHFQKTEIEKQVTALLESGFIQPSRSPYSSPVLLVKKKDGTWRMCVDYRALNSITVRDRFPLPTIDELLDELGRASWFSKIDLRQGFHQILMAPEDVSKTAFRTHHGHFEYRVMPFGLCNAPSTFQAAMNAVLGPHLRKFATVFFDDILIYSETLPDHVHHLERVFTSLTQAQYYLKRSKCLFGQRKLDYLGHVVSEKGVQPDPSKIQAILDWPAPRSAKELRAFLGLTRFYRKFVKGYAAIATPLTRLLCRDAFQWVPESQEAFLALKRAMTAAPVLALPDFSLPFALETDASGTAMGAVLQQQRHPIAFFSKPFCPRMQHASTYKKAIQAHPEDHPHFTIANELIFFKNAIWIDSRNPFIPALLHEYHATPLGGHFGVKKTLHRLRSNFQWTTMIADVKSFIRECRVCQQVKHVTRKSAGLLQPISPPTGIWEDLSMDFITHLPSSHSFTVILVVLDRFSKGLHLGALPTQFTAFKVATLFLDIVCKLHGFPSSIIYDRDPVFISSFWRELFKLSGTTLRMTTAYHPQSDGQTEVMNRSVEQYLRSFVHKRPEEWHKFLPLAEWAYNTSQHSGTGVTPYKVIYGKPPPSIPGYVLGSSRNEAVDTLLHSRAELHESLRRNLLKAQAEMKHFADKKRRDVQYEIGQLVYVKLRPHRQQSLRSQRHHKLMKRYFGPFPIMERIGSVAYRLQLPEGSRIHPVFHCSLLRPHHGPLDLPTSSLPADTSSPHPILEPLAILDSRMDFSVDPPTRFVLVQWVGLPPEDSTWEKWDEVCHAHHLEDKVSFTGSDDVSSSNPAKEDSSHDEPVPRRQRSSTRPKHLEDYVL

SEQ ID NO: 131835 - protein, 267 aa, Glycine max
  Coding DNA Sequence Number=SeqID_15057
MQKALRRTVWVPLHQLLQGVQPKSPPSWISSNICTFAPKGGGGGGPPPGGLGAPGTPGGGGGGGPRPPGVGGGGGPRPPGGGGGGGAPYIGGGGGGGPRPPGGGGGGGGPRPPGGGGGGGGPRPLGGGGGGGAPYIGGGAPCIGGGGGGGGAPRIGGGGASRVPYIGGGGGGAPLEGGRGGGGGAPLDGRRGGGGGRGTLDNGGGGGGGGAPLDEGRGGGGGGVGGDGSSEALPKGGGGGGGGTGGGAEYICELAKGGRGGGGGGGG

SEQ ID NO: 131836 - protein, 223 aa, Glycine max
  Coding DNA Sequence Number=SeqID_15058
VITDSQFVRPWTFATRLVATKYASGVRGRHSTARLERRETLYGEEVAVISHDDEGAGSDLSSLERLPCGDVIERDQREGDGHEGGGGDAAHRRLEQRVVVVGDDSGKEVAVLGCDRGGIAELEGYMVLNLDLQKAYDKVEWDFTLDTLSKVGIPPWMANAIHVHMSSTFMAINWNEIGTSHPRFSSECVAAGEVNQILNPFANASSQKINMSKSKVLFSTNVS

SEQ ID NO: 131837 - protein, 98 aa, Glycine max
  Coding DNA Sequence Number=SeqID_15059
MNKFERLEAGWSNKKKKRNNDNRILVIHFLLGKTSSTWCVGNNKTRKKGVWTCGGAKSKRLRFRVRDGGQKAVLGGPAADCVAATGCFGVSNRALIVG

SEQ ID NO: 131838 - protein, 205 aa, Glycine max
  Coding DNA Sequence Number=SeqID_15060
  Gene Ontology: Mol. function=transcription factor activity; Cellular component=nucleus; Biological process=regulation of transcription, DNA-dependent
  Homolog annotation: Hit_ID=Q1RSE6; Match level="QueryCoverage=82%, HitCoverage=81%, E-value=5e-46, Identity=58%"; Hit description =Pathogenesis-related transcriptional factor and ERF
  Pfam annotation: Domain name=AP2; Domain location=47-111; Score =125.6; E_value=1.4e-34; Accession=PF00847.10; Description=AP2 domain
MENIDPSKFSHQSQNQNKNNLPLMPIEIDKSYKKRAIKVPKVANKSEKKFLGVRQRPSGRWIAEIKDSSQKLRLWLGTFDKAEEAALAYDCAARLLRGRNAKTNFPNHGTMNTHEEDCSLLGKNPRAYQLLKHAVMKNHALSSSLYSTVVPWKNQIMMRDEFDSLVEETILLLSVLPKLLILADGDDGYIGPNQCAHSQKTKMRE

SEQ ID NO: 131839 - protein, 156 aa, Glycine max
  Coding DNA Sequence Number=SeqID_15061
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=94%, HitCoverage=28%, E-value=2e-56, Identity=72%"; Hit description =Putative receptor-like protein kinase 3
MKNGDSGTHSDSFHYIEKDGGVSHSQSGEEGSSGTVTVYKQSSSYPITAPSPLSGLPEFSHLGWGHWFTLRDLELATNRFSKENVLGEGGYGVVYRGQLINGTPVAVKKILNNTGQAEKEFRVEVEAIGHVRHKNLVRLLGYCIEGTLRYHSSQLQ

SEQ ID NO: 131840 - protein, 154 aa, Glycine max
  Coding DNA Sequence Number=SeqID_15062
  Gene Ontology: Mol. function=protein serine/threonine kinase activity; Cellular component=membrane; Biological process=protein amino acid phosphorylation
  Homolog annotation: Hit_ID=Q9AWQ0; Match level="QueryCoverage=91%, HitCoverage=27%, E-value=4e-72, Identity=92%"; Hit description =Receptor protein kinase PERK1-like protein
  Pfam annotation: Domain name=Pkinase; Domain location=2-154; Score= -46.1; E_value=8.1e-06; Accession=PF00069.15; Description=Protein kinase domain
  Pfam annotation: Domain name=Pkinase_Tyr; Domain location=1-152; Score=-93.8; E_value=1e-06; Accession=PF07714.7; Description=Protein tyrosine kinase
  Pfam module annotation: Pfam domain module=Pkinase::Pkinase_Tyr; Domain location=2-154::1-152
MNCMLINLLLGGWMLVYEYVNNGNLEQWLHGAMRHHGYLTWEARIKILLGTAKALAYLHEAIEPKVVHRDVKSSNILIDDDFNAKVSDFGLAKLLGAGKSYVTTRVMGTFGYVAPEYANTGLLNEKSDVYSFGVLLLEGITGRDPVDYGRPANE

SEQ ID NO: 131841 - protein, 76 aa, Glycine max
  Coding DNA Sequence Number=SeqID_15063
  Subcellular localization annotation: CTP_CleavageSite=53; ConfidenceScore=5.07e-01
MATAALSSIVQQQQAEPEAVAVPSPSAWKSSGSFGPFFAVITVFIILSVLSCYLGRKWNRRPIENTIGEYQRKWLF

SEQ ID NO: 131842 - protein, 737 aa, Glycine max
  Coding DNA Sequence Number=SeqID_15064
  Gene Ontology: Mol. function=zinc ion binding; Cellular component =endoplasmic reticulum; Biological process=ER to Golgi vesicle -mediated transport
  Homolog annotation: Hit_ID=Q9SFU0; Match level="QueryCoverage=73%, HitCoverage=52%, E-value=0.0, Identity=68%"; Hit description=Protein transport protein Sec24-like At3g07100
  Pfam annotation: Domain name=Sec23_BS; Domain location=666-734; Score= 55.8; E_value=1.4e-13; Accession=PF08033.2; Description=Sec23Sec24 beta-sandwich domain
  Pfam annotation: Domain name=Sec23_trunk; Domain location=424-664; Score=408.9; E_value=7.5e-120; Accession=PF04811.5; Description =Sec23Sec24 trunk domain
  Pfam annotation: Domain name=zf-Sec23_Sec24; Domain location=357-393; Score=54.4; E_value=3.7e-13; Accession=PF04810.5; Description =Sec23Sec24 zinc finger
  Pfam module annotation: Pfam domain module=Sec23_BS::Sec23_trunk::zf -Sec23_Sec24; Domain location=666-734::424-664::357-393
  Subcellular localization annotation: CTP_CleavageSite=54; ConfidenceScore=5.84e-01
MGTENPGRPTFPPSRPASSPFAAAQTVSPFSSTGPVAGSEPPSFRPSPSAPPPQGAMRFSSAGPAAVRPGAPSFRPAPPGRFNDPSVPPPVGPSNAPPAAGPFQQFPPPPFPPTMQPRGPPQPMLPPSIQSPPSQALPFPTSLPAQPQMPSVPMGSPPPPPQSAAPAHLGSNFPPPPPTIQPSFPGYPSKHASPEMQAPPMHSSFPANQGNFGPVPPAASSPFLSHPGGYVPSPPMAPPLGIQPMQQPGSVPPMGAIQGLAEDFNALTLQTRPGTMDPLFDAKELPRPLEGDVEPKNLVDMYPMNCSPRYLRLTTSAVPSSQSLASRWHLPLGAVVCPLAEPPDGEEVPIVNFAPASVVRCRRCRTYVNPYMTFTEAGRKFRCNICTLLNDDATGKRVDINQRPELTKGTVEFVAPAEYMVRPPMPPVYFFLIDVSISAVRSGMIEVVANTIKSCLDELPGFPRTQIGFATFDSTIHFYNMKSSLTQPQMLVVSDLDDIFIPLPDDLLVNLSESRNVVETFLDSLPTMFQDNVNLESAFGPALKAAFMVMSQLGGKLLIFQNTLPSLGVGRLKLRGDDSRVYGTDKEYGLRLPDDPFYKQMAAEFSKYQISTNVYAFSDKYTDIASLGTLAKYTAGQVYYYPAFQSAIHGEKLRHELRRDLTRETAWEAVMRIRCAKGVRFTTYHGNFMLRSTDLLALPAVDCDKAFAMQLSLEETLLTTQTMYLQVALLYPFFDNF

SEQ ID NO: 131843 - protein, 161 aa, Glycine max
  Coding DNA Sequence Number=SeqID_15065
  Gene Ontology: Mol. function=calcium ion binding; Cellular component =flagellin-based flagellum; Biological process=ciliary or flagellar motility
  Homolog annotation: Hit_ID=Q9LI84; Match level="QueryCoverage=98%, HitCoverage=98%, E-value=2e-47, Identity=60%"; Hit description =Calmodulin-like protein
  Pfam annotation: Domain name=efhand; Domain location=12-40; Score =25.4; E_value=0.0002; Accession=PF00036.22; Description=EF hand
  Pfam annotation: Domain name=efhand; Domain location=123-151; Score =39.1; E_value=1.5e-08; Accession=PF00036.22; Description=EF hand
  Pfam annotation: Domain name=efhand; Domain location=48-76; Score =16.4; E_value=0.11; Accession=PF00036.22; Description=EF hand
  Pfam annotation: Domain name=efhand; Domain location=87-115; Score =30.7; E_value=5.3e-06; Accession=PF00036.22; Description=EF hand
  Pfam module annotation: Pfam domain module=efhand::efhand::efhand::efh and; Domain location=12-40::123-151::48-76::87-115
MSSKLQVQQLNQLREIFGRFDMDSDGSLTMLELAALLRSLGLKPSGDQVQALLANMDSNANGKVEFDELIRAILPDINAQVLLNQEQLLGVFKCFDRDGNGYISAAELAGAMAKMGQPLTYRELTEMIKEADTDGDGVISFTEFATIMARSASDFLGLSFC

SEQ ID NO: 131844 - protein, 113 aa, Glycine max
  Coding DNA Sequence Number=SeqID_15066
MAWPLHGEKNRGGSGSASEFKTEKIMVVGCCQKYWRMKISNLPPTNPQNVTALRQNGISKMLPCSAIIAGYFHCDCNCSHHSKMHHHANFVAAQGCTTPLYHTINERHTKAGH

SEQ ID NO: 131845 - protein, 1227 aa, Glycine max
  Coding DNA Sequence Number=SeqID_15067
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=98%, HitCoverage=98%, E-value=0.0, Identity=78%"; Hit description=ATPase, E1-E2 type
  Pfam annotation: Domain name=E1-E2_ATPase; Domain location=108-391; Score=-108.0; E_value=0.0029; Accession=PF00122.10; Description=E1 -E2 ATPase
  Pfam annotation: Domain name=Hydrolase; Domain location=420-901; Score=24.1; E_value=0.00049; Accession=PF00702.16; Description =haloacid dehalogenase-like hydrolase
  Pfam module annotation: Pfam domain module=E1-E2_ATPase::Hydrolase; Domain location=108-391::420-901
MAGGRRRRHHFSRIHAFTCGRASMKEEHSLIGGPGFSRKVYCNDPEHATASLLNYGDNYVRTTKYTLATFLPKSLFEQFRRVANFYFLVCAVLSFFPVSPYSGISNVVPLLVVVAATMVKEFIEDFSRKKQDIEMNNRKVKLHRGGGVFDYSKWRDLKVGDVVRVEKDEFFPADLILLASNYDDAICYVETMNLDGETNLKLKQALEATSKLHEDSNFQNFRAVIKCEDPNANLYTFVGSMELEDQQYPLAPQQLLLRDSKLRNTDFVYGVVIFTGHDTKVMQNATDPPSKRSKIEKRMDKIIYCLFFVLILISFIGSIFFGIATNDDLENGRMKRWYLRPDDTEIYYDPNEPVAAAILHFFTALMLYGYLIPISLYVSIEIVKVLQSVFINQDVHMYYEETDKPAHARTSNLNEELGQVDTILSDKTGTLTCNSMEFIKCSIAGVAYGQRVTEVERALSGRHESHPGQVLEKISESKSSIKGFNFMDERVMNGNWIKEPNANVIQNFLQLLAVCHTAIPEVDEETGKVSYEAESPDEAAFVIAARELGFEFYERTHTTISLHELDPISGQKINRSYKLLNILEFTSARKRMSVIVRDAEGKLLLLSKGADSVMFERIAKNGRDFEEKTKQHISEYADSGLRTLILAYRELNEEEYNKFSKEFTEAKNLVSEDQEQIVEGIVQNIEKDLILLGATAVEDKLQDGREARLALFLCRSVQPNTILCRGVPECIDKLAQAGIKLWVLTGDKMETAINIGFACSLLRQGMKQIIISSDTPETKSLEKMEDKSAAEAAIKSSVLRQLREAKALLSTSDENYEALALIIDGKSLTYALEDDVKDLFLELAIGCASVICCRSSPKQKALVTRLVKMRTGSTTLAIGDGANDVGMLQEADIGIGISGVEGMQAVMSSDIAIAQFRFLERLLLVHGHWCYRRISSMICYFFYKNIAFGFTLFFFEIYASFSGQAAYNDWFMSLYNVFFTSLPVIALGVFDQDVSSKLCLKFPLLYQEGVQNILFSWKRIIGWALNGVVTSAIVFFFCIRSMEYQAFRKGGEVMGLEVLGATMYTCVVWVVNCQMALSISYFTYIQHIFIWGSILFWYIFLLAYGAIDPSFSTTAYKVFIEALAPAPFFWIITLLILIASLLPYFIYASIQMRFFPMYHQMIQWMRNDRQTSDPEYCNVVRQRSIRHTTVGFTARLEASKRFEASRRVEAFNPFEASKRSQGKSEDR

SEQ ID NO: 131846 - protein, 772 aa, Glycine max
  Coding DNA Sequence Number=SeqID_15068
  Gene Ontology: Mol. function=RNA binding; Cellular component =intracellular; Biological process=RNA processing
  Homolog annotation: Hit_ID=Q9FN46; Match level="QueryCoverage=86%, HitCoverage=70%, E-value=1e-152, Identity=47%"; Hit description =Genomic DNA, chromosome 5, P1 clone:MYJ24
  Pfam annotation: Domain name=Surp; Domain location=182-225; Score =52.9; E_value=1.1e-12; Accession=PF01805.10; Description=Surp module
VYVLNPKQDLHGLGFDPYKHAPEFREKKRSRLASKGGPGFSTRDGLFGKAAPGFGIGALEELDAEDEDVYATGYEFEDAYVQEVEEPLTLRLENQRKEVEEPSTLRLESHRKKEQKDQGDLPGFRVASNSDYKMERFEAPLIPKDFVPHHEFSGPLDINRKSYEVNPPDVPPPEDGNLKLLIEGVANLVAKCGKLYEDLSREKNQSNPLFNFLSGGTGHEYYARKLWEAQQKHNNQTSRQLDRKMPPSVQRLTAESRGQILGEKPLEKSSQDLSSSVASTDIHLQFNLTDTFIESASLSELMNVEKPFKDDPAKQERFEQFLKEKYKGGLRSASSSLAGDMSEVARAQERLSFEAAAEAIEKGRQVRGSKPLIPSSVDFIPGGVMQFTSGEVKPKKDLQAEDILKKKMYPKREEFQWRPSPLLCKRFDLIDPYMGKPPPAPRIRSKMDTLIFTSDSVKGAKVDEPVTSKKDISPLQLSTNKDITISITENEMEGDVEVENIERPVDLYKAIFSDDSDDEGPSNRRVENQEKKAEVANTALSRLIAGDFLESLGKELGIEVPPDMPYAMQKSRNVAPQKDIFNEDARTDILKSENNGVMSLNHDLPNDQQHIAHEGGPSKGDDTIDGNMLESSINKTKGTSSQDNDSCSEERSKKQSNREKYNEYRKDKTPVTHGWDYSSSSKLEEERSRKCSRHHRHKKRHAGSHSSSDDDRRDRHSSRSKGRRKGSSQEKSRSEKHSKHHKHRKHESPNRSSRYSKEKDNSHSRKEKRRGE

SEQ ID NO: 131847 - protein, 96 aa, Glycine max
  Coding DNA Sequence Number=SeqID_15069
MDLILLISVLAKGEDESAWEKVTGKRALGSVGCPNRMRARTGSLILHVFFALAPPLPSTTTIFDSAFSDSSFVVTGRIMEPMDIVGKSKEDASLPK

SEQ ID NO: 131848 - protein, 194 aa, Glycine max
  Coding DNA Sequence Number=SeqID_15070
  Gene Ontology: Mol. function=RNA binding; Cellular component =intracellular; Biological process=RNA processing
  Homolog annotation: Hit_ID=Q9FN46; Match level="QueryCoverage=98%, HitCoverage=22%, E-value=8e-76, Identity=69%"; Hit description =Genomic DNA, chromosome 5, P1 clone:MYJ24
  Pfam annotation: Domain name=DUF1604; Domain location=36-124; Score =192.1; E_value=1.3e-54; Accession=PF07713.3; Description=Protein of unknown function (DUF1604)
MESDEDDFVFYGTPIEREDDSISRKKKAIAESSGQLRTLPAWKQEVRDEEGRRRFHGAFTGGYSAGYYNTVGSKEGWAPQSFKSSRKNRAEFKEQNILNFLDEDEKTELEGRFLGTTSQFDTFGFTAAEIARKQAEKEQKQRPSIIPGPAPDEIVVPATESVGVKLLLKMGWSHGRSIKDSHSEALYGMASYYH

SEQ ID NO: 131849 - protein, 105 aa, Glycine max
  Coding DNA Sequence Number=SeqID_15071
MEKLAILIQEHVQLGLWHPVVPTRKVSGISSLFGTTLLKDLSNLILLRGQGGIRNLVVESDSTMALKMISEGVSITHAFAALVNSIRSYCDKGNFVADSLASGFA

SEQ ID NO: 131850 - protein, 76 aa, Glycine max
  Coding DNA Sequence Number=SeqID_15072
GGGGSKQVRMKETSSSTCVRRISMLAKRVLNLHAKEEVKEYAHLEEGVRLSSAIDHSDPYGNQKKSQHQHQLQRNA

SEQ ID NO: 131851 - protein, 119 aa, Glycine max
  Coding DNA Sequence Number=SeqID_15073
MFAETRARMNGGAIASKQPDADQKAIVLCLFVTLMNTGNLETEAYQFNLTNMCHENSVMVNLMSPWCAFTLEDMDAAEECAKSMSSFNSDGFVFCLFLVLTLVYFNPFFTVLGHQVKRV

SEQ ID NO: 131852 - protein, 587 aa, Glycine max
  Coding DNA Sequence Number=SeqID_15074
  Gene Ontology: Mol. function=ATP-dependent helicase activity; Cellular component=nuclear envelope; Biological process=ribosome biogenesis and assembly
  Homolog annotation: Hit_ID=Q84T03; Match level="QueryCoverage=86%, HitCoverage=85%, E-value=0.0, Identity=63%"; Hit description =Putative RNA helicase
  Pfam annotation: Domain name=DEAD; Domain location=111-282; Score =235.7; E_value=9.8e-68; Accession=PF00270.19; Description=DEADDEAH box helicase
  Pfam annotation: Domain name=Helicase_C; Domain location=352-428; Score=100.0; E_value=7.3e-27; Accession=PF00271.21; Description =Helicase conserved C-terminal domain
  Pfam annotation: Domain name=ResIII; Domain location=107-277; Score= -25.2; E_value=0.0059; Accession=PF04851.6; Description=Type III restriction enzyme, res subunit
  Pfam module annotation: Pfam domain module=DEAD::Helicase_C::ResIII; Domain location=111-282::352-428::107-277
MAETEDTLQASPMNETEKKMKKNNKKSDKKRSRDIATEERPEEEENENNTDSDGESSKKKKKKVEGESEVEEKKVKNNGGSGIMSTESFESLGLSEPTYKAIMDMGFHHMTQIQARAIPPLLIGKDVLGAARTGSGKTLAFLIPALELLYNVKFTPRNGAGVIVICPTRELAIQTHAVAKELLKYHSQTLGLVIGGSARKIEAERLAKGINLLVGTPGRLLDHLQNTKGFMYKNLKCLMIDEADRILEANFEEEMKQIIKILPKNRQTALFSATQTKKVEDLARLSFQTTPIYIDVDDGRTKVTNEGLLQGYVVVPCAKRFIVLYSFLKRHQSKKVMVFFSSCNSVKFHADILNLIQLNCSSIHGKQKQQTRTTTFFDFCKAEKGILLCTDVAARGLDIPAVDWIVQYDPPDEPKEYIHRVGRTARGEGGKGNALLFLIPEELQFLCYLKAAKVPVKEYAYDEKKVANVQSHLYQLQIILQRIIWIIQENLVVNNFYLNKMAKEAYRSYILAYNSHSMKDIFNVHRLDLQAVASSFSFSNPPNVSLNINSSKQRNKMRKVDGSRHGFNDNNPYGKKNADDKRQFVRH

SEQ ID NO: 131853 - protein, 116 aa, Glycine max
  Coding DNA Sequence Number=SeqID_15075
  Gene Ontology: Mol. function=electron carrier activity; Cellular component=membrane; Biological process=electron transport
  Homolog annotation: Hit_ID=Q9ZNX8; Match level="QueryCoverage=97%, HitCoverage=62%, E-value=3e-27, Identity=55%"; Hit description=NtEPc precursor
  Pfam annotation: Domain name=Cu_bind_like; Domain location=1-57; Score=48.3; E_value=2.6e-11; Accession=PF02298.8; Description =Plastocyanin-like domain
FKYERDSVMVVTEEEYEKCKASRPLFFSNNGDTVFKFDRPGLFYFISGVSGHCDRGQRMIIKVLDVEPAAPPPQSANEDAQKPPHKKNGVAEMIPMSIITTSTLFVLSTFVLQLYA

SEQ ID NO: 131854 - protein, 85 aa, Glycine max
  Coding DNA Sequence Number=SeqID_15076
  Gene Ontology: Mol. function=protein kinase activity; Biological process=protein amino acid phosphorylation
  Homolog annotation: Hit_ID=Q14K69; Match level="QueryCoverage=76%, HitCoverage=63%, E-value=5e-25, Identity=87%"; Hit description =Shaggy/glycogen synthase kinase-3 like protein
MASVGVAPTSSGLRESSGVDRLPEEMNDMRIRDDKEMEATVVDGNGTETGHIIVTTIGGRNGQPKQVFLLPSFSPNMYCAVETGM

SEQ ID NO: 131855 - protein, 216 aa, Glycine max
  Coding DNA Sequence Number=SeqID_15077
  Gene Ontology: Mol. function=lyase activity; Biological process=DNA integration
  Homolog annotation: Hit_ID=Q1S9U9; Match level="QueryCoverage=92%, HitCoverage=73%, E-value=5e-82, Identity=71%"; Hit description =Rhamnogalacturonate lyase
  Pfam annotation: Domain name=Rhamnogal_lyase; Domain location=1-216; Score=302.5; E_value=7.7e-88; Accession=PF06045.2; Description =Rhamnogalacturonate lyase family
MPFISRRGLRETLAKQSTTSKSGVMVNSNNREQLVVDNGIVAVTFSRPEGYILGISYNGIDNILEEENEDQDRGYLDVVWNTPGKPSNFQRIHGTIFSVIAADENMVELSFSKSWTSSLNGSSVPMNIDIRYILRSGDSGFYSYAIFDRPEGLPAVEIDQIRIVFKLNKDRFNYMAISDERQRSMPTMRDRETGQILAYPEAVLLTRPINPEFRGE

SEQ ID NO: 131856 - protein, 443 aa, Glycine max
  Coding DNA Sequence Number=SeqID_15078
  Gene Ontology: Mol. function=carboxypeptidase activity; Biological process=DNA integration
  Homolog annotation: Hit_ID=Q1S9U8; Match level="QueryCoverage=98%, HitCoverage=87%, E-value=0.0, Identity=78%"; Hit description =Carboxypeptidase regulatory region
VDDKYQYSCENKVNTVHGWISVDAADAPPVGFWMITPSSEFRNAGPIKQDLTSHVGPITLSMFVSTHYAGKEVTMAFQEGEIYKKVFGPVFAYVNNASNEDDTLSLWSDAVQQQSKEVRSWPYDFPKSVDFIPPNQRGIVLGRLLVQDRYFRGGRLLYANNSYVGLALPGDEGSWQIESKGYQFWTQADTKGFFLINNVVPGDYNLYAWVPGFIGDYRYNATITITPGGVIRLDSLVYVPPRNGPTIWEIGFPDRKAAEFYVPEPYPTLMNKLYNEQRRDKFRQYGLWERYTDLYPNDDLVYTVGISKYRKDWFFAHVTRSTGNKTYQPTTWQIIFEHPNQIIRGNYTLQLALACTADADLQVRVNDPSANPPDFATGKIGGDSAIARHGVHGLYRLFSINVPSDRFVKGTNTIYLRQSRAMNPFQGVMYDYIRLERPPLTQI

SEQ ID NO: 131857 - protein, 151 aa, Glycine max
  Coding DNA Sequence Number=SeqID_15079
  Gene Ontology: Mol. function=RNA-directed DNA polymerase activity; Biological process=RNA-dependent DNA replication
MEQRVAGSKEKPFPTPIYVIRTLWGRVLGSKYEGWKGWEVNEVRALDSIWWRDLKIVCGWGSEGWFDRRIEWKIEDGRNTRFWANTWMGEDNLRNSFPRLFLNSEQNMGLVSDMGNWNNGSWLWEVRWLRPWLEWEKHEERSSIIYWKGLR

SEQ ID NO: 131858 - protein, 58 aa, Glycine max
  Coding DNA Sequence Number=SeqID_15080
MPLSEKVETGLSGCNVSYTHTCTIFAFPALSPPKLLPFASLPSVCCIHSESPSIFSTR

SEQ ID NO: 131859 - protein, 125 aa, Glycine max
  Coding DNA Sequence Number=SeqID_15081
  Gene Ontology: Mol. function=nucleic acid binding; Biological process= apoptosis
MTLQLADRSITRPYGVIEDVLVRVKHFIFPTDFVVMDISEDTNILVILGRPFMLTASCIVDMGKRKLELGFEDQKIDFDLFVEDKPAPQHNVCLQVMEGGQEVLKIIGNLLYNLYIGVYQPIFEC

SEQ ID NO: 131860 - protein, 73 aa, Glycine max
  Coding DNA Sequence Number=SeqID_15082
MGAKYLEVVKRGSHPNNGWSLDEIRHEKRAKRNSNPRGNCAKQELLCLAQEELRLARIVVLCANNNPRGNCTE

SEQ ID NO: 131861 - protein, 81 aa, Glycine max
  Coding DNA Sequence Number=SeqID_15083
MERYLQHLVCQQAANHRGLSQQGQGFAPFACLTPEQFRAEVTWPEAQVGEAPAGSPDDAEEARMDEEMSDLLGFLGGSEAT

SEQ ID NO: 131862 - protein, 118 aa, Glycine max
  Coding DNA Sequence Number=SeqID_15084
MESVLVVVYYNGDIISSSEGVSFEYPIGSKVVRISEDMMLDALRKTIMNTIGEFVELKRDNDVRKMFFFIFSKFSSKGLIELNATFGQSPDEVFVLLCKPRKPRSTDEIIVLVHDKYV

SEQ ID NO: 131863 - protein, 149 aa, Glycine max
  Coding DNA Sequence Number=SeqID_15085
MVVAVLRCGEGGEGNGLTDSSLWIVNPYERLTITDSQSLYGKYSSDGGRWVMCLLRQRETNGGGGKGEFGFVTIDGIIDVGTMEKLLNTIWIGMFKLRVNARQVDRFVKGMVHKITSANRKGERGVKRHGKRNGRIYVDVVRRDKKRLI

SEQ ID NO: 131864 - protein, 76 aa, Glycine max
  Coding DNA Sequence Number=SeqID_15086
MALSEPSRTESPQKLKVAKKGGVEETSLPPCNMYFASKNPYCSLKVRKMQGSCMSEHNMQTMKIECMQWAEQKHAK

SEQ ID NO: 131865 - protein, 118 aa, Glycine max
  Coding DNA Sequence Number=SeqID_15087
  Gene Ontology: Mol. function=DNA binding; Cellular component=nuclear origin of replication recognition complex; Biological process=DNA replication
  Homolog annotation: Hit_ID=Q9ZVH3; Match level="QueryCoverage=78%, HitCoverage=24%, E-value=3e-11, Identity=40%"; Hit description =Origin recognition complex subunit 6
MMNIGRVKSALARIIGFDVSSFGHSVEPHCKGSIDENVESHGANFQAYERFCNLTLITQNKELQNRIKWNGMERKGAYDSDDGGIELNIIEAGEPDNFLDDEFGMEEEEEPQTIRRRT

SEQ ID NO: 131866 - protein, 124 aa, Glycine max
  Coding DNA Sequence Number=SeqID_15088
MVIQKNHLPESFQNNVFRNKVLLEEPNGHPEEPSSEKFPEQHLPKTFRNKVLPDDHLILLKEPYSGNFPEEVFLELSEEVVLPESSRKTVLLEEPNVPGCLNSQGIFGLNVPGGHWKFIYHWLN

SEQ ID NO: 131867 - protein, 231 aa, Glycine max
  Coding DNA Sequence Number=SeqID_15089
  Homolog annotation: Hit_ID=Q10JZ5; Match level="QueryCoverage=46%, HitCoverage=57%, E-value=1e-10, Identity=37%"; Hit description=ZIM motif family protein, expressed
  Pfam annotation: Domain name=Zim; Domain location=81-116; Score=69.0; E_value=1.5e-17; Accession=PF06200.4; Description=ZIM motif
MAAGVTVKSEVLESSPPEGVCSNTEENHLVQTNLSDGSPNKGFCLIGDMYREGCLIGKKRRSKDSGFQLCLSVPASGLNAVIPSANQLTIFYNGSVCVYDGIPAEKVHEIMLIAAAAAKSTEMKKIVTQTTLISPVPSRPSSPHGITNNIASSQKSSICRLQAEFPIARRHSLQRFLEKRRDRLGSKAPYPSSSTTKVADNIENNFCADNAPELVSLNRSEEEFQPTVSAS

SEQ ID NO: 131868 - protein, 85 aa, Glycine max
  Coding DNA Sequence Number=SeqID_15090
MEKEMITLIVDTLLVFYYEKVVGYTPSNFADLIFAGKTIEVGLKRGKFDHHALTNEKIGTNRGDEVEEGNHVVAVIPTWPSFPPA

SEQ ID NO: 131869 - protein, 46 aa, Glycine max
  Coding DNA Sequence Number=SeqID_15091
MVNDSFFLGDPIVPSSEDRDGNSHPGSRLSERPDMMYARVLVCPTV

SEQ ID NO: 131870 - protein, 49 aa, Glycine max
  Coding DNA Sequence Number=SeqID_15092
MGFPLPAVIYPAENLSDFSIRYSLSLEEIMLSFSSGERMRILFMGQGSK

SEQ ID NO: 131871 - protein, 90 aa, Glycine max
  Coding DNA Sequence Number=SeqID_15093
PVEWILPTPTPYRLVEPVQLIEVSSSEEDLEEDLDELPPEPAMDAPDLPEDGEDPLPDVDSPEDIMSASEADSTEESGPGGTTNSDDSPS

SEQ ID NO: 131872 - protein, 111 aa, Glycine max
  Coding DNA Sequence Number=SeqID_15094
MESMKDQMTSMMEAMLSMRWMMEDNAAAVVATSAATEADPTHPSSINQTSRPIPNMVGRGGEVLGRIGSPHMVQNKNSFPPYGLPPHYTLPNAVHVPNENANHSVPIPLEG

SEQ ID NO: 131873 - protein, 147 aa, Glycine max
  Coding DNA Sequence Number=SeqID_15095
  Homolog annotation: Hit_ID=Q1SKD7; Match level="QueryCoverage=95%, HitCoverage=37%, E-value=7e-14, Identity=31%"; Hit description =Ankyrin
MSFTKGKMFVNEMAPKKLSTKRSRRDAIGEGSSTALEFDSHRFRSAEHQQRFEAIRGWSFHKERRVQLRENEYTDFQEEIARRHWTPLVTPMAKFDPKIVLEFYANAWPTEEGVRDMRSWVRGQWIPFDADALSQFLGDPLVLEEDQ

SEQ ID NO: 131874 - protein, 201 aa, Glycine max
  Coding DNA Sequence Number=SeqID_15096
  Homolog annotation: Hit_ID=Q1T493; Match level="QueryCoverage=72%, HitCoverage=27%, E-value=2e-12, Identity=32%"; Hit description =Nucleic acid-binding, OB-fold, subgroup
EVVFGQVSGKGRRVVFKLKDLSQQLLSCTLWDDYCLQFLKFLDDYEGDGPITVLLTHGRIKEAQGSYPPSVSNFFKVSKLIINQPVMEIQEFNEWLAELGIEARSGFKSHGEGSTQLSGSIQLSSKEPFFGKTEAKTIDDINTISELAFSAIKKSDAEMVPFTCACGKYNKEVVLRYRLEVMINQEMKAQNSCFGTVNAVN

SEQ ID NO: 131875 - protein, 76 aa, Glycine max
  Coding DNA Sequence Number=SeqID_15097
MAVEWRRKRERRRHFKENMNLEEVQQHRRPWIRAWRKKEMNEGREREEHEILCSKGALKSEPTNPRSITRFSTKCA

SEQ ID NO: 131876 - protein, 57 aa, Glycine max
  Coding DNA Sequence Number=SeqID_15098
MASIIAAICSFMGSMSASIYSCTSSALPITLALAQKWVYDPNMVGSWYLTHVTKNAA

SEQ ID NO: 131877 - protein, 94 aa, Glycine max
  Coding DNA Sequence Number=SeqID_15099
MKSLRPGSDATKYCRFHRDIEHNTKDCWALNGKIEEFIQAGYLAQFVKRPDHYQEGARPKGHQEEQHKNQEVDKRRLEDRGRQRQQPQRHERPP

SEQ ID NO: 131878 - protein, 80 aa, Glycine max
  Coding DNA Sequence Number=SeqID_15100
MVETSQINTKRGVKDKAPNTLPMKGLFVTKLESNEVLLSPIALKVVGPLLLDSNSSRDGTNPPSNSLYDNPQTRKQRDKK

SEQ ID NO: 131879 - protein, 138 aa, Glycine max
  Coding DNA Sequence Number=SeqID_15101
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=95%, HitCoverage=35%, E-value=2e-58, Identity=69%"; Hit description =Ribulose bisphosphate carboxylase large chain precursor
  Pfam annotation: Domain name=RuBisCO_large_N; Domain location=21-136; Score=140.6; E_value=4.1e-39; Accession=PF02788.6; Description =Ribulose bisphosphate carboxylase large chain, N-terminal domain
MSPQTETKASVGFKAGVKDYKLTYYTPDYETKDTDILAAFRVTPQPGVPPEEAGAAVAAESSTGTWTTVWTDGLTSLDRYKGRCYGLEPVAGEENQYIAYDLRIPTAYIKTFQGPPHGIQVERDKLNKYGRPLYRMYY

SEQ ID NO: 131880 - protein, 96 aa, Glycine max
  Coding DNA Sequence Number=SeqID_15102
MGTNQTSKRFYQVKVKGLDTTSIKELGRVHRGHCVTPQYYDQPLRCFTFGDFQLVPTIEEFEEILGCPLGGKKTISFLRVSPLFEQNCDCGQRFSK

SEQ ID NO: 131881 - protein, 154 aa, Glycine max
  Coding DNA Sequence Number=SeqID_15103
MTSRDQVWSFCTQDTRRYLTVIRTLLSSRGGGPDDKQRPSLVILHPRYAEIPYGYLHPFARQTQLCPMASRDQVWSFCTQDTRRYLTVICTPFARQTQLCPMASRDQVWSFCTQDTRRYLTVICTPLLGRHSCVRWQAETKFGHSAPKIRGDTL

SEQ ID NO: 131882 - protein, 95 aa, Glycine max
  Coding DNA Sequence Number=SeqID_15104
MYEYPRRTRALTRKHSFQNSYGYSCFVGKTEMAPKKLSTKRSRRGATGEGSNAAPEFDSHRFRSAEHQQRFKAIRGWSFDRERRVQLREDEYADF

SEQ ID NO: 131883 - protein, 50 aa, Glycine max
  Coding DNA Sequence Number=SeqID_15105
MVSNVVLKFHDDPTVNESKIVVFLRQVRWHAGEGFGRREKKQHCEAEEAE

SEQ ID NO: 131884 - protein, 154 aa, Glycine max
  Coding DNA Sequence Number=SeqID_15106
MPRSSNLAQDSEEDLILMWAFLTDHPIDWAHLIRYRLHKALRSVKCSFAIGADAVTSFGYRKDMDGQLLKKDAQPPRDERTPSSPPQQDDSSALMNEVLSELRGLRTYVGEHFDSLDGRIDAIDARFEGMDTRITQLEKDVSYLRRCFDLPPRS

SEQ ID NO: 131885 - protein, 83 aa, Glycine max
  Coding DNA Sequence Number=SeqID_15107
MTVIECSTYAWGPAVLAYLYREMCSATYKTKSIGVFVEVLHNKCYVSVTSNLFDWKCSVAWCTVVSLICFHVVEWHQPDKVLR

SEQ ID NO: 131886 - protein, 142 aa, Glycine max
  Coding DNA Sequence Number=SeqID_15108
  Pfam annotation: Domain name=Transposase_23; Domain location=37-107; Score=-1.8; E_value=0.0018; Accession=PF03017.5; Description =TNP1ENSPM transposase
MQSHELALPLEPKVGPSAACVSTKGSCVDPSPTDPETGDSDKCGLYIEENLSHLVAQGRVYEGSTIVHNIPLLHGQVMVGVEEVKDAEAPVLVPTDEVILVGQVLNTFLAWPTHLVKRLSQQLCLQQNLQMGRMLRYMIPYI

SEQ ID NO: 131887 - protein, 73 aa, Glycine max
  Coding DNA Sequence Number=SeqID_15109
MIVDQSLFFSLTKLPSQGAPFEGTIVDDWKFDYSSHDARRMVCNDQTDMCNDPPRRYEVILSQHKFIQQHAIT

SEQ ID NO: 131888 - protein, 76 aa, Glycine max
  Coding DNA Sequence Number=SeqID_15110
MKLCFYTLMVKEECKEVSVSSKRLARKESHFEIKKNIKEASPLKQPPHLLLCKKTLVSTATPLGLEVIPQVKELLD

SEQ ID NO: 131889 - protein, 128 aa, Glycine max
  Coding DNA Sequence Number=SeqID_15111
MARRRARFEFAHHGGCRPDGGIRFTLATVLVAAIVTALASIIFFMLIMASIIVAIFSFMASMSAFTFSCTSSALQIFNLVHDIFVKVKLEVTGTSTALNVFGSRRSSDVTRSIFCPNFLQDGYFHTST

SEQ ID NO: 131890 - protein, 263 aa, Glycine max
  Coding DNA Sequence Number=SeqID_15112
  Homolog annotation: Hit_ID=Q1XWH5; Match level="QueryCoverage=41%, HitCoverage=69%, E-value=4e-22, Identity=42%"; Hit description =Hypothetical protein precursor
  Pfam annotation: Domain name=DUF393; Domain location=140-248; Score =22.3; E_value=1.4e-06; Accession=PF04134.3; Description=Protein of unknown function, DUF393
MKKILIILLVAFIIIQFFPIDKTNPPLNPGMDFLKIKKTQPEVAKLIRTSCYDCHSNETKYPWYSSIAPSSWFLKNHIDEGRKNLNFSTFAMYEPERQAHKLQECIEMIEKEEMPLESYIVGHQDAKLTPEQRKQLIQYFKKVKAETERSMWILERDKKNKFLFASLQSDFGQKFLSERGLETTVFNTMYLWKPNQYYLVKSRAVLQIAQLLGGVYQLIAAGKIIPTFLSDQVYDLISRNRMKLAAQKCYLPDQNQKRKFIEV

SEQ ID NO: 131891 - protein, 260 aa, Glycine max
  Coding DNA Sequence Number=SeqID_15113
  Homolog annotation: Hit_ID=Q6G3N8; Match level="QueryCoverage=88%, HitCoverage=9%, E-value=9e-09, Identity=24%"; Hit description =Filamentous hemagglutinin
  Pfam annotation: Domain name=Fil_haemagg; Domain location=145-210; Score=9.3; E_value=3; Accession=PF05594.4; Description =Haemagluttinin repeat
  Pfam annotation: Domain name=Fil_haemagg; Domain location=3-61; Score= 16.4; E_value=0.11; Accession=PF05594.4; Description=Haemagluttinin repeat
  Pfam annotation: Domain name=Fil_haemagg; Domain location=79-128; Score=2.9; E_value=14; Accession=PF05594.4; Description =Haemagluttinin repeat
  Pfam module annotation: Pfam domain module=Fil_haemagg::Fil _haemagg::Fil_haemagg; Domain location=145-210::3-61::79-128
  Subcellular localization annotation: CTP_CleavageSite=96; ConfidenceScore=5.11e-01
MVASTGDLSVSGSSIAAIGGTFTAGGNASLKANESILLANAKVTAGGNLGLTSNGDINISVTERSTTSTLRDKRSFTTVVRTTSQGSEITAGGSVSANAGGNLNVIGSNIAADGTVGLKATGDVTIAEAIDTTTIDYTYRKKGGLFGGSKQTTSHTETQTVVGSSVSSGKGVSIISGGDTVVSASKVTAGDETDKADINVSAGGDLLIASGKNTAEFEQSSSSKGFLSKKSSTQYNYDEATVSSELSASGNIKLDAGGNA

SEQ ID NO: 131892 - protein, 48 aa, Glycine max
  Coding DNA Sequence Number=SeqID_15114
MLIEDAAARAWRQGEQKADVTRDVLTSWKRLVADRRAWRQGEQKADVT

SEQ ID NO: 131893 - protein, 85 aa, Glycine max
  Coding DNA Sequence Number=SeqID_15115
MTNNEGRRTVETLRKITHGNVTEAPRLGFSSRKQFFSLILRKGRRCLPPSSHRRARLLPPEGTAFWRNILEGPSGPGCYLHPHFY

SEQ ID NO: 131894 - protein, 208 aa, Glycine max
  Coding DNA Sequence Number=SeqID_15116
  Gene Ontology: Mol. function=two-component response regulator activity; Cellular component=intracellular; Biological process=two -component signal transduction system (phosphorelay)
  Homolog annotation: Hit_ID=Q8GMB9; Match level="QueryCoverage=77%, HitCoverage=74%, E-value=1e-81, Identity=95%"; Hit description =Putative global response regulation activator GrrA
  Pfam annotation: Domain name=Response_reg; Domain location=47-159; Score=140.9; E_value=3.5e-39; Accession=PF00072.14; Description =Response regulator receiver domain
HSMRPSSAPGLFRSCGWATFAHCHAESSAGTPILPAFAGNNSFERGVLLVDDHELVRAGIRRILEDIKGIKVVGEAQCGEDAVKWCRGNAVDIVLMDMNMPGIGGLEATRKIVRYAPDVKVIMLTIHTENPLPAKVMQAGAAGYLSKGAAPQEVINALRSVHAGQRYIAFDIAQQMALSQLEPQAETPFSCLSERELQIMLMITKGKK

SEQ ID NO: 131895 - protein, 85 aa, Glycine max
  Coding DNA Sequence Number=SeqID_15117
MTKASQKGVRKENEGGACHPARLGELGCFLQKAPPSGELPGRPKWAWLLFSPPYLLNTPLPFFADSFSVTLRNLMNYVMILVFFP

SEQ ID NO: 131896 - protein, 50 aa, Glycine max
  Coding DNA Sequence Number=SeqID_15118
MAGTPQGSSLRQSWNTSSRLENGGHVNDSAIHSRGSGKGREWRIALRVLS

SEQ ID NO: 131897 - protein, 119 aa, Glycine max
  Coding DNA Sequence Number=SeqID_15119
RNGNRMLERQLAAEDTLDALHNLASQHFVRSLPLSMFQQQMGYGMYQNGQPAPGPAPAPAPAAAAPGPAPASRVAQKKAACERAEAKAGEDCTLRKLQTFLCDDYDDRQLSLAGGLTAV

SEQ ID NO: 131898 - protein, 175 aa, Glycine max
  Coding DNA Sequence Number=SeqID_15120
  Subcellular localization annotation: CTP_CleavageSite=57; ConfidenceScore=5.22e-01
KNYWNPDDLTVSIRGARRVRARPAELPSTSAAPTPASTSAAPSVPAQRSIPTIEQFLASVAWPEAQPSLHREDEGPIAQVAQHMEDESSEATIPEPFIAKEEAGHFRASCTSGGPILASVEEHAVDPSAPILEILEDSTTLVQTLNTSPLATPVLHLTDDEDVQTQDTQDQSQEF

SEQ ID NO: 131899 - protein, 86 aa, Glycine max
  Coding DNA Sequence Number=SeqID_15121
MVARITLRDGYELRIALGRNGDGMVTLLEIAKNRGRFGLGYKPTNTDKRRTTLERKEKCLACLQGHEPRIERSLSAALAKASGVRD

SEQ ID NO: 131900 - protein, 221 aa, Glycine max
  Coding DNA Sequence Number=SeqID_15122
  Gene Ontology: Mol. function=RNA-directed DNA polymerase activity; Cellular component=nucleus; Biological process=RNA-dependent DNA replication
MGPYKALGLNSFQSIFYLTFWSTVSHDVWELVANSITTGHIHEGLARTLIVLILKNDNPTSLKEFRPISLCNVLLKVVSKVIVNRVRPHSDNIIGSLQSSFIPGMGTYDRVNWRFLELTWNDFGFPPSIIKVIMSLTTSTSLSLKWNNEVLESFKSNRGLRQGDPLSLYLFLLCMEKLALMIHEKVTQKAWQPIKLTKDWLEISHLVFEDDCLLCTTAKSS

SEQ ID NO: 131901 - protein, 421 aa, Glycine max
  Coding DNA Sequence Number=SeqID_15123
  Gene Ontology: Mol. function=zinc ion binding; Cellular component =nucleus; Biological process=regulation of transcription
  Homolog annotation: Hit_ID=Q1SLX9; Match level="QueryCoverage=99%, HitCoverage=89%, E-value=1e-102, Identity=49%"; Hit description=Zinc finger, Dof-type
  Pfam annotation: Domain name=zf-Dof; Domain location=73-135; Score =139.7; E_value=8.2e-39; Accession=PF02701.6; Description=Dof domain, zinc finger
KPSRKELTSTQEDVEASHQTLEETKSPTSSSCNLENPKTPSTERETSILKSFKNGHQSDTTTTCPSQDKTPKKPDKVLPCPRCNSMDTKFCYYNNYNVNQPRHFCKHCQRYWTAGGTMRNVPVGAGRRKNKNTPSVSHFRQIMVPEGLQNGSLHGAVLTFGSDSPLCDSMASVLSLAEKTTQNGVLNGFHSPNTNTITSNKGDEYYDTVMGSTLSEKRHNATTSTNSHEKSLDNHKSYHHQGFTPQLCFPGSSSSSPWPYPWNPTKTPSAFCNPVPFYTTQAFWGCMPPPSWSVNYQSAPSSGPNSPTLGKHSRDGDILFQKPSTDMAENNNNNNTVLIPKTLRIDDPTEAAKSSIWSTLGIKNEKGNSLNGGGLFKAFASKGSSDEKKNNHVMMVEASLSPVLQANPAALSRSLVFHERT

SEQ ID NO: 131902 - protein, 116 aa, Glycine max
  Coding DNA Sequence Number=SeqID_15124
  Gene Ontology: Mol. function=ribonuclease H activity
  Homolog annotation: Hit_ID=Q1SZM6; Match level="QueryCoverage=52%, HitCoverage=20%, E-value=3e-11, Identity=48%"; Hit description =Ribonuclease H
MGRVIRWFPPPNNYIKINTDGSSFGNSGLSGYGGILRNEHGHWIRDFSSLYGFMNNINAKLVAIQKVFSPWPPERKCCLTPLCEGHISALSLWHIMDFYIAYPLLLGADTRYFKFV

SEQ ID NO: 131903 - protein, 169 aa, Glycine max
  Coding DNA Sequence Number=SeqID_15125
  Homolog annotation: Hit_ID=Q0ZCC1; Match level="QueryCoverage=61%, HitCoverage=16%, E-value=8e-16, Identity=42%"; Hit description =Transposase tnp2
MDNGKTKDTHNAQLDLAVISDRKEIELVNIGHAKLFKPKVAYALTKSQRVIICKWVKKLKLLDGFLHSLKSKVKNKARVKGSICEAYLVDETSTFVSFYYPDRIQTRRTSMTHNVDVGEGSSATPPISIFNYLGRVSEKSITYYLDSCDFDAAHLYVLQNCEEVESYLG

SEQ ID NO: 131904 - protein, 41 aa, Glycine max
  Coding DNA Sequence Number=SeqID_15126
MLSPMKNKGEDIESYGNIKARTLSPMKDKGEDVESYGNIKT

SEQ ID NO: 131905 - protein, 82 aa, Glycine max
  Coding DNA Sequence Number=SeqID_15127
MGEKLATQLAKASKVASSRSNRLLEESSGGPKTLRIVHQYFLLISGTSRNFTNCLMMGAKHLKMTKHKLHATKQRSLDEIRA

SEQ ID NO: 131906 - protein, 72 aa, Glycine max
  Coding DNA Sequence Number=SeqID_15128
  Subcellular localization annotation: CTP_CleavageSite=46; ConfidenceScore=5.48e-01
MEVQIAIFKFSNLGSSRIFGKLGCLRRKQRSSPGRGASLTLPRCFREQMREGFPPLFTVLHPFFVRSSFFNL

SEQ ID NO: 131907 - protein, 58 aa, Glycine max
  Coding DNA Sequence Number=SeqID_15129
MDFEICHFMQNNAVKIVQQFFLHSAEKCLCIASHRKSSTSRKNGGAVQVTGKAVYIVF

SEQ ID NO: 131908 - protein, 111 aa, Glycine max
  Coding DNA Sequence Number=SeqID_15130
MRSDCLVQFSILNPFSEPMNWVFVHVSSTHEFGAMCSDCLVQFKESSILTLFSEPMNCVFVHESSTLEFGATLKAILHSPPFSEPMNCVFVHVSSTLEFGAVFHDCLSADP

SEQ ID NO: 131909 - protein, 405 aa, Glycine max
  Coding DNA Sequence Number=SeqID_15131
  Gene Ontology: Mol. function=binding
  Homolog annotation: Hit_ID=Q10P70; Match level="QueryCoverage=93%, HitCoverage=65%, E-value=4e-46, Identity=33%"; Hit description =Armadillo/beta-catenin-like repeat family protein, expressed
  Pfam annotation: Domain name=Arm; Domain location=24-64; Score=8.2; E_ value=1.2; Accession=PF00514.13; Description=Armadillobeta-catenin -like repeat
  Pfam annotation: Domain name=Arm; Domain location=263-303; Score=5.8; E_value=2.3; Accession=PF00514.13; Description=Armadillobeta-catenin -like repeat
  Pfam annotation: Domain name=Arm; Domain location=309-349; Score =14.3; E_value=0.2; Accession=PF00514.13; Description=Armadillobeta -catenin-like repeat
  Pfam module annotation: Pfam domain module=Arm::Arm::Arm; Domain location=24-64::263-303::309-349
LLKEGTSPLAQIAAATTLCHLANDLDRVRVIVSEHGVPAVVQVLSDSPMRVQTLAANLVARMAKHDPVAQEDFARENAIRPLVTLLSFDTFVDDPLGHLGKQSIHSIVQINKELGKGGRGGHQFSSSYSSSYLFTEWSSRGVNHRKERENEDPVVKLQLKVSCAEALWMLVQGSVTNSRKITETKGMLCLAKIVEMEQGELQLNCLMTMMEITAAAEYNADLRRAAFKTNSPAAKSVVEQLLRIIKEVDSPALQIPAMKAIGSLARTFPARETRVIEPLVTQMGNRNAEVADEAVAALAKFASPDNFLHVEHSKTIVEFSGIPALMRLLRSNEVAQMHHGLTLLCYLALHAGNSESLEQARVLIVLEGADRTVLPQHIKELVSMAIIHLNLYHAGMNSQRISYFP

SEQ ID NO: 131910 - protein, 371 aa, Glycine max
  Coding DNA Sequence Number=SeqID_15132
  Gene Ontology: Mol. function=binding; Cellular component=membrane; Biological process=Notch signaling pathway
  Homolog annotation: Hit_ID=Q2DRB8; Match level="QueryCoverage=63%, HitCoverage=86%, E-value=5e-21, Identity=31%"; Hit description=Sel1 -like repeat
  Pfam annotation: Domain name=F-box; Domain location=53-100; Score =20.3; E_value=0.0067; Accession=PF00646.23; Description=F-box domain
  Pfam annotation: Domain name=Sel1; Domain location=132-163; Score =20.7; E_value=0.0051; Accession=PF08238.2; Description=Sel1 repeat
  Pfam annotation: Domain name=Sel1; Domain location=164-197; Score =25.4; E_value=0.0002; Accession=PF08238.2; Description=Sel1 repeat
  Pfam annotation: Domain name=Sel1; Domain location=198-234; Score =3.2; E_value=6.8; Accession=PF08238.2; Description=Sel1 repeat
  Pfam annotation: Domain name=Sel1; Domain location=239-268; Score =0.8; E_value=14; Accession=PF08238.2; Description=Sel1 repeat
  Pfam annotation: Domain name=Sel1; Domain location=269-304; Score =39.3; E_value=1.4e-08; Accession=PF08238.2; Description=Sel1 repeat
  Pfam annotation: Domain name=Sel1; Domain location=305-336; Score =8.3; E_value=1.5; Accession=PF08238.2; Description=Sel1 repeat
  Pfam annotation: Domain name=Sel1; Domain location=95-131; Score =13.7; E_value=0.3; Accession=PF08238.2; Description=Sel1 repeat
  Pfam annotation: Domain name=TPR_2; Domain location=132-165; Score =17.6; E_value=0.045; Accession=PF07719.7; Description=Tetratricopepti de repeat
  Pfam module annotation: Pfam domain module=F-box::Sel1::Sel1::Sel1::Se l1::Sel1::Sel1::Sel1::TPR_2; Domain location=53-100::132-163::164 -197::198-234::239-268::269-304::305-336::95-131::132-165
  Subcellular localization annotation: CTP_CleavageSite=28; ConfidenceScore=5.71e-01
VADLLCTLQQMKHPTWPRTSSSPFSSLPFSNRSEFFTTRLCARPPLPSPPGAGDFSALPYDVLAKIAASFDDPNLRAASLVCRAWCEALRPLREAMALLLWGKRFKHGHRGVGPNPDRALDSFIKAAARGSALAMVDAGLIYWERGEKPKAMEFYHKAAELGNPSAQCNLGLSYLQAEPPNTELAVKWLHKASVCGNVRAQYQLALCLHRGGGRVRSNLKEAVGALSISSPLLIMSEAVNLFFQRGVCVNGLELCLAKWYMKAAEGGYVRAMYNISLCFSFGEGLTRNHQLARKWMKRAADRGHSKAQFEHGLALFSEGDMMKAVVYLELATRAGEKGAAHVKNAVLHRLSSASRDHAMHLANSWRALPSS

SEQ ID NO: 131911 - protein, 815 aa, Glycine max
  Coding DNA Sequence Number=SeqID_15133
  Gene Ontology: Mol. function=copper ion binding; Cellular component =cytosol; Biological process=metabolic process
  Homolog annotation: Hit_ID=Q9XHP4; Match level="QueryCoverage=99%, HitCoverage=100%, E-value=0.0, Identity=78%"; Hit description =Peroxisomal copper-containing amine oxidase
  Pfam annotation: Domain name=Cu_amine_oxid; Domain location=312-793; Score=766.9; E_value=1.2e-227; Accession=PF01179.10; Description =Copper amine oxidase, enzyme domain
  Pfam annotation: Domain name=Cu_amine_oxidN3; Domain location=188 -292; Score=162.6; E_value=1e-45; Accession=PF02728.6; Description =Copper amine oxidase, N3 domain
  Pfam module annotation: Pfam domain module=Cu_amine_oxid::Cu_amine _oxidN3; Domain location=312-793::188-292
MTRAQTCHPLDPLSAAEISVAVATVRAAGATPECVFGSIYFEERVTYVCPLNDNLSKIKVRDSMRFVEVVLVEPDKQVVALADAYFFPPFQPSLLPRTKGGPLIPTKLPPRKARLVVYNKRSNETSIWIVELREVHAATRGGHHRGKVISSEVVPNVQPPMNLNGLGNTCVESLKNLNLYQQANTDVYIQDAVEYAECEAAVKDFPPFREAMKRRGIEDMDLVMVDAWCVGYHSEADAPSRRLAKPLIFCRTESDCPMENGYARPVEGIHILVDMQNMEILEFEDRKLIPLPPADPLRNYTSGETRGGVDRSDVKPLQIIQPEGPSFRVNGHFIQWQKVIVCTLLFLEASSFETCKLWNFRIGFTPREGLVIYSVAYIDGSRGRRPVAHRLSFVEMVVPYGDPNDPHYRKNAFDAGEDGLGKNAHSLKKGCDCLGYIKYFDAHFTNFNGGVETIENCVCLHEEDHGILWKHQDWRTGLAEVRRSRRLTVSFICTVANYEYGFFWHFYQASYCLDSSIRVCLIRLIEWKPWLSPSDIYFKIKNSYKWVSQDGKIEAEVKLTGILSLGALQPGESRKYGTTIAPGLYAPVHQHFFVARMDMAVDCKPGEAFNQVVEVDVKIEEPGKNNVHNNAFYAEEKLLKSESEAMRDCNPLSARHWIVRNTRTVNRTGQLTGYKLVPGSNCLPLAGSEAKFLRRAAFLKHNLWVTPYVPGEMHPGGEFPNQNPRVGEGLATWVQKNRSLEEADIVLWYVFGITHIPRLEDWPVMPVERIGFMLMPHGFFNCSPAVDVPPSASDLDDKENGMSAKPIQNGMIAKL

SEQ ID NO: 131912 - protein, 123 aa, Glycine max
  Coding DNA Sequence Number=SeqID_15134
  Gene Ontology: Mol. function=binding
  Homolog annotation: Hit_ID=Q1SPQ2; Match level="QueryCoverage=98%, HitCoverage=16%, E-value=8e-16, Identity=37%"; Hit description=IMP dehydrogenase/GMP reductase
VEDAEEPHHVAGGGVDVGEDFAEIGGADDGDDAAEDAAALALADEGEGAVEVLGGLSGDAADGALVEGRRDGGGGGGGGEADEGSEHLEEAIDVLPNLGALEFERVRLVHGRANSLRHHNRIY

SEQ ID NO: 131913 - protein, 327 aa, Glycine max
  Coding DNA Sequence Number=SeqID_15135
  Gene Ontology: Mol. function=drug transporter activity; Cellular component=membrane; Biological process=response to nematode
  Homolog annotation: Hit_ID=Q6ZJI2; Match level="QueryCoverage=70%, HitCoverage=48%, E-value=1e-62, Identity=51%"; Hit description =Putative ripening regulated protein DDTFR18
  Pfam annotation: Domain name=MatE; Domain location=123-284; Score =99.9; E_value=7.6e-27; Accession=PF01554.9; Description=MatE
MHSLRYELVEECVDDYDAKPGICELRKAVLEGMSWLKSVLMITMRNLESEGSSRGAEDAQLAGTGKSTLLAAILREPHQIQPQLGSTAVFIAGTPDIAPITSTGDFYREFMVESKKLGYLAGPAIFSFVSKYSLGAFTQIFAGHVGTIDLAAVSVENSLIAGFSYGIMLGMGSALETLCGQAVGAGKLDMLGVYMQRSWVLLLSMAFVLWPMYIFAGQVLKFIGQDTQISEAAGTFAIWMIPQLFAYALNFPVAKFLQAQVLSWLLMVKLELGLVGAAVVLNGSWWWLSWFMCLVGGVGLRGTASRGKRFGISVDSFASLLLLLLCF

SEQ ID NO: 131914 - protein, 64 aa, Glycine max
  Coding DNA Sequence Number=SeqID_15136
MSPQHHLMNVRLQKSMPDTENDDMHYMCFATENDDMHWYFASVDDNMHSLFRAHEPYAAVGWHT

SEQ ID NO: 131915 - protein, 192 aa, Glycine max
  Coding DNA Sequence Number=SeqID_15137
  Subcellular localization annotation: CTP_CleavageSite=45; ConfidenceScore=5.12e-01
MEFAATSLQLVSPIGLAASTPRGSYRQWDQRFSVHVSSYRQCQCRDQPVSPLPLAGHALPPKPTAASMQIRDPLCKLFENIPIYVKNFDNDFSYIGKDDPYSQIKIKWLFSPHAALDHPLSMYLSLVETPCTVMSLQLQPAIIRGAKDTVKLVVAFQIVSLYQVGATQELGNKLVAPPRTTLHFQLNKTFVV

SEQ ID NO: 131916 - protein, 75 aa, Glycine max
  Coding DNA Sequence Number=SeqID_15138
  Gene Ontology: Cellular component=chloroplast
  Homolog annotation: Hit_ID=Q9ME92; Match level="QueryCoverage=64%, HitCoverage=40%, E-value=4e-09, Identity=75%"; Hit description =Hypothetical protein trnI
MVNNFVTEGAFVVTEGVKDQEVSYLSAKHSILLMARSNLLVPVERKKNFSRSSFREGRISKILLIAIFSRPPGKA

SEQ ID NO: 131917 - protein, 459 aa, Glycine max
  Coding DNA Sequence Number=SeqID_15139
  Gene Ontology: Mol. function=ATPase activity, coupled to transmembrane movement of substances; Cellular component=integral to membrane; Biological process=transport
  Homolog annotation: Hit_ID=Q8RY46; Match level="QueryCoverage=88%, HitCoverage=65%, E-value=1e-135, Identity=57%"; Hit description =Transporter associated with antigen processing-like protein
  Pfam annotation: Domain name=ABC_membrane; Domain location=141-410; Score=81.7; E_value=2.3e-21; Accession=PF00664.13; Description=ABC transporter transmembrane region
  Subcellular localization annotation: CTP_CleavageSite=56; ConfidenceScore=5.81e-01
MPLLLARTPPSSLSPFPLQNARAPLITASQKRFPLAATRIVLFTSRRSILASPPPKCASINGVSVPNNPEASGEEQQQVYNASELLERIRKWVGILPSILPGGRWWEFSGDVDVQVVAQPVTVWRALGKMWDLVAGDRWVIFAAFSALIVAAISEISIPHLLTASIFSAQSADLTVYHRNVRLLVLLCVASGICSGIRGCFFGIANMILVKRMRETLYSSLLLQDISFFDNETVGDLTSRLGADCQQVSRVIGNDLNLIMRNVLQGGGSLIYLLILSWPLGLSTLVVCSILAAVMLRYGRYQKKAARLIQEVTASANDVAQETFSLVRTVRVYGTEEEEHGRYKWWLEKLADISLRQSAAYGVWNFSFNILYHSTQVIAVLFGGMSILAGIRLLTLIPSIIVLKLLVLAMMVDIGGHKVQHVNFVVYPGEVVAIVGLSGSGKSTLVNLLLRLYEPTNGQ

SEQ ID NO: 131918 - protein, 195 aa, Glycine max
  Coding DNA Sequence Number=SeqID_15140
  Gene Ontology: Mol. function=ATPase activity, coupled to transmembrane movement of substances; Cellular component=integral to membrane; Biological process=transport
  Homolog annotation: Hit_ID=Q9CAB3; Match level="QueryCoverage=73%, HitCoverage=22%, E-value=3e-57, Identity=79%"; Hit description =Putative ABC transporter; 82503-78258
  Pfam annotation: Domain name=ABC_tran; Domain location=1-135; Score =50.8; E_value=4.6e-12; Accession=PF00005.17; Description=ABC transporter
MFVQEPKLFRMDISSNIRYGCTRDVKQEDIEWAAKQAYAHNFISALPNGYETLVDDDLLSGGQKQRIAIARALLRDPKILILDEATSALDAESEHNVKGVLRSVRSDSATRSVIVIAHRLSTIQAADRIVVMDGGHIIEDRTMKTVIVCSHIFIWFRLSLGASARLLPCELEVTDSNPGNSFSSYWKKTAYIYPS

SEQ ID NO: 131919 - protein, 249 aa, Glycine max
  Coding DNA Sequence Number=SeqID_15141
MLKHVVHSLGLVDKNPRRKSKVRGTKTIPDFGLRSKDLYVRVIHQGGLQDAFPASKLTAKYPGMCVARAQVFMAPHHSVLGPEEHLLLGHKYVIISCKDVEKLKRKHPQQCKTKEHNGVVTLEANIIRSPSGHKPKENDKLSVPNEMINTRTTLSPSECKIHENCEVKEPNILGKEKVNEEMDVCQGGEDIEVHCSAKDFYVGKDKSVRYSRRKGIKVKKPFSPPLPEGRSYRGLGWQPSLVTVQELSP

SEQ ID NO: 131920 - protein, 161 aa, Glycine max
  Coding DNA Sequence Number=SeqID_15142
  Homolog annotation: Hit_ID=UPI00006A1288; Match level="QueryCoverage =97%, HitCoverage=40%, E-value=3e-07, Identity=24%"; Hit description =UPI00006A1288 related cluster
EDIESYGNIKARTLSPMKDKGEDVESYGNIKTRMTLSPMKNKGEDIESYGNIKARMLSPMKDKDEDVESYGNIKARTLSLMKDKGEDVEQRMLSPIKNKGEDIESYGNIKARMLSPMKDKGEDVKSYGNIKVMALSLMKDKREDVESYGNIKARMLSPMKA

SEQ ID NO: 131921 - protein, 50 aa, Glycine max
  Coding DNA Sequence Number=SeqID_15143
MVQELFTHREEKAIWCKGSSPRRAARLGLKLFLGPGKLDASLGEFRVRKL

SEQ ID NO: 131922 - protein, 217 aa, Glycine max
  Coding DNA Sequence Number=SeqID_15144
CHIDGGGEEVDEYLLDQSDLDEPYHDEYITSEDEIETRVTINSFIHISTSKPTIPVIGHCQAPIFIIHQEEVNPTNVGESVPPSREATPLTSEVSLTLKLPPRAECGQPIDESLCFKFLLDLGVFHIISDIFKAKFNEACPSWKKASTELHNRWFGEFKENAIKSIFEKRGSRLLKNSSTRSVMSKSSIAKENQTVDKRSSTYYSGSISTIAQFEKL

SEQ ID NO: 131923 - protein, 123 aa, Glycine max
  Coding DNA Sequence Number=SeqID_15145
  Gene Ontology: Mol. function=calcium ion binding; Cellular component =flagellin-based flagellum; Biological process=ciliary or flagellar motility
  Homolog annotation: Hit_ID=Q1SLX8; Match level="QueryCoverage=95%, HitCoverage=59%, E-value=7e-30, Identity=55%"; Hit description =Calcium-binding EF-hand
  Pfam annotation: Domain name=efhand; Domain location=57-85; Score =34.0; E_value=5.1e-07; Accession=PF00036.22; Description=EF hand
  Pfam annotation: Domain name=efhand; Domain location=93-121; Score =28.6; E_value=2.1e-05; Accession=PF00036.22; Description=EF hand
  Pfam module annotation: Pfam domain module=efhand::efhand; Domain location=57-85::93-121
MGLDYIERGAKVSKEDVVLVMEKLGMNVECDGDDGVEGFDVKNIGELFDDEDVTLSEVEQAFDVFDQNKDGFIEARELQRVLSCLGLGKDLMECQEMINAVDRNGDELIDRNEFVRIVEQSFG

SEQ ID NO: 131924 - protein, 465 aa, Glycine max
  Coding DNA Sequence Number=SeqID_15146
  Gene Ontology: Mol. function=DNA binding; Cellular component=nucleus; Biological process=regulation of transcription
  Homolog annotation: Hit_ID=Q1SLX7; Match level="QueryCoverage=72%, HitCoverage=79%, E-value=4e-90, Identity=57%"; Hit description =Homeodomain-related
  Pfam annotation: Domain name=Myb_DNA-binding; Domain location=137 -183; Score=53.4; E_value=7.8e-13; Accession=PF00249.21; Description =Myb-like DNA-binding domain
  Pfam annotation: Domain name=Myb_DNA-binding; Domain location=189 -234; Score=52.5; E_value=1.4e-12; Accession=PF00249.21; Description =Myb-like DNA-binding domain
  Pfam module annotation: Pfam domain module=Myb_DNA-binding::Myb_DNA -binding; Domain location=137-183::189-234
  Subcellular localization annotation: CTP_CleavageSite=37; ConfidenceScore=5.49e-01
MASSKCCMISPQQNQNAPTCYPSPIGVVFADMMGSLSLATVSNNASSSQESNVYGYGYGYASGVGNGSTRWSFPFMREFLSSNFEDCSDLVGAGESNNSNEKTNHNNGKFSEEESNPNENHANGKEVDSGHSKLCARGHWRPAEDSKLKELVALYGPQNWNLIAEKLEGRSGKSCRLRWFNQLDPRINRRAFSEEEEERLMQAHRIYGNKWAMIARLFPGRTDNAVKNHWHVIMARKYREQSSAYRRRRMSQSVHRRVEQNPTFVCSSSRDNASTTEQEPEPSPSYYPNLIHHGVALTNNMASFPPFHGVAACNGVVVEFGSNGSPQNMTSGREAMPNTTHVGLSAQAQQQAPFDFFSGGGSNDIVLESISHMRSRERTNGSHNHHCQLSGCYPHYPQQYLMAMQQQLDNNNNFYSFLNSSPAASTAREPSSSPCVAEIRDKVENSDPPDGVPPPFFDFLGVGAT

SEQ ID NO: 131925 - protein, 43 aa, Glycine max
  Coding DNA Sequence Number=SeqID_15147
MNEVEIERQREKIGGAKTERKKHESGRGETKRKRRKMIVNIDF

SEQ ID NO: 131926 - protein, 117 aa, Glycine max
  Coding DNA Sequence Number=SeqID_15148
MAPPDSIPTVEQLNEMEDEGPTAQVPRHVEDESSEATIPEPFDIGEEAEETQVRQVAATTPERSLEATSEPSTPVIPEDPTTPVLVVDTSPPTTPVLQLTNLEDGQTQDTQDQSQEF

SEQ ID NO: 131927 - protein, 50 aa, Glycine max
  Coding DNA Sequence Number=SeqID_15149
  Subcellular localization annotation: CTP_CleavageSite=16; ConfidenceScore=5.06e-01
MAEPSKKRKGLSSTTTAAGQRNHDTSSDPPNPSFSSPRSLTLFSSDEQHQ

SEQ ID NO: 131928 - protein, 116 aa, Glycine max
  Coding DNA Sequence Number=SeqID_15150
  Subcellular localization annotation: CTP_CleavageSite=62; ConfidenceScore=5.11e-01
MKRGENEGETHAAIVILHGPTSHQPNNVNNNHSLYPPPSYPQRSSLNQPQSLSTTLPITNTTFSMNQNTNEGRNFAAKKPIEFTLIPVSYDDLLPYPFDNSMVAIPPARFPQPLFF

SEQ ID NO: 131929 - protein, 71 aa, Glycine max
  Coding DNA Sequence Number=SeqID_15151
MDYEQGTISRIRMNTNRNGNAMLETHNMGDQTGLHPSMKGSSSVLRIFYASMCYPLFPSLLDNILCLTIQE

SEQ ID NO: 131930 - protein, 67 aa, Glycine max
  Coding DNA Sequence Number=SeqID_15152
MKHSSKLESGGHMNENAIHGAPKKGVGGTERSTGGVGYRQSRMTLNGNLKGRDTKNGFSFVGSPLPC

SEQ ID NO: 131931 - protein, 235 aa, Glycine max
  Coding DNA Sequence Number=SeqID_15153
  Gene Ontology: Mol. function=oxidoreductase activity; Biological process=flavonoid biosynthetic process
  Homolog annotation: Hit_ID=Q10SI2; Match level="QueryCoverage=90%, HitCoverage=70%, E-value=8e-34, Identity=36%"; Hit description =Oxidoreductase, 2OG-Fe oxygenase family protein, expressed
  Pfam annotation: Domain name=2OG-FeII_Oxy; Domain location=161-235; Score=49.9; E_value=8.6e-12; Accession=PF03171.10; Description=2OG -Fe(II) oxygenase superfamily
MNSFQLANESSSLLSLSPKFILPEDKRPQLSDVTSLDSIPIIDLSDHGYNDDNPSSSLMVQKISQACEEYEFFQIVNHGIPEQFCTKMMTAITDLFNLPPEQIGQLYTTDPPKNTKLYNNYLHVEGGEKVKNVEEAFSEYPREIGLGIEEDCLLKTLRHQPRLRAQSNFYPPSPDPEPELTLGLPVHTDFNALTIVLQSDVSDLLVIKDGKWVAVPVNPNAFVINLGDQIQARCT

SEQ ID NO: 131932 - protein, 200 aa, Glycine max
  Coding DNA Sequence Number=SeqID_15154
  Gene Ontology: Mol. function=protein binding; Cellular component =membrane; Biological process=regulation of intermediate filament polymerization and/or depolymerization
  Homolog annotation: Hit_ID=Q9FFJ3; Match level="QueryCoverage=98%, HitCoverage=58%, E-value=5e-36, Identity=50%"; Hit description =Arabidopsis thaliana genomic DNA, chromosome 5, P1 clone:MJJ3
  Pfam annotation: Domain name=LRR_1; Domain location=22-43; Score =14.6; E_value=0.35; Accession=PF00560.23; Description=Leucine Rich Repeat
  Pfam annotation: Domain name=LRR_1; Domain location=45-66; Score =13.8; E_value=0.64; Accession=PF00560.23; Description=Leucine Rich Repeat
  Pfam annotation: Domain name=LRR_1; Domain location=68-89; Score=6.4; E_value=18; Accession=PF00560.23; Description=Leucine Rich Repeat
  Pfam annotation: Domain name=LRR_1; Domain location=91-109; Score =9.1; E_value=5.6; Accession=PF00560.23; Description=Leucine Rich Repeat
  Pfam module annotation: Pfam domain module=LRR_1::LRR_1::LRR_1::LRR _1; Domain location=22-43::45-66::68-89::91-109
LVEASAESVKRILPQAFGKIRALVVLDLSQNQLGVIPDSIAGLKKLVELDVSSNVLESLPDSIGLLVNLKILNVSASKLIALPESIALCRSLVELDASFNNLVCLPTNMGFGPVNLEKLLIHLNKPGAEAVKDFMAKWWLDLIDEAQQKSMAETQNHQAQTGWLAWGASLLNNVAEVSESVAEYFGAKKAPRDPSLDQQL

SEQ ID NO: 131933 - protein, 44 aa, Glycine max
  Coding DNA Sequence Number=SeqID_15155
MSDKTCPPCLDYSTGPSLRRENAKADFTATLVELSLKIKPEFEC

SEQ ID NO: 131934 - protein, 292 aa, Glycine max
  Coding DNA Sequence Number=SeqID_15156
  Gene Ontology: Mol. function=signal transducer activity; Cellular component=membrane; Biological process=response to light stimulus
  Homolog annotation: Hit_ID=Q75H87; Match level="QueryCoverage=76%, HitCoverage=31%, E-value=5e-34, Identity=39%"; Hit description =Putative NPH3 family protein
  Pfam annotation: Domain name=NPH3; Domain location=3-151; Score= -34.6; E_value=2.9e-08; Accession=PF03000.5; Description=NPH3 family
  Subcellular localization annotation: CTP_CleavageSite=42; ConfidenceScore=5.19e-01
FVSQGQSPPTSPARSRLAFERRRSRSAENINLEFQESRRSSSASHSSKLKVAKLVDRYLQEVARDVNFQLSKFIALAEIIPDFARHDHDDLYRAVDIYLKGEKIACQSCVIELYHIAAFQYYVQAHPELSKSERKRLCRILDCKKLSMEACMHAAQNELLPLRVVVQVLFFEQARAAQAGGKVTDLPTNIKALLTAHGIDPSKPTAPLSTTTSINAEDNWSVSNFKSPKSKSSTLRMKLAEDEDFNQNGLAHDGIGRNSRFKAICAIPTQPKKMLTKFWSTTNRTAATTEKN

SEQ ID NO: 131935 - protein, 36 aa, Glycine max
  Coding DNA Sequence Number=SeqID_15157
MTTNDLKVQISSRNDVMSGDGMKAQVRLSSSQGLCR

SEQ ID NO: 131936 - protein, 74 aa, Glycine max
  Coding DNA Sequence Number=SeqID_15158
MKMKAKKTRNELKVSDLNTYWLKNEERMKNGRRTTINLHEIAHGNVSEVLRKYLDLDFLHENTFFHPKQLKCIA

SEQ ID NO: 131937 - protein, 69 aa, Glycine max
  Coding DNA Sequence Number=SeqID_15159
MSEVVIKDSAIKLFGRTISLPRNTKNEVSPDEPAPPEDSSSSFPREVSSTTEYDAGDKWWPQVIVGHCQ

SEQ ID NO: 131938 - protein, 296 aa, Glycine max
  Coding DNA Sequence Number=SeqID_15160
  Gene Ontology: Mol. function=nucleic acid binding; Biological process= DNA integration
  Homolog annotation: Hit_ID=Q1SG63; Match level="QueryCoverage=75%, HitCoverage=14%, E-value=1e-08, Identity=28%"; Hit description =Integrase, catalytic region; Zinc finger, CCHC-type
MEKLEKKSLKEKKAYITWEENDMGSSSDSKNEVANLSLMARDYKSDEEIASSNLDSTISVDELQYAFNDLHKECIKLAKLFSSNKKDISNIEKEISKLNKELKEFKLENETLGLIDANSSCTKCLMYENAIKSYSCSSCNKFEKEINGLKNTLAKFTFGAYCSNLTFKDPRKFGYLNQNCDIELKDLLKQSWHIDSECFKHMMGDASKFIHITPKNSGHVTYGDNNKGKILRVINVQALENTYIHEKELESKEKENKKETSFQEESRTIDLPKEWKASKNHPLDNIIGDISKGVTT

SEQ ID NO: 131939 - protein, 49 aa, Glycine max
  Coding DNA Sequence Number=SeqID_15161
MDNAKEIATPMSTACYLDKDEGGKLVDIKKCRGIRPILKKHILVQSKEL

SEQ ID NO: 131940 - protein, 125 aa, Glycine max
  Coding DNA Sequence Number=SeqID_15162
MVKEECKEVSVSSKSDQGVPMNPKRIKVIPKWPTPPTPLNELVRNHVPSWKDAQEMGFQILPYFNIPNITNTYVFVLFTSVEEKSPEFQESRDLRSNPFRGEGMMQSYPARALDRRLQEDWARDA

SEQ ID NO: 131941 - protein, 232 aa, Glycine max
  Coding DNA Sequence Number=SeqID_15163
MDSFRWRCPQSVPETPTDLGRRPTMRFVGIAPTRHPVDPEKSNKALGFPALITGLCQFYKVSVAPNKALQQLEEDLQPAADAPPPPQDEVPSLRSIFDRLQRIELHMHSPFPWPTPEQFEAMVAWLGLGMRPILRHKRGPRGPPEVEMKPKRMRTWPTWWTSSCEESELLFALRDTTCLCGCKIYQQVHQVVKYLKVLGPLTEQIDAIKDVSLIKDVFVFYAEGSSTKHDVS

SEQ ID NO: 131942 - protein, 153 aa, Glycine max
  Coding DNA Sequence Number=SeqID_15164
  Gene Ontology: Mol. function=chitin binding; Cellular component =extracellular region; Biological process=chitin metabolic process
  Homolog annotation: Hit_ID=UPI0000612705; Match level="QueryCoverage =78%, HitCoverage=86%, E-value=2e-09, Identity=29%"; Hit description =UPI0000612705 related cluster
MTDPLNESISCFLKRVDPWVLVPSPSEDYTSSRSEDYTSSPSEDYTSSPSEDYTSSPSEGYTPSPLEGYASSPLEGYMHTLRGLRVLTFRGLHALAFRGLHALTFRKLHVVAIRGLRTLTFRGLHVLAFRGLHILTFRGLQICALREFKVLCP

SEQ ID NO: 131943 - protein, 253 aa, Glycine max
  Coding DNA Sequence Number=SeqID_15165
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=21%, E-value=1e-27, Identity=45%"; Hit description=Chromo
MTSAEMQLRRERGLCFTCDDKFSPSHRCPNKQYFVLQWEEEDEPALQPDPPDEVETAGDPSLQDHHLSYNALKGSSGLGTMKFQGSINGLGVLVGNGNALTAEGLILDLEVKIQGHTLKLPVYLLPISGADLVLGAAWINYLDIPVDMELELAMILYTYRTVFDVPSGLPPSKISNHSIPLVEGVGPVKVKPYRYPHSRKDQIEVMIADMLKEGIIAPSTSPFSSPIILVKKTPPHLEILHRLQGLECHHNQR

SEQ ID NO: 131944 - protein, 110 aa, Glycine max
  Coding DNA Sequence Number=SeqID_15166
  Gene Ontology: Mol. function=lipid binding; Cellular component =anchored to membrane; Biological process=lipid transport
  Homolog annotation: Hit_ID=Q10R96; Match level="QueryCoverage=54%, HitCoverage=32%, E-value=4e-07, Identity=37%"; Hit description =Protease inhibitor/seed storage/LTP family protein, expressed
MDSNACLPHLLVLAITLVLVSHAMGDSAQDKQRCAESLTGVATCLPYLGADAKAPTADCCSGLTQAMKTNKKKFPEGTDETASAKNSESYIGKRFLESLVAVAGLLIWLS

SEQ ID NO: 131945 - protein, 332 aa, Glycine max
  Coding DNA Sequence Number=SeqID_15167
  Gene Ontology: Mol. function=chitin binding; Cellular component =extracellular region; Biological process=chitin metabolic process
  Homolog annotation: Hit_ID=UPI00006A17C9; Match level="QueryCoverage =56%, HitCoverage=100%, E-value=2e-21, Identity=32%"; Hit description= UPI00006A17C9 related cluster
GLYAFTFRGLHVLTFRELHVLAFRGLHSLAFRGLQVLTFKGLHVLPFRRLHVLAIRGLQVLTIGGLHALAFRGLHALAFRGLHVLPFRGLHVLAIRGLHALNFRGLHVLGFRGLHVLTFRGLHIFAFRGLHICAFRGLKREAIAQLLCIPGQDAPGEVIAQQLCILGQDFIQPLQGDECGSCAPPQLRSPPTEVSVGLCHHDIEVQQGPAVSSFGYGPLSVLPGIAPIRHLVGLEMSNRVLGFLALITSLCQFYEVPFAPNKVIRPPTNQAFIRKYCAPRQVGRDTTTARGWLAAGNRHTAATSRAPQLIYKSWSVAYDPWSTTRRPSPKPK

SEQ ID NO: 131946 - protein, 81 aa, Glycine max
  Coding DNA Sequence Number=SeqID_15168
MGTAMQTSSAKVEIQMAILEKILQGLTGQAIRKIQMDFIRMKGSTLHVYHSYGRKTPELTLEGLISELIQHYNGIECIGNA

SEQ ID NO: 131947 - protein, 577 aa, Glycine max
  Coding DNA Sequence Number=SeqID_15169
  Gene Ontology: Mol. function=nucleic acid binding; Cellular component= intracellular; Biological process=DNA integration
  Pfam annotation: Domain name=rve; Domain location=148-293; Score =32.1; E_value=1.9e-06; Accession=PF00665.16; Description=Integrase core domain
  Pfam annotation: Domain name=zf-CCHC; Domain location=153-170; Score =24.5; E_value=9.1e-05; Accession=PF00098.13; Description=Zinc knuckle
  Pfam module annotation: Pfam domain module=RVT_2::rve::zf-CCHC; Domain location=477-577::148-293::153-170
MVVALYLRLDSILFELQNWNIVTPMAQFVDKVERYFNKTNIQIKAELDGMERTKDEESKKFKGHNIEFDFHILIKIKEAMVDVSSNCMELALKALASTLMSKLSSMRLIGVTEEGRLAQEIGECALTMTQDKGKKERKENNHIPPIAKINKESRCFFCKKKGHMKKDCYKHKAWLGKKGEQFVYSGNWMRTRVVAIGTCEFYGEYTKNGQAPGLFAKFLEEHGIVAQYTMPGSSNQNGVVERRNRTLMDMVKSMLSNSKLPRSLWNEALKIAVYILNWVPTKAVPKTPFELLKGWKPSLKHVLVWGCLAEVWIYNPNEKKLDPRTISAYFIGYAERSKGYRFYCPTHSTRIVESRNAKFLENDVASGSDLTQGIGLEKNQCEGAVPTSSYKLVVFGNTHQNRVTQAPHQVNPILADPIEQHKTQNVEKPVEQHQTQDVEQPVEQQPEESQYDFGVENDPESFLQVINSCNSKLWYDAMKDELESMVNNKVWDLVELPNGIKPIGCKWVFKTKKDSLGFAQREGVDYRETFSPVSMKDSLCIIMTLVAHFDLELHQMDVKMTFLNGDLEEEVYKTQPG

SEQ ID NO: 131948 - protein, 294 aa, Glycine max
  Coding DNA Sequence Number=SeqID_15170
MGYVGVRELSWRRATGDGGFIRDLWMWKTCCAPSPDRHLVPQSGTWRYVTGVRRSWGRQEQRPQSKEACVVAGQLWTLIDIWDMASGNRLPRASGNRLPGCVIDYTEEHVTASGNRLPRLCNRLPEMKSLEIPLLLTCSGYGTHCVATAIVMAMQLIHDRVEMECLEGAWETLEGNTRCRFRGTIRFTATSLVHLDEPARTLQRTVEWILPTPTPYRLVEPVQVIEVTSSEEDPEEDLEELPPEPAVDALDFLEGDEDPLPEVDSPEDVMSASEVDSMEDSGPREMATSGGSSS

SEQ ID NO: 131949 - protein, 225 aa, Glycine max
  Coding DNA Sequence Number=SeqID_15171
MLHFLGLSVGTELKGVQGDLRMPDRRKEAIPLFWEWSSGYTEEVLGGEGKNHGKPMRVAIDAFLAYHHNKESPVVAVLVDMYDAFDLRCHCMCLGKDKVYWEEFLASVMGLSISWFSRWKEGVVGVLCSGYPMRGAPLEETIMPFIARGFSEANTEILQKIRQAWNKVEREDKELRGRSNSVIGGYHKWLKSRVQGIVWLKKDRGLEWGRDRGVRGKRRGASLEG

SEQ ID NO: 131950 - protein, 101 aa, Glycine max
  Coding DNA Sequence Number=SeqID_15172
  Gene Ontology: Mol. function=carboxylic ester hydrolase activity; Biological process=lipid metabolic process
  Homolog annotation: Hit_ID=Q6TGC0; Match level="QueryCoverage=86%, HitCoverage=20%, E-value=2e-24, Identity=63%"; Hit description =Triacylglycerol/steryl ester lipase-like protein
MLSNSSVELWRKLWLEDGITRLLNQPEQELPLILEIMGLTCGLQTPDRGTKYSCRHISLDPSSLAYWNWSWDEIVSYDLLVMFNYVFSQTEQKINYVGHSL

SEQ ID NO: 131951 - protein, 204 aa, Glycine max
  Coding DNA Sequence Number=SeqID_15173
MGPKSTLRLIRTLGPSLASLAQSTWSFSIQCPCGVGLHHYLTQPPTHFHLFPNHQEPVIFPSPETLISRGCDKKYHHGHKCTSKVFHLIAEEDKDAQMDPSLLDSQPEPPDEMVFSQAQISLHTCLTVGKCTGSRKQYKMDVLYLTMFMCSMLSPGLLNPDVSCMCSLILIKRRPQMSLIVLNLIRTALRHNITKTWLQYFDVS

SEQ ID NO: 131952 - protein, 239 aa, Glycine max
  Coding DNA Sequence Number=SeqID_15174
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=53%, E-value=6e-45, Identity=44%"; Hit description =Integrase, catalytic region
  Pfam annotation: Domain name=Chromo; Domain location=152-203; Score =20.6; E_value=0.0037; Accession=PF00385.14; Description='chromo' (CHRromatin Organisation MOdifier
MDNRGTGASPYEITYGKKPFTIPQYVIGTSKVAAVDDFLTNQEAVFALFRKKLLKAQEVMKRSVDTKRRDMNFQCGDWVMVKLRPHRQSYVSNTTHSKLAKRFYGPYQIMEQIGKVSHSPCLPLFHLKPFKQSFTCIPLPFPAKTVDIKPLISPLTIVSTKWDQKSSSPKLLMLVQLEGLSPDDATWEDWEELKSDFNLEDKVIFDVAGDDIQSKISQVEMTSRPKREISTPKYLADYN

SEQ ID NO: 131953 - protein, 70 aa, Glycine max
  Coding DNA Sequence Number=SeqID_15175
MVAGESKARELAAECERYIGICPKHVSYLHLTYLIFHDYKEVIMVVVPRVLNADATSLGCSQMTTTILDS

SEQ ID NO: 131954 - protein, 61 aa, Glycine max
  Coding DNA Sequence Number=SeqID_15176
MVSVKLRSREKKESHEDSTSGGFNLFSVSLTFGNSIRGSRRKNWRNLREPLEMPLSLLEDT

SEQ ID NO: 131955 - protein, 79 aa, Glycine max
  Coding DNA Sequence Number=SeqID_15177
MTCGNHLVPHFLILSSRGGGLDDMRRPITVIRTLLLSRQVMIILRPLSFRSSKLSDKHAETSYGHSAPCHPGSIVSEDT

SEQ ID NO: 131956 - protein, 249 aa, Glycine max
  Coding DNA Sequence Number=SeqID_15178
  Homolog annotation: Hit_ID=Q5WA77; Match level="QueryCoverage=22%, HitCoverage=12%, E-value=1e-15, Identity=61%"; Hit description=MYB transcription factor-like
  Pfam annotation: Domain name=Myb_DNA-binding; Domain location=189 -235; Score=39.8; E_value=9.2e-09; Accession=PF00249.21; Description =Myb-like DNA-binding domain
  Subcellular localization annotation: CTP_CleavageSite=19; ConfidenceScore=5.42e-01
MEFDPSFQGPQYLSSLFPRNSYLKPLTQTIFPSQSSIFTPPPPSSVMFHPNNNSHHFQDHIMNVPTNNTPFVMEGPSNPITTPMYGITTPSLGDGSSLGGFVNVQCHPPMMLAPKNNNKMEALYGQDKGKAISDFSQKTMLCLSEDSSSKSPSPVSLPNDWWMSQYHWDTDQKVKVEKDSNIGNDNVIKGKWSMKEDRDLIELVNQYGLKKWSKIAKLLHCRTGKQCQERWNNHLQPNIRVSLLSILIL

SEQ ID NO: 131957 - protein, 325 aa, Glycine max
  Coding DNA Sequence Number=SeqID_15179
  Gene Ontology: Mol. function=RNA-directed DNA polymerase activity; Cellular component=intracellular; Biological process=RNA-dependent DNA replication
VTVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDTGSSLNVMAKSTLGQLSYQGPPMRRSGVVVKAFDGSRKSVIGEVDLPITIGPFVFQITFQVMDIQAAYSCLLGRPWIHEAGAVTSTLHQKLKFVRNGKLITVSGEEALLRRQKPEKNEVSFATWKSAQKVVQEGTGVGWGKIVQLIESKNREGLGFASSAGSATNSVGSSSITSTFCSAGFINNSPEANAVLED

SEQ ID NO: 131958 - protein, 70 aa, Glycine max
  Coding DNA Sequence Number=SeqID_15180
MVLINHSADFRNSKPINQAVEKLLWKINYSRLKSRRGQFCGHKESANFSIFLFRVISSPLFVGHHRWLIN

SEQ ID NO: 131959 - protein, 224 aa, Glycine max
  Coding DNA Sequence Number=SeqID_15181
  Gene Ontology: Mol. function=protein-tyrosine kinase activity; Cellular component=large ribosomal subunit; Biological process =protein amino acid phosphorylation
  Homolog annotation: Hit_ID=Q1SMM2; Match level="QueryCoverage=92%, HitCoverage=59%, E-value=4e-82, Identity=74%"; Hit description =Protein kinase; Ribosomal protein S2
  Pfam annotation: Domain name=Pkinase; Domain location=15-210; Score= -89.2; E_value=0.003; Accession=PF00069.15; Description=Protein kinase domain
  Pfam annotation: Domain name=Pkinase_Tyr; Domain location=1-210; Score=-99.8; E_value=2.4e-06; Accession=PF07714.7; Description =Protein tyrosine kinase
  Pfam module annotation: Pfam domain module=Pkinase::Pkinase_Tyr; Domain location=15-210::1-210
MSGNILVKFSGKEKLVLYEYMGNGDLGRWLHELPTGDTNVEDWTGDTWEIQNGVVDDGSPEKMGWLTRHRIAVGIARGLAYLHHARSKPVVHGHLVTSNILLADDFEPRIADFGLRSDPNPSSGTEDDVYCFGAVLVELLTGRESTAEAVAAARKAVREGHGVRVLDERLRLGGDSVVLSQMVETLRVAFLCTAESPSKRPTMQQVLGMLKDIGPHHHHQINSS

SEQ ID NO: 131960 - protein, 87 aa, Glycine max
  Coding DNA Sequence Number=SeqID_15182
MAIFIKPHLYISTLIISSSNGILFSITRQLCWTRVVGLKVVIEGNDGLVEGDTSLDKDGGKYGALEGKVRKEEIKILSLNRFESHSN

SEQ ID NO: 131961 - protein, 171 aa, Glycine max
  Coding DNA Sequence Number=SeqID_15183
  Homolog annotation: Hit_ID=Q9LIH4; Match level="QueryCoverage=31%, HitCoverage=41%, E-value=1e-12, Identity=64%"; Hit description =Arabidopsis thaliana genomic DNA, chromosome 3, P1 clone:MFD22
  Subcellular localization annotation: CTP_CleavageSite=23; ConfidenceScore=5.78e-01
MAPSGRTTTASTRTTSKTTRRTRQQRRTTNFKKKQQQQHNTKSNNNKKQQEEVPVPTVLPSSYCSSSSISSQDSSNSKEVDNMHGSAEVIDVCNSPCSTPKGKKFRIPEISTCPPAPKKPRVLSNCSLRRSPLSFFAPPDLEHFFFVALRDVSGLPFTKFSWGGSPTKFGF

SEQ ID NO: 131962 - protein, 348 aa, Glycine max
  Coding DNA Sequence Number=SeqID_15184
  Subcellular localization annotation: CTP_CleavageSite=43; ConfidenceScore=5.16e-01
MESKLFSSSSHQDPIQHQRKFIKLTNMLKQSQNDITTRNQCTSAFLRRYFSPVKMDQYIRGMGNFVQREQESPPEALSSHYRMSLDAAYGGECTVDDELVATMDEINFVGGRKTSYNQYPSNFNQGDEKVVFNLSDTFKQLSSFAFYSFIESIDISNALMEGVFSIEEILSFFHSQHGPRPFSFDRLEWGNGPMPKPFVEEPPKLELKPLPSNLKYDNKKTFGWSIHDIKGLDPIICTHRINIEEGFPPKQLPQKRHNSNMMEVVKGEEKCQFMVKECVVLGTNSPHVGMEVDLVKVEVIAKLPLPNYESCGGLFRACWILDEECLRAFNILKQSLVSAPVVTTLRAH

SEQ ID NO: 131963 - protein, 67 aa, Glycine max
  Coding DNA Sequence Number=SeqID_15185
VYAAKGNRGRKELVLNKGDWVLEMINNNAYMLNLLEELDLPEEYGVSNTSYNHTLCMSFMLYMPHDI

SEQ ID NO: 131964 - protein, 232 aa, Glycine max
  Coding DNA Sequence Number=SeqID_15186
MCAFGVLCEKFFITPTAFKFLHHYNVNVNKKEGWVSLAGIPERTSSANKDTMKPVVYMSSSDQEDSVVLHKFPRALHCKTLVGMPFSKTLTVDWEHEYLFDYVEDDWVPSPPPIRSGDCFSLGEGFNPSAFIQSSMLNQLDRDMLREEVETQEKALKTKLAFAENSAKTLEEEIKRLNKEFALFKEEAKKAKEKLNSDLNEAKSKILRTHEDVNCQVDLVNEVEMSEDEVPT

SEQ ID NO: 131965 - protein, 225 aa, Glycine max
  Coding DNA Sequence Number=SeqID_15187
MTRFREKVCGKSSTKPTYQEVKIESSHSRGKSKTSRTPRSSCWLRMDLHQELTSSTFKKLGIPERQIEPFIGFVGETTDTIGYVHLLTTFKDERGSKSIMIKYILIGVLTSYNILIRLPSLNELGAIILIPYLVMKFPSEDEKIITVRADKMIAKECYVLSLMISNMKNMVEPKVQLVVCTSLNINLGEFKLDLREVELRAEPTKEVIPTLKRVISVHQTQMPDK

SEQ ID NO: 131966 - protein, 69 aa, Glycine max
  Coding DNA Sequence Number=SeqID_15188
MATNDNTPTPSFKEINHDYGGTTPTWMEVAEHRSIRMDSWTRTNTWMHPSHRKSVHELTTHHMSSVPTR

SEQ ID NO: 131967 - protein, 780 aa, Glycine max
  Coding DNA Sequence Number=SeqID_15189
  Gene Ontology: Mol. function=voltage-gated chloride channel activity; Cellular component=membrane; Biological process=chloride transport
  Homolog annotation: Hit_ID=Q0IJ86; Match level="QueryCoverage=99%, HitCoverage=99%, E-value=0.0, Identity=79%"; Hit description =Chloride channel
  Pfam annotation: Domain name=CBS; Domain location=590-763; Score =39.8; E_value=9.1e-09; Accession=PF00571.18; Description=CBS domain
  Pfam annotation: Domain name=Voltage_CLC; Domain location=144-557; Score=623.7; E_value=1.6e-184; Accession=PF00654.10; Description =Voltage gated chloride channel
  Pfam module annotation: Pfam domain module=CBS::Voltage_CLC; Domain location=590-763::144-557
MGEDSGEFGESTKINHKMENVEREEEIDPESNPLNEPLLKRNRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRIKWRWLRYFNNDRDRRDLITCGSSSGVCAAFRAPVGGVLFALEEVATWWRSALLWRTFFSTAVVVVVLRAFIEICHTGKCGLFGEGGLIMFDVSNVTVRYHVMDIVLVVVIGIIGGVLGSLYNHVLHKVLRLYNLINHLAVALFTSMCEYGLPFLAKCTPCDPSLPESTCPTNGRSGNFKQFNCPPGYYNDLATLLLTTNDDAVRNIFSTNTPQEYQPLSLVIFFVLYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPVMDDGVVPPVVGQANGGTELHGLILRAHLIQALKKKWFLKERRRTEEWEVREKFTWVELAEREGSIEEVAVTSEEMEMFVDLHPLTNTTPFTVLESMSVAKAMILFRQVGLRHLLVVPKYQASGVSPVIGILTRQDLLAHNILTVFPHLAISKGREKRN

SEQ ID NO: 131968 - protein, 190 aa, Glycine max
  Coding DNA Sequence Number=SeqID_15190
  Gene Ontology: Mol. function=chromatin binding; Cellular component =chromatin; Biological process=chromatin assembly or disassembly
  Homolog annotation: Hit_ID=Q1SAV4; Match level="QueryCoverage=55%, HitCoverage=31%, E-value=8e-25, Identity=52%"; Hit description =Integrase, catalytic region
MIRNTHPKLGATQMKNFFQKATNEDRITVRDNTIRKTMMLTDYIQKECGNFEGIIMSRKCAKMYTLGETINNNQNNKIHWREGNSNEVKGNVRPFSLKRNWQSKTTPIANPEASGLRGNKTVKSDKAKMGAQASRAWLGFWSGLVPPLGLRQYAPKIQALFGQKHAWKASRRIKFAKEEKEYNLIDEGGQ

SEQ ID NO: 131969 - protein, 113 aa, Glycine max
  Coding DNA Sequence Number=SeqID_15191
MQTTFCRRGGGITSTNEGIGVEQRAIITMFGGGVVTNCSQQISARFDRWICKITIFYLSLSVKSLLSAIRTREAIALSVNCRAYHKRNCAQRKLSCLVQILTQRNFAKHESRA

SEQ ID NO: 131970 - protein, 167 aa, Glycine max
  Coding DNA Sequence Number=SeqID_15192
  Homolog annotation: Hit_ID=Q7XY17; Match level="QueryCoverage=43%, HitCoverage=24%, E-value=2e-24, Identity=68%"; Hit description=Emr1
MATLYGAENKCVYAVGGAWGGGAGGEGGGRSCMTRTGFGMRKKVKELKVSGGKALSKSFEANVSAVYYLRGTTTTGFHTFPWRTSMGNQELLDYFSIYDAMRARHSYGPQGHRGMSVLIFEASAIGYLEVERLHKHFVEQGTDKDSWFTCPILYLPGGIASSMDTWL

SEQ ID NO: 131971 - protein, 99 aa, Glycine max
  Coding DNA Sequence Number=SeqID_15193
  Homolog annotation: Hit_ID=Q7XY17; Match level="QueryCoverage=99%, HitCoverage=32%, E-value=1e-07, Identity=31%"; Hit description=Emr1
MYMQEQFFKDQIKIIHDSRDAKEEDIKRMQPEECEKVKQSCTTGHVNAKEYRLKVEEYLKFVEVQDKEMENLVAEKEKLLHACGMGYAAMKSRHWEEEV

SEQ ID NO: 131972 - protein, 114 aa, Glycine max
  Coding DNA Sequence Number=SeqID_15194
  Homolog annotation: Hit_ID=Q1SWX1; Match level="QueryCoverage=92%, HitCoverage=21%, E-value=2e-07, Identity=27%"; Hit description=IMP dehydrogenase/GMP reductase
MVEVSTESIASFAQYYDQPLRCFTFGDFQLTPTVEEFEEILGCPLGGKKPYLFSGFHPSLARISKIVKILTQELDRGKQVENGVVGVPRKCLEAKARTLASQDEWLRSWTSWRS

SEQ ID NO: 131973 - protein, 78 aa, Glycine max
  Coding DNA Sequence Number=SeqID_15195
  Subcellular localization annotation: CTP_CleavageSite=50; ConfidenceScore=5.09e-01
MPNAQTPPIAQTKKEFCSKKPVGFTSNSAITPARVPQPPFFQEYDSNATCAHHGGVSGHSNEHCMTLKRKVQSVIDAG

SEQ ID NO: 131974 - protein, 160 aa, Glycine max
  Coding DNA Sequence Number=SeqID_15196
  Gene Ontology: Mol. function=DNA binding; Biological process =regulation of transcription, DNA-dependent
  Homolog annotation: Hit_ID=Q7MYX2; Match level="QueryCoverage=68%, HitCoverage=81%, E-value=3e-30, Identity=57%"; Hit description =Complete genome; segment 16/17
  Subcellular localization annotation: CTP_CleavageSite=52; ConfidenceScore=5.34e-01
MVFRQGTDGQGGVAFNPARGQFDGPARRLAQPPPQRRAGQSAGIPYRQPAVRRAQPVGLARDRPSGLRRQTPGSDTGLDRVLLSPDAGRAGKAAGVPDARGHEPPAAADRAPPLARMLNPPLPAPSRRCATDAAWRKSATGANVRHSVRSGAASCRENAV

SEQ ID NO: 131975 - protein, 130 aa, Glycine max
  Coding DNA Sequence Number=SeqID_15197
  Gene Ontology: Mol. function=protein transporter activity; Cellular component=membrane; Biological process=electron transport
  Homolog annotation: Hit_ID=Q79MP4; Match level="QueryCoverage=100%, HitCoverage=28%, E-value=4e-30, Identity=56%"; Hit description =Membrane fusion protein SdeC
  Pfam annotation: Domain name=Biotin_lipoyl; Domain location=83-124; Score=-16.9; E_value=0.056; Accession=PF00364.12; Description=Biotin- requiring enzyme
MNAKPQRRSLMLRLLVAAIAIIVAVLAWRHFSAAQPAAGTTPGAHQAAGKTGAGRAAGGRRGAPMSPVQVATATRQTVPRYLSGLGTATAANTVTVTSRVDGQLMAIHFTEGQQVKAGDLLAEIDPRPFQ

SEQ ID NO: 131976 - protein, 36 aa, Glycine max
  Coding DNA Sequence Number=SeqID_15198
MASRKHSTKKSRKDATAEGTSAAPEFDSHRFRSAEH

SEQ ID NO: 131977 - protein, 96 aa, Glycine max
  Coding DNA Sequence Number=SeqID_15199
  Homolog annotation: Hit_ID=Q8TGM5; Match level="QueryCoverage=40%, HitCoverage=58%, E-value=6e-08, Identity=74%"; Hit description =Uncharacterized protein ART3
MNPDFNQPRGGCSREVSIHPAQQHCRRALGLMASGATCVQRLDGSRDSAIHTKYRISLRSSSMQEPRYPLPRVIVCKCCVVTTPAGHRLRAPGSRT

SEQ ID NO: 131978 - protein, 108 aa, Glycine max
  Coding DNA Sequence Number=SeqID_15200
MEEGYAASVNQNYQWKITCIEISEVGQVHLRMRKMLLVEVLDPAFPTSMLWSLVETAVLHSHLPHKFFKGRIRPYKVGMIPPPGILPVAGEHKLQAVQLLQIVAQKGK

SEQ ID NO: 131979 - protein, 162 aa, Glycine max
  Coding DNA Sequence Number=SeqID_15201
  Gene Ontology: Mol. function=DNA binding; Biological process=DNA integration
  Homolog annotation: Hit_ID=Q1SXA8; Match level="QueryCoverage=93%, HitCoverage=9%, E-value=1e-20, Identity=38%"; Hit description=Zinc finger, CCHC-type; Polynucleotidyl transferase, Ribonuclease H fold
MERNLPANFKGIFLGYSLQSKAYKVFNRITLRVEEFVYVVFIEKNSFIQEIVLEDEDAGFPDEHITLEEESNFKDLEQSKEITTTHPKDLPKEWRTQRDISLDNIIGEISKGVSTRHRLRILCNNMTFVSQIEPRSIDEAFHDEHWLLAMDDELNQFKRNEV

SEQ ID NO: 131980 - protein, 357 aa, Glycine max
  Coding DNA Sequence Number=SeqID_15202
  Gene Ontology: Mol. function=calcium ion binding; Cellular component =mitochondrion; Biological process=metabolic process
  Homolog annotation: Hit_ID=Q8LQY2; Match level="QueryCoverage=99%, HitCoverage=83%, E-value=5e-91, Identity=29%"; Hit description =Fertility restorer homologue-like
  Pfam annotation: Domain name=PPR; Domain location=102-136; Score =44.2; E_value=4.6e-10; Accession=PF01535.11; Description=PPR repeat
  Pfam annotation: Domain name=PPR; Domain location=11-45; Score=25.2; E_value=0.00023; Accession=PF01535.11; Description=PPR repeat
  Pfam annotation: Domain name=PPR; Domain location=137-171; Score =50.7; E_value=4.9e-12; Accession=PF01535.11; Description=PPR repeat
  Pfam annotation: Domain name=PPR; Domain location=172-206; Score =30.6; E_value=5.4e-06; Accession=PF01535.11; Description=PPR repeat
  Pfam annotation: Domain name=PPR; Domain location=207-241; Score =34.3; E_value=4.4e-07; Accession=PF01535.11; Description=PPR repeat
  Pfam annotation: Domain name=PPR; Domain location=242-276; Score =41.7; E_value=2.5e-09; Accession=PF01535.11; Description=PPR repeat
  Pfam annotation: Domain name=PPR; Domain location=277-311; Score =41.0; E_value=4.2e-09; Accession=PF01535.11; Description=PPR repeat
  Pfam annotation: Domain name=PPR; Domain location=312-346; Score =46.2; E_value=1.1e-10; Accession=PF01535.11; Description=PPR repeat
  Pfam annotation: Domain name=PPR; Domain location=67-101; Score=28.5; E_value=2.4e-05; Accession=PF01535.11; Description=PPR repeat
  Pfam module annotation: Pfam domain module=PPR::PPR::PPR::PPR::PPR::PP R::PPR::PPR::PPR; Domain location=102-136::11-45::137-171::172 -206::207-241::242-276::277-311::312-346::67-101
MIGKGITPSLVSDSHMILGHCKKGCMDDAHEVMNGIIESGLKPNAITYTILMEGSFKKGDCIVPTDYTFNSIINGLCKVGRVSEARDKLNTFIKQSFIPTSMTYNCIIDGYVKEGAIDSAESVYREMCRSEISPNVITYTSLINGFCKSNKMDLALKMHDDMKRKGLELDITVYATLIAGFCKMQDMENACKFFSKLLEVGLTPNTIVYNIMISAYRNLNNMEAALNLHKEMINNKIPCDLKIYTSLIDGLLKEGKLSFALDLYSEMLCRGIVPDIFMYNVLINGLCNHGQLENAGKILKEMDGNNITPTVLLYNTLIAGHFKEGNLQEAFRLHDEMLDKGLVPDDTTYDILVNGKL

SEQ ID NO: 131981 - protein, 486 aa, Glycine max
  Coding DNA Sequence Number=SeqID_15203
  Homolog annotation: Hit_ID=Q6DDA2; Match level="QueryCoverage=36%, HitCoverage=47%, E-value=6e-24, Identity=38%"; Hit description =MGC89952 protein (WD repeat domain 74) (NOP seven associated protein 1 (NSA1))
  Pfam annotation: Domain name=WD40; Domain location=324-363; Score =19.8; E_value=0.0098; Accession=PF00400.22; Description=WD domain, G- beta repeat
MPRTTTLECSGCPPLRALTFDALGLIKVVEARDKQRGAPLVVERWGDPESSKCVMAVSMIDRKSHPLLAVARKNNQIEVLSPVNGDIQATISDANDLDVQSEENNIVGLHLFAKQNSELAFRYLNSWVPNGTSVLLFLTLDTNGFRVGGGHQKQISLLDCTLLTCTTKGNASIRSIELADSSKGSSCIKTWNVCSGGNILCCKVDGNEKFALFGGKCVEMNIWDLNNFTKIWNSKPPTKDNLGIFTPTCFTSATFLMKDDHRKFVAGTNSHQVRLYDVSAQRRPVLSFDFRETPIKALAEDIDGYSIYVGNGSGDMASVDIRTGKMLGCFSGKCSGSIRSIVKHPELPVIASCGLDSYLRLWDTKTRQLLSAVFLKQHIIHVLFDSNFDVKANISTVADLLPCNEQTPTEILVSKEVEGSPLKRKKSSRNKPDGGERKKRSKQSKERKESKENDGWEKIASRDERSKSASKKGNKAQFQCCDLDVD

SEQ ID NO: 131982 - protein, 69 aa, Glycine max
  Coding DNA Sequence Number=SeqID_15204
MVEYSTILTTTERGGRGAERRTRSGEYKGKEERRDAFSGGPRKGEYNNEKRKDTFERVESRREEESSII

SEQ ID NO: 131983 - protein, 42 aa, Glycine max
  Coding DNA Sequence Number=SeqID_15205
REKNESHEDSTSGSFNLFSVSLTFGNSIKAVGGIIEGISGNR

SEQ ID NO: 131984 - protein, 155 aa, Glycine max
  Coding DNA Sequence Number=SeqID_15206
  Gene Ontology: Mol. function=actin binding; Cellular component =cytoplasm; Biological process=cytoskeleton organization and biogenesis
  Pfam annotation: Domain name=Transposase_21; Domain location=62-155; Score=8.8; E_value=2.3e-15; Accession=PF02992.5; Description =Transposase family tnp2
MGRVTKVSLHCIRCGVSRYKVKDNDECSSDESTKKGPLAKVLWYLLIILRFKCLFANEDDAKDLTWHANGRNYDGMLRHPVDSSQWMKINRFYPDFDKDIRNLRLGLATDGMNSYGSLSTQHSSWPILLVIYNLSPWLCMKQKYIMLSMMILGPR

SEQ ID NO: 131985 - protein, 77 aa, Glycine max
  Coding DNA Sequence Number=SeqID_15207
  Gene Ontology: Mol. function=transition metal ion binding; Cellular component=cytoplasm; Biological process=fucose metabolic process
MHNCPRGGVSWYKVKDDDECSNEESTKKGPPTKVLWYLSIIPRFKYLFTNANGTKDLSWHADGRNCDGMLRHSVDSS

SEQ ID NO: 131986 - protein, 151 aa, Glycine max
  Coding DNA Sequence Number=SeqID_15208
MLRDSIRHPRKKLLSFEFAQSINIQISSVSLYYGTQSDIRVKSYCRLNWLRGSTFNFERLVILRDTIRHPSKKLLSFELAESSNIEFRASRYMTGLNQTSEGSTFNSERLVILRNSFRHPSKKLLSFELSQSFNIQFGASRYVTGLNQTFE

SEQ ID NO: 131987 - protein, 134 aa, Glycine max
  Coding DNA Sequence Number=SeqID_15209
MPASDFPGVPDRPSATFSDTANRIDIKISAAPDRLQLADFVNYWKAESVAYYQSQWGLKLARYIEKGRKHLSSKRSRERRDCMLAPAEMLTVLAAINAGQVQGHFVNGILLSAGRSSSGVVIMRCDILWRKCNG

SEQ ID NO: 131988 - protein, 84 aa, Glycine max
  Coding DNA Sequence Number=SeqID_15210
MASQRLLERMTTAVLEVAIDCKGKANQLRGTMSVGEYATKFEELSKYCPYYWDMDERSKWLKFENGLKPHIKQVVEYLKVVQFP

SEQ ID NO: 131989 - protein, 238 aa, Glycine max
  Coding DNA Sequence Number=SeqID_15211
KLSQVKKDHRGKWAPNYEGPFVVKKAFLGGALLLMNMDDEELPLPMNSDIVKRYYGREYIYLDCYTQNKRGYISCGSVQVEGTSTWLFKENKGGYIPCGSLACKGFYKVERNLKNRWLLGDWMPLDPTYLAMGKVNEQPFWVMVSTTPTWVSLGASGKLPTGARSMIRFSHNQGKELGMMRWRSLDYNPAMALKLFAIRAKKATTGEGSNAAPQAEIEFDGHHFRSNEHQCRFKAIKD

SEQ ID NO: 131990 - protein, 44 aa, Glycine max
  Coding DNA Sequence Number=SeqID_15212
MRGKFWVEKNSPSLVFMPPGAGVLAQTSSARPAALSACPVLGMR

SEQ ID NO: 131991 - protein, 92 aa, Glycine max
  Coding DNA Sequence Number=SeqID_15213
  Pfam annotation: Domain name=zf-CCHC; Domain location=44-57; Score =7.4; E_value=0.06; Accession=PF00098.13; Description=Zinc knuckle
  Pfam annotation: Domain name=zf-CCHC; Domain location=60-77; Score =15.4; E_value=0.0029; Accession=PF00098.13; Description=Zinc knuckle
  Pfam module annotation: Pfam domain module=zf-CCHC::zf-CCHC; Domain location=44-57::60-77
METVSGDRGLVDSSLPVEDFTQLPAGRDGGGASVALAMPSWHGKCGKMSHFAHECPDNDVTCFNYRGKGHISTSCPLPRKENSSGSLNNQSG

SEQ ID NO: 131992 - protein, 703 aa, Glycine max
  Coding DNA Sequence Number=SeqID_15214
  Gene Ontology: Mol. function=NADH dehydrogenase (ubiquinone) activity; Cellular component=membrane; Biological process=ATP synthesis coupled electron transport
  Homolog annotation: Hit_ID=Q8PQ66; Match level="QueryCoverage=100%, HitCoverage=74%, E-value=0.0, Identity=67%"; Hit description=NADH dehydrogenase subunit 5
ADRAGQRHVADQRQVQVEVAAGQERHAEQHRSAAAEDGDQQAHADAADVVEAEARFHRCSALDHVLDQQRHRQHQAGDEATARRVVAAQEQEDRHGQGQREHDLRQVGRHRQLDRRAGHDLLRCHPRAPQQSMHHQRGDAEHGDLAEGIEAAEVDQDHVDYVLAVGLGQRPAQQFAGHRVRRKGHRGVSQRAKAGTGDDRDHRVTALAPARPLRPGLRRQVVHAQQHQHQGHHLDQQLGQGQIGCGQEHEGQRHHQADATDQQHRQQALLVDAQGGDRTGHHHQPQGPAQQRNRLRFGPVRRGRVGDVGRGGHGDGHQHQAQQHALQAAIGDAVGQAHGQRGDRIQLCMEHVAPGGAGFHAVQVDQLAQAEVQRHATDYADRAHRQRQVETVPHRQAVLGHGVAEDRGRSGMQHRRHGQCRGDAYRHADHHQQFHRHLHPARRFMRHAVQVVRAGAEESVVHEAQAVGHAQHAGQQRGDRHRRAHRARAATGGQCLGEQHFLGQEAVEQRDAGHRQRGDDRQRAGERHQLTQASELAHVTGAGFVVDDAGGHEQRGLEGGVVEDVEHAGHHRHWRGQAEQQGDQAQVGNGRVRQQALQVMLEDRIPGADQQGQCADAADRVEEQVAAGQCRMQARQQEHAGLYHGGRVQVGRDRGRRRHRVRQPEVERELRALGEDAGQHQEQRVRVQRAGADLLAGGQYHVQ

SEQ ID NO: 131993 - protein, 100 aa, Glycine max
  Coding DNA Sequence Number=SeqID_15215
  Gene Ontology: Mol. function=RNA-directed DNA polymerase activity; Biological process=RNA-dependent DNA replication
MEPLPVVTLKWAVTQSNTLREDNDCMAAHFTAKGLKVVLFHMHSNKSPGPNGLNPTFFKRFWHLLGPKVHKVASSWLQQSTFLLQLNSTTIRSHPKMSKP

SEQ ID NO: 131994 - protein, 98 aa, Glycine max
  Coding DNA Sequence Number=SeqID_15216
MESHEDNTSGDFNFFSVSLTFGNSIRAVGGKTEGEGIIHSEIVIISVHLEKETCRSLFHPDDFCFFDTNIGVFRDSLCVWQDSNTHLGLWQMRKFRDD

SEQ ID NO: 131995 - protein, 102 aa, Glycine max
  Coding DNA Sequence Number=SeqID_15217
VTKVYTTFNTPPPTYNPSPLRSCYRPSLSIQMHDMGHENEDEDDDNNNINNNDHDDDDNGGDHLPQQQQIITCDDPRTREGRGRRTRKQQPSTNQMQQDQRP

SEQ ID NO: 131996 - protein, 55 aa, Glycine max
  Coding DNA Sequence Number=SeqID_15218
MEADFVVNRDTSEMDEDQWMYDSIMSEKVDMNEQNKDEAGVNEEHVDCSDAFNTS

SEQ ID NO: 131997 - protein, 75 aa, Glycine max
  Coding DNA Sequence Number=SeqID_15219
MARDKEYKEWKVSVNVSRDLEECIRSDGWTKCDVSSIGACRPRIFFINEFLYFLEDEWQQNGEGRERGDATSRRR

SEQ ID NO: 131998 - protein, 160 aa, Glycine max
  Coding DNA Sequence Number=SeqID_15220
MAYSLVDGASPLLFSFAFRCISMVEKSPLKDLIEAQRSSLHRSSTSKLPSKGGKSSEEIYPQEEGQPLMVKEECKEVSVSSKRLAKKERHFEIKKNIKEISPLRQPPHFLLCKNTLVSIVTPLGLKYIPQVKELLDEGLVRKSLNPCALLVAKIVIKGFP

SEQ ID NO: 131999 - protein, 73 aa, Glycine max
  Coding DNA Sequence Number=SeqID_15221
MFAWSYQDMPDLSPVYFRQVHRIAQPNPDQASSADSSCWTKKIFTSSTYKEDPIEDLAFQNWEASFTTKRRER

SEQ ID NO: 132000 - protein, 142 aa, Glycine max
  Coding DNA Sequence Number=SeqID_15222
MVAAQLAQASQVASSRSNSLLEESSGGPKWAWLLFAPPFLLITETYEFRNDTCFLSVMLRNLMDYIIIPFLTYAMLRNLNSCATMLHLISGVSRNLTDCASIFSFVFRHVPEFHKLPNDGCQAPYKDQTKVACHQAKVPGRN

SEQ ID NO: 132001 - protein, 320 aa, Glycine max
  Coding DNA Sequence Number=SeqID_15223
  Gene Ontology: Mol. function=zinc ion binding; Biological process =intracellular signaling cascade
  Homolog annotation: Hit_ID=Q2HRX8; Match level="QueryCoverage=68%, HitCoverage=34%, E-value=3e-27, Identity=32%"; Hit description=IMP dehydrogenase/GMP reductase
  Pfam annotation: Domain name=DUF1723; Domain location=157-202; Score =42.8; E_value=1.2e-09; Accession=PF08330.1; Description=Protein of unknown function (DUF1723)
MVRIRGLGRALGHVIGKGDRDDFDYVAQRRRPTAFARRQQVPMTVAHDESVLPAPDVEADVFPDDPMAPADVEDTGADIPADTGAQAAEDEHEGFPGGPSDPSMLTQYTDHVACSVWMRDERPELKLSFHGRKVHSLGKPAPAIEGLVVGTGLSPLRLLSSFVERWHRETSSFHLPVGEVTITLENVLSLLHLPVVGNLHAFQPLHVDDAVQMLVDLLMVSTEAVRAETGQCRGPYVRLQWVRDIYERGCQTSYWAAAARTYLLHLLGCTLFANKSATNVHVVYLKALCDLSQTGRYAWGVAALVHMYDHLNDASISSSR

SEQ ID NO: 132002 - protein, 709 aa, Glycine max
  Coding DNA Sequence Number=SeqID_15224
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=99%, HitCoverage=72%, E-value=1e-165, Identity=46%"; Hit description =Receptor-like protein kinase
  Pfam annotation: Domain name=LRRNT_2; Domain location=30-70; Score =52.9; E_value=1e-12; Accession=PF08263.3; Description=Leucine rich repeat N-terminal domain
  Pfam annotation: Domain name=LRR_1; Domain location=123-146; Score =14.1; E_value=0.52; Accession=PF00560.23; Description=Leucine Rich Repeat
  Pfam annotation: Domain name=LRR_1; Domain location=148-170; Score =12.9; E_value=1.1; Accession=PF00560.23; Description=Leucine Rich Repeat
  Pfam annotation: Domain name=LRR_1; Domain location=172-194; Score =7.0; E_value=14; Accession=PF00560.23; Description=Leucine Rich Repeat
  Pfam annotation: Domain name=LRR_1; Domain location=196-218; Score =18.6; E_value=0.023; Accession=PF00560.23; Description=Leucine Rich Repeat
  Pfam annotation: Domain name=LRR_1; Domain location=220-242; Score =13.4; E_value=0.84; Accession=PF00560.23; Description=Leucine Rich Repeat
  Pfam annotation: Domain name=LRR_1; Domain location=244-266; Score =9.4; E_value=5; Accession=PF00560.23; Description=Leucine Rich Repeat
  Pfam annotation: Domain name=LRR_1; Domain location=268-290; Score =9.4; E_value=5; Accession=PF00560.23; Description=Leucine Rich Repeat
  Pfam annotation: Domain name=LRR_1; Domain location=292-314; Score =12.7; E_value=1.2; Accession=PF00560.23; Description=Leucine Rich Repeat
  Pfam annotation: Domain name=LRR_1; Domain location=316-337; Score =9.5; E_value=4.7; Accession=PF00560.23; Description=Leucine Rich Repeat
  Pfam annotation: Domain name=LRR_1; Domain location=340-362; Score =13.8; E_value=0.64; Accession=PF00560.23; Description=Leucine Rich Repeat
  Pfam annotation: Domain name=LRR_1; Domain location=363-385; Score =5.3; E_value=29; Accession=PF00560.23; Description=Leucine Rich Repeat
  Pfam annotation: Domain name=LRR_1; Domain location=391-413; Score =13.0; E_value=1.1; Accession=PF00560.23; Description=Leucine Rich Repeat
  Pfam annotation: Domain name=LRR_1; Domain location=415-437; Score =17.1; E_value=0.064; Accession=PF00560.23; Description=Leucine Rich Repeat
  Pfam annotation: Domain name=LRR_1; Domain location=439-461; Score =13.9; E_value=0.57; Accession=PF00560.23; Description=Leucine Rich Repeat
  Pfam annotation: Domain name=LRR_1; Domain location=463-485; Score =3.9; E_value=53; Accession=PF00560.23; Description=Leucine Rich Repeat
  Pfam annotation: Domain name=LRR_1; Domain location=487-509; Score =17.0; E_value=0.068; Accession=PF00560.23; Description=Leucine Rich Repeat
  Pfam annotation: Domain name=LRR_1; Domain location=511-533; Score =12.7; E_value=1.2; Accession=PF00560.23; Description=Leucine Rich Repeat
  Pfam annotation: Domain name=LRR_1; Domain location=535-558; Score =8.9; E_value=6.2; Accession=PF00560.23; Description=Leucine Rich Repeat
  Pfam annotation: Domain name=LRR_1; Domain location=75-97; Score=0.5; E_value=2.3e+02; Accession=PF00560.23; Description=Leucine Rich Repeat
  Pfam annotation: Domain name=LRR_1; Domain location=99-121; Score =13.0; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1; Domain location =30-70::...
  Pfam module annotation: Domain location=123-146::148-170::172 -194::196-218::220-242::244-266::268-290::292-314::316-337::340 -362::363-385::391-413::415-437::439-461::463-485::487-509::511 -533::535-558::75-97::99-121
MKQVQFTLLLSVSLVILFGPILVISVDLSFNDDVLGLIMFKAGLQDPKGKLSTWNEDDYSPCHWVGVKCDPANNRVSSLVLDGFSLSGHIDRGLLRLQFLQILSLSRNNFTGTIAPDLLTIGDLLVVDLSENNLSGPIPDGIFQQCWSLRVVSFANNNLTGKVPDSLSSCYSLAIVNFSSNQLHGELPSGMWFLRGLQSIDLSNNFLEGEIPEGIQNLIDLRELRLGSNHFTGRVPEHIGDCLLLKLVDFSGNSLSGRLPESMQKLTSCTFLSLQGNSFTGGIPHWIGEMKSLETLDFSANRFSGWIPNSIGNLDLLSRLNLSRNQITGNLPELMVNCIKLLTLDISHNHLAGHLPSWIFRMGLQSVSLSGNSFSESNYPSLTSIPVSFHGLQVLDLSSNAFFGQLPSGVGGLSSLQVLNLSTNNISGSIPVSIGELKSLCILDLSNNKLNGSIPSEVEGAISLSEMRLQKNFLGGRIPTQIEKCSELTFLNLSHNKLIGSIPSAIANLTNLQHADFSWNELSGNLPKELTNLSNLFSFNVSYNHLLGELPVGGFFNIISPSSVSGNPLLCGSVVNHSCPSVHPKPIVLNPNSSYSNSGSSLQNHQHRMMLSISVIIAIGAAIFIVIGVVVVTVLNIHARSSMIPSAAPFVFSGGEDYSGSPRNDPNYGKLVMFSGDAEFADGAHNLLNKDSEIGRGGFGVVYCTVLRD

SEQ ID NO: 132003 - protein, 133 aa, Glycine max
  Coding DNA Sequence Number=SeqID_15225
  Gene Ontology: Mol. function=protein kinase activity; Cellular component=integral to membrane; Biological process=protein amino acid phosphorylation
  Homolog annotation: Hit_ID=Q70AH8; Match level="QueryCoverage=98%, HitCoverage=78%, E-value=2e-53, Identity=72%"; Hit description =Receptor-like kinase with LRR repeats
CSDEPKIGDFGLVRLLPMLDHCVLSSKIQSALGYTAPEFACRTVKITEKCDIYSFGILILEVVTGKRPVEYTEDDVVVLCDKVRSALDDGKVEQCVDEKLKGNFAADEAIPVIKLGLVCASQVPSNRPDMAEL

SEQ ID NO: 132004 - protein, 76 aa, Glycine max
  Coding DNA Sequence Number=SeqID_15226
MQSANLFGSCFWASCCDAVGAGVLRWGATVKGGFWSATVQSKGFGSGKKLYKAFPEKVECRMHRVPQNFACVDEAF

SEQ ID NO: 132005 - protein, 292 aa, Glycine max
  Coding DNA Sequence Number=SeqID_15227
  Gene Ontology: Mol. function=chromatin binding; Cellular component =chromatin; Biological process=chromatin assembly or disassembly
LDAGVGVDFGLLMQLLDRFSTDACQVLDLNAGGFGLWMHVLGKFWDLNVGAGQVLGLDVGVKQAFVDVCQVLDFDVGAFDDMLVYRVEPVPAKVQAIQQWPTPSSSKALRSFLGLAGFYQKFIHGYASITVPLTNLLARDSFTWSTEAQTTFNDLKAALTTALVLMLPDFTLPFTVETDASGVALCYHCSSEEMTPVFLGHPFIILTDHHSLKELMAQVVQTLEQQTYLVKLLEFDYTIQFHSGKANVVADALSRILELPPNTLLSLSVPYLTFLEELKQHLANNLAFNELQ

SEQ ID NO: 132006 - protein, 121 aa, Glycine max
  Coding DNA Sequence Number=SeqID_15228
  Gene Ontology: Mol. function=chromatin binding; Cellular component =chromatin; Biological process=chromatin assembly or disassembly
TCKGLLQDSGTLKWVAWGLDIGTRATCLTCLSDMKCSMPVLPSPETYPTMKAKLIRKHVPLNLNKACQNWLRNNGSRLEVKLRGIPWIFPTITIKRTATVCEDGVLATCLDEYPSRTGLPP

SEQ ID NO: 132007 - protein, 67 aa, Glycine max
  Coding DNA Sequence Number=SeqID_15229
MARTKKSSQMTSKTTKEITDKIARHCGLEVVRSDAKSLGHCGLTKTLIVDHDRGEFAMIIVRSLMLF

SEQ ID NO: 132008 - protein, 66 aa, Glycine max
  Coding DNA Sequence Number=SeqID_15230
MTNHGLIYYTFCTFGGGSCNNNNDDHFGGGDHACGGGSNDDNGHGRGYGGGGAGDGRDGDSRFEIF

SEQ ID NO: 132009 - protein, 109 aa, Glycine max
  Coding DNA Sequence Number=SeqID_15231
  Subcellular localization annotation: CTP_CleavageSite=56; ConfidenceScore=5.56e-01
MAEQAKQHMTTPESLVASSSTSKKTRKSTRLRSLATRPVGVERPEVHVDPNTRKVNGPHKKKLRMYLGIFARDKMDITFVNWKEVPANQKDLIWEDIQIFELNVECYCN

SEQ ID NO: 132010 - protein, 87 aa, Glycine max
  Coding DNA Sequence Number=SeqID_15232
MREEEFSSTQNSPPSLQKHQAHGNYEDSNPQASIVEFLLPFSRFVSLPTRVVRDGLRPMLHSGVMGHATLPPFSCYSCQNMRPPSAR

SEQ ID NO: 132011 - protein, 139 aa, Glycine max
  Coding DNA Sequence Number=SeqID_15233
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=72%, HitCoverage=20%, E-value=4e-38, Identity=76%"; Hit description =Uridine kinase-like protein
  Subcellular localization annotation: CTP_CleavageSite=45; ConfidenceScore=5.47e-01
MALIQSLQLPNETTVPSSATPASSTPDSTLTLNSLPNQPFVIGVSGDTASGKTTVCDMIIQQLHDHRVVLVNQDSFYHWLNPEELERVHEYYFDHRDAFDTEQLLKCTRKLISGQGVHVPIYDFKKQQHSSDSFRQVFD

SEQ ID NO: 132012 - protein, 333 aa, Glycine max
  Coding DNA Sequence Number=SeqID_15234
MSDFAWRPLVKQVRPAGGVVPPSSTTLLEGGQPTVEVSPTAEVAPNALSSILAKRKRDDCARALGLKKLRGPMSLCALRQATGLTLGVGCPLSLQDLPPASLAVKASIAIVATSVTPASSPPLAMPVQEAAPDVVEVSVPTALPGFVMASLSTIVAPLLSVGVVTTSAFVVPPHPSSSDPLVLPFVVLAVVSPSSSSYPSECFTKNVEQENNVRNDHSRDSVGPQLCFLCFFLLLSLFSQFPQLTLEPLKTPLRCLFIGKWSLLGSWSSPKRAGFFTMKLFDGPSVATYPSAGGRRETHGCIFQGRKMRGVTTNIYSRKTSEKPERAWSMNFK

SEQ ID NO: 132013 - protein, 160 aa, Glycine max
  Coding DNA Sequence Number=SeqID_15235
MVSCGEAKDTIDEEYSRPTSSIWSYITHEAPRDHNLVDFKPHLEYAAEGQAFCGIPLPNTLGGPQYCLQPQPLHFAVGRVPPAMVERKKFDHLKERLRAIEGGVNAYAKTRMQIFIEAIDLNIWEAIEISPYIPTMVAGNATIEKPREQWDEEERKKGTL

SEQ ID NO: 132014 - protein, 292 aa, Glycine max
  Coding DNA Sequence Number=SeqID_15236
MAKSDPEVVLEFYANAWPTEEGVRDMRSWVRGQWIPFDADALSQFLGDPLVLEEGQECEFSQRRNMADEFDEEAIAQLLCTPGQDFTRTAAGRRVRIMRTNMTTLTQMWMTFLLSNVLPSDHNSDLPLPKCQLVYAILTRMSVHVAQLIADAIYLFAGMPPTRHPLDPDKSNRALGFPALITGFYKSFGVPVTPSKVIRPPITWAFIEKYCMPRQAQGDAPQAADAPPPPHQANPTGRRPTTVGRYRYMSVSTGSASVSRGEAPAGSPGDAKEARMDEEMTNLLGFLGGSRA

SEQ ID NO: 132015 - protein, 220 aa, Glycine max
  Coding DNA Sequence Number=SeqID_15237
  Gene Ontology: Cellular component=extracellular region; Biological process=sexual reproduction
  Homolog annotation: Hit_ID=Q4F8J6; Match level="QueryCoverage=93%, HitCoverage=99%, E-value=1e-71, Identity=64%"; Hit description =Putative beta-expansin
  Pfam annotation: Domain name=DPBB_1; Domain location=30-110; Score =123.0; E_value=8.5e-34; Accession=PF03330.8; Description=Rare lipoprotein A (RlpA)-like double
  Pfam annotation: Domain name=Pollen_allerg_1; Domain location=121 -205; Score=106.1; E_value=1e-28; Accession=PF01357.11; Description =Pollen allergen
  Pfam module annotation: Pfam domain module=DPBB_1::Pollen_allerg_1; Domain location=30-110::121-205
MFGPPEGAGSDGGACGYIDSVEKPPLSKMVSAGGPSLYLGGRGCGACYQVKCTENAFCSRNPVSVMITDECPGCTSPSVHFDLSGTAFGSMATPGQADNLRNAGVLNILYRRVACSFGNSMAFTIDNGANPYYFATEIEYENGGSDLVAIELKQANSDTWLPMQRSWGARWALNLGLQLQAPLSIKLTEQGKGYYKTIVADSVIPHGWQPGQVYRSVVNF

SEQ ID NO: 132016 - protein, 52 aa, Glycine max
  Coding DNA Sequence Number=SeqID_15238
AKSNGDGYVAKRKAITHSAIDDNEHHSCNFQKNLSTIGVMHYVRLLSQVRNN

SEQ ID NO: 132017 - protein, 632 aa, Glycine max
  Coding DNA Sequence Number=SeqID_15239
  Gene Ontology: Mol. function=DNA binding; Cellular component=beta -galactosidase complex; Biological process=DNA integration
  Homolog annotation: Hit_ID=Q1S3I6; Match level="QueryCoverage=86%, HitCoverage=40%, E-value=0.0, Identity=67%"; Hit description =Integrase, catalytic region
EGTKGYLLYDPITHEFYVSRNVIFHETVFPFASPPPANNPVSVNPDITNLDTSDILLDLPLSLPPPNEPTSSPAPTRKSHRLTKPPAYLSEYHCNLLSSMLPASNPEPKTYKQACKFDYWNLAMKSELDALASTNTWSVVDLPKGKQPIGCKWVYKIKHHADGSIERYKARLVAKGYTQLEGVDYFDTFSPAAKLTTIRTLLSVAAIKDWHLEQLDVNNAFLHGDLHEEVYMDLPPGFLRPGSSSNKVCKLHKSLYGLKQASRQWFSKLSTALISLGYSPSSADHSLFTKLHNSHFTALLVYVDDIVLTGDDLQEIQSVKQFLDSTFKIKDLGKLKYFLRLEIARSTQGIFLNQRKYALELLEDNGLLATKPSTTPFDCSLKLHDSDSPPYEDETAYRRLVGRLLYLTTTRPDIAFIVQQLSQFISQPLQVHHSAAIRVLKYLKSAPAKGLFYSSSSTLKLSGFADSDWASCPATRRSVTGYCVFLGTSMLSWKSKKQSTISRSSSEAEYRALASLTCELEWLQYLFKDLHISLDQPISAYCDNKSAIYLAHNPIFHERTKHIEIDCHVIREKIQTGLIHLLPVSSVAQLADVLTKPLPAPSFNSLISKLGLLDIHSPACGGLLHDVNSNSS

SEQ ID NO: 132018 - protein, 224 aa, Glycine max
  Coding DNA Sequence Number=SeqID_15240
  Gene Ontology: Mol. function=protein-tyrosine kinase activity; Cellular component=cyclin-dependent protein kinase holoenzyme complex; Biological process=regulation of progression through cell cycle
  Homolog annotation: Hit_ID=Q9M205; Match level="QueryCoverage=93%, HitCoverage=91%, E-value=3e-79, Identity=68%"; Hit description =Regulatory protein-like
  Pfam annotation: Domain name=Cyclin; Domain location=30-170; Score =111.0; E_value=3.4e-30; Accession=PF08613.1; Description=Cyclin
  Pfam annotation: Domain name=Cyclin_N; Domain location=34-171; Score =8.7; E_value=2.6e-05; Accession=PF00134.13; Description=Cyclin, N -terminal domain
  Pfam module annotation: Pfam domain module=Cyclin::Cyclin_N; Domain location=30-170::34-171
MTSCSSITISPRKLRYDLYSYSYKEDSNTPLVINVLASLIERSMARTQRIVKNCSNSLSKAISTNIFDCREIPDLTIQSYLERIFRYTRAGPSVYVVAYVYIDRFCQNNPGFRINARNVHRLLITTIMVASKYVEDMNFRNSYFARVGGLTTNELNELELEFLFMMGFKLHVNVSVFESYCCHLEREVSIGGGYHIERTLRCAEEIKAKNIEGRGYTQITRVML

SEQ ID NO: 132019 - protein, 61 aa, Glycine max
  Coding DNA Sequence Number=SeqID_15241
MSYHTIGNPTLSLSPRRHHWWRVRVFHPCKDTPTHVINMSLKDIPNRCNPKRFLSRRDRFS

SEQ ID NO: 132020 - protein, 201 aa, Glycine max
  Coding DNA Sequence Number=SeqID_15242
PESCSLESLTFECLSSVINLAYIRKNCWNPEDLTVSIRGARRARLRPTKLPSTSAAPTPASTSAAPLVPAQRSIPSVEQFLERVACPGTQPSLHREDEGPTAQVPQHVEDESSKATIPEPFMIHPHQWWTYLRVSMQLDPSTPILEIPKDPTTPVLTLNTSLPATPILHLTDEEDVQTQDTQDQFPNSNSGGHGRAQLDFS

SEQ ID NO: 132021 - protein, 214 aa, Glycine max
  Coding DNA Sequence Number=SeqID_15243
  Subcellular localization annotation: CTP_CleavageSite=62; ConfidenceScore=5.22e-01
MSIQTHQIALDNTNRVTTQLERAILPKSSSARAPPNLILNIGNQNVTPMVSSIGTSNVIIPMAMPNPRQNLQIERELRREEPNEVARNFRLTEGQAERPLGNQRLEIGEGSSSKRRRTNSLPRQGPNTGLALQLPNNAPAWQGPNTGLALQLPNNAPEIQGPQNQNNNPGNQVEIRGNSLYDPIFETLGLAVDPHIRLFEAQNGQAEKGYYMFK

SEQ ID NO: 132022 - protein, 144 aa, Glycine max
  Coding DNA Sequence Number=SeqID_15244
MDAKEFGLGEGILVQVGLILGETSSQIQQQNLARNYDPFTNQLLNDPPVFQGLAISNENHTRSQVDEIARVNMGKANTQIMTSERSTLPPLQDDHTNNSHEAWNSRTIHQAKWFSHCRYTQSQSQVAMPNDYRERVDGPVQLYR

SEQ ID NO: 132023 - protein, 274 aa, Glycine max
  Coding DNA Sequence Number=SeqID_15245
MDKNLPGSVQREEQLTQLHLPPWTGNQEFHWWMDRICVVEVRQVEGGNKRDWFNQALVKRVGDRRDTFFWKDKWAGDDLLLQTFLDYLVLLLIRRQRLGKRGSGWMKDGAGNGIGEGSFLGGKRSCFYYCRLFWRIIHQLETYQLWSSEANGIFTVSSAYVCLKENTMTEGAGIYQLERLMEFSDTAEGDTVRVEGSMQFMRLGRGISGFGTLSFKWVGISSAIHKNFETNMVHFNGMAGTVGVESESWETIYHGCNIMGNLAKQKQGGVLIDR

SEQ ID NO: 132024 - protein, 144 aa, Glycine max
  Coding DNA Sequence Number=SeqID_15246
RSVAGDLIPIDLEINATCRRQNAERIRIFLQDLEAVATPGEEPRSFEAFSSFPTQGQSHTRVKGDTIMAEQPRRMILEDYSNVIRLSLFSFSLSGEAKRWLHSFKGVKTWDEVVEKFLKTISLSLRLQKEKRPSLLFTNFEMNP

SEQ ID NO: 132025 - protein, 45 aa, Glycine max
  Coding DNA Sequence Number=SeqID_15247
MAGATVGTGHWALMGKEFLRLAKTKSVPKYCKTTRSEGLGSINVC

SEQ ID NO: 132026 - protein, 266 aa, Glycine max
  Coding DNA Sequence Number=SeqID_15248
  Gene Ontology: Mol. function=signal transducer activity; Cellular component=membrane; Biological process=response to light stimulus
  Homolog annotation: Hit_ID=Q69P69; Match level="QueryCoverage=99%, HitCoverage=39%, E-value=8e-55, Identity=44%"; Hit description =Putative RPT2
MKFMKLGSRPDTFYTAEAVRSVSSEVSSDLIIQVKGSRYLLHKLVVSTYSEVHGDVVQFPLLSKCLRLQKLCSEPPDSSSQHQIIQLPDFPGGMEAFELCAKFCYGITITLSPYNIVAARCGAEYLQMTEEVEKGNLIQKLEVFFNSCILRGWKDSIVSLQSTKALPMWSEDLGITSRCIEAVAAKVLSHPSKVSLSHSHSRRVRDDVSCNGNQSVRHNKSGNKGWWAEDLAELSIDLYWRTMIAIKSGGKIPSNLIGDALKIYAS

SEQ ID NO: 132027 - protein, 68 aa, Glycine max
  Coding DNA Sequence Number=SeqID_15249
DTLEATKTGHIQLFVQCGCPLLLSHLAETCTYKKLEKENTSTAPSAKAQVFHSIHLNFRSWQLTAVSG

SEQ ID NO: 132028 - protein, 163 aa, Glycine max
  Coding DNA Sequence Number=SeqID_15250
  Gene Ontology: Mol. function=DNA binding
  Homolog annotation: Hit_ID=Q1SFS3; Match level="QueryCoverage=96%, HitCoverage=38%, E-value=8e-54, Identity=71%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)
MDIPLRSTRKYLFKKTDLLRLRELASLVSDPVDFQAHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAAKPRTHSTRRYLPFNP

SEQ ID NO: 132029 - protein, 131 aa, Glycine max
  Coding DNA Sequence Number=SeqID_15251
MGPILLDPQRPLLGGCAEKGTGLQKQNTAPHVLSRGGYEHLEQNLMVEKIKKKLEEDAQSESTEGVIDPPSPITREVEDWDSLEEQASQGSFVPHGRQDLLTAAIGRPEHPGRVRASRVGVTIKQYFGLAP

SEQ ID NO: 132030 - protein, 104 aa, Glycine max
  Coding DNA Sequence Number=SeqID_15252
RSFLIGAVVVVSFGYPKERDGSWVKKGAQPNDDEGQLPVEGDSSLLQSILDKFDGLQTYVGERFDALEQQVDMRFDAMDSRITKVKEDVTIIRDCLDLPPPPSV

SEQ ID NO: 132031 - protein, 285 aa, Glycine max
  Coding DNA Sequence Number=SeqID_15253
  Gene Ontology: Mol. function=protein binding; Cellular component =integral to membrane; Biological process=xylan catabolic process
  Homolog annotation: Hit_ID=Q1SWI7; Match level="QueryCoverage=80%, HitCoverage=88%, E-value=2e-71, Identity=36%"; Hit description =Leucine-rich repeat
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=128-150; Score =10.0; E_value=3.9; Accession=PF00560.23; Description=Leucine Rich Repeat
  Pfam annotation: Domain name=LRR_1; Domain location=152-175; Score =12.2; E_value=1.5; Accession=PF00560.23; Description=Leucine Rich Repeat
  Pfam annotation: Domain name=LRR_1; Domain location=177-199; Score =10.8; E_value=2.7; Accession=PF00560.23; Description=Leucine Rich Repeat
  Pfam annotation: Domain name=LRR_1; Domain location=201-223; Score =16.9; E_value=0.075; Accession=PF00560.23; Description=Leucine Rich Repeat
  Pfam annotation: Domain name=LRR_1; Domain location=31-50; Score=0.7; E_value=2.1e+02; Accession=PF00560.23; Description=Leucine Rich Repeat
  Pfam annotation: Domain name=LRR_1; Domain location=52-73; Score=4.0; E_value=51; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-99; Score =11.6; E_value=1.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=104-126::128 -150::152-175::177-199::201-223::31-50::52-73::7-29::80-99
MWEALSQVLYLNLSRNHIHGEIGTTLKNPISIPTIDLSSNHLCGKLPYLSSNVLQLDLSSNSFSESMNDFLCNDQDEPMQLEFLNLASNNLSGEIPDCWMDWTSLVDVNLQSNHFVGNLPQSMGSLAELQSLQIHNNTLSGIFPTSLKKNNQLISLDLGANNLSGTIPTWVGENLLNLKILRLRSNRFASHIPSEICQMSHLQVLDLAENNLSGNIPSCFSNLSAMALKNQSTDPRIYSQAQYGRRYSSTQSIVSVLLWLKGRRDRVQKHSGFGNKHMICQVTSY

SEQ ID NO: 132032 - protein, 61 aa, Glycine max
  Coding DNA Sequence Number=SeqID_15254
MHGSKLEGGGHVNQNAIHGAPQKGGGHMNENAIHWAPKRLRMENCTKQSLRMSPNSKVEDT

SEQ ID NO: 132033 - protein, 352 aa, Glycine max
  Coding DNA Sequence Number=SeqID_15255
  Gene Ontology: Mol. function=hydrolase activity, hydrolyzing O -glycosyl compounds; Biological process=tRNA aminoacylation for protein translation
  Homolog annotation: Hit_ID=Q1XSQ4; Match level="QueryCoverage=99%, HitCoverage=43%, E-value=1e-122, Identity=57%"; Hit description =Hypothetical protein precursor
MKLQKPEKYFEAAANKSFKTLVQNHLNAYQNYFKRVDLDLGTSEAAKNPTDVRIKNFATGYDPELISLYYQFGRYLLISSSQPGGQPANLQGIWNNSNKPAWDSKYTININTEMNYWPAEKTNLPEMHEPLIRMIKDLSETGRETAKTMYNSRGWVAHHNTDIWRITGVVDFANAGMWPMGGAWLSQHLWEKYLYSGDKNYLRTIYPVLKSAAQFYEDFLIEEPAHHWLVASPSMSPENIPQGHQGSALAAGNTMDNQLMFSLFTKTKKAAQILNTDSDKIQVWNTIISKLPPMKIGSYGQLQEWMEDLDDPKDNHRHVSHLYGLFPSNQISPFTTPELLDASRTVLIHRGD

SEQ ID NO: 132034 - protein, 74 aa, Glycine max
  Coding DNA Sequence Number=SeqID_15256
MVKLLRANRRKSPQTLTSQNPTTIPQAMMTMRMFPDFEGCDYLNRFFLRVWHRRITHPNKIMVKHHKINIRLWK

SEQ ID NO: 132035 - protein, 62 aa, Glycine max
  Coding DNA Sequence Number=SeqID_15257
  Gene Ontology: Mol. function=electron transporter, transferring electrons within cytochrome b6/f complex of photosystem II activity; Cellular component=integral to membrane; Biological process =photosynthetic electron transport
  Homolog annotation: Hit_ID=Q9X9S9; Match level="QueryCoverage=53%, HitCoverage=15%, E-value=3e-12, Identity=94%"; Hit description =Cytochrome b6
MEYIHMRRNIFTGYIIGNRLNFKTFFEPIIDFIEIGILLLGPYESIKKTSDSYYNHDDSKKP

SEQ ID NO: 132036 - protein, 120 aa, Glycine max
  Coding DNA Sequence Number=SeqID_15258
MYLSANYTLRDKSCYLPQKIIRKERRWGEGSCYVHPALLLGHPANSEVAKLPFNNSSFGRSISVNFSEKAFPESFRKKISSGRRICEFRKYHKLRPEERHPEVSGRTFFRKFPEEPSSGT

SEQ ID NO: 132037 - protein, 252 aa, Glycine max
  Coding DNA Sequence Number=SeqID_15259
  Homolog annotation: Hit_ID=Q2QLK4; Match level="QueryCoverage=42%, HitCoverage=12%, E-value=5e-08, Identity=38%"; Hit description =Pentatricopeptide, putative, expressed
MLHITSKGLGGRLTCSRRRRRKPWARLAEKKQVHEEDKKNQVHRRGREDEAVRTNSVFREDYGERVGHDRVAPVLSGRAREIIADTLTLASAPSCWKSLPLQQHRSRHPSFSHLLNPSSILYASTTPLNDAEFPGRDMLSFYSQNMLRAKAISSTLSSNARSILLSGSRCNAADGNSCNCPEDETCVSKRQQRKNNEDLLAPKPPSLVSKATSQVVGTLVSGNLANGPASHNVGSVGQSGCVQKSGLLRMHR

SEQ ID NO: 132038 - protein, 49 aa, Glycine max
  Coding DNA Sequence Number=SeqID_15260
MPKWMRAHGESFDTTSRKVSMSDAHRSRVSHYMREGIVVDGGRGILREV

SEQ ID NO: 132039 - protein, 617 aa, Glycine max
  Coding DNA Sequence Number=SeqID_15261
  Homolog annotation: Hit_ID=O80784; Match level="QueryCoverage=84%, HitCoverage=48%, E-value=1e-152, Identity=50%"; Hit description =Nodulin-like protein
  Pfam annotation: Domain name=MFS_1; Domain location=11-499; Score= -22.8; E_value=0.0035; Accession=PF07690.6; Description=Major Facilitator Superfamily
  Pfam annotation: Domain name=Nodulin-like; Domain location=7-271; Score=222.8; E_value=7.4e-64; Accession=PF06813.4; Description =Nodulin-like
  Pfam annotation: Domain name=Sugar_tr; Domain location=97-544; Score=- 156.6; E_value=0.057; Accession=PF00083.14; Description=Sugar (and other) transporter
  Pfam module annotation: Pfam domain module=MFS_1::Nodulin-like::Sugar_ tr; Domain location=11-499::7-271::97-544
MGWVANRWTGVAAAIWIQWSCGASYTFSIYSSVLKSTQGYDQSTLDTVSVFKDIGANFGVLSGLLYSAVVPYTTHRASAAAKSKWASLGGPWVVIAAGTVQCFAGFIFIWASVVGLISPPPVPVMCFFAWLASNGQTFLNTTNVVTGLRNFPEYSGTIIGIMKGFLGLSGAILIQIYHTFFDGDPATYLLMLAALPSFICVLLMFLLRIYEVHGSDYKKHLDGFSVVTVIIVAYLMFIIILQNLVSLPYWGRMFAFVILMVLLATPFGIAIKAHWEESRKFAQSYTIGRSSSTNKGTTSSSYSASVDQVEYHELPSDEGQEQVTSDDKLPREEEKNLWQAMCTVDFWMLFVIMISGLGSGLATINNMSQIGQSLGYSTIEINNLVSLWSMWNFLGRFGGGHVSDYIMHRKGWPRPLLMTATLGIMILGHLIIASGFRGNLYLGPVLVGICYGAHWSLMPTITSEIFGVKHMGTIFNTIAAASPLGSYILSVRVVGYIYDKQADKEDNLCFGIDCFMPSFFILAGRLWMALTCLEGSSEAVEWRMDRIPDLIKGIELVPVVRTVDKGHDLASVKPWVVGDVSDLLFRKSMRNIENAENVTARLQLLVESSLPAFVMYD

SEQ ID NO: 132040 - protein, 287 aa, Glycine max
  Coding DNA Sequence Number=SeqID_15262
  Gene Ontology: Mol. function=DNA binding; Cellular component=oxygen evolving complex; Biological process=DNA integration
  Homolog annotation: Hit_ID=Q1SS72; Match level="QueryCoverage=97%, HitCoverage=28%, E-value=1e-47, Identity=34%"; Hit description =Integrase, catalytic region
YVFKVSEIYESQFYHQAIRFPKWRQAMNEEIQALQMNNTWVVQPLPPDKRPISCRWIYKVKYRADGSLDRYKARLVAKGNWNMFQLDLNNVFLNSDLIEGVYMDMPLGYLVKNDNMVCKLTKSSYGSGATLVTLLVYVNDIIIVGPDQKLIAETQQMLVKHFKIKVIGDLKYFLGLEIDKSPRGIHLCQNASQYRRLIGRLMYLTISHPDISPHLAKALYFPHHHPCGFLHMWTPTRVVAKSPIVTIGFCVFLDSSFIAWKSKKQPMVARSSAEGTCPDWLHQPCPS

SEQ ID NO: 132041 - protein, 141 aa, Glycine max
  Coding DNA Sequence Number=SeqID_15263
  Subcellular localization annotation: CTP_CleavageSite=28; ConfidenceScore=5.10e-01
VSKHDVKGFISHTIWPQGRGKPQHPNPRSLMTPPYSSLRLPRREYDEFRRELEMRCWHKALTRQMDGHIDVALLKEFYANLYDPEDKSPRQRPPWFWSQGKDTQPIPGSTADAQILRSLSPSSVFQGATLSLTLMERPGSS

SEQ ID NO: 132042 - protein, 165 aa, Glycine max
  Coding DNA Sequence Number=SeqID_15264
MLAESSLAWPHELPLAITEASGLQRPHLPPQRRRLDSWPGHLSSELLNTDDGLMLSQVLVGAGVDGEGRTEVEGATKVKVGSAGVEEEGAAESCPLALDLRVPGNVIEGSSRDSNVSKSGTTPWAMHRAVISVGNPSLEELDWAICKICPEMNEPTYMSIFITSP

SEQ ID NO: 132043 - protein, 133 aa, Glycine max
  Coding DNA Sequence Number=SeqID_15265
  Gene Ontology: Mol. function=RNA-directed DNA polymerase activity; Biological process=DNA integration
MASEVSILQPSSSLLLSSSFISEVLQPFELSAMDDPYDPYIINNAYTMLMALVGRNKLRFVDGTIHPPDPKDPLHHVWLHNNNIVASWLMNSISKEVVASVTYSLIATTIWKDLKDRFHQNNGAHILQPKRDL

SEQ ID NO: 132044 - protein, 61 aa, Glycine max
  Coding DNA Sequence Number=SeqID_15266
MNKLGAKSGIAIVYQWKMKKKKKLEKVEKWMLTIHRIEYGTGSLNINLKGNTPHAYLYKVA

SEQ ID NO: 132045 - protein, 144 aa, Glycine max
  Coding DNA Sequence Number=SeqID_15267
RRGFELAEDVIEGSNTSRTPRSINTSSTSSFRYKDGPAATPVFVLFVVHVDCTYTEHLLRQRPSSPTTTISCPLRLVPFEAAADKGPWLSSSWSTLYYLRKISGVYVGLVDEADLRAVSERPSGTACCHPSSVVCHPVPHYQFR

SEQ ID NO: 132046 - protein, 344 aa, Glycine max
  Coding DNA Sequence Number=SeqID_15268
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=62%, HitCoverage=83%, E-value=3e-50, Identity=57%"; Hit description=CjMDR1
  Pfam annotation: Domain name=ABC_membrane; Domain location=22-344; Score=24.5; E_value=0.00012; Accession=PF00664.13; Description=ABC transporter transmembrane region
  Pfam annotation: Domain name=ABC_tran; Domain location=211-344; Score= -24.3; E_value=2.4e-05; Accession=PF00005.17; Description=ABC transporter
  Pfam module annotation: Pfam domain module=ABC_membrane::ABC_tran; Domain location=22-344::211-344
MEKRFKNKNVQADFGLKGKEHVLKIILTNFLSSFLNRYYTNFSSYVITSNPVFSLEIATGPRELPGDQPNIGIMSEGHNEQEKGALLDYYYATYANDSWLRVNEPKSNCCDWQRVLMSVHGWICWVNDYSEVACWVSTGERQAARIRGLYLRAILRQDISFFDKETNTGEVVGRMSGDTLLIQEALGEKVGKFIQCVACFLGGLVIAFIKGWLLTLVLLSCIPPLVISGSMMSFAFEKLASRGQAAYSEAATVVERTIGSIRQEPILFSCSIKENIAYGKDGATNEEIRAATELANAAKFIDRFPHGVDTIVGEHATQLSGGQKQRIAIAMAILKDPRILQVNL

SEQ ID NO: 132047 - protein, 424 aa, Glycine max
  Coding DNA Sequence Number=SeqID_15269
  Gene Ontology: Mol. function=molecular_function; Cellular component =anchored to membrane; Biological process=biological_process
  Homolog annotation: Hit_ID=Q1SLH3; Match level="QueryCoverage=53%, HitCoverage=98%, E-value=2e-53, Identity=45%"; Hit description =Thaumatin, pathogenesis-related
  Pfam annotation: Domain name=Thaumatin; Domain location=30-219; Score= 160.8; E_value=3.6e-45; Accession=PF00314.8; Description=Thaumatin family
  Subcellular localization annotation: CTP_CleavageSite=84; ConfidenceScore=5.22e-01
MAMPRSLFITLAIFLGFLSGSYAAKFRISNECISTVWPAIVANSTSTTGFSLQPGKSYMVTMPTGEVKVWARTFCSYSIAGNFSCFTGDCSSSNIDCRGGNANPKPPVTLAEFTLNGSYGLDYYKVSLREGFNLPMSIEPGGSCRSTGCGRDLNQKCPTKLKVIIDGGDVVGCQSLCQAHETCKSTLFSEFSKTKCPEAYQHGSFTCASAQYYTVTFCPTSSRSSKNAEKEKKSPVENSGGQVQGSLYVLLRLLKKYVVPIVAVTVTWYSSPNRQWGMEMVMGQTSTTAEALARNQQHVYAEMFTLNGFNRLGYIRESLTHGFKLAMRVEPLVEPETGGAELVKGAPLLIVVVCDDVINSMDFNDGTVVDLIVFYDGCLLRTVVEWSTIQRRLPDSPVVELRKDYDDLGDSTVVDIIGFYDDCL

SEQ ID NO: 132048 - protein, 332 aa, Glycine max
  Coding DNA Sequence Number=SeqID_15270
  Gene Ontology: Mol. function=RNA-directed DNA polymerase activity; Cellular component=chromatin; Biological process=chromatin assembly or disassembly
MSDHNPSALERIEDAISKLASSQLQVTEKLEDLLLRVANLEQTANSNTSPSSSSPAPASNTITITHPKMKLDVPRFDGSDPSGWVFKITQFFSYHSTPERERLTIASFYMEGPALAWFQWMSRNHQLTTWAGFLEALEARFSPSPYEDPTGILFKLTQQGSVTTYLHQFESLANRIVGLQPSMLLSCFISGLDPAIRREVQALQSLTLAHAAGLARLQEDKLAAQRRPYSQLPSQRPPPPPNPLPLPPLNPNVFPLPSPSTPLLPTPPKPPPLPFRRLTPAELASRRERGLCFHCDEKFTRGHRCASRFFLLVADEDDPNAQDVLDKWPQIS

SEQ ID NO: 132049 - protein, 66 aa, Glycine max
  Coding DNA Sequence Number=SeqID_15271
MVASVTTWWCCWRRSDTAENVIKKQKAELAEAEPKEAESPNSGAKMEEPRPKRTITKPPYLQDFVE

SEQ ID NO: 132050 - protein, 80 aa, Glycine max
  Coding DNA Sequence Number=SeqID_15272
  Gene Ontology: Mol. function=structural constituent of ribosome; Cellular component=ribonucleoprotein complex; Biological process =translation
  Homolog annotation: Hit_ID=P61845; Match level="QueryCoverage=79%, HitCoverage=87%, E-value=3e-25, Identity=98%"; Hit description =Chloroplast 50S ribosomal protein L23
  Pfam annotation: Domain name=Ribosomal_L23; Domain location=10-73; Score=45.9; E_value=1.4e-10; Accession=PF00276.10; Description =Ribosomal protein L23
MPEAGITEQYEQYVVGVFTDKSIRLLGKNQYTFNVESGSTRTEIKHWVELFFDVKVIAMNSHRLPTYDYYASTGLFYSTS

SEQ ID NO: 132051 - protein, 98 aa, Glycine max
  Coding DNA Sequence Number=SeqID_15273
MKKERVQPSWHFEALRKIAEENCFREENPSRGASVTFSWVITRRFSTVLRHSSFVLHFLQSSTGPTPLNDHLSSKKKLCDSPLRKNYVGLISSSMEGT

SEQ ID NO: 132052 - protein, 175 aa, Glycine max
  Coding DNA Sequence Number=SeqID_15274
MAEWSRRILEKCHQITVALQVAYGGAMTAAIVMARCDQQQSPAQRTAARAPATHTTIADDVLERDDKRPADDAHKKPTTDARDRRMTHDARRRQCSGAQRRRQTGLLNKEGRKSRHLRIHNPTVYNQDNCKMINDPTTKHRQAIYIRGKSEYRQKQQRKKERKNHEVILPSQSKI

SEQ ID NO: 132053 - protein, 222 aa, Glycine max
  Coding DNA Sequence Number=SeqID_15275
  Gene Ontology: Mol. function=heat shock protein binding; Cellular component=cellular_component; Biological process=protein folding
  Homolog annotation: Hit_ID=Q9SU57; Match level="QueryCoverage=91%, HitCoverage=57%, E-value=1e-50, Identity=54%"; Hit description=Heat shock-like protein
  Pfam annotation: Domain name=DnaJ; Domain location=22-85; Score =125.3; E_value=1.7e-34; Accession=PF00226.21; Description=DnaJ domain
MALQILTVNSISNAAPEVMGMDYYNILKVNRNASDDDLKKAYKRLARIWHPDKNPVNKTEAEAKFKRISEAYDVLSDPQKRQIYDLYGEEALKSGQFPPPPQSSSSSSSRAFHHHHHHHRQNNNPPPASASSFRFNPRDADDIYAEFFGPDDIGAGASSRRGGGPDAFFRTSNGGGAAFSASAAAGRKAAAVENALPCSLEDLYKGVKKKMKISRNVYDAFG

SEQ ID NO: 132054 - protein, 333 aa, Glycine max
  Coding DNA Sequence Number=SeqID_15276
MPRKLLPERNVVVYYTEFDKFKDELERRHWDEELTSFADDNIDVAIVKEFYANHYDLEDKSPKQVRVRGHLIKIDEDTLNTFPKTPVIEEEGEILCAYSRFALLRPNPQELAAKLCIPWRGFKLNADGQPSKILRKNMTTLAQTWSVLSFSNLIPTSHTSDVTLDKAKLIYGIIMKMDMNVGYLISHQVSLTAQHDSSRLGFPALITALCKARGVQSDSRSLESLSPAINLAYIKKNCWNLDDPTVTFRGPRKARGGLARSLNQRSQQQQQRCTHGSGGGDFHRPVPEPSPAPIPEETQPSAPVMELEKPIQDVPAAPALDLNEDQPQDEQDI

SEQ ID NO: 132055 - protein, 78 aa, Glycine max
  Coding DNA Sequence Number=SeqID_15277
MPISPVLLAEPMGDGCMHGHVMDGMNAACTVGFANGGGEIHMPVNAWRYACFANLNSETPKIKDSLRTMFEKRPILAM

SEQ ID NO: 132056 - protein, 604 aa, Glycine max
  Coding DNA Sequence Number=SeqID_15278
  Gene Ontology: Mol. function=protein serine/threonine kinase activity; Cellular component=cytoplasm; Biological process=protein amino acid phosphorylation
  Homolog annotation: Hit_ID=Q8W4I7; Match level="QueryCoverage=87%, HitCoverage=94%, E-value=0.0, Identity=66%"; Hit description=Calcium- dependent protein kinase
  Pfam annotation: Domain name=Kdo; Domain location=67-253; Score= -88.0; E_value=0.1; Accession=PF06293.4; Description=Lipopolysaccharid e kinase (Kdo)
  Pfam annotation: Domain name=Pkinase; Domain location=69-327; Score =323.2; E_value=4.4e-94; Accession=PF00069.15; Description=Protein kinase domain
  Pfam annotation: Domain name=Pkinase_Tyr; Domain location=69-331; Score=-21.1; E_value=3.5e-11; Accession=PF07714.7; Description =Protein tyrosine kinase
  Pfam annotation: Domain name=efhand; Domain location=399-427; Score =38.0; E_value=3.3e-08; Accession=PF00036.22; Description=EF hand
  Pfam annotation: Domain name=efhand; Domain location=435-463; Score =27.8; E_value=3.8e-05; Accession=PF00036.22; Description=EF hand
  Pfam annotation: Domain name=efhand; Domain location=471-499; Score =30.6; E_value=5.6e-06; Accession=PF00036.22; Description=EF hand
  Pfam annotation: Domain name=efhand; Domain location=507-535; Score =41.4; E_value=3.1e-09; Accession=PF00036.22; Description=EF hand
  Pfam module annotation: Pfam domain module=Kdo::Pkinase::Pkinase _Tyr::efhand::efhand::efhand::efhand; Domain location=67-253::69 -327::69-331::399-427::435-463::471-499::507-535
MGNCNVCAKADVVEDSNNNRNKKSNETNRARKKEPKPFTDEPARSTAAPIRVLKDVIPMSHRTRISDKYILGRELGRGEFGITYLCTDRETKEALACKSISKRKLRTAVDIDDVRREVAIMSTLPEHPNVVKLKATYEDNENVHLVMELCEGGELFDRIVARGHYSERAAAAVARTIAEVVRMCHSNGVMHRDLKPENFLFANKKENSALKAIDFGLSVFFKPGERFSEIVGSPYYMAPEVLKRNYGPEVDVWSAGVILYILLCGVPPFWAETEQGVALAILRGVIDFKREPWPQISESAKSLVRRMLEPDPKNRLTAEQVLGGNWEGGEFGMKTTSHFLGMTIILEEHPWLQNAKKAPNVPLGDIVRSRLKQFSVMNRFKKKALRVIADHLSVEEVEIIKDMFTLMDTDKDGRVTFEELKAGLRKVGSQLAEPEIKMLMEVADVDGNGVLDYGEFVAVTIHLQKMENDEHFHKAFKFFDKDGNGYIELRELEEALADESGETDADVLNDIMREVDTDKDGRISYEEFVAMMKTGTDWRKASRQYSRERFKSLSLNLMKDGSLQLHDEITASCHALTQLLIFLAPPIVLEISFAESLQGSKFWA

SEQ ID NO: 132057 - protein, 333 aa, Glycine max
  Coding DNA Sequence Number=SeqID_15279
  Gene Ontology: Mol. function=transmembrane receptor activity; Cellular component=membrane; Biological process=defense response
  Homolog annotation: Hit_ID=Q19PP0; Match level="QueryCoverage=92%, HitCoverage=18%, E-value=4e-65, Identity=43%"; Hit description=TIR -NBS-LRR type disease resistance protein
MHDEISTLEKNHTRVLTDLPQHKNVIGCKWVYKIKHNADGSIEWYKARLVAKGYTQIEVILMKRGIWVYLQASHQWYAQLSTFLMAYGFKQFVADYSLFTLKRENSFTTLLVYVDDIVLSRNDLSVISHITKLLDDTFKIKDLGNLKYFLGFEVAHGTSVAPGLGIFFPSTSELQFKAFSDSDWARCINTRKFITDFSVYLGSSLISWKSKKQATVLRSSFEAEYRALTIVTCEIQWLTYLPHDFGIIHKPALVFCDNKSALHITANPDFHERTKHIEIYCHLVHDKLLSGLIKLLPIASAQQLVDVYTKALALGAFHFIFSKLGINGIHSPT

SEQ ID NO: 132058 - protein, 139 aa, Glycine max
  Coding DNA Sequence Number=SeqID_15280
MEIWAIHNGPTVNAWHDRWLDERTMLFDQAIVFPAHIHNCCVADLVDNNGDWNLPLLNMFLPHDIVKRIKMQNMVLQIDSKAVVTAIKGNRWGCVSGRRLVRTIRILLPSFNHIRIHHHSHREKDYYWLIMVVLWGVNM

SEQ ID NO: 132059 - protein, 58 aa, Glycine max
  Coding DNA Sequence Number=SeqID_15281
MVQFAWHSMLPQAPIEHMFVQHLVMTDNLEKGLLNVLPAIARKSRNLPHESVTQASGI

SEQ ID NO: 132060 - protein, 85 aa, Glycine max
  Coding DNA Sequence Number=SeqID_15282
MVEGFEDCVCGDEHEGRNAFPRLFLNSEQKRRWWEIWEHGMRKIGHGILPGENRGLNGRRMKYMNFMHYWKRRSLEGKSWIVGSG

SEQ ID NO: 132061 - protein, 69 aa, Glycine max
  Coding DNA Sequence Number=SeqID_15283
MTAYGGRGENKRWQIMITDLMHTSAQFESIAITRQVKRVKFNLASRMNPKIDENLIFISFVDFCQLRLD

SEQ ID NO: 132062 - protein, 615 aa, Glycine max
  Coding DNA Sequence Number=SeqID_15284
  Gene Ontology: Mol. function=protein serine/threonine kinase activity; Cellular component=integral to membrane; Biological process=protein amino acid phosphorylation
  Homolog annotation: Hit_ID=Q9LFS4; Match level="QueryCoverage=95%, HitCoverage=94%, E-value=0.0, Identity=71%"; Hit description =Receptor protein kinase-like protein
  Pfam annotation: Domain name=LRRNT_2; Domain location=46-86; Score =47.1; E_value=6e-11; Accession=PF08263.3; Description=Leucine rich repeat N-terminal domain
  Pfam annotation: Domain name=LRR_1; Domain location=114-136; Score =15.4; E_value=0.21; Accession=PF00560.23; Description=Leucine Rich Repeat
  Pfam annotation: Domain name=LRR_1; Domain location=138-160; Score =20.7; E_value=0.0053; Accession=PF00560.23; Description=Leucine Rich Repeat
  Pfam annotation: Domain name=LRR_1; Domain location=162-184; Score =16.3; E_value=0.11; Accession=PF00560.23; Description=Leucine Rich Repeat
  Pfam annotation: Domain name=LRR_1; Domain location=284-309; Score =3.2; E_value=72; Accession=PF00560.23; Description=Leucine Rich Repeat
  Pfam annotation: Domain name=Pkinase; Domain location=295-564; Score =118.6; E_value=1.8e-32; Accession=PF00069.15; Description=Protein kinase domain
  Pfam annotation: Domain name=Pkinase_Tyr; Domain location=295-564; Score=116.0; E_value=1.1e-31; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=46-86::114-136::138 -160::162-184::284-309::295-564::295-564
MGTQRGIALLSFTFFLLLSSANALLSPKGVNFEASYLFKSFEFGLTLIAVQALMGIKDSLEDPHGVLDNWDGDAVDPCSWTMVTCSSENLVIGLGTPSQSLSGTLSPSIGNLTNLQIVLLQNNNISGPIPSELGKLSKLQTLDLSNNFFSGGIPPSLGHLRSLQYLDLSYNNLSGPVPRILAKSFSIIGNPLVCATGKEPNCHGMTLMPMSMNLNNTEDALQSGRPKTHKMAIAFGLSLGCLCLIVLGFGLVLWWRHKHNQQAFFDVKDRHHEEVYLGNLKRFQFRELQIATNNFSSKNILGKGGFGNVYKGVFPDGTLVAVKRLKDGNAIGGEIQFQTEVEMISLAVHRNLLRLYGFCMTPTERLLVYPYMSNGSVASRLKGKPVLDWGTRKHIALGAGRGLLYLHEQCDPKIIHRDVKAANILLDDYYEAVVGDFGLAKLLDHQDSHVTTAVRGTVGHIAPEYLSTGQSSEKTDVFGFGILLLELITGQRALEFGKSANNKGAMLDWVKKIHQEKKLDMLVDKDLKNNYDRIELEEMVQVALLCTQYLPGHRPKMSEVVRMLEGDGLAEKWEASQRVDTTKCKPQESSSSDRYSDLTDDSLLLVQAMELSGPR

SEQ ID NO: 132063 - protein, 380 aa, Glycine max
  Coding DNA Sequence Number=SeqID_15285
  Gene Ontology: Mol. function=zinc ion binding; Cellular component =intracellular; Biological process=regulation of transcription, DNA -dependent
  Homolog annotation: Hit_ID=Q52ZI8; Match level="QueryCoverage=90%, HitCoverage=95%, E-value=1e-105, Identity=56%"; Hit description =CONSTANS-LIKE a
  Pfam annotation: Domain name=CCT; Domain location=317-355; Score =78.2; E_value=2.5e-20; Accession=PF06203.4; Description=CCT motif
  Pfam annotation: Domain name=zf-B_box; Domain location=38-74; Score =11.7; E_value=0.0071; Accession=PF00643.14; Description=B-box zinc finger
  Pfam annotation: Domain name=zf-B_box; Domain location=78-125; Score =61.2; E_value=3.3e-15; Accession=PF00643.14; Description=B-box zinc finger
  Pfam module annotation: Pfam domain module=CCT::zf-B_box::zf-B_box; Domain location=317-355::38-74::78-125
  Subcellular localization annotation: CTP_CleavageSite=13; ConfidenceScore=5.07e-01
MSQLSDTTKYPPRVAERFSRWHKTLTPPMLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLEFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 132064 - protein, 199 aa, Glycine max
  Coding DNA Sequence Number=SeqID_15286
  Gene Ontology: Mol. function=molecular_function; Cellular component =nucleus
  Homolog annotation: Hit_ID=Q69L77; Match level="QueryCoverage=57%, HitCoverage=38%, E-value=2e-31, Identity=55%"; Hit description =Putative brix domain-containing protein
MFSLSKSERKKNWEERLGIKKKPFKRVVRIAGPKTQLERGLSPKARPNLTLWDSEKEKKPLPPLIVVHFEAKIMGKKRKHSETTQSVAQPKKEDAAPERPARTLLGWKDKNQVEDNNNADSPIFRNKEKLLVTCSRRINYRYRHLMLNLVTLLPHCKKDNKVESKETKGATLNELVELKNCSSCLFFEIHACYNLNNDC

SEQ ID NO: 132065 - protein, 112 aa, Glycine max
  Coding DNA Sequence Number=SeqID_15287
  Gene Ontology: Mol. function=cellulose synthase (UDP-forming) activity; Cellular component=membrane; Biological process=cellulose biosynthetic process
  Homolog annotation: Hit_ID=Q1T0J4; Match level="QueryCoverage=99%, HitCoverage=10%, E-value=7e-52, Identity=84%"; Hit description=Zinc finger, RING-type; Cellulose synthase; Zinc finger, FYVE/PHD- type
MQNGTPWPRNNVRDHHGMIQVFLGKNGVRDMEGNELPYLVYVSREKRAKYHHHKKGGAMNALVRVSTIISNAPYVLNVDCDHYINNSKALREAMCFMMDPTSGKKICCVQFP

SEQ ID NO: 132066 - protein, 45 aa, Glycine max
  Coding DNA Sequence Number=SeqID_15288
  Gene Ontology: Mol. function=cellulose synthase (UDP-forming) activity; Cellular component=membrane; Biological process=cellulose biosynthetic process
  Homolog annotation: Hit_ID=Q1T0J4; Match level="QueryCoverage=86%, HitCoverage=3%, E-value=6e-11, Identity=77%"; Hit description=Zinc finger, RING-type; Cellulose synthase; Zinc finger, FYVE/PHD- type
MKGLEGIQGPIYVGTGCVFRRQAFYEYDASTLKTTPRKTCLRQQE

SEQ ID NO: 132067 - protein, 495 aa, Glycine max
  Coding DNA Sequence Number=SeqID_15289
  Gene Ontology: Mol. function=zinc ion binding; Biological process =transcription
  Homolog annotation: Hit_ID=Q1SPG0; Match level="QueryCoverage=56%, HitCoverage=82%, E-value=6e-65, Identity=40%"; Hit description=Zinc finger, SWIM-type
  Pfam annotation: Domain name=zf-CCHC; Domain location=449-466; Score =15.6; E_value=0.0026; Accession=PF00098.13; Description=Zinc knuckle
MWLGGDVSCACGCPDFEMIYFSFVNLAGGYHKVGFIRKDIYNEQARMRKLKTTDAGGALKYPSLLCQKDPIMVVTYTVDERERLQYLFWCDAESQMNYKVFGVNHHNHTIVFAAAVVTNETEETYVWLFEKFLQAMNGKAPFSVIADGDVAMKNSIKRVFLNAHHRLSVGHLMRNATSHVRDKGVLKCLKSFMLSDIEVVEFEERWTNMVGKYELQDNHWITDLYARRKTWSPTHIRGNFFAGIQTTSRCEAFHSHVAKYVDVKLNLTEFVEQFQRSLTLQSLEKSVGTILTKEMLLLLKPTIAKTVRFKVVDCKEMTMFSIYTVVKYRSESIWWSKNAKEPIKGKYLGASLYWESEDIARYATLLQLSREVCEAGYRVEEDFDDLVVLFSNEVTRLKSKNINAGVQNEMETHVETVNEFDGVLNPPVVRAKGCGQTMNNESNSRRRIQTCGICGATGHNRRKCTVLSQNSIDAGGRVGIPPSHQTCNAPKMTDE

SEQ ID NO: 132068 - protein, 81 aa, Glycine max
  Coding DNA Sequence Number=SeqID_15290
MKLWCCPWLCFTKEDEEECNVPKPMKEDDVFRNHVIFYDGNNIHGGDYKQFMIACANALGSWLEMWCNHGAKKQSKCERGY

SEQ ID NO: 132069 - protein, 196 aa, Glycine max
  Coding DNA Sequence Number=SeqID_15291
MKSQDLVTAIVCLAYNTEQSMAEIVECTSSRLGLSYAPEGGLMSMMYGGGKLAEGLTKLSILPSLLVHQMHLWVKHKWCKMKLSSYLALDFCTLVSSEDDVFQLAQLASKVVKDPKLTVDQLEKLLVKSSILEDAQKSKAKLNYRLVSTTNSIPSLVEEIQLGFSRRAKWEMDKGKHAKVAADIEDRFFKLKGLTF

SEQ ID NO: 132070 - protein, 135 aa, Glycine max
  Coding DNA Sequence Number=SeqID_15292
MSNIAYVTKLGLSLIVVASHKRLAEDARPTHPIDILASWFVSRHFALSELVVFFGGDVLLLPQIGTWSLVLFGELHASCQTMLHMAFKMSLFLSSKASNLLSRPPSSNYNSIYRFNRLQISIDNVYKHYDEGCTI

SEQ ID NO: 132071 - protein, 119 aa, Glycine max
  Coding DNA Sequence Number=SeqID_15293
MQGKIPFETTLPSRKMTYSVGRSVERMLKMPKIDCQPHMSGVPKFKIYANLGEVKNIRASGVHEKPRTNATTNRGNGELLPMGMSCVFRPTSDMKLSIDKAHVCAYIFNPKLDKIYTNL

SEQ ID NO: 132072 - protein, 110 aa, Glycine max
  Coding DNA Sequence Number=SeqID_15294
MNSTMSESGAGGFKTLSSPIPYLFGGLAIMLALIAVALLILAWSYRKQYYTTSSNSASDEEKPPQIKMVEKEENVSEPKIVVIMAGEGNPTYLAKPVPSTSHNEQALISK

SEQ ID NO: 132073 - protein, 191 aa, Glycine max
  Coding DNA Sequence Number=SeqID_15295
  Homolog annotation: Hit_ID=Q1RWU1; Match level="QueryCoverage=69%, HitCoverage=32%, E-value=1e-11, Identity=33%"; Hit description =Resistance-like protein HAAS-2-related
MKGCMNRSRLKSMHDVQYKSTNKGQLLDHTYMSYMRKEIKACNRVTLSWLEGMYHTYVASKSYVWAARAYLLHLVGNTILANKSLTHVHICYLHYLSDLDCCNEYTWGATTLAFLYDQQSYASKYGNQQMRGYMTLLIVFEHLSTISCSEKMVDVFWSPYASRRDIRPFEDFGYIKVGTNMWSYLSERVLR

SEQ ID NO: 132074 - protein, 87 aa, Glycine max
  Coding DNA Sequence Number=SeqID_15296
MGQICVAPGQCAIYYMEWIYIISHPFMSLAQLGDPPRHPLVVHDDTFIELDIPQHPVAAEAMNEAPTNAPGHVEQSQHAMETLDPRS

SEQ ID NO: 132075 - protein, 263 aa, Glycine max
  Coding DNA Sequence Number=SeqID_15297
  Gene Ontology: Mol. function=structural constituent of ribosome; Cellular component=ribonucleoprotein complex; Biological process =translation
  Homolog annotation: Hit_ID=Q9ASV6; Match level="QueryCoverage=79%, HitCoverage=62%, E-value=3e-25, Identity=67%"; Hit description=30S ribosomal protein S20, chloroplast precursor
  Pfam annotation: Domain name=Ribosomal_S20p; Domain location=185-247; Score=-6.3; E_value=0.0096; Accession=PF01649.8; Description =Ribosomal protein S20
  Subcellular localization annotation: CTP_CleavageSite=65; ConfidenceScore=5.97e-01
MAASVSCSWLTLPSQMRSLSLTSSSSSLCISNSASLSFSRNLSRPFFSKGNSLSLSTVLRRASVVCEAAPKKKVDSAVKRARQAEKHRVYNKARKSEIKTRTKKVTHIGKCVMYVRKRGGRERRKIDGDDMKYDYCDIFFFWCLKLSGHSMKLLLDFRVEGMIALICPFFRVTYSSKAWHVVHDVHDVLEALEVLKKKSDAQAEEILPIEKLIGEAYSIIDKAVRVGTLHRNTGANRKSRLARRKKAVEIHHGWYTPAPEAIV

SEQ ID NO: 132076 - protein, 67 aa, Glycine max
  Coding DNA Sequence Number=SeqID_15298
MSFGCLLVDPNGHNLGRIDGDPVLRETRIWATWEYVSSDGGGQQGMVGLCAHCGRGKLVVHHRPTAT

SEQ ID NO: 132077 - protein, 333 aa, Glycine max
  Coding DNA Sequence Number=SeqID_15299
  Gene Ontology: Mol. function=chromatin binding; Cellular component =chromatin; Biological process=chromatin assembly or disassembly
  Homolog annotation: Hit_ID=Q1SAV4; Match level="QueryCoverage=29%, HitCoverage=24%, E-value=2e-17, Identity=45%"; Hit description =Integrase, catalytic region
  Pfam annotation: Domain name=Chromo; Domain location=287-332; Score =24.8; E_value=0.00031; Accession=PF00385.14; Description='chromo' (CHRromatin Organisation MOdifier
MKKAVSKAPVLRLPNFALHFVVETDVSRVGMGAELKHELLLQPEFITFMQEISVNLTDHPDCTTVQGLILKKGCIWLPKGLRFIPILLNKFHVTRTRGHIGITKTLVQGCIWLPKGLRFIPILLNKFHVTRTRGHIGITKTLVQDLKEDLKEDLSLDFIEELLAYRGHNAILMVVDHFSKGIHLGMLHSHYTAHSVALLFMELVGYVQKLQKEVAQGIGTMKHFANNHRRDVLQKIGMVAYKLQLPKGSHIHPSFNYSFLKPFHSSSSTSEPAVELPPTTIENQPVIAPLAIINTRWHYTSSEPKPLVLVQWKGWPPENTTWEDWETLKDASP

SEQ ID NO: 132078 - protein, 41 aa, Glycine max
  Coding DNA Sequence Number=SeqID_15300
MTLDTWAMSSGEFRKNLLSRIPCKIALVKTTTVPRINAHVF

SEQ ID NO: 132079 - protein, 79 aa, Glycine max
  Coding DNA Sequence Number=SeqID_15301
MSFDAAIEVRNHVSPEPEVEDAGVASLANPKACDKIGMQNDFKGSKVASKSENRKQPDLINPIWIHLGDILQGDTNSNS

SEQ ID NO: 132080 - protein, 230 aa, Glycine max
  Coding DNA Sequence Number=SeqID_15302
  Homolog annotation: Hit_ID=Q9LIL7; Match level="QueryCoverage=74%, HitCoverage=27%, E-value=7e-30, Identity=43%"; Hit description =Arabidopsis thaliana genomic DNA, chromosome 3, BAC clone:F4B12
MNTEHVSKHLDKLIVRKCLQHPSLLDIQGATLLLSGSSPAARHVIDAAFEGQGPTGHGSLKEHIALKVKIAETAFMMLCANNFSSKLELTWSLKWQSQAALHALGNISGKTRSENSIILNAEAEGLFLSVLQQDSEMRLAGYRMLSELVARPWCLMEICSKQEIINKVTDPSTETTKIGMEGRYDCCKAIHKSLTVSSRVSANPAFAGIAAKVRYQTFLPYHSFENQTGE

SEQ ID NO: 132081 - protein, 49 aa, Glycine max
  Coding DNA Sequence Number=SeqID_15303
PREMHQCVYIYSDLDARRVQIVLEQNTIMKLRSILLIVWALFALLSHAY

SEQ ID NO: 132082 - protein, 60 aa, Glycine max
  Coding DNA Sequence Number=SeqID_15304
  Subcellular localization annotation: CTP_CleavageSite=38; ConfidenceScore=5.04e-01
MGLILILKDSLGKGSVTSISKEGRTFYYAFSPFPAVARANLSSTGAPTAYFLGAIPTIIP

SEQ ID NO: 132083 - protein, 77 aa, Glycine max
  Coding DNA Sequence Number=SeqID_15305
MSCTPLLYDYLRILPCYVHLPVALLRIYIMSSHMHCMVSSFVTGCRKVHITFLTTHMGHCTAKCTSKKKQFFDLSCP

SEQ ID NO: 132084 - protein, 141 aa, Glycine max
  Coding DNA Sequence Number=SeqID_15306
  Homolog annotation: Hit_ID=Q47522; Match level="QueryCoverage=38%, HitCoverage=66%, E-value=2e-25, Identity=100%"; Hit description=LacZ protein
MRRMPTASARRQQVHQMTEDVPDMTEDAPEMTADVQADDGPEGESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132085 - protein, 177 aa, Glycine max
  Coding DNA Sequence Number=SeqID_15307
  Gene Ontology: Mol. function=chitin binding; Cellular component =extracellular region; Biological process=chitin metabolic process
  Homolog annotation: Hit_ID=UPI0000612705; Match level="QueryCoverage =61%, HitCoverage=98%, E-value=1e-10, Identity=30%"; Hit description =UPI0000612705 related cluster
MTDRLDESISCFLIRVNPWVLVPSPSEDYTSSPLKDYTSSPSEGRTPSPSEDYTSSPSEDYTSSPSKGDMPSPLEDYTSSPSEDYTSSPSKGHVPSTSEDYTSSPSKGHGSHPQRHPVDLKKSNRALGFPALVTGLCRPYRAPVPPSKFMSSWHRDCAHKTPSGPEEGQQGLGVANS

SEQ ID NO: 132086 - protein, 289 aa, Glycine max
  Coding DNA Sequence Number=SeqID_15308
MCSNLSCSETDAVNVEEQGEGQGIGPSSPQGSSQRSSSEEHFSDEEAIQEAEAGGSDIFPASSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSEIKACDDNISSWEATITNLLSQVDDLRQKIVTEQAKRKDSRRRLLIRFRTWLPKKGGKA

SEQ ID NO: 132087 - protein, 181 aa, Glycine max
  Coding DNA Sequence Number=SeqID_15309
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=97%, HitCoverage=63%, E-value=1e-73, Identity=92%"; Hit description =NAD(P)H-quinone oxidoreductase chain H, chloroplast (EC 1.6.5.-) (NAD(P)H dehydrogenase, chain H)
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGPMLRLPEYNGISVKWIIMNVTKNLIGKSMAKRRRFLSSLFSRLVE

SEQ ID NO: 132088 - protein, 114 aa, Glycine max
  Coding DNA Sequence Number=SeqID_15310
MGGGPPAMVEREKFDHIEERLRVIEGGGNYAFADMAELCLVPDVVIPPKFKVSNFDKYKGTTCPKNHLKMYCRKMGACAKDEIFLFISSKKVLLGQPSPGILIWNLPGSIPGRT

SEQ ID NO: 132089 - protein, 47 aa, Glycine max
  Coding DNA Sequence Number=SeqID_15311
MMENKPVNFVGLNKLVLGTKWMNGMNKGEDERKKRITLSREGNTQRL

SEQ ID NO: 132090 - protein, 127 aa, Glycine max
  Coding DNA Sequence Number=SeqID_15312
MSEIEEVHEQMKVDMEAMKEQITTMMEAMMSMRRMMEVNATTFVAASTAIEVDLTHPSGLNQVNHLVSDMVGQGCEALGSTSGPHFVQAQSKHSFPPYGLPPNYTPPNVAHALDENVDNFDPIPIES

SEQ ID NO: 132091 - protein, 134 aa, Glycine max
  Coding DNA Sequence Number=SeqID_15313
MASGNQLPRGVIDYQALKKRDQEAKRASSNRLPRGSHKPLVIDYQIAMAALLIHDRVEMECLEGAWETLEGNARCRFRGTIRFTTTSLVHPDEPARTLQRTVEWILPMPTPYRLVEPVQVIDVTSSEEDLEEDP

SEQ ID NO: 132092 - protein, 68 aa, Glycine max
  Coding DNA Sequence Number=SeqID_15314
MLTTASWLLSKDGNRSAYDIGIGVNSTGFLSGKFLRGLVFMLGLGIGFGQGALGRRGVGQGGGSILAE

SEQ ID NO: 132093 - protein, 91 aa, Glycine max; identical to SEQ ID NO: 124810
  Coding DNA Sequence Number=SeqID_15315

SEQ ID NO: 132094 - protein, 232 aa, Glycine max
  Coding DNA Sequence Number=SeqID_15316
  Homolog annotation: Hit_ID=Q1T493; Match level="QueryCoverage=97%, HitCoverage=42%, E-value=4e-24, Identity=29%"; Hit description =Nucleic acid-binding, OB-fold, subgroup
DIPFRKYRFAGFADVVAGQFERGLLVDVIGVVEEVVFRQVSGKGRRVVFKLKDLSQQLLSCTLWDDYCLQFVKFLDDYEGDGPITVLLSHCRIKEAQGSYSASINNSFKASKLIINQPVMEIQEFNERLAELGIEPRSGFKSHGEGSTQLSGSIQLSSKESFFGKAEAKTIAEINTISEEIVCVTVGTITRIVLDNHSWCYTTCIECHKKSDAEMTPFTCVCSKYNKEAVLR

SEQ ID NO: 132095 - protein, 318 aa, Glycine max
  Coding DNA Sequence Number=SeqID_15317
  Gene Ontology: Mol. function=succinate-semialdehyde dehydrogenase [NAD(P)+] activity; Cellular component=mitochondrion; Biological process=metabolic process
  Homolog annotation: Hit_ID=Q8ZJZ3; Match level="QueryCoverage=74%, HitCoverage=51%, E-value=1e-116, Identity=86%"; Hit description =Putative NAD-dependent aldehyde dehydrogenase
  Pfam annotation: Domain name=Aldedh; Domain location=77-318; Score= -137.6; E_value=8.7e-10; Accession=PF00171.12; Description=Aldehyde dehydrogenase family
  Subcellular localization annotation: CTP_CleavageSite=54; ConfidenceScore=5.25e-01
MQKSAQLPVRAGQFASGLPKSGHVCSKQKLAFGTARESAVCPHGIFRIYLTLPASSAISTTLNILSGIFDCVNSDNKETCDMAYQTVNPANNQLIKSYPAHSDADVEAALRQADALYHSAWAKGDIAQRLPVLHKLADLIDSRTEELAKIASQEMGKLIKQSRGEVKLCAQIARYYADNAERFLAPVKYPSDLGEAWVEHHPIGVLMAVEPWNFPYYQLMRVLAPNLAAGNPVIAKHASIVPQCAETFAHLVREAGAPEGAWTNLFISQEQVAKIIADDRVQGVALTGSEKAGGIVASQAAKHIKKATLELGGNDVFV

SEQ ID NO: 132096 - protein, 131 aa, Glycine max
  Coding DNA Sequence Number=SeqID_15318
  Pfam annotation: Domain name=Transposase_23; Domain location=46-116; Score=14.3; E_value=3.1e-05; Accession=PF03017.5; Description =TNP1ENSPM transposase
  Subcellular localization annotation: CTP_CleavageSite=29; ConfidenceScore=5.05e-01
MASFSQLQSQMQSQGPPEPLVGLGPSGPGVSTKGTCVDPSGNDPETGDSNRCGLYIEADPARLVAVGRVYEGSTLVHNTPLLPGQVKVSVDEVKDADAPVLVPTDEVSLVGQTLHTFLAWPTHLVKSLSHQ

SEQ ID NO: 132097 - protein, 163 aa, Glycine max
  Coding DNA Sequence Number=SeqID_15319
  Gene Ontology: Mol. function=catalytic activity
  Homolog annotation: Hit_ID=Q02CD7; Match level="QueryCoverage=76%, HitCoverage=18%, E-value=7e-24, Identity=48%"; Hit description =Hypothetical protein precursor
MAPPARLGDGTYAALSTPPYLVRKDHPSMLMALGWLPPTDAVDPDIMRSTLEAVWARWDLQSSWGWDYPVMAMTAASLGDLGRAFDALLLPSPKNQFLPNGHTPQIPGFLSLYLPANGGLLAAIAHIVQAIEGGASEPHGWRVTYDAPDTASTGKPRAASRVS

SEQ ID NO: 132098 - protein, 197 aa, Glycine max
  Coding DNA Sequence Number=SeqID_15320
  Gene Ontology: Mol. function=DNA binding
  Homolog annotation: Hit_ID=Q1RUD8; Match level="QueryCoverage=79%, HitCoverage=35%, E-value=2e-15, Identity=32%"; Hit description=IMP dehydrogenase/GMP reductase
MASLAQYYDQPVRCFTFEDFQLVPTVEEFEEILGCPLGGRKPYLFFGFYPSTTRVAKVVKISAQELERLKQNRNGVVRVPRKCLEERAKALENQVVLFPNMEGLVDLAAIDAFLAFHHGKESPVVAILAMYDTFDRGCKKSSARIVCCALALYVWLVSHLFFSKKVGPSIRYKVTARASKRERVIDSLHQEATMWTD

SEQ ID NO: 132099 - protein, 148 aa, Glycine max
  Coding DNA Sequence Number=SeqID_15321
  Homolog annotation: Hit_ID=O04892; Match level="QueryCoverage=47%, HitCoverage=13%, E-value=8e-23, Identity=74%"; Hit description =Cytochrome P450 like_TBP
MDGAKARDLYPAGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 132100 - protein, 43 aa, Glycine max
  Coding DNA Sequence Number=SeqID_15322
MRKLIKEMMEYKVANFVGLNKVKWWLDRNIEMTITEATGLQMR

SEQ ID NO: 132101 - protein, 279 aa, Glycine max
  Coding DNA Sequence Number=SeqID_15323
  Homolog annotation: Hit_ID=Q45FN6; Match level="QueryCoverage=24%, HitCoverage=88%, E-value=1e-17, Identity=60%"; Hit description=Fpo1
  Pfam annotation: Domain name=DUF1599; Domain location=57-118; Score =105.9; E_value=1.1e-28; Accession=PF07659.2; Description=Domain of Unknown Function (DUF1599)
MVEESEEDEFIAIVNYSIIGLIQLEKGLSNDFNENNDEILSLYDKYASEAQALMERKNHDYGEAWRDMRISSITDLIYQKVLRTKQIEDNQGKTIVSEGLDANYFDMLNYAVFFIFILSGFVKAVDLKRIRPERRIQQHNENTYGQGIMHEPLIDFRDYKIGTDIKAEKDKISKNPSEYKTFYSLKNQKTGEVLKVNQDDYIKETKYWADGSPWKIEEGKNESVIVKEGYKSEIVKFKIEDPTGLEVTDEIIKAPKAVLVFSYHPKELSQELIQKVEAK

SEQ ID NO: 132102 - protein, 187 aa, Glycine max
  Coding DNA Sequence Number=SeqID_15324
  Gene Ontology: Mol. function=ATPase activity, coupled to transmembrane movement of substances; Cellular component=integral to membrane; Biological process=transport
  Homolog annotation: Hit_ID=Q8U9I4; Match level="QueryCoverage=55%, HitCoverage=17%, E-value=1e-36, Identity=95%"; Hit description=ABC transporter, nucleotide binding/ATPase protein
MGPLIAVRLHVLTRKTLGGLHTDLEARVLDAGGEPVPGLYAAGEVAGFGGGGMHGYNALEGTFLGGCLFSGRVAGRSTGEPGIETVLANETLMRAFLDDAAFIHHQNAVGFENGGKAVGDDNGGAAAHERIESLLYQCLAFRVERRRGLVQKQDRCVAQMARAMAMRWRCPPESVTPRSPTWVSYPS

SEQ ID NO: 132103 - protein, 152 aa, Glycine max
  Coding DNA Sequence Number=SeqID_15325
  Gene Ontology: Mol. function=oxidoreductase activity; Biological process=electron transport
  Homolog annotation: Hit_ID=Q28KV0; Match level="QueryCoverage=83%, HitCoverage=23%, E-value=2e-38, Identity=59%"; Hit description =Fumarate reductase/succinate dehydrogenase flavoprotein-like precursor
MPGSPVCNSRRGPKNCAHRPELRQHAAPRNAPGKQASSKESAFKRVISMHAATAETSHLASGIKPRHRLTAGVQHPRLKVGVQATQGLARQHMQTHGNQRPHDRIEQAMRFRRSHQPVTEVTARTVDRRYLRILAKAVFNLAVARFDLPADV

SEQ ID NO: 132104 - protein, 36 aa, Glycine max
  Coding DNA Sequence Number=SeqID_15326
MRIHCYQASRRPSMTTDQPPLPVSHTDPGIEPNIST

SEQ ID NO: 132105 - protein, 95 aa, Glycine max
  Coding DNA Sequence Number=SeqID_15327
PFDIGEEAEETQLRQVAATTPEQSLEATSEPSAPVVNPPSPQPASHPSTPLLQILEYPTTPVLAVDTSPPTTPVLQLTDEEDGQTQKTQDQSQEF

SEQ ID NO: 132106 - protein, 160 aa, Glycine max
  Coding DNA Sequence Number=SeqID_15328
  Homolog annotation: Hit_ID=Q1SKD7; Match level="QueryCoverage=73%, HitCoverage=28%, E-value=5e-11, Identity=33%"; Hit description =Ankyrin
MAPRKLFAKRSRKDKAAKGTSAAPEYDSHRFWSAEHQQRFEAIKGWSFHRERRVQLRDDEYTDFQEEIARRRWTSLVTPMAKFDPNIVLEFYANAWPTKEGVRDMRSWEGQECEYSQRRNRADGFDEEAIAQLLCIPATSCPAIIIPTSLCRSVSWCMPS

SEQ ID NO: 132107 - protein, 69 aa, Glycine max
  Coding DNA Sequence Number=SeqID_15329
  Subcellular localization annotation: CTP_CleavageSite=49; ConfidenceScore=5.23e-01
MILGVIFGKVQKAKSKSQRMTRAKGSTHNASPVLSYLPTRDKVGAKVTVLAIVWTPNTHESREDVCEDS

SEQ ID NO: 132108 - protein, 251 aa, Glycine max
  Coding DNA Sequence Number=SeqID_15330
  Homolog annotation: Hit_ID=Q8ZGW2; Match level="QueryCoverage=42%, HitCoverage=70%, E-value=3e-41, Identity=78%"; Hit description =Molybdopterin-converting factor subunit 2
  Pfam annotation: Domain name=MoaE; Domain location=4-113; Score =149.9; E_value=6.9e-42; Accession=PF02391.7; Description=MoaE protein
MTTRIRVGSAPFNVGDEYALLAAHDSDGAVVTFTGKVRNHNLGDSVAALTLEHYPGMTEKALAEIVADARQRWALQQVTVIHRVGELFPGDEIVFVGVSSAHRGSAFAARSRMNTTTILRGAALLAALVLAGCSTKKEPQLPARQPADVKAQIQQLLPAHVTQKSAWADDIYTALRVQHIDASASNICAVIAVTDQESNFSADATVPGLPKIAWAEIDRRAASVHVPAFLVRTALLIKSSNGESYAARLDK

SEQ ID NO: 132109 - protein, 90 aa, Glycine max
  Coding DNA Sequence Number=SeqID_15331
VLPPEASNYLSRSKEYMIVDRGRGRLYEWMITMNNGLSCVVKSWIQYLADRHLKPGDEVVFFYNFDQHLWEVLYRKQVKWNQEKDEADST

SEQ ID NO: 132110 - protein, 193 aa, Glycine max
  Coding DNA Sequence Number=SeqID_15332
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=6e-23, Identity=29%"; Hit description= UPI00006A17C9 related cluster
GLHTLAFSGLHVLTFRGLHAFAFRGPHALTFRGLHVLAFIVLHALSVRLHALAFKGLHALTFRGLHAFTFRVLYVLAFKGLHVLAFRELHVLVFRGLHVLAFRGLHAFAIRGLHGLHVLLFRWLHALAFIGLHVLTFKGLHALAFKRLNALSFRGLHALTLRGLHILAFRGLHVLAFRGLHVLAFRGLLILAF

SEQ ID NO: 132111 - protein, 49 aa, Glycine max
  Coding DNA Sequence Number=SeqID_15333
MEFGRCVTLSIIIVGHRIPAIRKKRPGGRMELEAPYEVGWRERSEIALK

SEQ ID NO: 132112 - protein, 235 aa, Glycine max
  Coding DNA Sequence Number=SeqID_15334
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=8e-28, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHAIAIRGLHALTFRGLHVLTFRGLHALTFRGLHTLTLRGPHVLVIRGLYANTIRGLHVLAFRGLHTLTFGGLHDLTFRGLHALGFRGLHILVIKGLQAHTFRGLHAHTFRGPHVLSIRELHVLAIRGLHTLTFRGLHVLAFTGVHVLTFRGLHALTLRGLHVLAFRGLHAHAIRGLNALTFRELHVLTFRELHALSFRGLHVLAIRDCTPTPSEDYTSSPSKGYASSPLEGYTP

SEQ ID NO: 132113 - protein, 381 aa, Glycine max
  Coding DNA Sequence Number=SeqID_15335
  Gene Ontology: Mol. function=nucleic acid binding; Cellular component= beta-galactosidase complex; Biological process=DNA integration
  Pfam annotation: Domain name=rve; Domain location=190-287; Score= -10.4; E_value=0.044; Accession=PF00665.16; Description=Integrase core domain
  Subcellular localization annotation: CTP_CleavageSite=48; ConfidenceScore=5.12e-01
MNQVSPSTSIPDFHLTAQQYSQLMSLLQIHTSNAVTPDIESSNTGMVLSASLTKFPQNCWIIDSGANTHIVCAIDLFDSYHYVSNRIVKLPNNAVVSVIAVGTEMPHCKKIGRGDLIHGLYVLNLKDTHSTCNVSDHNSCINFVSNTCTPAIDWHNRFGHVSDSVLKILSNKIPFALPNEFSTKSCYVCPIAQPFDLIHCDIWGPYKHSSTYANYRYFLTIVEDCSRFTWIFLLKHKSKASTVIMKYFAMSIVAITFWGKCVVTTTFLINRLPSPLLKQNTPYQVLYGSAPNYSISRSFGCLAFATTLNSESTKFSPRAVPCVFVGYPQGIKGDLVFHENIFPFQTLPNTSQEPDFLNDLAVSLPIPESMSLTIQPRATVK

SEQ ID NO: 132114 - protein, 302 aa, Glycine max
  Coding DNA Sequence Number=SeqID_15336
  Gene Ontology: Mol. function=DNA binding; Cellular component=oxygen evolving complex; Biological process=DNA integration
MAVEIKALESNNTWTLVPLPIGKQCIGCRWVYKVKFKPDGTVDRYKTRLVANAAKNWPILQLDVDNAFLNGDLFEEVYMELPKGYTSVDKNLVCRLNKSIYGLRLASRQWFYKLSTTLIENGFFQSKNDYSLFTIGKGLGSILVQTEDPWFLTIFSGPGSCKVQQGHYFGSKKICPFSVRGYWFSWLQTIISSNGSKFKAQHAQWRLLGHLMYLTISRPNIVTFTVNKLSQYMQHPRIPHLDDVHRLLQYIKGTPGHGLHFLASNSFNLSTYADADWGGCLDTRRSTSGSCVFLGDALISWK

SEQ ID NO: 132115 - protein, 121 aa, Glycine max
  Coding DNA Sequence Number=SeqID_15337
MLITFGLLLSEKGALSAIPTEGNFTERPKVALSLILTERKCAERPEGYKYVLSVKNTIFTLLFPQKRLPNPKTLFSTIQDHWWPPLLTVGPPHQEEHFNRSEILRILLRDSMEKIPQSSIS

SEQ ID NO: 132116 - protein, 177 aa, Glycine max
  Coding DNA Sequence Number=SeqID_15338
  Gene Ontology: Mol. function=RNA-directed DNA polymerase activity; Biological process=RNA-dependent DNA replication
MVGDGDGGGEYHQLDGTQRLLLDIMTTQMQRLLNRNNEELYGQIEGPENQLNQNTGRHFGGNRVGNVGPRQNKMEGVKLNVPPFEGKSDPDAYLDWEMKIEHKVKLAVAEFSDYAFVWWNKNQREMMREEWREIDRWTGMRRLQENHAIETPKAVPGKFDYGRVLQGGEDGPSEGQH

SEQ ID NO: 132117 - protein, 304 aa, Glycine max
  Coding DNA Sequence Number=SeqID_15339
MAKVKYVKILHEQVKAQIAKKDESYVKQANKNRKEVVLEPGEYGVSSSFNVANFTQFVAGHVLKTHSWVGGVMPWHEILGWKRFRGFHPTTPGGTEGCPIDDSSSEETHREASDSRSSSIERLVDLCHAKEGSSRPRERVGPFVAPLEKEPIPIMTILPSFPSTAIGRGDGGLVRIFPRNRHSRSAGTSPPPPFVVGYKWVRDDVLKYCSLVTFIVSVGALWGQLELAKLGDSHKMGNLVGPAGEGGQTKVRVDPPRLSEVDKAVVVEVIPNVPPPHPTKRKHNEGVGGPVNARSQGPPSVSKL

SEQ ID NO: 132118 - protein, 141 aa, Glycine max
  Coding DNA Sequence Number=SeqID_15340
MTSMHEPEIKENKLKDEIFDLNKDPNENFVEDSLDKAIKNEEDEDSFDKIVEDSLVASKDENEVGETLFRRKQKSWLEEDLTENKEVCTDGCSPSTSNGFINNNLFYLNKYPDEAHDFGFESEDMKKEHFSMLKIYFARFY

SEQ ID NO: 132119 - protein, 179 aa, Glycine max
  Coding DNA Sequence Number=SeqID_15341
  Gene Ontology: Mol. function=RNA binding
  Homolog annotation: Hit_ID=Q49KC8; Match level="QueryCoverage=70%, HitCoverage=30%, E-value=2e-39, Identity=64%"; Hit description =Transposase
EPLTLSSPLQKVEEAIGTTGNIRKLKKHSHLEEVDETLTHEEVEEELALTLTIGVIQCHSNALKPYLKPENMIACLKFFLSMLDDRIMPYDPKFKSMENIVFIDEKWFYIRRTSKKFYLLAKEDEPHRTCKRKSFIAKLMFLVAVVRPRFDHEGNETFLGKIGVFPFVIDQPAKRASVN

SEQ ID NO: 132120 - protein, 120 aa, Glycine max
  Coding DNA Sequence Number=SeqID_15342
  Gene Ontology: Mol. function=ribokinase activity; Biological process =D-ribose metabolic process
  Homolog annotation: Hit_ID=Q1SXC4; Match level="QueryCoverage=99%, HitCoverage=65%, E-value=3e-27, Identity=76%"; Hit description =Carbohydrate kinase, PfkB
MKTDDLPESSLLTALNGARFVYFDRRLHETALVVAHEEVKENIPILMDAGRLREGLDDLVKLADYVVCAARFLQAPICAKFAPEKMLCFAATVAASKCRVLGARSGLPHRTDPCLASFMQ

SEQ ID NO: 132121 - protein, 1207 aa, Glycine max
  Coding DNA Sequence Number=SeqID_15343
  Gene Ontology: Mol. function=motor activity; Cellular component =myosin complex; Biological process=signal transduction
  Homolog annotation: Hit_ID=Q1SXC2; Match level="QueryCoverage=97%, HitCoverage=76%, E-value=0.0, Identity=76%"; Hit description=IQ calmodulin-binding region; Myosin head, motor region; Dilute; AAA ATPase; Myosin, N-terminal, SH3-like
  Pfam annotation: Domain name=IQ; Domain location=776-796; Score=16.9; E_value=0.073; Accession=PF00612.17; Description=IQ calmodulin -binding motif
  Pfam annotation: Domain name=IQ; Domain location=799-819; Score=25.7; E_value=0.00016; Accession=PF00612.17; Description=IQ calmodulin -binding motif
  Pfam annotation: Domain name=IQ; Domain location=824-844; Score=18.1; E_value=0.033; Accession=PF00612.17; Description=IQ calmodulin -binding motif
  Pfam annotation: Domain name=IQ; Domain location=847-867; Score=7.7; E_value=6.2; Accession=PF00612.17; Description=IQ calmodulin-binding motif
  Pfam annotation: Domain name=IQ; Domain location=872-892; Score=24.5; E_value=0.00037; Accession=PF00612.17; Description=IQ calmodulin -binding motif
  Pfam annotation: Domain name=IQ; Domain location=895-915; Score=26.9; E_value=7.1e-05; Accession=PF00612.17; Description=IQ calmodulin -binding motif
  Pfam annotation: Domain name=Myosin_N; Domain location=33-70; Score =22.8; E_value=0.0012; Accession=PF02736.9; Description=Myosin N -terminal SH3-like domain
  Pfam annotation: Domain name=Myosin_head; Domain location=113-760; Score=849.1; E_value=2.2e-252; Accession=PF00063.11; Description =Myosin head (motor domain)
  Pfam module annotation: Pfam domain module=IQ::IQ::IQ::IQ::IQ::IQ::Myo sin_N::Myosin_head; Domain location=776-796::799-819::824-844::847 -867::872-892::895-915::33-70::113-760
MEELDFRWSSQIHFLKTLNVSNNGAAAANPVVGSHIWVEDPDVAWIDGEVLEVKGEEIKVLCTSGKTYFDFLNMNDWWESFKYSIMKICVLFKVVVKASSIYHKDTEVPPSGVDDMRKLAYLHEPGVLDNLRSRYDINEIYTYTGNILIAVNPFIKLPHLYDSHMMAQYKGAAFGELSPHPFAVADAAYRLMINEGISQSILVSGESGAGKTESTKLLMRYLAYMGGRAAAAEGRTVEQKVLESNPVLEAFGNAKTVRNNNSSRFGKFVEIQFDQSGRISGAAIRTYLLERSRVCQVSDPERNYHCFYMLCAAPPEDVKKYKLGDPRMFHYLNQSNCFELEGVDESKEYRDTRRAMDIVGISSEEQDAIFKVVAAILHLGNIEFAKGKEIDSSMPKDEKSRFHLQTAAELFMCDAKALEDSLCKRVIVTRDETITKWLDPEAAALSRDALAKIVYTRLFDWLVDKINNSIGQDPESKSLIGVLDIYGFESFKTNRQYNGNSESRATPSQRMNSGFPILTNFLLHASAQCLTGDYSNGQKLFEQFCINLTNEKLQQHFNQHVFKMEQEEYKKEEIDWSYIEFVDNQDILDLIEKVTYQTELFLDKNKDYVVAEHQALLYASKCPFVSGLFPPSPEESSKQSKFSSIGSRFKQQLQSLLETLSATEPHYIRCVKPNNLLKPAIFENKNVLLQLRCGGVMEAIRISCAGYPTRKTFDEFVDRFSLLAPEALAGSSDEVTACKRILKNVGLEGYQIGKTKVFLRAGQMAELDTRRTEILGRSASIIQRKVRSYLACQSFILLRLSAVQIQAACRGQLARQVYEGMRQEASSLVIQRCFRMHIAWKAYKDLYTSAISIQTGMRGMAAHCELHFRRQTKAAIAIQSHCRKYLAQLHFAKLKKAAITTQCACRGKVARRELRKLKMAARETGALQAAKSKLEEQVEDLTLRLQLEKRLRVDIEEAKAQENQRLQSALQEMQLQFKETKLLLEKEREATKKAAERAAVIQEVPVVDNALLEKLRSENEKLKNMVSSLEKKIDETEKRYEEANKIGEERLKQALDAESKVIHLKTAMQRLEEKFIDMESANHILQKQSLLNSSVKTIAEHLSSPLDEKLENGHHAAEEQEAVDTFVTPVKQFGTESDSKLRRSYNERQHESVDSLVNCVMKNIGFNHGKPIAAFTIYKCLLHWKSFEAERTSVFDRLIQMIGSEIE

SEQ ID NO: 132122 - protein, 824 aa, Glycine max
  Coding DNA Sequence Number=SeqID_15344
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=68%, HitCoverage=98%, E-value=0.0, Identity=69%"; Hit description=CMV 1a interacting protein 2
  Pfam annotation: Domain name=Pkinase; Domain location=420-693; Score =144.8; E_value=2.3e-40; Accession=PF00069.15; Description=Protein kinase domain
  Pfam annotation: Domain name=Pkinase_Tyr; Domain location=420-693; Score=146.4; E_value=7.8e-41; Accession=PF07714.7; Description =Protein tyrosine kinase
  Pfam module annotation: Pfam domain module=Pkinase::Pkinase_Tyr; Domain location=420-693::420-693
  Subcellular localization annotation: CTP_CleavageSite=40; ConfidenceScore=5.26e-01
LCVLSLPARSAAVSTMTAGGCSAGISPPAGHSSKPLLSPDDALRWCRVRRERMPVSVVFLLALLNLLFSCQDIPFEILSVDATVTYDIIGSLHAVKSISLSVSFASSERAKMWLVKPSSGPSSAPVPSPSYHGPHVTPRPRHHYHHRHHHSMRPYVAAPPPSKDQACDQTCTDPLTSSPFGSPCGCVFPMKIRLTLDVAPYAVFPVMTELENEIALGTYLEQSQVKIMGATADSQNQGRTIVDINLVPLGEKFDNTTAALTYERFWHKKVPLNRSLFGDYAVVYIIYPGMPSSPPYGSLTGSSPSQSVDGILPVSANFVSKNQKMNLRTIIIIALSSFVLLLVLVGAFSIILKWRKTGRPSSAVGPAFTSSLNKRSGLGSMLSSSITSSTSISLMSTMATSLLSVKTFSLSELEKATDKFSSKRVLGEGGFGRVYSGTLEDGAEIAVKMLTRDNHQNGDREFIAEVEMLSRLHHRNLVKLIGICIEGRRRCLVYELVRNGSVESHLHGDDKIKGMLDWEARMKIALGAARGLAYLHEDSNPRVIHRDFKASNVLLEDDFTPKVSDFGLAREATEGSNHISTRVMGTFGYVAPEYAMTGHLLVKSDVYSYGVVLLELLTGRKPVDMSQPQGQENLVTWARPMLTSREGVEQLVDPSLAGSYNFDDMAKVAAIASMCVHSEVTQRPFMGEVVQALKLIYNDTDETCGDYCSQKDSSAQESDFRGDLAPSDSSWWNAGGLTPRITYGQASSFITMEYSSGPLEEMENRPFSTSSLIGDEISLPIRHGNRSGPLRTVRNKLSLYRFTGSRSEHGGPSSKPNWNDGYWV

SEQ ID NO: 132123 - protein, 495 aa, Glycine max
  Coding DNA Sequence Number=SeqID_15345
  Gene Ontology: Mol. function=motor activity; Cellular component =myosin complex; Biological process=protein amino acid phosphorylation
  Homolog annotation: Hit_ID=Q1SXC2; Match level="QueryCoverage=93%, HitCoverage=22%, E-value=2e-91, Identity=73%"; Hit description=IQ calmodulin-binding region; Myosin head, motor region; Dilute; AAA ATPase; Myosin, N-terminal, SH3-like
  Pfam annotation: Domain name=DIL; Domain location=193-418; Score =42.6; E_value=1.4e-09; Accession=PF01843.9; Description=DIL domain
MVFSGIVTKSVRALILPFFCPTLFFTIQNQDDNDHMAYWLSNTSALLFLLEQSLKSGSSAKATPARKLPNPTSLFGRMTMSFLSSPSSANLAAPPADVVRKVEAKYPALLFKQQLTAYFEKIYGIIRDNLKKDLTPVLALCIQAPRISKGGLRSNRSLAKDSPVVHWQSIIESLNTLLCTLKENFVPPVLIQKIFSQTFSYINVQLFNSNGEYVKAGLAELELWCCQAKEELQLIAWSTNLQYAGSSWDELKHIRQAVGFLGHKPSTTTKQGEDHSKLSTVANQDGHNKIERSHQARIGVQQSKCDCQTRRGAHQTKCSSQTTSKQKLRDQSKIYRTRLFIRSIGFPMMKSSMIYAPCKGWIRRRLGILIYAWSLQLTASQCFPFHFSSPHLLVLLLQILSVQQLYRICTLYWDANYNTRSVSPDVLSSMRMLMAEDSNNAQSDSFLLDDSSSIPFSVDDLSTSLQEKDFSDMKPADELLENPAFQFLKELAQEA

SEQ ID NO: 132124 - protein, 47 aa, Glycine max
  Coding DNA Sequence Number=SeqID_15346
MKSLRGKEIALVKVQWGTDEGDSTWELEDRMRELYPKIGVVGARYAS

SEQ ID NO: 132125 - protein, 140 aa, Glycine max
  Coding DNA Sequence Number=SeqID_15347
MEPDVQHSHTVIPMLQSLFRGQLMIMYNPQELAHNRPIISMEHFLEKVAWPEAQLPLEKSHELVPPEPTPTRTKPIPAEPQPPVVDPPLSPELEILSPPPAPAPPLIIVSDESSDEAATPPDSPSCNIDDGADFSDWMNC

SEQ ID NO: 132126 - protein, 111 aa, Glycine max
  Coding DNA Sequence Number=SeqID_15348
MGKVEEVQEKMKADMEAMKEQMATMMEAMMSMRKIMEANAVVVAATSAVAKVNSMPPSVLKQMNHPTSDMVGKALGSTGGPHYAQIQNKHAFPPYGLPPQLYTTQCGIHSQ

SEQ ID NO: 132127 - protein, 58 aa, Glycine max
  Coding DNA Sequence Number=SeqID_15349
PPGCARNSPPPIGDQPGSPKVFPTSAKDPGRSVHSAPHDHTQHPTYERGQKLVPKTLE

SEQ ID NO: 132128 - protein, 83 aa, Glycine max
  Coding DNA Sequence Number=SeqID_15350
  Gene Ontology: Mol. function=helicase activity; Biological process =protein amino acid phosphorylation
  Homolog annotation: Hit_ID=Q1SZZ8; Match level="QueryCoverage=89%, HitCoverage=34%, E-value=1e-18, Identity=64%"; Hit description =Unnamed protein product; contains similarity to helicase gene _id:T13C12.11-related
MEELERHIWRALSTNFCSKGDIVLITASSNIVALLIPEGRTMHSRFAIPINVDEDSTCNIKKGGQLDELIAKTKLIIWDEAPQ

SEQ ID NO: 132129 - protein, 124 aa, Glycine max
  Coding DNA Sequence Number=SeqID_15351
THLLLEVASPLSLPFSIPLPFIFQEAKESIDEEDPRPTSSNGACITKDIIKEAMQVIIHEAMQFFGKEEIFLRTKGPNLYERITKLEDTLAHLMQLAEKPNGEFATNTEKNPKEECKMIFTRSK

SEQ ID NO: 132130 - protein, 152 aa, Glycine max
  Coding DNA Sequence Number=SeqID_15352
SLEEQASQGSFVPHGCQDVLTTIIGRPDHPGYVRAAGSVADLTNQGPARGVDHRKSDSTADGIFQPDAVPVSIPDAILGTCTASRAYGNDPKTDDSDKCRLYIEANPPCLVALGRVFEGSTIHNIPLLPGHVKVGVEEVKDAQAPVPVPTDE

SEQ ID NO: 132131 - protein, 438 aa, Glycine max
  Coding DNA Sequence Number=SeqID_15353
  Homolog annotation: Hit_ID=Q337M3; Match level="QueryCoverage=30%, HitCoverage=22%, E-value=8e-09, Identity=29%"; Hit description =Expressed protein
MQCHCYVCDYVAPCPKWGTGFLGTDHCHATEKSETWRSLRKNFKLGKTAPLPASTNHCTLSDVTNSQQNHILPFRVMSPNSMLLNQTSISTATHTCSPVNFIPQNQASRPITTIMHTCSSLNSNFQNHVSRPNTVPSIATNFTIPSCINHGRYGELVSTLVRNRYQSHSIPPHSLGVHNRAIQRVRQHGVGTLVPQFHSHTFLNGLGSVGVGSTLPMNHSTHGASGGFINNDNPAQQYPNYHAATGFSNNSRTSYGQNAYAYVPQNFGYPNPFSQLNNLSSVSNYSTAHETQASYQSNGSQNIYAYSVQGDNAPSSNNVAGLSRVENACGNVTQSGTTRQYSCQQKPHDASLIEAALKADRIGDANQSNPHQQSSESMNISSSATQFTGSTRLSNENSVPVGADGALASELNASPDLSTFDGAFYFDFETTWDCLARV

SEQ ID NO: 132132 - protein, 215 aa, Glycine max
  Coding DNA Sequence Number=SeqID_15354
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=5e-14, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
SSPSEDYTSSPSEGCTPSPLEGLHVLAFGGLHVLTFRGLRVLTFRGQRVLTFRGLHVLTYRGLQVLIFTRLLTLAFRGLHVLTFRGQLALAFRGLHALTFRGLRTLTIRGLYILTSRGPHVLTIRVPHALTFRGLHVLTFRGRHIFTFTGLHRATRPHLQRTTRPRLEDYMPSPLEDYTSSPSEACTPSSSEACTPSSSKGDTSSTSEGCTPPHL

SEQ ID NO: 132133 - protein, 63 aa, Glycine max
  Coding DNA Sequence Number=SeqID_15355
MSYWSAWKGNGRCCLCVTNCNLKSKLKGRFFSWGSKTEGSSWVSFCCIEKQDNHILQMLMFRY

SEQ ID NO: 132134 - protein, 692 aa, Glycine max
  Coding DNA Sequence Number=SeqID_15356
  Homolog annotation: Hit_ID=Q1S805; Match level="QueryCoverage=100%, HitCoverage=85%, E-value=0.0, Identity=66%"; Hit description=DENN; dDENN; uDENN
  Pfam annotation: Domain name=DENN; Domain location=511-691; Score =19.5; E_value=9.2e-10; Accession=PF02141.11; Description=DENN (AEX -3) domain
MDSKEEAEPHEDRPTSPMRVLQQLSEGAFRVAGEAFHNMYSGGGSSKSQMGPGAHRRSQSELVTRGVERTNSFQKLRSHVHKAWRWGGRFRQEVSPASFNPEVMANQKRQWYQLHPRSLVSLCTIHIFVRNGCVHYKEPTSLFEHFLIVGLHPDANLEDVEHAFVRRKKWEKEKPEFLDYKMLQQQRPPEPTLEPQLLFKYPPAKKLTMRMKDLAPFCFPEGVKAWLLERTPSLSELNELVYGQEHLGKDDLSFVFTIKAADNTTLYGVCLHVPEIVQRPPGILGISSPFSHPSGACSRFLVSAPRCYCLLTRVPFFELHFEMLNSLIAQERLNRITQFINEVTITGSTPSTPKLGDQMSSNANSPDRESFSDWMDCAIPLDGAAIITAAAAGIISDDEIIQLSPKIWDSRCQSPVRDVDKDGRKNLQDHDNCAFEAPENLGSIERMHGICENDQVSPKVGTPFSARSRVLERLGSSESLFSPVRSMASDNEEDFFSNNERDYGDELLMEWAMENKNDLLQIVCRYHAEPIPPRGSELVFHPLEHLQAIQYIRHSVASLDFSNDCSNCSEPAQDNAKLAAAEEALSLSVWTMATTCRVLSLDSVLALITGVLLEKQVVIVCPNLGVLSATVLSLIPMIRPFQWQSLLLPVLPGKMIDFLDAPVPYIVGIQHKPDDLNMKTTNLVLVNIPKDQ

SEQ ID NO: 132135 - protein, 61 aa, Glycine max
  Coding DNA Sequence Number=SeqID_15357
MDDKIRRCVYGEVYAKKAKLFTHYCLKDIDFESLALQLFVDTQLFTVLSDSRLSSFESGES

SEQ ID NO: 132136 - protein, 646 aa, Glycine max
  Coding DNA Sequence Number=SeqID_15358
  Gene Ontology: Mol. function=translation elongation factor activity; Cellular component=nucleolus; Biological process=regulation of transcription, DNA-dependent
  Homolog annotation: Hit_ID=Q1S808; Match level="QueryCoverage=99%, HitCoverage=100%, E-value=0.0, Identity=58%"; Hit description=Plus-3
  Pfam annotation: Domain name=Plus-3; Domain location=262-371; Score =144.0; E_value=4e-40; Accession=PF03126.8; Description=Plus-3 domain
MADLENLLLEAAGRTRHSRQTSRRGHGDGGSDSRDDDSENEHDYPGRKASGLQVPQKKWFDPMERDDGERSKDEGDDDVGGRSYHEGDSSDESDFGDDLYKNEDDRHKLSEMTELQREMILSERATKKHDKDLLGKIASKREKGKTTVAGKLTSPLTPSHVRSSARSANRSTAKDGALNELRAKRLKQQDSEANRRPSKASRSSGPGLVSPKHRPFPSLGSSSDSETESKSLSDNEGSSDDDRIIDSNDDRIMLGSEGLLFEHIKEITIRRSKLAKWFMEPFFEELIAGCFVRVGIGRSMSGPIYGLCMVKNVDATDCDQQYKLEDKTTHKYLNVVWGNETSATRWQMAMVSDSPPEEEEFIQWVKDVERRGGRMPTKQEVAEKKEAIQKTNLFVYSAATVKQMLQEKKSAKTRPLNIAAEKDRLRTELEIAHSKNNKAEVKRIMTRLLELEESRQAKTMDARALKLAEMNRKNRFENFKNASELKPVNKELKAGEAGYDPFSRRWTRSMNYYAGKPAEEAAGEINSASGAVADTGSYHTGASETVTAGMAATTAALKAAAGAGKLVDTSAPVDQGTESNSLHNFQLPISLAILQKFGGAKGVQAGFMAKKQRIEATVGFQVLKNDRQKHALTLTVSDYKRRRGLL

SEQ ID NO: 132137 - protein, 62 aa, Glycine max
  Coding DNA Sequence Number=SeqID_15359
  Homolog annotation: Hit_ID=Q1SXD5; Match level="QueryCoverage=74%, HitCoverage=43%, E-value=2e-17, Identity=87%"; Hit description=Cupin, RmlC-type
  Pfam annotation: Domain name=Cupin_3; Domain location=1-60; Score= -6.1; E_value=0.072; Accession=PF05899.3; Description=Protein of unknown function (DUF861)
MAADSNSNLRITIQRKYQLKFDAEDSCYLLKGKVKAYPKGSSEFVEFGAGDLVTIPKGLGCS

SEQ ID NO: 132138 - protein, 820 aa, Glycine max
  Coding DNA Sequence Number=SeqID_15360
  Homolog annotation: Hit_ID=Q1SXD3; Match level="QueryCoverage=58%, HitCoverage=88%, E-value=0.0, Identity=76%"; Hit description=WD40 -like
  Pfam annotation: Domain name=WD40; Domain location=104-141; Score =13.7; E_value=0.68; Accession=PF00400.22; Description=WD domain, G -beta repeat
  Pfam annotation: Domain name=WD40; Domain location=145-184; Score =41.6; E_value=2.7e-09; Accession=PF00400.22; Description=WD domain, G-beta repeat
  Pfam annotation: Domain name=WD40; Domain location=188-224; Score =12.5; E_value=1.3; Accession=PF00400.22; Description=WD domain, G -beta repeat
  Pfam annotation: Domain name=WD40; Domain location=756-795; Score =2.9; E_value=17; Accession=PF00400.22; Description=WD domain, G-beta repeat
  Pfam module annotation: Pfam domain module=WD40::WD40::WD40::WD40; Domain location=104-141::145-184::188-224::756-795
  Subcellular localization annotation: CTP_CleavageSite=54; ConfidenceScore=5.69e-01
MTGFPGPRRDHASSSSSSHNSNSRISLLSNVLNLASGSNVFNLLARREISPRTRYVAKWHWGEPGEASKSKSIPYSRPKKEVVRDARRGLLSWVEAESLRHLSAKYCPLVPPPRSTIAAAFSPDGKVLASTHGDHTVKIIDCETGSCLKVLVGHRRTPWVVRFHPLHPHILASGSLDQEVRLWDANTSECIISHHFYRPIASIAFHAKGEIIAVASGHKLYIWHHNKKGEASSPIFVLKTKRSLRAVHFHPHAAPYLLTAEVNDLDSSDSSMTEATSLGYLQYPPPAVFVTNIHPTEHINLSSELPYVSLPFYVMPAYNVDESRAELQHASHDVVSGSMQIESSAMVQLQADPSAAEHYETTVSPMDTFSEMPSSSQTGAEYPAHTAFSNGMGIGLSNLTMDGMETDETRPAEGNQHGNLTNTYSLNGMLHGLSRQTANRGVPSEFGQFHQFFPSRDPSGWEIPFLHGWIMGQSQVGVPSMLPHMGASRDNLSQQIGSSSYIMASNHSTSNVDAAMPSSAIPGSISIPGSSMRSGLRNHFSQSRVPVSESGNLAASINTPHDGFDMQTIVSRIQSELATSVAATAAELPCTVKLRVWSHDIKNPCAPLNADRCRLTVPHAVLCSEMGAHFSPCGRFLAACVACMLPHIEADPGLQTPVHQDPGVATSPTRHPISAHQVMYELRIYSLEEATFGSVLASRAIRAAHCLTSIQFSPTSEHILLAYGRRHGSLLKSIVIDGETTLPIYTVLEVYRVSDMELVRVLPSAEDEVNVACFHPFAGGGLVYGTKEGKLRVLQYDGAHAVNGAGPSYFPEETIVGVSQ

SEQ ID NO: 132139 - protein, 193 aa, Glycine max
  Coding DNA Sequence Number=SeqID_15361
MAPNLHDQVEEPRRCSSSSDTTLVVVDVVTIGIILDPFNTVEGGSYVLFEIVSVTSSWLRHLNGLHDPRSCSPIICTGTPARWCPPFSVLHGDEDDVNLLDTAGQDGDDGGILRERIGDGYLDISASEGSLSEISSLSEKTIYSLDKFAACWASTSLTDPILGFSNMLSELHALLSGCHSLSTYVSLSETSTT

SEQ ID NO: 132140 - protein, 523 aa, Glycine max
  Coding DNA Sequence Number=SeqID_15362
  Gene Ontology: Mol. function=molecular_function; Cellular component =cytoplasm; Biological process=transport
  Homolog annotation: Hit_ID=Q9FND4; Match level="QueryCoverage=98%, HitCoverage=99%, E-value=0.0, Identity=62%"; Hit description=WD -repeat protein-like
  Pfam annotation: Domain name=WD40; Domain location=214-252; Score =39.8; E_value=9.4e-09; Accession=PF00400.22; Description=WD domain, G-beta repeat
  Pfam annotation: Domain name=WD40; Domain location=259-297; Score =35.5; E_value=1.8e-07; Accession=PF00400.22; Description=WD domain, G-beta repeat
  Pfam annotation: Domain name=WD40; Domain location=301-341; Score =13.9; E_value=0.57; Accession=PF00400.22; Description=WD domain, G -beta repeat
  Pfam annotation: Domain name=WD40; Domain location=344-383; Score =0.8; E_value=29; Accession=PF00400.22; Description=WD domain, G-beta repeat
  Pfam annotation: Domain name=WD40; Domain location=385-423; Score =9.7; E_value=2.7; Accession=PF00400.22; Description=WD domain, G -beta repeat
  Pfam annotation: Domain name=WD40; Domain location=428-469; Score =14.2; E_value=0.47; Accession=PF00400.22; Description=WD domain, G -beta repeat
  Pfam annotation: Domain name=WD40; Domain location=473-512; Score =48.4; E_value=2.4e-11; Accession=PF00400.22; Description=WD domain, G-beta repeat
  Pfam module annotation: Pfam domain module=WD40::WD40::WD40::WD40::WD4 0::WD40::WD40; Domain location=214-252::259-297::301-341::344 -383::385-423::428-469::473-512
MENPCEVLGSKGLIRRHEFVRIIIQCLYSLGYSSSASCLESESGISYKSNEVKLLESLILNGSWDESIDYLNSIKDELGETRESALFLVFRQCVMEYLNCGEYALALGVLRKQVSALDAGKCKVHSFAKCLLSFKDRELGAVDGGDVVVHDLRKKLLADLEKLFPPPISVPEGRLEHLVENTVMSWVDSCMYHSSSSPISLYEDHHCSRDQIPTTTTQILTGHKNEVWFVQFSNNGEYLASSSNDCTAIIWKVLEDGKLTLKHTLYGHQHAVSFVAWSPDDTKLLTCGNTEVLKLWDVETGTCKHTFGNQGFVVSSCAWFPNSKQFVCGSSDPEKGVCMWDCDGNVIKSWRGMRMPKVVDLAVTPDGEYLISIFMDKEIRILHMGTYAERVISEEHPITSLSVSGDSKFFIVNLNSQEIHMWDVAGKWDKPLRFMGHKQHKYVIRSCFGGLNNTFIASGSENSQVYIWNCRNSRPVEVLSGHSMTVNCVSWNPKIPQMLASASDDYTIRIWGPSLQKKEGQLE

SEQ ID NO: 132141 - protein, 91 aa, Glycine max
  Coding DNA Sequence Number=SeqID_15363
MMLVQLQDLTFLVAIVEEITTLWIIVSRRMDILLTSQLIREVEEVVALIAEQSNHGVSAPNNISHINKLGTVSSSDHCTIGNSQPEDDWYS

SEQ ID NO: 132142 - protein, 365 aa, Glycine max
  Coding DNA Sequence Number=SeqID_15364
  Gene Ontology: Mol. function=catalytic activity; Biological process =protein amino acid phosphorylation
  Homolog annotation: Hit_ID=Q10G25; Match level="QueryCoverage=92%, HitCoverage=71%, E-value=5e-58, Identity=38%"; Hit description =Expressed protein
  Pfam annotation: Domain name=DUF860; Domain location=24-356; Score =428.0; E_value=1.3e-125; Accession=PF05898.4; Description=Plant specific of unknown function (DUF860)
MALSCKHPHLFNHIRTFVNVKVKWVQDPYLDNAVLKEKDLKQTISLRNQIISSPSKSLSIYTASQLKASLNLPTTTTKFVDKYHCVFSQFQPGPGLPPVVKLTPLALSLHKEEMAVHNSPINREDTVQRLARLLMLAGMSKLPLYVIEKLKWDMGLPHDYVTTLLAEYPDYFDVCVVEDPSSGKELLALELVSWKKELSVSEIEKRAISLGYSGDKRRHDIAFPIFLPKGFDLEKRVKTWVENWQKLPYVSPYEDAFHLDSNSDQAEKWTVAILHELLSLFVSKKTERDNLLCFGECLGLALRFKKALVHHPGIFYISNKIRTQTVVLREAYRKDFLVKNHPLVATMVVDCGSNCGCWGYNFSQG

SEQ ID NO: 132143 - protein, 95 aa, Glycine max
  Coding DNA Sequence Number=SeqID_15365
MDASILLEMFSIVFLLTINGSDRVGCTLVKEAGQVCFDGYLVTMYLPPDIIKSLESVIEHVPYNEFVGPLHVDLPFTLGLLDVWGMRGLLYNVPC

SEQ ID NO: 132144 - protein, 198 aa, Glycine max
  Coding DNA Sequence Number=SeqID_15366
  Homolog annotation: Hit_ID=Q7CJW3; Match level="QueryCoverage=96%, HitCoverage=71%, E-value=2e-97, Identity=84%"; Hit description =Putative myo-inositol catabolism protein iolB
  Pfam annotation: Domain name=IolB; Domain location=1-190; Score =395.6; E_value=7.4e-116; Accession=PF06845.2; Description=Myo -inositol catabolism protein IolB
MSPFERIKPWAVYVTPQETVQVTALTTWELAVCAAPGKGTYPTRLIAPQYMDGEARGKGHNQRYVHNILPEGKSADSLLVVEVWTNEGCTSSYPSHKHDTDNPPQETYLEETYYHRLNPEQGFCMQRVYTDDRTLDECMAVYNRDVVMVPKGYHPVATMAGYDSYYLNVMAGPVRKWMFTWEEDHAWINRDYPADGGR

SEQ ID NO: 132145 - protein, 172 aa, Glycine max
  Coding DNA Sequence Number=SeqID_15367
  Gene Ontology: Mol. function=acyltransferase activity
  Homolog annotation: Hit_ID=Q4BEG1; Match level="QueryCoverage=87%, HitCoverage=57%, E-value=3e-39, Identity=56%"; Hit description =Probable signal peptide protein precursor
MTWPPRSEPSPGRTATWCCEAGNDARVKSLVYVAAFAPDSGQSTAVLAGSVPAPPGSAGIAKTADGYLYLPTEAVRKDFAPDVKPAEQQTIAATQGPIKGDAFAEKVTHAAWYNKPSWYVVSQNDRMINPALERAMAKTIHAKTTEVAASHVSMVSQPEIVARTIEQAIEAK

SEQ ID NO: 132146 - protein, 200 aa, Glycine max
  Coding DNA Sequence Number=SeqID_15368
MDKIPSKNRIKFCQKVLNSNRFYRRNQIHYPQLKDPNPSPLFFHFAIFLYVPQSCGHNRRASIVPSLSAHAANSLVGDGGGLVGGGGLGLECALVCLGWFGSQVVSGALVDDGAGALVGCGAGARLASKCFIYFCVDEDRIRGIGNVALFLFQVGYFMRRGVTLKFNNLGKLVSSSNCAHVASLLTICLQEALRKSIKHV

SEQ ID NO: 132147 - protein, 46 aa, Glycine max
  Coding DNA Sequence Number=SeqID_15369
MEKYLKLYSYHYLINGFAVLVTQQQMFRNDFLEDKLKPFLKSDLEP

SEQ ID NO: 132148 - protein, 129 aa, Glycine max
  Coding DNA Sequence Number=SeqID_15370
  Gene Ontology: Mol. function=peptidase activity
  Homolog annotation: Hit_ID=Q2QTQ5; Match level="QueryCoverage=96%, HitCoverage=43%, E-value=1e-31, Identity=49%"; Hit description =Expressed protein
MAYEVVDCSHGKQSWELCKEKYEPLWLKGGNHCDLELFPEYIRHVKKFITIVEKSPSQRYNFRRSTDQFMQPWKSTGRSEKLKNLSNNSGMLEKLRMTFDHKERSRRRIDHQLEKARKSVDRLNIITSG

SEQ ID NO: 132149 - protein, 132 aa, Glycine max
  Coding DNA Sequence Number=SeqID_15371
  Homolog annotation: Hit_ID=Q08069; Match level="QueryCoverage=27%, HitCoverage=16%, E-value=1e-09, Identity=78%"; Hit description=40S ribosomal protein S8
MKSQASDLPRGLVSSVSFGHGPNNGMNLDKSGVLDFKHLMMIFFCRTNLKNEEDGEAATEEKSKSRTEFLILTLKSNSEVVAFWPVSHLALANVVVLIERYEGLKDKETRDITVEEGCFIDLESRVPFTKRC

SEQ ID NO: 132150 - protein, 120 aa, Glycine max
  Coding DNA Sequence Number=SeqID_15372
MILVCLLSKIWTHDPYNREGIFVGWVWFGFVPIEYGLHVCPIYFDLPIYFTQERVPGYSCVSDKPPPSSLGSSFGDYVMHNDEYEGIMIVISSPISVLCDALEDNGTEEDPEEDPSDGSS

SEQ ID NO: 132151 - protein, 49 aa, Glycine max
  Coding DNA Sequence Number=SeqID_15373
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=92%, HitCoverage=12%, E-value=1e-17, Identity=91%"; Hit description =Glycerol-3-phosphate dehydrogenase [NAD+]
MWVFEEKLPSGEKLTDVINKTNENVKYLPGIKLGKNVVADPELENAGIN

SEQ ID NO: 132152 - protein, 56 aa, Glycine max
  Coding DNA Sequence Number=SeqID_15374
MEGGKPDGVRGNKLCRNTAPIAATNNGLENKREVRRVAQKIEKTLKEEEKRHAQNA

SEQ ID NO: 132153 - protein, 293 aa, Glycine max
  Coding DNA Sequence Number=SeqID_15375
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q2HUX8; Match level="QueryCoverage=95%, HitCoverage=76%, E-value=1e-119, Identity=77%"; Hit description =Peptidase S26A, signal peptidase I; NAD-dependent glycerol-3 -phosphate dehydrogenase, C-terminal
  Pfam annotation: Domain name=NAD_Gly3P_dh_C; Domain location=116-280; Score=238.1; E_value=1.9e-68; Accession=PF07479.4; Description=NAD -dependent glycerol-3-phosphate deh
  Pfam annotation: Domain name=NAD_Gly3P_dh_N; Domain location=1-98; Score=35.6; E_value=2.2e-09; Accession=PF01210.13; Description=NAD -dependent glycerol-3-phosphate deh
  Pfam module annotation: Pfam domain module=NAD_Gly3P_dh_C::NAD_Gly3P _dh_N; Domain location=116-280::1-98
MVDYAVKDANMLVFVTPHQFMEGICKRLAGKIRSDTEGISLIKGMEVKKEGPTMISTLITKQLGINCSVLMGANIANEIALEKFSEATVGYNQNKLAAERWVELFNTPYFNVTAVEDVEGVELCGTLKNVVAIAAVSVNDQEIACNVIGFVDGLEMGNNTKAAIMRIGLKEMRAFSKMWFPSVKDNTFFESCGVADLITTCMGGRNRKVADAYARNGGKRPFDELEAEMLQGQKLQGVLTAQEVHEVLSHRGWLHMFPLFSAVHAISTGRLPPSAIVKISDLKPRHGQLQSML

SEQ ID NO: 132154 - protein, 57 aa, Glycine max
  Coding DNA Sequence Number=SeqID_15376
  Subcellular localization annotation: CTP_CleavageSite=15; ConfidenceScore=5.04e-01
MQTFLITSLKHVMPSFAVGKSPENVNVASNQLWLWSNVSSSPCRQFIHYELNLWTIL

SEQ ID NO: 132155 - protein, 103 aa, Glycine max
  Coding DNA Sequence Number=SeqID_15377
MDYIRASIPYARINIVTTRKAGFYISVATCPSRASEGEAHGCAFQRRKDVRSRHQRLFVENVGKTEGNRSTKAGALAPTYPLSKGKSDLRSSFLSVNQAILFT

SEQ ID NO: 132156 - protein, 134 aa, Glycine max
  Coding DNA Sequence Number=SeqID_15378
  Homolog annotation: Hit_ID=Q9SJI9; Match level="QueryCoverage=86%, HitCoverage=56%, E-value=3e-11, Identity=37%"; Hit description =Expressed protein
  Pfam annotation: Domain name=DUF1637; Domain location=1-132; Score= -83.1; E_value=5.8e-05; Accession=PF07847.3; Description=Protein of unknown function (DUF1637)
MKSSDIKAWCLNLHKIIFSKTCFHSSNSGCYFGFFLVRMLEEIQDFSTLAAKPAKLVKHCQMSAPYNTTVLYPSKEDGRHCSYFRKSSRKGLLGVELDQLSGVKQSKITWLEEIQAPKNLVVRRGLYKGPTIRR

SEQ ID NO: 132157 - protein, 159 aa, Glycine max
  Coding DNA Sequence Number=SeqID_15379
DPLRELIKTLVDIYDKPVEFVWDVSQFGIPNVDSSLFLTYTDINEITSSDKCLNIAILQLWTMYMNEWSNSLGQQSVYGFLEPQSIHNAKDRRGQYEEYIEKYLKESQRQLYLGAYLNQAHWQMVVLCPKDNVVVWFCSVRRRPDVHIKTAINKLSNIF

SEQ ID NO: 132158 - protein, 81 aa, Glycine max
  Coding DNA Sequence Number=SeqID_15380
MTSRKRARTEDIPSSSTLAPLSVTVGQDAQNSLTLVPMLQSLFRGQFIIMHSLQELAHNRPIISMEHFLEQVAWPEAQLPL

SEQ ID NO: 132159 - protein, 44 aa, Glycine max
  Coding DNA Sequence Number=SeqID_15381
MVLLSAHRCAKPNIFTKALSAAALLSPKCLLEFATSCWVSARLG

SEQ ID NO: 132160 - protein, 103 aa, Glycine max
  Coding DNA Sequence Number=SeqID_15382
MTRSGWIFAALELPVRSKGKGKAKVDIGERDKMSLIANDEAPAGKITKEGDDFSKKEISAEEATEFLRIIQQSEFKVIEQLNKTPARISLLGLLMNSKPHWAL

SEQ ID NO: 132161 - protein, 49 aa, Glycine max
  Coding DNA Sequence Number=SeqID_15383
MIEYISQVIKFNMLERECPNAHEWRDGGSGSERWHEPLGQACLSFAPPA

SEQ ID NO: 132162 - protein, 336 aa, Glycine max
  Coding DNA Sequence Number=SeqID_15384
  Gene Ontology: Mol. function=transcription regulator activity; Cellular component=nucleus; Biological process=regulation of transcription
  Homolog annotation: Hit_ID=O81348; Match level="QueryCoverage=92%, HitCoverage=94%, E-value=1e-104, Identity=65%"; Hit description =Symbiotic ammonium transporter
  Pfam annotation: Domain name=HLH; Domain location=134-183; Score =50.0; E_value=8.1e-12; Accession=PF00010.16; Description=Helix-loop -helix DNA-binding domain
MEDATFLHQWHLSSIDDPNLLPIAAAFGETLQHHAFSTYPNFNPKTSMETTLADDERGTKHHRNISLNPNSKSAQTSSETQFVSFPNLFSFVDSNHTTPPPDTISQGTLGNHNNYVFKACQEAKKTGKRYKHSQPQDHIIAERKRREKLSQRFIALSALVPGLQKTDKASVLGDAIKYLKQLQEKVNALEEEQNMKKNVESVVIVKKCQLSNDVNNSSSEHDGSFDEALPEIEARFCERSVLIRVHCEKSKGVVENTIQGIEKLHLKVINSNTMTFGRCALDITVIAQMDMEFCMGVKDLVRNLRSAFTSFMRLKSSTGRKLKTLAALVPLYLYTS

SEQ ID NO: 132163 - protein, 270 aa, Glycine max
  Coding DNA Sequence Number=SeqID_15385
MQCSFDSTKLALLAKPLFEINCSGLNGIKEKEEHCFKATELERCNLHKRLANLQEGSIDVAVVKEFYANLYSPEDQSPKQVKVRGHLIRIDVDRLNTFLETPVVLEGATLPTYSRFTRMRIDPQEFSTRLYIPGRGFVLNAEGHPWKLLRKDLTTLAQTWSVLSYSNLTPTSHTSDLNMDRARGARKVRARLADVPSSSAPPAPPTSAMPTPAAHDSQRFEAMLQSIHQGQILLLQSLQVVVPLGSILSVEQFIEKVSWPGTCTFYCERG

SEQ ID NO: 132164 - protein, 222 aa, Glycine max
  Coding DNA Sequence Number=SeqID_15386
  Gene Ontology: Mol. function=helicase activity; Biological process =viral genome replication
  Homolog annotation: Hit_ID=Q9ZQ61; Match level="QueryCoverage=92%, HitCoverage=20%, E-value=3e-39, Identity=33%"; Hit description =Putative helicase
MMLGSCKGPTSFEDIRIVANIQYPTYREACFAMGFLQDDREYVEAIKEAKDWGTTNYLRKLFVLILLTGAMSKPEEVWNQCWHWLADDIAYQYTKSTISSDEQKTIYHRIIQAVNNNEGGMFFLYGFGGTGKTFIWRTLASSLRAENQIVIIVASSGIASLLLPGGRTAHSRFKIPVPIFEDSTCNIHQGTELAELLNQTSLIIWGEAPIVTTRLVATVSTL

SEQ ID NO: 132165 - protein, 56 aa, Glycine max
  Coding DNA Sequence Number=SeqID_15387
NLENTGSAVHENIEDFAAFKQMDHSGKGKARLRENTNVSESVIAQRRNKLKTTKCR

SEQ ID NO: 132166 - protein, 218 aa, Glycine max
  Coding DNA Sequence Number=SeqID_15388
  Gene Ontology: Mol. function=carboxypeptidase activity; Cellular component=chromatin; Biological process=chromatin assembly or disassembly
  Homolog annotation: Hit_ID=Q9SPU5; Match level="QueryCoverage=99%, HitCoverage=30%, E-value=9e-72, Identity=53%"; Hit description =Putative transposase protein
  Pfam annotation: Domain name=Transposase_21; Domain location=7-212; Score=344.3; E_value=2e-100; Accession=PF02992.5; Description =Transposase family tnp2
MTSQIATEMRWHKDRKIEDGQLRHPADSITWKTLDSKYPSFAADPRNVRLGLASDVVVPYNLPPWMCMKDPFFMMSLLIPGPMALGNDIDVYLQPLIEELKELWEKGVVTYDASTKETFRLYASILWTINDFLAYGNLRGWSTKGRYACPCCNMDTWLLNEGKFSYMGSRRFLPHDHSWRNNAKAFDGKKEKQSAPKPLSGDDIIEQYQHFDQFTLFK

SEQ ID NO: 132167 - protein, 82 aa, Glycine max
  Coding DNA Sequence Number=SeqID_15389
KSPLKDLIEAQRSSLHRSPTSNLPSGSDLQNQVMTYLWVRIRMKHLPIACSHFSEENTETIFSLTVNKNYVGLSSSSQIEDT

SEQ ID NO: 132168 - protein, 71 aa, Glycine max
  Coding DNA Sequence Number=SeqID_15390
  Gene Ontology: Mol. function=dihydroneopterin triphosphate pyrophosphohydrolase activity; Cellular component=cytosol
  Homolog annotation: Hit_ID=Q9CA40; Match level="QueryCoverage=65%, HitCoverage=31%, E-value=2e-09, Identity=63%"; Hit description=Nudix hydrolase 1
MENKNNNSGESELRVVVVIFLLKGRSILLGRCRSAVGNATFTLLGGHLEFGHSLTLSHIMFFFSSNILKTK

SEQ ID NO: 132169 - protein, 84 aa, Glycine max
  Coding DNA Sequence Number=SeqID_15391
MRKIWGFEDLGMEGAVKEKGRKKELPKEREGAIFIGKDELQRIKLNVLMMPKDHMLLKKDHMFLKALFKTKKLKIFKMDDHESF

SEQ ID NO: 132170 - protein, 147 aa, Glycine max
  Coding DNA Sequence Number=SeqID_15392
MKPVDISNPDVDALYLMTLTIPQLFLKPLQVPWDASVFGVYNDNFSLYIKHEHLSKIAHSGQCLSISVTQLWILAHWQMVIILPKDDVVIWFCSLHNRSNNYLKGIINRDSTTGQGSKSKAVARWIIVKCNKQKGSSECEYCVVHWM

SEQ ID NO: 132171 - protein, 158 aa, Glycine max
  Coding DNA Sequence Number=SeqID_15393
MNILTTHDQGWEQELSPYNQYEEERTPNLESMFEEFRAYHASSKANQNSMKNHEIHFGTSYSTENFQGRQELQPYYQNEAKGGPNLDKLLMQFMETTKSTQQALQSVEIQVGELAEAVTQFMSRQEKSFVEVEAQKKSPVKEHESREKDEEQAQQQWE

SEQ ID NO: 132172 - protein, 81 aa, Glycine max
  Coding DNA Sequence Number=SeqID_15394
MTMWVSRKRFPTDFRREEKEKSDFRQKDDKEKREGKAHNISRRSKLNNGSAREVQMVINFDSVSNLGAWYIETLEIEQRNL

SEQ ID NO: 132173 - protein, 279 aa, Glycine max
  Coding DNA Sequence Number=SeqID_15395
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=3e-30, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=49-260; Score=- 50.1; E_value=0.078; Accession=PF02389.6; Description=Cornifin (SPRR) family
  Pfam annotation: Domain name=PT; Domain location=93-128; Score=8.4; E_ value=0.083; Accession=PF04886.3; Description=PT repeat
  Pfam module annotation: Pfam domain module=Cornifin::PT; Domain location=49-260::93-128
MPSPLEGNTPSPSEDYTSMPSEDCTSLPLEDYTSSPTKGYRSSPSEDYTSSPSEDYTSLPTGGYMSLPSKGYAPSPSEDYGYATSPSEGYTPSPSEHYTSSPSEDCTSSPSKDFTSSPTEGYISQPSEEYTSSPLEGYAPSPSEDYTSSPSEGYTPTPLEDYTSSPSEDYTSSPTEGYMSSPLEGYAPSPSEGYTPSLSEDNTYSLSDDYTSSPTEGYMSSPSEGYVPSPSEGYTPSPLEDYTSSPLEGYTPSPLGDYTSSPSEGCTSSPSESYTSSPS

SEQ ID NO: 132174 - protein, 77 aa, Glycine max
  Coding DNA Sequence Number=SeqID_15396
MEEQQRGLRCFCQCAHSQNRKEGLGFKRRGEASNIFNQVIKYSGNWKIFKFNDDAKDMDGFNRSGVIILQRGEFKPF

SEQ ID NO: 132175 - protein, 220 aa, Glycine max
  Coding DNA Sequence Number=SeqID_15397
  Gene Ontology: Mol. function=zinc ion binding; Cellular component =nucleus
  Homolog annotation: Hit_ID=Q2R448; Match level="QueryCoverage=66%, HitCoverage=42%, E-value=9e-32, Identity=46%"; Hit description=MYND finger family protein, expressed
  Subcellular localization annotation: CTP_CleavageSite=50; ConfidenceScore=5.07e-01
MFPLSNPKSKSKPHSLTPCHPHKAKTRKHYKLNKCKRLNSLGIHPFVLSKASHKTFSYKAKNWCDFLHRFLKHCPDAPKTLKHIRFYCLQNRGSSVSLMAKVTMNSHASALYSLTVIQFNGSGDMKNDKDLRAGVILCPHVAFLGHIDALQKLGHCLQDGYNIKQNAMEGRRFLVQANVHELTVVLFTENNKVSLANMEPPTCSLLEAQVSNQVGLSNVK

SEQ ID NO: 132176 - protein, 103 aa, Glycine max
  Coding DNA Sequence Number=SeqID_15398
  Gene Ontology: Mol. function=nucleic acid binding
MAEELHRGAMLDYDDPSYLFLAKLEELSLLLDINIVGKILLQENFLEPLPSDSRSLSCQTPSSVVPSMLCTRLQHSHSSASIGSTLPQKNGGSFIRNLDNTAY

SEQ ID NO: 132177 - protein, 560 aa, Glycine max
  Coding DNA Sequence Number=SeqID_15399
  Homolog annotation: Hit_ID=Q9FG25; Match level="QueryCoverage=92%, HitCoverage=92%, E-value=2e-28, Identity=23%"; Hit description =Arabidopsis thaliana genomic DNA, chromosome 5, P1 clone:MPH15
  Pfam annotation: Domain name=mTERF; Domain location=213-536; Score= -2.9; E_value=6.2e-08; Accession=PF02536.5; Description=mTERF
MSLHRHVCTTTSKLSAAAAAAIPWKYKKFAIAQGQKSLTDYLHATRCIPYAYADKIAKNSLTSLTTLITTTLGGSFSPPHFPHNLNKFLRYHPINEFEFFFESIGIHPSKLGSLLPQDNFFFSEDDTLLNAARVLHEFGFPWDRLGILYVESGCFFKCGASELKGRLCGFKRYGFCNAQVVGICLAFPFVFDGQKGDEVEALFCDLGLLFGELGLAECVEGKGNNSVDDWIGVCRKIRLFYDLNGGRSLVELVGGNNGVGVGVILEHGEEELVQATEYFCSFGAKKEDVARLIVDGRELLELDLKTRVVDVVKLLKYFGMSSDDVEDVRRDYAHVLGTVKMGNLPNVMRALGLHEWFFGKIKDGNHCLLVSFVASYPNEVQDEGYLGCLKAIQESRTPTHNISKLNFLHAIGFGENALTMNVYAQMHGTSVELQKRFDCLLRLGIEFSKVCKMITIYPKILSQNPQNLEQKVNFFCQEMGHSLEHLVTFPAFLCFDLENRIKPRYRFHMWIMEKGLSSKKYSIASMVATSNKNFVARAFKIHPAALKHWFEQFYPRNLQV

SEQ ID NO: 132178 - protein, 64 aa, Glycine max
  Coding DNA Sequence Number=SeqID_15400
MLEDDAPLSYLKVTLHSIMALTNLELQSRCISSTLMAQQRRYTSTEEVRPLMPPGARPRGARLP

SEQ ID NO: 132179 - protein, 232 aa, Glycine max
  Coding DNA Sequence Number=SeqID_15401
MSTQSSSALNVDPLVLLGCTVTYQFKVAFHVGRNLIEIPSLYHRQWAPHYPLYVLLDYNGDKHYIRLRKHNNKFYFADGLKGFRRTMGIHKGVMITFVVPEKNWMFHIHFMPPLHRKTCGRPLATTRTHVFTVDVTQRLISRTYPLVLPPDALNFVDASTKYMIVLGIHGRRHLWKMTIHNGLQSLGHPWYHYLTVNELMAGDEVVFYYRPNQHVWEVIFRKQMTWNEDESG

SEQ ID NO: 132180 - protein, 157 aa, Glycine max
  Coding DNA Sequence Number=SeqID_15402
  Gene Ontology: Mol. function=RNA-directed DNA polymerase activity; Biological process=RNA-dependent DNA replication
  Pfam annotation: Domain name=AT_hook; Domain location=104-116; Score =14.9; E_value=0.061; Accession=PF02178.9; Description=AT hook motif
TDQAKGKVYRTAVRPAILYGTECWAVKSQHENKVGVAEMRTLRWMCGKTRQDKIRNEAIRERVGVAPIVEKMVENRLRWFGHVERRPVDSVVRRVDQMERRQTIRGRGRPKKTIREVIKKDLEINGLDRSMLLGGKITNINFNDTYYCPYNSLFIHG

SEQ ID NO: 132181 - protein, 185 aa, Glycine max
  Coding DNA Sequence Number=SeqID_15403
  Gene Ontology: Mol. function=hydrolase activity, acting on carbon -nitrogen (but not peptide) bonds; Cellular component=cellular _component; Biological process=nitrogen compound metabolic process
  Homolog annotation: Hit_ID=Q10R10; Match level="QueryCoverage=77%, HitCoverage=47%, E-value=1e-46, Identity=66%"; Hit description =Hydrolase, carbon-nitrogen family protein, expressed
  Pfam annotation: Domain name=CN_hydrolase; Domain location=28-184; Score=74.1; E_value=4.5e-19; Accession=PF00795.12; Description =Carbon-nitrogen hydrolase
MSATSVNSERALAPPAIPLPPPPLSNFKIGLYQLSVSPDKDNNIAHARTAIQDDASKGAQLVLLPEIWNSPYSNDSFSVYAEDIDAGASPSTAMLSELSRILKITIVGCFILESYGGLLYNTCCVFGTDENLLAKDRKIHLFDIDIPGKITFIESKTLTVGETLTIVDTGCNPEGSLEINYPIVS

SEQ ID NO: 132182 - protein, 803 aa, Glycine max
  Coding DNA Sequence Number=SeqID_15404
  Gene Ontology: Mol. function=RNA-directed DNA polymerase activity; Cellular component=chromatin; Biological process=chromatin assembly or disassembly
  Pfam annotation: Domain name=Chromo; Domain location=711-761; Score =17.6; E_value=0.0081; Accession=PF00385.14; Description='chromo' (CHRromatin Organisation MOdifier
  Pfam annotation: Domain name=RnaseH; Domain location=158-276; Score= -34.4; E_value=0.092; Accession=PF00075.14; Description=RNase H
  Pfam annotation: Domain name=rve; Domain location=409-565; Score =99.1; E_value=1.3e-26; Accession=PF00665.16; Description=Integrase core domain
  Pfam annotation: Domain name=zf-H2C2; Domain location=350-391; Score =4.7; E_value=0.087; Accession=PF09337.1; Description=His(2)-Cys(2) zinc finger
  Pfam module annotation: Pfam domain module=Chromo::RnaseH::rve::zf -H2C2; Domain location=711-761::158-276::409-565::350-391
MNDTLRPFLRKFVAFFFDDILVFSPDLATHVTHLDTVLATLSARKFLLRHSKCEFAKSQLNYLGHVISAQGVAPDPAKIQAMLAWPVPTSPTALRGFLGLTGFYRKFIKGYATVASPLTALLRKDNFQWSQAADLAFQTLKNLMTQAPVLSTPDFSIPFTLETDASASTIGAVLLQQGHPIAYYSKTLCPRLQHSSAYVRELHAITSAVRKWRHYLLGNSFIILTDHKSLKDLMSQVIQTPEQQNYLVKLLGYDYEIKYKPGSTNIVADALSRISDGVCLSFSVPHLDFLDKLRHTLTQDPQYIELLQAIQSRPTEHPSLSVHKDLIFRQGRIWIPFPNPFTSILLAEFHSSPLGGHTGVAKTVHRVRQNFDWPNLRADVRQFVSQCPICQLTKYETKKPGGLLQPLPPPAAVWEDLSLDFIIGLPSSQGFIVILVVVDRFSKGAHFGALPTHYSAFKVASLFLDMVCKHHGFPWSLVSDRDYIFLSTFWRELFRLSGTKLRMSTAYHPQSDGQTEVLNRILEQYLRSFVHHKPSLWIRFLPLAEWSYNTTIHSSTGFSPFEVIYGWPPPSISRYIQGTSSIDAVDNLLVDHTELYTALLHHLHKAQEKMKANADAHRRDVQFFVGDWVYVRLRPYRQKSVANTFHKLSKRFYGPFQVIQRIGAVAYKLRLPAYSRIHPVFHISLLKPHHGPLPAEYTHLPPDAIENNPVISPQSIVDWKWDESVTPAIKRVLVQWDGLAPKDTSWESWDELRTSYNLGDKVVFGVEGVDSNTQDNNHTTANSNVHNRPTRIIRMPKHLQDFV

SEQ ID NO: 132183 - protein, 327 aa, Glycine max
  Coding DNA Sequence Number=SeqID_15405
  Homolog annotation: Hit_ID=Q1S4R0; Match level="QueryCoverage=42%, HitCoverage=47%, E-value=5e-12, Identity=28%"; Hit description=Myb, DNA-binding; Tetratricopeptide-like helical
  Pfam annotation: Domain name=PPR; Domain location=161-195; Score=5.3; E_value=1.8; Accession=PF01535.11; Description=PPR repeat
  Pfam annotation: Domain name=PPR; Domain location=197-231; Score =15.1; E_value=0.12; Accession=PF01535.11; Description=PPR repeat
  Pfam annotation: Domain name=PPR; Domain location=232-266; Score =19.8; E_value=0.0097; Accession=PF01535.11; Description=PPR repeat
  Pfam annotation: Domain name=PPR; Domain location=267-302; Score=2.6; E_value=3.7; Accession=PF01535.11; Description=PPR repeat
  Pfam module annotation: Pfam domain module=PPR::PPR::PPR::PPR; Domain location=161-195::197-231::232-266::267-302
  Subcellular localization annotation: CTP_CleavageSite=23; ConfidenceScore=5.35e-01
MATQPFRKAIAKPSSSSTPPIPNLSLVSCITSILQNLNPQSPDYSPPKQFSSHHTPNLVINVIKNQNIPHHALHLFNWASNHNHYSHTLFCYAAITDLLLSHSLSTTPTDSPTTSSACSSTLSATAATSGAPFTGSMERIPSQRTLRVFLQRHIGCPHEGQLCQHCQGHLRSVGMVESARKVFEEMVSHGMNPDVKAYRVVVVNEYCKIRKPSEAVLLLREMVVRRVKPSMSSFNAVFRVLVDEGKLNKRVILLKQMPKMGCSPNFLFYCTMICGLCKVKGRMQQVEELILDMLQNGHNLDATMYNCLLAGYCQDRDEERTPKIVMT

SEQ ID NO: 132184 - protein, 190 aa, Glycine max
  Coding DNA Sequence Number=SeqID_15406
  Homolog annotation: Hit_ID=Q1RUD8; Match level="QueryCoverage=79%, HitCoverage=33%, E-value=7e-12, Identity=28%"; Hit description=IMP dehydrogenase/GMP reductase
MGSKIYPKVHENPKAFFINSSPILLEPLAHGSVKHGPSLKKRFYQVKIKSLEVTSLRELGQLMGQLQRQAFRKAYGKIWDLARVEVSMEPIASLSQYYDQPLRCFTFEDFQLVPTVKEFEEILGCPLGGRKPYLFSGFYPSTTRVAKVKISAQELDRVKQNRNGVVGVPRKCLEERAKALANQGEWAFFY

SEQ ID NO: 132185 - protein, 95 aa, Glycine max
  Coding DNA Sequence Number=SeqID_15407
  Gene Ontology: Mol. function=transporter activity; Cellular component= mitochondrial inner membrane; Biological process=transport
  Homolog annotation: Hit_ID=Q6ZA15; Match level="QueryCoverage=88%, HitCoverage=17%, E-value=1e-22, Identity=80%"; Hit description =Putative mitochondrial carrier protein
MERHKCWPGSCSTNSKELTDMTFICLNQVGIYLPCYDILRNWLEEFTAKNAPTTTTYVPLVAGSLARSLACATCYPIELARTRMQWKAMEWRGMA

SEQ ID NO: 132186 - protein, 72 aa, Glycine max
  Coding DNA Sequence Number=SeqID_15408
ACDLLASSKHRLDPLSTGFTLVDLKKLGYHNDPFIMAEQARQGKTIGVNAEDVDSYMDTYVSPLTAQITPNV

SEQ ID NO: 132187 - protein, 115 aa, Glycine max
  Coding DNA Sequence Number=SeqID_15409
MLQQYYRASVIKKIFQRIDCEHIPTPSSTNDVAQIHKPTKASCIDSIKSPPHLILNDVAPCAACRPWIFFINGVLCFLKIMAAEWRRKRVERRCHFKEKISQEEAHHHRKSWIRA

SEQ ID NO: 132188 - protein, 96 aa, Glycine max
  Coding DNA Sequence Number=SeqID_15410
MHELLLFMDKFAINAWMFSNMESYFSMMYETRGRCQNSKQLLEHRFKLATRITVEEAVDRGAHDLVFLASLVVELCRRRDVVIVNGSMAKLRQKRW

SEQ ID NO: 132189 - protein, 302 aa, Glycine max
  Coding DNA Sequence Number=SeqID_15411
MKWMTFMQIVMIIMKAYGKTFLPYCVLDKHMAKSPSSPLPDSLAPSEFTSKRIRQCTQLRRLTAKYSNQLRPVVHVNPSTEKALGPLKENFHTYLGIVAQERLRQFDIPKMSNAKKKVISLVGTRWRQFKISLTSKFVYAKNEGLDEKIWEEFFVNCKTPSWKESERKLKNAKNTTCGNTYCLVADSIEEQMTQDTFVPHGCQDILTTIIGRPGHPGHVRATGMETFEDRWKKEIDDESKCREEKLREEFKEVLHNELSQRASQQPPAIKEVEPFISARVSTKGSYARTATNPLRGNLTLLI

SEQ ID NO: 132190 - protein, 88 aa, Glycine max
  Coding DNA Sequence Number=SeqID_15412
MCGKRRKPFTNRTLPPTFCLVGDSFEEQVTQGSFIPHGRQDVLTAAIGRPEHPGRVHAAGAGVTIKQYFRSAPWTSRNSSLLPPEELQ

SEQ ID NO: 132191 - protein, 126 aa, Glycine max
  Coding DNA Sequence Number=SeqID_15413
MTFISYFFLCWYLYWQDGDVDLNASPQALDRLLGCFLAFKVKVQPRFRNSVVLKYSDESDLINVVLDMIPDSEPCCKIKNSILESTDPTVLEFQSLSITADHDRSMLGSSEPTELESQSMSVTGGS

SEQ ID NO: 132192 - protein, 363 aa, Glycine max
  Coding DNA Sequence Number=SeqID_15414
  Gene Ontology: Mol. function=uridine kinase activity; Cellular component=membrane; Biological process=biosynthetic process
  Homolog annotation: Hit_ID=Q8ZFZ9; Match level="QueryCoverage=54%, HitCoverage=93%, E-value=1e-104, Identity=95%"; Hit description =Uridine kinase
  Pfam annotation: Domain name=PRK; Domain location=164-350; Score =159.4; E_value=9e-45; Accession=PF00485.8; Description =Phosphoribulokinase  Uridine kinase family
MAKGNIHPVSKAMLRIGWENRPVNVQSSGGQMLAARAEWPLNPVKSKRSLPMPQPIKASLDRQTTPPVNPKISAHCQPAARVAGDMSSNKNRISAQGSNNMLSPKKVRKYQSSTSISDERGRGAKVSAGECNPLRRVALAARFLKCRVPVAWQPEFARRRAIYTGASASGKSLIASTLYRELREQVGDEHIGVIPEDSYYKDQTHLTMEERVKTNYDHPSAMDHNLLFQHLQMLKAGKAIELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 132193 - protein, 331 aa, Glycine max
  Coding DNA Sequence Number=SeqID_15415
  Gene Ontology: Cellular component=periplasmic space
  Homolog annotation: Hit_ID=UPI00005FA0D8; Match level="QueryCoverage =96%, HitCoverage=52%, E-value=1e-82, Identity=50%"; Hit description =COG2982: Uncharacterized protein involved in outer membrane biogenesis
MAADIDLQQFPHQIGAKVTQFNYQLAGADIPNGGIQGEGNAQVVYQQTPAQIAVSQLNVSANNSQLTGDISASLGAVPGYVVNLNSANLDLDALSGWQSSTNTAEQPAVTAAPVIASQVDDRQQNLEALRDFNAQLNLQAAQLTYRGMNVTQLAVAADNQRGLLTLHKLAGRLAGGDFSLPGSLDARGNKPVINVQPTLNQVELGTVLKAFDMPQMLTGKFSMKGDLTGDRLSSQSFEHRWRGTAQLAMQDAQLHGLNIQQLIQQAVARNDNSVRGQDSYQRYTEVKSVSARARLSQGTVKLSSLTADSPLLALTGAGSTRYAGKTVRYGA

SEQ ID NO: 132194 - protein, 171 aa, Glycine max
  Coding DNA Sequence Number=SeqID_15416
  Gene Ontology: Mol. function=DNA-directed RNA polymerase activity; Cellular component=chromatin; Biological process=chromatin assembly or disassembly
  Homolog annotation: Hit_ID=Q1SJG5; Match level="QueryCoverage=88%, HitCoverage=13%, E-value=4e-20, Identity=40%"; Hit description=SNF2 -related; Chromo; DEAD/DEAH box helicase, N-terminal; DNA-directed RNA polymerase, subunit beta-prime
MEVQYGSYSEPDGSRLQKEATTDDRVGTRESNIENMGNKTAAVGGWGTTFWKDCQPMCPPNDGSDDNLSEDRGESLDSEDDDDGLKDSGKGSIGHSGIPAEEMLSDEYYEQNGEEQSVSLHCRVVRQPTGSNSRPQQMSSIVKSRMHKSRISDDAEDNDGDADYEEEDEAD

SEQ ID NO: 132195 - protein, 118 aa, Glycine max
  Coding DNA Sequence Number=SeqID_15417
  Subcellular localization annotation: CTP_CleavageSite=82; ConfidenceScore=5.35e-01
MTPCETNSWEKCLKKVILSCWSTFKFSFTSFNLLTNRKPYRNKSRNSNNKRLNLPPAGSARDRVQAIRRNRGTAGHRLAIVRTFAVEGSPETEYPAESIEKSEARILELRRRRSAAGG

SEQ ID NO: 132196 - protein, 210 aa, Glycine max
  Coding DNA Sequence Number=SeqID_15418
  Homolog annotation: Hit_ID=O04237; Match level="QueryCoverage=34%, HitCoverage=19%, E-value=9e-20, Identity=68%"; Hit description =Transcription factor
MTLEEYEKVLEERRKAFHALKTKERKVDTKFFESLQHLSNKKDNDDNFIKLGGDNDKRRETLDKEDKLKKGMGDFLDEMLTMMSQTKSNENGEESFEELQKLFEDMFQADIGLDGGPSLASSDSSTSFAYMTYSEISSSNKRNSSEMNFGKAENSFVFDASYQNFCFGLYTLIGGKNKLKVDKCFTTPGMAPNLGKVKYVFTSVPMSPPM

SEQ ID NO: 132197 - protein, 398 aa, Glycine max
  Coding DNA Sequence Number=SeqID_15419
  Gene Ontology: Mol. function=DNA binding; Biological process=DNA integration
  Homolog annotation: Hit_ID=Q69V30; Match level="QueryCoverage=69%, HitCoverage=30%, E-value=5e-10, Identity=24%"; Hit description =Hydroxyproline-rich glycoprotein-like
  Pfam annotation: Domain name=Transposase_23; Domain location=245-308; Score=-11.5; E_value=0.021; Accession=PF03017.5; Description =TNP1ENSPM transposase
MIIIKTPKAVASTRFVYGNSEGQREHDPPVKYDVDKETWEQFAASRKTPNWQGIRKKMQEIRKWNDCPHVLYRGGYDLLEKKMMDEKMNKRQHDAMTTENTPNSGDPPTPIQGHVKWIASLEEQMRQGTFVPHGREDILNTAIGRPDHGGRVRAAGFGVTISQYFGRATRGSSCSSGSINQVLKDELKEQIILEMSQRGSLIPTHIQPDIHGLVARVSTKGSNAESVVNPCLPNDVAPVEPPIGLYVPRQDSIELVALGKTYDGGSTIHNVAYADDVVRVSVEQVIDGDAEVPFPTSEIKCVRQALHTFIAWPTPLHEGSSPTKDTEAVEAVNDVVVDDPLHELIKSLVDIYEKPVELVWDATKFGIPNATASLFVTCADVNEIISGVQCLNIAILQL

SEQ ID NO: 132198 - protein, 34 aa, Glycine max
  Coding DNA Sequence Number=SeqID_15420
MYGDVGTDVVSCAFYIIFQKATMLNMGTSTTVVT

SEQ ID NO: 132199 - protein, 72 aa, Glycine max
  Coding DNA Sequence Number=SeqID_15421
MRIQLRISMRILLKDFIKCTCCVHMIFKFLIIKATTRIYDENPETGQIQAKGSSGEGRRPKWRRTKPPSGEG

SEQ ID NO: 132200 - protein, 235 aa, Glycine max
  Coding DNA Sequence Number=SeqID_15422
  Gene Ontology: Mol. function=pyridoxal phosphate binding; Cellular component=peroxisome; Biological process=metabolic process
  Homolog annotation: Hit_ID=Q3S4G9; Match level="QueryCoverage=99%, HitCoverage=71%, E-value=1e-115, Identity=76%"; Hit description =Enzymatic resistance protein
  Pfam annotation: Domain name=Aminotran_5; Domain location=12-230; Score=-204.2; E_value=0.067; Accession=PF00266.9; Description =Aminotransferase class-V
MDYFNAPGRNHLFVPGPVNIPDQIIRAMNRNNEDYRSPAIPAMTKTLLEDVKKIFKTTTGTPFLIPTTGTGAWESALTNTLSPGDRIVSFLIGQFSLLWIDQQQRLKFNVDVVESEWGHGAKLDVLESKIASDTSHTIKAICIVHNETATGVTNDLAKVRQILGPKAIEASKHAKSLRVFFDWKDYLKFYQLGTYWPYTPSIHLLYGLRAALDLIFEEGLENVIARHSRLGKATR

SEQ ID NO: 132201 - protein, 43 aa, Glycine max
  Coding DNA Sequence Number=SeqID_15423
MVRFVYALIFGFVALNCLQVFEESNAQRLPQDEVNIGTTKELF

SEQ ID NO: 132202 - protein, 98 aa, Glycine max
  Coding DNA Sequence Number=SeqID_15424
MSNSLNQRLVVRDRGRFQTVDLLCIERMRLGMGIYIFKATNVATYLEIKTLTLCGVPKGEEDREETKAVQASRTRMIGGGIKSNGGGWRRGFGGGGMR

SEQ ID NO: 132203 - protein, 49 aa, Glycine max
  Coding DNA Sequence Number=SeqID_15425
MSRRVQIDDAKNDDVPDGDSSPVEPDKLRKRDHINVPSHPFLMKLLNKQ

SEQ ID NO: 132204 - protein, 418 aa, Glycine max
  Coding DNA Sequence Number=SeqID_15426
  Gene Ontology: Mol. function=protein dimerization activity; Cellular component=chromatin; Biological process=DNA integration
  Homolog annotation: Hit_ID=Q6RZV0; Match level="QueryCoverage=99%, HitCoverage=63%, E-value=4e-74, Identity=35%"; Hit description =Transposase-like protein
  Pfam annotation: Domain name=DUF659; Domain location=170-322; Score =266.1; E_value=6.8e-77; Accession=PF04937.6; Description=Protein of unknown function (DUF 659)
  Pfam annotation: Domain name=zf-C2HC_plant; Domain location=8-61; Score=49.3; E_value=1.3e-11; Accession=PF07567.3; Description =Protein of unknown function, DUF1544
  Pfam module annotation: Pfam domain module=DUF659::zf-C2HC_plant; Domain location=170-322::8-61
MVVVREKDVCWEYAEKLDGNKVRCKFCQRVLNGGISRLKHHLSRFPSKGVNPCSKVRDDVTDRVRGIIASKEEVKETSSAKKQKIAEVKSPSNLSASKALVSLDAASPVMKIFPTGHPMTPSSTNNQEIAERSIALFFFENKLDFSVARSSSYQLMIDAIAKCGPGFTGPSAETLKTIWLERMKSEVGLQTKDVEKEWATTGCTILADTWTDYKSKAIINFLVSSPSRTFFHKSVDASAYFKNTKWLADLFDSVIQEFGPENVVQIIMDSSVNYTVIANHIVQSYGTIFVSPCASQCLNLILEEFSKVDWISRCILQAQTISKLIYNNASLLDLTKKYTGGQELIRTGITKSVSTFLSLQSMLKLRTRLKNMFHSHEYASNTSYANKPQSLSCITIAEDGDFWRTVEECVAISEPFLK

SEQ ID NO: 132205 - protein, 176 aa, Glycine max
  Coding DNA Sequence Number=SeqID_15427
  Homolog annotation: Hit_ID=Q8LG11; Match level="QueryCoverage=70%, HitCoverage=57%, E-value=2e-37, Identity=60%"; Hit description =Proline-rich cell wall protein-like
  Subcellular localization annotation: CTP_CleavageSite=44; ConfidenceScore=5.31e-01
MDYDFRSRSGPQPPMYRPPPPPSPMYRPSPYQQNPTPSSGLGVRVGIKPEYRITPPPHLSSLAGDNPRSNFQFDFGLERKILAEAEKDNPNWSKFGSENIPTKVSDSSTAKVTALDPIVSKFMAMGLSREAVLIAVENYGDNPTKIIELRKKYDYVSEKYCHTSFSLYSVMTILIE

SEQ ID NO: 132206 - protein, 232 aa, Glycine max
  Coding DNA Sequence Number=SeqID_15428
  Gene Ontology: Mol. function=protein dimerization activity; Biological process=electron transport
  Homolog annotation: Hit_ID=Q6RZV0; Match level="QueryCoverage=85%, HitCoverage=30%, E-value=1e-34, Identity=36%"; Hit description =Transposase-like protein
  Pfam annotation: Domain name=hATC; Domain location=83-161; Score =48.4; E_value=2.4e-11; Accession=PF05699.5; Description=hAT family dimerisation domain
MDENKCKKFLDIVDKKWRDQLHSPLHAAAAFLNPSIQYNPEIKFISSIKEDFFNVLEKLLPVPDMRRDITNQIYTFTKAHGMFGCSLAKEARNTVAPWLWWEQYGDSAPGLQRVAIRILSQVCSTFSFHRQWSTIRQIHSEKRNKIDRETLNDLVYINYNLKLARQMSAKSSEVDLLQFDDIDMTSEWVEENETASPTQWLDRFGPALDGNDLNTRQFGSSIFGANDPIFGL

SEQ ID NO: 132207 - protein, 39 aa, Glycine max
  Coding DNA Sequence Number=SeqID_15429
MKGRVNLGLESENVVLTYEKAWAVQERKTNDQSEGKNHF

SEQ ID NO: 132208 - protein, 148 aa, Glycine max
  Coding DNA Sequence Number=SeqID_15430
  Gene Ontology: Mol. function=galactosyltransferase activity; Cellular component=membrane; Biological process=protein amino acid glycosylation
  Homolog annotation: Hit_ID=Q9FK08; Match level="QueryCoverage=98%, HitCoverage=36%, E-value=4e-50, Identity=64%"; Hit description=Avr9 elicitor response protein-like
  Pfam annotation: Domain name=Galactosyl_T; Domain location=1-133; Score=-53.7; E_value=0.0053; Accession=PF01762.12; Description =Galactosyltransferase
ASLKKIEEGKGIIVRFVIGRSENRGDSQDKDIDHENRLTNDFLILDNHVETNDAFPKKVKLFFAHAADKWDAEFYAKVNDDVYVNIDALGATLATHLDKPRVYMGCMKSGEVFSELEYFMILILVSVKYDRNHKWYEPEWWKFGDKKS

SEQ ID NO: 132209 - protein, 81 aa, Glycine max
  Coding DNA Sequence Number=SeqID_15431
MYDSPYVMFAFGQDLNFLAIPLATIEQWKCVLLLNQSGRRIAWEGLWCGKTQIQDLLITPTLMPLLPITRSPYISPQLWWL

SEQ ID NO: 132210 - protein, 167 aa, Glycine max
  Coding DNA Sequence Number=SeqID_15432
  Gene Ontology: Mol. function=galactosyltransferase activity; Cellular component=membrane; Biological process=protein amino acid glycosylation
  Homolog annotation: Hit_ID=Q8RW34; Match level="QueryCoverage=84%, HitCoverage=41%, E-value=6e-45, Identity=64%"; Hit description=Beta 1,3-glycosyltransferase-like protein I
MQSRGSSHRVSSMGNNRSRIPALLISMFAAFASIYVAGRLWLDAENRVYLIKELDRITGQGQSAISVDDTLKIIACREQHKKLDALETELAGARQEGFVSNPLIETNGTYSTRRPLVVIGILTKFGRQKNRDAIRKAWMGSGKYILCFVFLGATCLEYTFVYVLVSK

SEQ ID NO: 132211 - protein, 68 aa, Glycine max
  Coding DNA Sequence Number=SeqID_15433
MKNEGVKIINGSHGHERRKKEPTRHPKDPLKNRFIRTSPQRNPAPKGWTFMLLCQGVDGLKSAPMRPK

SEQ ID NO: 132212 - protein, 871 aa, Glycine max
  Coding DNA Sequence Number=SeqID_15434
  Gene Ontology: Mol. function=RNA binding; Cellular component=integral to membrane; Biological process=transport
  Homolog annotation: Hit_ID=Q2QUQ9; Match level="QueryCoverage=77%, HitCoverage=83%, E-value=0.0, Identity=68%"; Hit description=Pre -mRNA splicing factor cwc22, putative, expressed
  Pfam annotation: Domain name=DUF1777; Domain location=141-334; Score=- 90.9; E_value=0.046; Accession=PF08648.2; Description=Protein of unknown function (DUF1777)
  Pfam annotation: Domain name=MA3; Domain location=623-729; Score =139.3; E_value=1.1e-38; Accession=PF02847.7; Description=MA3 domain
  Pfam annotation: Domain name=MIF4G; Domain location=334-517; Score =155.2; E_value=1.7e-43; Accession=PF02854.9; Description=MIF4G domain
  Pfam module annotation: Pfam domain module=DUF1777::MA3::MIF4G; Domain location=141-334::623-729::334-517
MARRHSRSSESSEDDVRKRRGSESEDEERDRRYRRGGWSNKKSSGHRSSRENGDGSDSGEERNGAKRDGKSKSRERKESESSEEEGQIVSKERIREEKKEDARLQRRHDGRGGRDNEGDDRDGRESHRGNDQDEKRGETESHRLHHGDRWRGGDEDRQKINDRRGRHDSEEEDYRELARKSERDRDNNRDRDRRQRVEKGGDNERDRRMRHNSEEEDARELARKLDRDRDRDRDRDRRRRVEKDGGSERNHREKDVSKRQEESRKKEDGNGRMVEDEKPQRQATIPGGNLNGDASNLGKSGGVYIPPFKMAMMMKEVQDKSSVEYQRLTWDALRKSINGLVNKVNATNIKNIIPELFAENLIRGRGLFCRSCMKSQMASPGFTDVFAALVAVVNTKFPEVGDLLLRRIVLQLKRAYKRNDKPQLLAAVKFIAHLVNQQAAHEIIALELLTVLLEKPTDDSVEVAVGFVTECGSILQDLSPKGLHGIFERFRGILHEGEIDKRVQFLIEGLFAIRKAKFQGYPAVRPELDLVEQEDQITHEVSLDEEIDPEISLDIFKPDPNFLENEKRYEELKKSMLGEESEDDEEGLDSESDDDDDEDDESDEEEEEQMQIKDETETNLVNLRRTIYLTIMSSVDFEEAGHKLLKIKLEPGQEMELCIMLLECCSQERTYLRYYGLLGQRFCMINKVHQENFEKCFVQQYSMIHRLETNKLRNVGKFFAHLLGTDALPWHVLSYIRLTEEDTTSSSRIFIKILFQELSEHLGIRLLNERLNDPTMQESFESIFPKDNPKNTRFCINFFTSIGLGGLTENLREYLKNMPRLIMQQQKQVSESESDDESGSSDSSDSGTASSDSDSASSDESDRRRRKRRRK

SEQ ID NO: 132213 - protein, 122 aa, Glycine max
  Coding DNA Sequence Number=SeqID_15435
  Gene Ontology: Mol. function=binding; Cellular component =intracellular; Biological process=metabolic process
  Homolog annotation: Hit_ID=Q8LI18; Match level="QueryCoverage=94%, HitCoverage=33%, E-value=2e-20, Identity=39%"; Hit description =Selenium-binding protein-like
  Pfam annotation: Domain name=PPR; Domain location=10-44; Score=43.0; E_value=1e-09; Accession=PF01535.11; Description=PPR repeat
  Pfam annotation: Domain name=PPR; Domain location=45-79; Score=6.1; E_ value=1.4; Accession=PF01535.11; Description=PPR repeat
  Pfam module annotation: Pfam domain module=PPR::PPR; Domain location =10-44::45-79
MGEGGGRDEVSWNAMIVACGQHREGMEAVGLFREMVRRGLKVDMFTMASVLTAFTCVKDLVGGRQFHGMMIKSGFHGNSHVGSGLIDLYSKCAGSMVECRKVFEEITAPDLVLWNTMISGFS

SEQ ID NO: 132214 - protein, 225 aa, Glycine max
  Coding DNA Sequence Number=SeqID_15436
  Gene Ontology: Mol. function=transmembrane receptor activity; Cellular component=membrane; Biological process=defense response
  Homolog annotation: Hit_ID=Q2HUN2; Match level="QueryCoverage=80%, HitCoverage=18%, E-value=2e-31, Identity=41%"; Hit description=TIR; Disease resistance protein
  Pfam annotation: Domain name=LRR_1; Domain location=136-161; Score =1.5; E_value=1.5e+02; Accession=PF00560.23; Description=Leucine Rich Repeat
  Pfam annotation: Domain name=LRR_1; Domain location=180-202; Score =10.0; E_value=3.8; Accession=PF00560.23; Description=Leucine Rich Repeat
  Pfam annotation: Domain name=LRR_1; Domain location=91-112; Score =10.6; E_value=3; Accession=PF00560.23; Description=Leucine Rich Repeat
  Pfam annotation: Domain name=LRR_3; Domain location=68-87; Score =25.5; E_value=0.00019; Accession=PF07725.3; Description=Leucine Rich Repeat
  Pfam module annotation: Pfam domain module=LRR_1::LRR_1::LRR_1::LRR _3; Domain location=136-161::180-202::91-112::68-87
MGPLKKRCPRLNSQNMLGAVPFWLHWVKPKKPCIGELILLKSLPDKLMYLEWDRFYLKSLPSNFCAEQIVELHMPDSKLKKPWDGVQNLANLKIISLCGCRNLIEIPDLSNTEKLESVFLHECVSLHQLHHVHAKSLQRLLAYGCSSLKEFSVISEEITELNLGHTAICALLSSIWQKRKLTILSLDNCNNLEFVGINIVHLSSLERLGLSKLTAFLWRQTLLNS

SEQ ID NO: 132215 - protein, 101 aa, Glycine max
  Coding DNA Sequence Number=SeqID_15437
  Homolog annotation: Hit_ID=Q01AI6; Match level="QueryCoverage=92%, HitCoverage=93%, E-value=8e-10, Identity=39%"; Hit description =Chromosome 04 contig 1, DNA sequence
MARDSCLTRVTAGAAMGGAVGGAVGAVYGTYEAIRYKALISQTVTVPVPAVHQLAANFLAMPNTVPGLLKIRHIGQTTLGSAAIFGLFLGAGSLIHCGKSY

SEQ ID NO: 132216 - protein, 354 aa, Glycine max
  Coding DNA Sequence Number=SeqID_15438
  Gene Ontology: Mol. function=catalytic activity; Cellular component =intracellular; Biological process=metabolic process
  Homolog annotation: Hit_ID=Q5G1T1; Match level="QueryCoverage=95%, HitCoverage=88%, E-value=8e-97, Identity=36%"; Hit description =Embryo-defective 2261
  Pfam annotation: Domain name=PPR; Domain location=117-151; Score =16.4; E_value=0.086; Accession=PF01535.11; Description=PPR repeat
  Pfam annotation: Domain name=PPR; Domain location=183-217; Score=8.1; E_value=0.82; Accession=PF01535.11; Description=PPR repeat
  Pfam annotation: Domain name=PPR; Domain location=46-80; Score=36.5; E_value=9.4e-08; Accession=PF01535.11; Description=PPR repeat
  Pfam annotation: Domain name=PPR; Domain location=81-115; Score=19.4; E_value=0.013; Accession=PF01535.11; Description=PPR repeat
  Pfam module annotation: Pfam domain module=PPR::PPR::PPR::PPR; Domain location=117-151::183-217::46-80::81-115
DALAIKSDVPYNRVSVNNALVAMYSKCGNVHDARRVFDTMPEHNTVSLNSMIAGYAQHGVEVESLRLFELMLEKDIAPNSITFIAVLSACVHTGKVEEGQKYFNMMKERFCIEPEAEHYSCMIDLLGRAGKLKEAERIIETMPFNPGSIEWATLLGACRKHGNVELAVKAANEFLRLEPYNAAPYVMLSNMYASAARWEEAATVKRLMRERGVKKKPGCSWIEIDKKVHVFVAEDTSHPMIKEIHVYMGKMLKKMKQAGYVPDIRWALVKDEEVEPDERERRLLYHSEKLAVAFGLISTEEGVPILVVKNLRICGDCHNAVKLISALTGREITVRDTHRFHCFKEGHCSCRDYW

SEQ ID NO: 132217 - protein, 38 aa, Glycine max
  Coding DNA Sequence Number=SeqID_15439
MGDQEGPWPRAVTSIALRRGAVLRRYPKPATMERELCY

SEQ ID NO: 132218 - protein, 88 aa, Glycine max
  Coding DNA Sequence Number=SeqID_15440
MRENNNEVVITAGEEENHVSGGHLRHSRDGIWWSVAKSLPRSTAVLIFPVMLIIGALTYTRTLDTHMLLNCLFRTLMLSEAETRWGIP

SEQ ID NO: 132219 - protein, 75 aa, Glycine max
  Coding DNA Sequence Number=SeqID_15441
VFSYLPPVFLMLWLSERVWGELEKVLAPSPYSPLPHCHSMWVKTFRVQEAYAVNLTGKPSLEPLDFFLPLVDINK

SEQ ID NO: 132220 - protein, 87 aa, Glycine max
  Coding DNA Sequence Number=SeqID_15442
MVDDEIQLERSSASKMKTRTGMCPEGTNEATGLVQRVIEIQAMRLLGMGRALQGAPNSGFVERKDGGRRWSETVAMPETVKTGSYPL

SEQ ID NO: 132221 - protein, 124 aa, Glycine max
  Coding DNA Sequence Number=SeqID_15443
MVNSSHFLFIQEHVIEFWQEVMDALGPNIKIAVVEGGIRVEDVRVEEVKVKDVKESKPMATVFCHFGSWVTSMHVVVVNGWVVALVVFRVVVLLGGWVEVGLGGHVGLGERLLGFAGERKGKKE

SEQ ID NO: 132222 - protein, 119 aa, Glycine max
  Coding DNA Sequence Number=SeqID_15444
  Subcellular localization annotation: CTP_CleavageSite=26; ConfidenceScore=5.17e-01
MNSLKYYQYAVFSFVVVGRARPPFSRRSEAQNHRNPYEFRVSIPNLKILRFSSWHRMAFSFVLLLHAHSHRDSYSAYIVKDVQVHSWRWLRARRKGFTYSLTSWISNPRNVLEKVQYIF

SEQ ID NO: 132223 - protein, 1073 aa, Glycine max
  Coding DNA Sequence Number=SeqID_15445
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=95%, HitCoverage=91%, E-value=0.0, Identity=49%"; Hit description =Receptor protein kinase-like protein
  Pfam annotation: Domain name=LRRNT_2; Domain location=9-51; Score =44.2; E_value=4.4e-10; Accession=PF08263.3; Description=Leucine rich repeat N-terminal domain
  Pfam annotation: Domain name=LRR_1; Domain location=103-125; Score =16.7; E_value=0.086; Accession=PF00560.23; Description=Leucine Rich Repeat
  Pfam annotation: Domain name=LRR_1; Domain location=127-149; Score =11.4; E_value=2.1; Accession=PF00560.23; Description=Leucine Rich Repeat
  Pfam annotation: Domain name=LRR_1; Domain location=151-173; Score =8.0; E_value=8.9; Accession=PF00560.23; Description=Leucine Rich Repeat
  Pfam annotation: Domain name=LRR_1; Domain location=175-198; Score =5.7; E_value=25; Accession=PF00560.23; Description=Leucine Rich Repeat
  Pfam annotation: Domain name=LRR_1; Domain location=200-222; Score =2.2; E_value=1.1e+02; Accession=PF00560.23; Description=Leucine Rich Repeat
  Pfam annotation: Domain name=LRR_1; Domain location=224-246; Score =7.2; E_value=13; Accession=PF00560.23; Description=Leucine Rich Repeat
  Pfam annotation: Domain name=LRR_1; Domain location=248-270; Score =10.2; E_value=3.5; Accession=PF00560.23; Description=Leucine Rich Repeat
  Pfam annotation: Domain name=LRR_1; Domain location=272-294; Score =11.3; E_value=2.2; Accession=PF00560.23; Description=Leucine Rich Repeat
  Pfam annotation: Domain name=LRR_1; Domain location=296-318; Score =9.8; E_value=4.3; Accession=PF00560.23; Description=Leucine Rich Repeat
  Pfam annotation: Domain name=LRR_1; Domain location=320-342; Score =8.2; E_value=8.5; Accession=PF00560.23; Description=Leucine Rich Repeat
  Pfam annotation: Domain name=LRR_1; Domain location=344-366; Score =12.8; E_value=1.1; Accession=PF00560.23; Description=Leucine Rich Repeat
  Pfam annotation: Domain name=LRR_1; Domain location=368-390; Score =6.0; E_value=22; Accession=PF00560.23; Description=Leucine Rich Repeat
  Pfam annotation: Domain name=LRR_1; Domain location=392-414; Score =20.6; E_value=0.0056; Accession=PF00560.23; Description=Leucine Rich Repeat
  Pfam annotation: Domain name=LRR_1; Domain location=416-438; Score =9.6; E_value=4.6; Accession=PF00560.23; Description=Leucine Rich Repeat
  Pfam annotation: Domain name=LRR_1; Domain location=440-462; Score =12.9; E_value=1.1; Accession=PF00560.23; Description=Leucine Rich Repeat
  Pfam annotation: Domain name=LRR_1; Domain location=464-486; Score =16.8; E_value=0.078; Accession=PF00560.23; Description=Leucine Rich Repeat
  Pfam annotation: Domain name=LRR_1; Domain location=488-510; Score =15.7; E_value=0.17; Accession=PF00560.23; Description=Leucine Rich Repeat
  Pfam annotation: Domain name=LRR_1; Domain location=512-534; Score =16.5; E_value=0.099; Accession=PF00560.23; Description=Leucine Rich Repeat
  Pfam annotation: Domain name=LRR_1; Domain location=536-558; Score =11.5; E_value=2; Accession=PF00560.23; Description=Leucine Rich Repeat
  Pfam annotation: Domain name=LRR_1; Domain location=560-582; Score =17.6; E_value=0.045; Accession=PF00560.23; Description=Leucine Rich Repeat
  Pfam annotation: Domain name=LRR_1; Domain location=587-607; Score =0.4; E_value=2.4e+02; Accession=PF00560.23; Description=Leucine Rich Repeat
  Pfam annotation: Domain name=LRR_1; Domain location=609-630; Score =14.4; E_value=0.43; Accession=PF00560.23; Description=Leucine Rich Repeat
  Pfam annotation: Domain name=LRR_1; Domain location=632-653; Score =12.2; E_value=1.5; Accession=PF00560.23; Description=Leucine Rich Repeat
  Pfam annotation: Domain name=LRR_1; Domain location=79-101; Score =12.2; E_value=1.5; Accession=PF00560.23; Description=Leucine Rich Repeat
  Pfam annotation: Domain name=Pkinase; Domain location=748-1023; Score= 120.2; E_value=6e-33; Accession=PF00069.15; Description=Protein kinase domain
  Pfam annotation: Domain name=Pkinase_Tyr; Domain location=748-1023; Score=68.9; E_value=1.6e-17; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=9-51::103-125::127-149::151-173::175-198::200 -222::224-246::248-270::272-294::296-318::320-342::344-366::368 -390::392-414::416-438::...
  Pfam module annotation: Domain location=440-462::464-486::488 -510::512-534::536-558::560-582::587-607::609-630::632-653::79 -101::748-1023::748-1023
MCPSISVALNQEGLSLLSWLSSFNSSNSATAFSSWDPTNKDPCTWDYITCSKEGYVSEIIITSIDLRSGFPSRLNSFYHLTTLIISNGNLTGQIPSSVGNLSSLVTLDLSFNALSGSIPEEIGKLSNLQLLLLNSNSLQGGIPTTIGNCSRLRHVALFDNQISGMIPGEIGQLRALETLRAGGNPGIHGEIPMQISDCKALVFLGLAVTGVSGEIPPSIGELKNLKTISVYTAHLTGHIPAEIQNCSALEDLFLYENQLSGSIPYELGSMQSLRRVLLWKNNLTGTIPESLGNCTNLKVIDFSLNSLRGQIPVTLSSLLLLEEFLLSDNNIYGEIPSYIGNFSRLKQIELDNNKFSGEIPPVIGQLKELTLFYAWQNQLNGSIPTELSNCEKLEALDLSHNFLTGSIPSSLFHLGNLTQLLLISNRLSGQIPADIGSCTSLIRLRLGSNNFTGQIPSEIGLLSSLTFLELSNNLFSGDIPFEIGNCAHLELLDLHSNVLQGTIPSSLKFLVDLNVLDLSANRITGSIPENLGKLTSLNKLILSGNLISGVIPGTLGPCKALQLLDISNNRITGSIPDEIGYLQGLDILLNLSWNSLTGPIPETFSNLSKLSILDLSHNKLTGTLTVLVSLDNLVSLNVSYNGFSGSLPDTKFFRDIPAAAFAGNPDLCISKCHASENGQGFKSIRNVIIYTFLGVVLISVFVTFGVILTLRIQGGNFGRNFDGSGEMEWAFTPFQKLNFSINDILTKLSESNIVGKGCSGIVYRVETPMKQTIAVKKLWPIKKEEPPERDLFTAEVQTLGSIRHKNIVRLLGCCDNGRTRLLLFDYICNGSLFGLLHENRLFLDWDARYKIILGVAHGLEYLHHDCIPPIVHRDIKANNILVGPQFEAFLADFGLAKLVSSSECSGASHTIAGSYGYIAPEYGYSLRITEKSDVYSYGVVLLEVLTGMEPTDNRIPEGAHIATWVSDEIREKRREFTSILDQQLVLQSGTKTSEMLQVLGVALLCVNPSPEERPTMKDVTAMLKEIRHENDDFEKPNFLHKSVVTTNPKAAVHCSSFSRSCEPLIIESTSSSV

SEQ ID NO: 132224 - protein, 203 aa, Glycine max
  Coding DNA Sequence Number=SeqID_15446
  Gene Ontology: Mol. function=electron carrier activity; Biological process=electron transport
  Homolog annotation: Hit_ID=Q5KZG6; Match level="QueryCoverage=63%, HitCoverage=55%, E-value=6e-19, Identity=37%"; Hit description =Hypothetical conserved protein
  Subcellular localization annotation: CTP_CleavageSite=53; ConfidenceScore=5.47e-01
MALRLRLKVSSIGSPFLQLGSSASAACSVSKLGFHPPRLQLNKNSHPIRLFVRAARIESKGVTLGFRTPQFQLPEPLTGTTWTLDDFEAYPALLVMFICNHCPFVKHLKKDIVKLTKFYMEVVKSITLEEIFFLLQEQVGLAQKGLAVIAISSNSVATHPQDGPEFMAEDAKLFGYPFPYLYDESFPNSIIVNSLTSAPKCLK

SEQ ID NO: 132225 - protein, 39 aa, Glycine max
  Coding DNA Sequence Number=SeqID_15447
MRIEEDPRVQETSPKVQEIIAHNPLEEHCMGPAAQQLPT

SEQ ID NO: 132226 - protein, 47 aa, Glycine max
  Coding DNA Sequence Number=SeqID_15448
MSGLNEAITCLVDFALSAPLGFFVDFLHVKTWPLSTEEKVNPKGVFV

SEQ ID NO: 132227 - protein, 45 aa, Glycine max
  Coding DNA Sequence Number=SeqID_15449
MQLDENSKVVKVEFFYDPAELLGGLLKGPEDGTPARASSTSSRKP

SEQ ID NO: 132228 - protein, 110 aa, Glycine max
  Coding DNA Sequence Number=SeqID_15450
  Subcellular localization annotation: CTP_CleavageSite=63; ConfidenceScore=5.06e-01
MKELGVVAVMLTAQLLDVIVNTLSQAAMKKGMNNFVFVMKRTLPPLSYNNLGLLFVVGLFSVIGAAIVVIGFYAVIWGKTQEKVEEDCTVYNSESYNDEVPLLQNKKMGE

SEQ ID NO: 132229 - protein, 284 aa, Glycine max
  Coding DNA Sequence Number=SeqID_15451
  Gene Ontology: Mol. function=molecular_function; Cellular component =membrane; Biological process=auxin mediated signaling pathway
  Homolog annotation: Hit_ID=Q8L9I2; Match level="QueryCoverage=91%, HitCoverage=74%, E-value=1e-53, Identity=41%"; Hit description =Nodulin MtN21-like protein
  Pfam annotation: Domain name=DUF6; Domain location=121-250; Score =22.7; E_value=0.0014; Accession=PF00892.11; Description=Integral membrane protein DUF6
MGKLTLPFVGMIMAEFAQAFGYAGIYYGSATLSTSILNLVPGFTFILAVLFRMEKLDWRKLSSLAKLLGTIVSIAGAFIVTLYKGPALLMGVSSANTSQQPLLSEDSNWILAGLFLAADCVMASAYIIVQASILKKYPAELIVVFFYCFFVAIQSAVTCLVVERDISAWSLEPKLRLLAVLYSGVFGSAFQVGIICWCLHQTGPVFVSMFKPLGILISVVLGVLFLGDAFYLGSLIGATVIVVGFYSVLWGKAKDIEDAGLSLESKGKQAPLLEENSHEDIQGH

SEQ ID NO: 132230 - protein, 125 aa, Glycine max
  Coding DNA Sequence Number=SeqID_15452
MGGALKKLHLQYIGRWGELIKYGVHSGIFLKKPLGGNHIHFVKKWHPGHPGLPGVNLVIKGALRNLPQEASGRQAPPVCYAFQGSLTPMLCISSRGASVTLPRRFREQIHEDFPSFFVRSSVFNR

SEQ ID NO: 132231 - protein, 403 aa, Glycine max
  Coding DNA Sequence Number=SeqID_15453
  Gene Ontology: Mol. function=protein binding; Biological process =defense response
  Homolog annotation: Hit_ID=Q6R271; Match level="QueryCoverage=98%, HitCoverage=58%, E-value=2e-61, Identity=44%"; Hit description =Disease resistance protein
  Pfam annotation: Domain name=LRR_1; Domain location=166-188; Score =3.0; E_value=78; Accession=PF00560.23; Description=Leucine Rich Repeat
  Pfam annotation: Domain name=LRR_1; Domain location=218-241; Score =6.1; E_value=21; Accession=PF00560.23; Description=Leucine Rich Repeat
  Pfam annotation: Domain name=LRR_1; Domain location=291-313; Score =4.3; E_value=45; Accession=PF00560.23; Description=Leucine Rich Repeat
  Pfam annotation: Domain name=LRR_1; Domain location=314-337; Score =1.2; E_value=1.7e+02; Accession=PF00560.23; Description=Leucine Rich Repeat
  Pfam annotation: Domain name=LRR_1; Domain location=339-362; Score =15.5; E_value=0.19; Accession=PF00560.23; Description=Leucine Rich Repeat
  Pfam module annotation: Pfam domain module=LRR_1::LRR_1::LRR_1::LRR _1::LRR_1; Domain location=166-188::218-241::291-313::314-337::339-362
MAENLLQFPQQNKSLKEVGEQYYDDLLSKSFFQQSSEDEALFFMHDLLNDLAKYVCGDIYFREFGIQQLGELNLRESLSIGELQNIENPSYALAADLKNKIHLVGLRLGWNWNQNQIPDDPKKEREVLENLTFEVLEKFVNQQLWWYRISKCKYCLCLPPLGHLPFLKTLNIQRLDGIVSIDSSFHGSGSSSFTSLETLEFYCLKEWECRAVTGAFPRLQRLCIVECPKLKGSLPEQLLCLKILLFLTANSLWLLEICELELQDCGKIAYTLKIVQSSSLSLKKELWEPTPLKSLYIQNLDVESFPDEGLLPLSLKRIQIDKCRNLLNFYNKGLCQLSSLEELSLGNNPNLQCLPEEGLPKSISTLDILDCTLLKQRCLGPKGEDWGNIIHIKNVWVDHKLVR

SEQ ID NO: 132232 - protein, 46 aa, Glycine max
  Coding DNA Sequence Number=SeqID_15454
MGDANLSLAHLGRLTPYPKFNLDKKMLVLRYQARLLEYFGISLSHV

SEQ ID NO: 132233 - protein, 95 aa, Glycine max
  Coding DNA Sequence Number=SeqID_15455
MEARKKKKGFRSREEERFRGFGNKEAEGMSSQVSKHVTEQESGQDLFESKREKSLLKGIPRFKEVFAKYKARTGKRASNHWAIRVGVWSSRSQGS

SEQ ID NO: 132234 - protein, 175 aa, Glycine max
  Coding DNA Sequence Number=SeqID_15456
  Gene Ontology: Mol. function=lipid binding; Cellular component =anchored to membrane; Biological process=lipid transport
  Homolog annotation: Hit_ID=Q6Z387; Match level="QueryCoverage=92%, HitCoverage=93%, E-value=2e-20, Identity=35%"; Hit description=Lipid transfer protein-like
  Pfam annotation: Domain name=Tryp_alpha_amyl; Domain location=34-105; Score=5.9; E_value=0.022; Accession=PF00234.12; Description=Protease inhibitorseed storageLTP f
MDSNACLPHLLVLAITLVLVSHAMGDSAQDKQRCAESLTGVTTCLPYLGGDTKAPTADCCSGLTQAMKTNKKCVCVILKDRDDPDLGLKINMTIAAALLHLDPKSPEAQAFNQIDQKSNGGSIRPSPTPSVEGSSQNGRKQGTDETATAKNSASYIRKRLLESLVAVAGLLIWLS

SEQ ID NO: 132235 - protein, 213 aa, Glycine max
  Coding DNA Sequence Number=SeqID_15457
  Gene Ontology: Mol. function=protein binding; Cellular component =integral to membrane; Biological process=xylan catabolic process
  Homolog annotation: Hit_ID=Q1SWI7; Match level="QueryCoverage=83%, HitCoverage=94%, E-value=2e-66, Identity=49%"; Hit description =Leucine-rich repeat
  Pfam annotation: Domain name=LRR_1; Domain location=120-141; Score =8.6; E_value=7.1; Accession=PF00560.23; Description=Leucine Rich Repeat
  Pfam annotation: Domain name=LRR_1; Domain location=48-70; Score=7.6; E_value=11; Accession=PF00560.23; Description=Leucine Rich Repeat
  Pfam annotation: Domain name=LRR_1; Domain location=72-94; Score =13.6; E_value=0.72; Accession=PF00560.23; Description=Leucine Rich Repeat
  Pfam annotation: Domain name=LRR_1; Domain location=96-118; Score =14.8; E_value=0.32; Accession=PF00560.23; Description=Leucine Rich Repeat
  Pfam module annotation: Pfam domain module=LRR_1::LRR_1::LRR_1::LRR _1; Domain location=120-141::48-70::72-94::96-118
MTLMNQSSDPCIYSVAQNSTHYSSGYSIVIVLLWLKGREDEYRNILGLVTSIDLSSNKLLGEIPREITSLNGLNFLNLSHNQVIGHIPQGIGNMGSLQSIDFSRNQLSGEIPPTISNSSFLSMLDLSYNHLKGKIPTGTQLQTFDASSFIGNNLCGPPLPINCSSNGKTHSYEGSDEHGVNWLFVSAAIGFIVGFWIVIAPLLICRSWRLINL

SEQ ID NO: 132236 - protein, 216 aa, Glycine max
  Coding DNA Sequence Number=SeqID_15458
  Homolog annotation: Hit_ID=Q10L85; Match level="QueryCoverage=77%, HitCoverage=71%, E-value=5e-25, Identity=36%"; Hit description =Expressed protein
  Subcellular localization annotation: CTP_CleavageSite=8; ConfidenceScore=5.05e-01
MGNAAVTPCFHPKNSLLSSSSSSKLIFWDGTMRSLKGKHIASEIMLEFPNKVVCHANSFFIGHPIPALALEDELIQGEAYFVLPIDSFTCKTLSVSSLLSLGSHPNNKSTIKFGECAFEYLKGSNGRMLIKVTPEFITSLVNRSKRPCCPSSNVDNNFLCSTPELRKHYQMLVKSKDQVWSPKLETISEYKVKFSPGRFIGLERKEKEKAEVVSTR

SEQ ID NO: 132237 - protein, 322 aa, Glycine max
  Coding DNA Sequence Number=SeqID_15459
  Homolog annotation: Hit_ID=Q94HU2; Match level="QueryCoverage=15%, HitCoverage=7%, E-value=5e-07, Identity=50%"; Hit description =Putative transposable element
  Pfam annotation: Domain name=Transposase_23; Domain location=260-319; Score=-17.2; E_value=0.086; Accession=PF03017.5; Description =TNP1ENSPM transposase
MKILKGYIKDLHRTEASIVERCVAKETIEFCLEYIEKAKPIRIPESRHDKRKGDPCEERWLVVLHEKTIGVNVEDDDSTVDTYVSPSSTQMPPNINGEEEVDDHIATPPISPLLPPESLTPSPSTSKKTRKVTRLRSLATRPVGAERSVVYVNPATGKIDGLPERVGLTRKLCRPWTSRCTNCYHWVTRAPWSYPCYWNRCHDQTILWTSLKKLPHVYIHDSRSPRATDTKNQGLAGGGLALSPELEVGFSGTLARTKGSCVNPSRQDPDTVYEGLTTTHNVPLGNDQVKIGVEKARDADSRVLVPTQEVQLMRQTLNTFLA

SEQ ID NO: 132238 - protein, 728 aa, Glycine max
  Coding DNA Sequence Number=SeqID_15460
  Gene Ontology: Mol. function=RNA-directed DNA polymerase activity; Cellular component=chromatin; Biological process=chromatin assembly or disassembly
  Pfam annotation: Domain name=Chromo; Domain location=649-702; Score =18.1; E_value=0.0072; Accession=PF00385.14; Description='chromo' (CHRromatin Organisation MOdifier
  Pfam annotation: Domain name=RnaseH; Domain location=96-214; Score= -34.9; E_value=0.1; Accession=PF00075.14; Description=RNase H
  Pfam annotation: Domain name=rve; Domain location=347-503; Score =107.3; E_value=4.6e-29; Accession=PF00665.16; Description=Integrase core domain
  Pfam module annotation: Pfam domain module=Chromo::RnaseH::rve; Domain location=649-702::96-214::347-503
  Subcellular localization annotation: CTP_CleavageSite=70; ConfidenceScore=5.07e-01
MGHIISSDGIAPDPDKIQAMVNWPTPTSTTSLRGFLGLTGFYRKFIRGYASIAAPLTNLLRKDQFVWSPAATSAFNQLKSYMTCAPILTTPDFTIPFIIETDASAFAIGAVLVQQDHPIAYYSKVLCPRLQRASAYVRELHAITSAVRKWRHYLLGSSFTILTDHRSLKELMSQTIQTPEQQTYLVKLLGYDYTIRYKPGAHNVVADALSRVPTGEFLSLTVPHCDFLNTLRQALMADTQYQELLHEIQTTPAAHHGLSIRNGLILKDHRIWIPFPTALTSTLLEEFHTSPLGGHTGVAKTLHRLRQSFDWPTIKKDVQRFVSHCTVYQQTKYETKKPSGLLQPLPIPARIWEDMSIDFITGLPPSQGHTVIMVVVDRYSKGAHFGALPTHHTAHQVAVHFLTLVCKLHGFPRSLVSDRDALFLSQFWKELFRLSGTQLRMMTAYHPQSDGQTEVVNRTLEQYLRAYVHHKPSHWFRYLHLAEWSYNTTVHSSTGFTPFEIIYGRPPPSTVDYIRGSSPIDAVDSLLTDRTELHALLQRRLQKTQSSMKATADKHRRDTQFSIGDWVYLRLRPYRQKSLAQSYTKLAKRFYGLYQVTDRIGPVAYKLALPATSRIHNVFHVSLLKLHQGPSPTTDAPLPPLAVDHHPLVSPLTILDWKWDTSVTPPLRLVLVQWAGLPPEDTSWESWSELQSTYNLEDEVVFGGVGVDSIMQNKATDTNNSSTNKPKR

SEQ ID NO: 132239 - protein, 99 aa, Glycine max
  Coding DNA Sequence Number=SeqID_15461
  Gene Ontology: Mol. function=RNA-directed DNA polymerase activity; Cellular component=chromatin; Biological process=RNA-dependent DNA replication
MGGEGRKNRVQMRDMGMKVTAIDEDIVKKYCNKFSEKRPESVVHGGLEGGGRIAEAEGHYAELVMTLVPCESDGNPTGGRASRTRRPFQDRRGVRPPSA

SEQ ID NO: 132240 - protein, 214 aa, Glycine max
  Coding DNA Sequence Number=SeqID_15462
  Homolog annotation: Hit_ID=Q10L85; Match level="QueryCoverage=78%, HitCoverage=71%, E-value=1e-25, Identity=37%"; Hit description =Expressed protein
MGNAAVTPCFHPKNSSLSSSSKLIFWDGTMRSLKGKHIASEIMFEFPNKVVCHADSFFIGHPIPALALEDELIQGEAYFVLPIDSLITCKTLSVSSLLSLGSHTNNKSTIKFGECTFEYLKGSNGRVLIKVMPEFITRLINRSKRPCCPSINIDNNFLCSTPELRKHYQMLVKPKDQVWSPKLETISEYKVKFSPCRFIGLERKEKEKAEVFIY

SEQ ID NO: 132241 - protein, 137 aa, Glycine max
  Coding DNA Sequence Number=SeqID_15463
  Gene Ontology: Mol. function=structural constituent of ribosome; Cellular component=ribonucleoprotein complex; Biological process =translation
  Homolog annotation: Hit_ID=Q42351; Match level="QueryCoverage=81%, HitCoverage=79%, E-value=1e-42, Identity=79%"; Hit description=60S ribosomal protein L34-1
  Pfam annotation: Domain name=Ribosomal_L34e; Domain location=5-120; Score=201.8; E_value=1.6e-57; Accession=PF01199.8; Description =Ribosomal protein L34e
MVQRLTYRKRHSYATKSNQHRVVKTPGGKLVYQTTKKRASGPKCPVTGKRIQGLKVKCTHKTQGLFSSLKIPHLRPTEYKRSRLPKNRRTVNRAYGGVLSGSAVRERIIRAFLVEEQKIVKKVLKIQKTKEKQALKG

SEQ ID NO: 132242 - protein, 60 aa, Glycine max
  Coding DNA Sequence Number=SeqID_15464
MKNKKVAEVGVSLSEPYALSEQHLLSEACMLESLCNRETRKGKIGQGSIKNLNFQEDFRF

SEQ ID NO: 132243 - protein, 108 aa, Glycine max
  Coding DNA Sequence Number=SeqID_15465
MKPEGLAFHVKGGGSADKVMEGFGLEVVAETVEEGDEFDDSGGVPSEPWDLADSCVKLGGEGREVGIRGGRGEEVGENAEKTLRNRSSIPCVDTGTNPFKVQLTKFTF

SEQ ID NO: 132244 - protein, 138 aa, Glycine max
  Coding DNA Sequence Number=SeqID_15466
  Gene Ontology: Mol. function=transmembrane receptor activity; Cellular component=membrane; Biological process=defense response
  Homolog annotation: Hit_ID=Q1S494; Match level="QueryCoverage=51%, HitCoverage=6%, E-value=2e-22, Identity=69%"; Hit description=TIR
MIDSLVKEHRFFPSGGLMFEYFSAECHKSNRCSHLKFKETSWILHNKSHIHQTKHLHNLHNNSFNQVSEAMILEVVSLEAFTSLFVTRESTPSWMMRGSEEGKRLDMLFSRQFSSQELPLLFSLKTMLPQLTVLKSLS

SEQ ID NO: 132245 - protein, 1072 aa, Glycine max
  Coding DNA Sequence Number=SeqID_15467
  Gene Ontology: Mol. function=nucleoside-triphosphatase activity; Cellular component=membrane; Biological process=defense response
  Homolog annotation: Hit_ID=Q1SVC8; Match level="QueryCoverage=81%, HitCoverage=79%, E-value=0.0, Identity=44%"; Hit description=TIR; Disease resistance protein; AAA ATPase
  Pfam annotation: Domain name=LRR_1; Domain location=402-427; Score =8.0; E_value=9.2; Accession=PF00560.23; Description=Leucine Rich Repeat
  Pfam annotation: Domain name=LRR_1; Domain location=445-470; Score =1.9; E_value=1.3e+02; Accession=PF00560.23; Description=Leucine Rich Repeat
  Pfam annotation: Domain name=LRR_1; Domain location=492-514; Score =9.4; E_value=4.9; Accession=PF00560.23; Description=Leucine Rich Repeat
  Pfam annotation: Domain name=LRR_1; Domain location=516-538; Score =0.9; E_value=1.9e+02; Accession=PF00560.23; Description=Leucine Rich Repeat
  Pfam annotation: Domain name=LRR_1; Domain location=539-561; Score =7.0; E_value=14; Accession=PF00560.23; Description=Leucine Rich Repeat
  Pfam annotation: Domain name=LRR_1; Domain location=563-584; Score =11.0; E_value=2.5; Accession=PF00560.23; Description=Leucine Rich Repeat
  Pfam annotation: Domain name=LRR_1; Domain location=586-608; Score =5.9; E_value=22; Accession=PF00560.23; Description=Leucine Rich Repeat
  Pfam annotation: Domain name=LRR_1; Domain location=641-665; Score =5.3; E_value=29; Accession=PF00560.23; Description=Leucine Rich Repeat
  Pfam annotation: Domain name=LRR_1; Domain location=682-707; Score =5.3; E_value=29; Accession=PF00560.23; Description=Leucine Rich Repeat
  Pfam annotation: Domain name=NACHT; Domain location=57-209; Score= -14.1; E_value=0.00072; Accession=PF05729.3; Description=NACHT domain
  Pfam annotation: Domain name=NB-ARC; Domain location=18-313; Score =101.8; E_value=2e-27; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::NACHT::NB-ARC; Domain location= 402-427::445-470::492-514::516-538::539-561::563-584::586-608::641 -665::682-707::57-209::18-313
MADIFQYEHEVIQKIVEEVSRKINRSPLHVANYPIGLESRVQEVNSLLDVGSNQGVSMVGIYGIGGIGKTAIACAVYNLIADQFEGQCFLGDIREKSKHGLVELQETILSEMVGEKSIKLGSTNRGKAVLKSKLQRKKVLLILDDVDRLEQLKALAGDPSWFGHGSRIIVTTTDKHLLRVHGVERRYEAKGLDDKEALELFSWHAFKSNEVSPSYMDISKRAVLYSNGLPLALEIIGSNLNGKTMPEWQAALDTIERNPDEDIQEKLKVGYDGLKRNEKEVFLDIACFFRGSDLKDVTSLLFQGRGFSPEYVIRVLIDKSLIKIDKYGFVRMHNLVENMGREIVKQESPSEPGKRSRLWLYEDIVDVLENDKGTDTIEVIMLHSPKNKEVQWNGSELKKMTNLKLLSIENAHFSRGPVHLPNSLRVLKWWGYPSPSLPPEFDSRRLVMLDLSNSCNIMGKQLKFMKFESLSEMVLRGCRFIKQTPDMSGAQNLKKLCLDNCKNLVEVHDSIGLLDKITWFTAVGCTNLRILPRSFKLTSLEHLSFKKCSNLQCLPNILEEMKHVKKLDLCGTAIEELPFSFRKLTGLKYLVLDKCKMLNQIPISILMLPKLEKLTAIKCGRYANLILGKSEGQVRLSSSESLRDVRLNYNDLAPASFPNVEFLVLTGSAFKVLPQCISQCRFLKNLVLDNCKELQEIRGVPPKIKYLSAINCTSLSHESQSMLLNQRLHEGGGTDFSLPGTRIPEWFDHCTTGPLLSFWFRNKFPRMALAVVGVLDKQGSFPMSRFHLLINGIQKLHCLFTAQSKLTTYHIFLSDVQLKSYNGELQSVYGEDGWNHVEISYVRPSAFPHSCRAKRGTIKLMGVHVYKQKTSMEGVRFTNPWSPKRSYSEVSKPSLKENFQSLAKRSRGSQGMEICEAPRMKQHEVNSGYHSVSQRLWLEICSIVAPADVKVLMWSICQNALPTFEYLFRRKLVNSPLCPICGTEPETVEHAFLFCPWTRPLWFGSDFQWCIDAKTVQSFQLWLWQKLVEIQRVYQENANQVSAQVGSICWAIWKGRNEFILEGKPVNPLILR

SEQ ID NO: 132246 - protein, 723 aa, Glycine max
  Coding DNA Sequence Number=SeqID_15468
  Gene Ontology: Mol. function=small conjugating protein ligase activity; Biological process=protein modification process
  Homolog annotation: Hit_ID=Q1RVR2; Match level="QueryCoverage=53%, HitCoverage=54%, E-value=1e-129, Identity=57%"; Hit description =Ubiquitin-conjugating enzyme, E2
  Pfam annotation: Domain name=UQ_con; Domain location=440-579; Score =67.4; E_value=4.6e-17; Accession=PF00179.16; Description=Ubiquitin -conjugating enzyme
MEVCEDVMGKSRWTYGHSSSSESSNDEENDDNCFDFFSKDYMTSQPSFSLEPTIKDPSGVQYSQTPLSKKKSNGSQQRRRKLKLPWEMGSSKSFESEKKPNICYSSNHEFVNNFEAKKLPLAGGTPHWGLPPADGAPDKGLLFVGGAPEWEFSHVGGIPYWGLLPAGGASGTPLETPQWGLSPAGGGTPKWRLSHVGGTPHWGLQPAGSRAPKWGLSHIGGRSHWGLPPAGGIGGTPLETPQWGLPPAGGGTSEWGLSHVGGTPHWGLQPVRSGAPEWGLPHIGGTSHWGLPPAGGGTPKWELSHVGGTQHWGLLHASGVDGTPPAGGAPEWGLSHISGTPHWGLSPASGVGGTPLAAPFAHHFHVPPGPLIHNSWVYNSVGDGNNEATANNTIATISDEARGEILRKFRSFKQFDVIEDVSDHHFVHANSSMEQHWAKRIQGEWKSLEKDLPDSIFVRVYESRIDLLRAVIIGAEGTPYHDGLFFFDVFFPSGYSHVPPQVHYHSGGLRLNPNLYSSGKVCLSLLNTWTGHQNEQWIPGVSTILQPFFNEPGYAHLSNSQYGEISSLKYNEDTFILSLRTMIYIMRRPPKNFKDFVAGNFCSRAHDILVACKAYIDGAQVGCVVKGGAQDVDQGGSSSSVQFRTSLAAFVNMLVNEFTQVGAKDCDKVFPLTAVGNSSNEMLKTVGNPSGVKLTAVGNMSGEMVAAVGNASDEMLVAAAAIP

SEQ ID NO: 132247 - protein, 233 aa, Glycine max
  Coding DNA Sequence Number=SeqID_15469
  Gene Ontology: Mol. function=carboxypeptidase activity; Cellular component=membrane; Biological process=auxin mediated signaling pathway
  Homolog annotation: Hit_ID=Q9FL08; Match level="QueryCoverage=89%, HitCoverage=57%, E-value=7e-30, Identity=32%"; Hit description =Nodulin-like protein
  Pfam annotation: Domain name=DUF6; Domain location=70-199; Score=3.7; E_value=0.041; Accession=PF00892.11; Description=Integral membrane protein DUF6
MNLRSPGMQVQLIGILVSIMGAVVAEFFKGPLVRPSSHDHLKHANKQYLVFSSTPEFWVLGGALLAASFFSLSIFNLFQKETVERYPEPMKVLSYSNLLGTILSAIVSWIVEREINVWKIKRNKDLILIVLTALVGGVIRPNIHVWFTRIKGPLYVPLFKPFGIAFATTFALCFFSNSLHYGSVIGTTTLGMGYYTVMYGQIKGNEEETSCDDCSSDSLDKKIPLLQEKMEEV

SEQ ID NO: 132248 - protein, 360 aa, Glycine max
  Coding DNA Sequence Number=SeqID_15470
  Gene Ontology: Mol. function=carboxypeptidase activity; Cellular component=membrane; Biological process=electron transport
  Homolog annotation: Hit_ID=Q8L9I2; Match level="QueryCoverage=89%, HitCoverage=86%, E-value=6e-47, Identity=34%"; Hit description =Nodulin MtN21-like protein
  Pfam annotation: Domain name=DUF6; Domain location=199-328; Score =6.5; E_value=0.028; Accession=PF00892.11; Description=Integral membrane protein DUF6
  Pfam annotation: Domain name=DUF6; Domain location=22-157; Score =30.1; E_value=8e-06; Accession=PF00892.11; Description=Integral membrane protein DUF6
  Pfam annotation: Domain name=UAA; Domain location=48-334; Score= -161.9; E_value=0.025; Accession=PF08449.2; Description=UAA transporter family
  Pfam module annotation: Pfam domain module=DUF6::DUF6::UAA; Domain location=199-328::22-157::48-334
MEARTKMSEVLPFIVMVIMEGWTIGLTIFAKTAITNGMSPFVFIVYTNALATIILFPCFFLPHQEDRKERPSFTFSLFMRFLFLGFIGMTMTQAFLFLGLSYSSPILVCAMSHLIPTFNFLLSLILRKTELNLRSPGIQVQVIGILVSIMGAVLAEFFKGPLVRPSSHHLRHTDKQYLVFSSTPEFWVLGGALLAAASFSVSISNFIQKETLKQYPEPMKLLSYSSLLGTILSAIVSGIVERDINAWKIKRNKDVILIVLTALVGGVIRPNIQVWFTRMKGPLYVPLFKPFGIAFATTFAVCFFSNSLHYGSVIGTTVLGMGHYTVMYGQLRENEEETSCDESSDSLDKMVPLLQEKMEV

SEQ ID NO: 132249 - protein, 394 aa, Glycine max
  Coding DNA Sequence Number=SeqID_15471
  Gene Ontology: Mol. function=kinase activity; Cellular component =integral to membrane
  Homolog annotation: Hit_ID=Q5Z7P9; Match level="QueryCoverage=98%, HitCoverage=80%, E-value=1e-109, Identity=52%"; Hit description=MAP kinase activating protein-like
  Pfam annotation: Domain name=DUF300; Domain location=1-240; Score =285.7; E_value=8.8e-83; Accession=PF03619.7; Description=Domain of unknown function
FLSLLDSSAAFNCEVIRDCYEAFALYCFERYLIACLGGEDKTIQFMESMSLTESSTPLLKESYAYGVVEHPFPINCFLRDWYLGPDFYQSVKIGIVQYMILKMICALLAMILQSFGVYGEGKFEWKYGYPYLACILNFSQTWALYCLVRFYSVTKDKLEPIKPLAKFLTFKSIVFLTWWQGVAVAFLFSMGAFKGSLAQELKTRIQDYIICIEMGVAAVVHLYVFPAVPYKRGERCVRNVAVMTDYASLGSPPDPAEVQDSERSTRMRLGRHDDRERRMKFTHNVRDVVLGSGEIIVDDMKFTVSHVVEPVERGIAKINKTFHEISENVKRRDEEWRRSTKVKDDSYLVPLRSWRAEFSDVHDRLGEGSVSDSGLPSSKRQHLQSKASASRMRR

SEQ ID NO: 132250 - protein, 1145 aa, Glycine max
  Coding DNA Sequence Number=SeqID_15472
  Gene Ontology: Mol. function=transcriptional elongation regulator activity; Cellular component=intracellular; Biological process =regulation of transcription, DNA-dependent
  Homolog annotation: Hit_ID=UPI0000196BB2; Match level="QueryCoverage =80%, HitCoverage=89%, E-value=0.0, Identity=70%"; Hit description =structural constituent of ribosome / transcription factor/ transcriptional elongation regulator
  Pfam annotation: Domain name=KOW; Domain location=1093-1126; Score =18.7; E_value=0.021; Accession=PF00467.19; Description=KOW motif
  Pfam annotation: Domain name=KOW; Domain location=383-416; Score =26.0; E_value=0.00014; Accession=PF00467.19; Description=KOW motif
  Pfam annotation: Domain name=KOW; Domain location=534-565; Score =31.6; E_value=2.8e-06; Accession=PF00467.19; Description=KOW motif
  Pfam annotation: Domain name=KOW; Domain location=586-618; Score =30.5; E_value=5.8e-06; Accession=PF00467.19; Description=KOW motif
  Pfam annotation: Domain name=KOW; Domain location=710-741; Score =17.6; E_value=0.044; Accession=PF00467.19; Description=KOW motif
  Pfam annotation: Domain name=KOW; Domain location=813-846; Score =27.7; E_value=4.2e-05; Accession=PF00467.19; Description=KOW motif
  Pfam annotation: Domain name=Supt5; Domain location=264-303; Score =50.1; E_value=7.2e-12; Accession=PF03439.4; Description=Supt5 repeat
  Pfam annotation: Domain name=Supt5; Domain location=336-382; Score =59.3; E_value=1.3e-14; Accession=PF03439.4; Description=Supt5 repeat
  Pfam module annotation: Pfam domain module=KOW::KOW::KOW::KOW::KOW::KO W::Supt5::Supt5; Domain location=1093-1126::383-416::534-565::586 -618::710-741::813-846::264-303::336-382
MGVARLMELASSNDVFSTCQIQGKLASGTDGFARIALAATPPPTLTSRKPRVWVCGMSRRGMDDDDEEEYEEEDEQVADFDEEEEEDNHRGRGGGGGRKRRRSGFIDDDAEEVDEDEDEEDDDDEDFDGRGGGGGRRRQYKKVSASNFFDEEAVVDSDEEEEEEEGEDEMRLPAATVALDDEHQCQPLLMLDKDGKMIAVAFVGDVVIIAVEVATTVMVEDFIVEGGADLPEEDDGRKMRSSRMLPHHQEDHEDLEAMARSIQERYGRRLTDYDEETTDVEQQALLPSVRDPKLWMVKCAIGRERETAVCLMQKYIDKGSELQIRSAIALDHLKNYIYVEADKEAHVREACKGLRNIFGQKITLVPIREMTDVLSVESKAIDLARDTWVRMKIGTYKGDLAKVVDVDNVRQRVTVKLIPRIDLQALANKLEGREVVKKKAFVPPPRFMNVDEARELHIRVEHRRDAYGERFDAIGGMMFKDGFLYKTVSIKSISAQNIKPTFDELEKFRKPGESGDGDVASLSTLFANRKKGHFMKGDAVIVIKGDLKNLKGKVEKVDEDNVHIRPEMEDLPKTIAVNEKELCKYFEPGNHVKVVSGAQEGATGMVVKVEQHVLILISDTTKEHIRVFADDVVESSEVTTGVTRIGDYELRDLVLLDNNSFGVIIRVESEAFQVLKGIPDRPEVVLIKLREIKCKIDKKISVQDRFKNTVSSKDVVRIVDGPCKGKQGPVEHIYRGILFIFDRHHLEHAGFICAKAQSCVVVGGSRSSGERNGDAYSRFASLRSPSRIPPSPRRFSRGGPMDWRHRGGRGHDSLAGTTVKVRQGPYKGYRGRVIDVKGTTVRVELESQMKVVTVDRNHISDNVAVTPYRDTSRYGMGSETPMHPSRTPLHPYMTPMRDPGATPIHDGMRTPMHSRAWNPYTPMSPPRDNWEDGNPGSWGASPQYQPGSPPSRPYEAPTPGAGWASTPGGNYSEAGTPRDSSAYANAPSPYLPSTPGGQPMTPSSASYLPGTPGGQPMTPGTGGMDMMSPVLGGENEGPWFIPDILVNVHRAGEESIGVIREALPDGSYRVGLGSSGNGETITALPNEMEAVVPRKSDKIKIMGGALRGATGKLIGVDGTDGIVKVDDTLDVKILDLVILAKLAQP

SEQ ID NO: 132251 - protein, 535 aa, Glycine max
  Coding DNA Sequence Number=SeqID_15473
  Gene Ontology: Mol. function=transferase activity; Cellular component= nucleus; Biological process=mRNA editing
  Homolog annotation: Hit_ID=Q8LJJ8; Match level="QueryCoverage=94%, HitCoverage=92%, E-value=1e-127, Identity=45%"; Hit description =Pentatricopeptide (PPR) repeat-containing protein-like
  Pfam annotation: Domain name=PPR; Domain location=113-147; Score =33.4; E_value=8.1e-07; Accession=PF01535.11; Description=PPR repeat
  Pfam annotation: Domain name=PPR; Domain location=177-211; Score =39.8; E_value=9.4e-09; Accession=PF01535.11; Description=PPR repeat
  Pfam annotation: Domain name=PPR; Domain location=239-273; Score =39.3; E_value=1.3e-08; Accession=PF01535.11; Description=PPR repeat
  Pfam annotation: Domain name=PPR; Domain location=274-308; Score =14.2; E_value=0.16; Accession=PF01535.11; Description=PPR repeat
  Pfam annotation: Domain name=PPR; Domain location=340-374; Score =45.2; E_value=2.2e-10; Accession=PF01535.11; Description=PPR repeat
  Pfam annotation: Domain name=PPR; Domain location=375-409; Score =24.3; E_value=0.00044; Accession=PF01535.11; Description=PPR repeat
  Pfam annotation: Domain name=PPR; Domain location=410-444; Score=7.5; E_value=0.95; Accession=PF01535.11; Description=PPR repeat
  Pfam module annotation: Pfam domain module=PPR::PPR::PPR::PPR::PPR::PP R::PPR; Domain location=113-147::177-211::239-273::274-308::340 -374::375-409::410-444
MSFNLGTWRNNPSHWFCSIRNHIQQGSLRCALLAYKQTRHEGVYDSSVAPLLFKACASLPFLHYVKALHAESIKAGSESDVIIGTALLTTYSKCGVVRDARNLFDTMPERNVVTWNAMISGYLRNGDTESAYLVFEKMQGKTQVTWSQMIGGFARNGDIATARRLFDEVPHELKNVVTWTVMVDGYARIGEMEAAREVFEMMPERNCFVWSSMIHGYFKKGNVTEAAAVFDWVPVRNLEIWNSMIAGYVQNGFGEKALLAFEGMGAEGFEPDEFTVVSVLSACAQLGHLDVGKQIHHMIEHKGIVVNPFVLSGLVDMYAKCGDLVNARLVFEGFTEKNIFCWNAMISGFAINGKCSEVLEFFGRMEESNIRPDGITFLTVLSACAHRGLVTEALEVISKMEGYRIEIGIKHYGCMVDLLGRAGRLKDAYDLIVRMPMKPNDTVLGAMLGACRIHSDMNMAEQVMKLICEEPVTGASSHNVLLSNIYAASEKWEKAERMKRITVDGGSQRIPGCSSIIFSDSCGFKCTSPTLKSMD

SEQ ID NO: 132252 - protein, 796 aa, Glycine max
  Coding DNA Sequence Number=SeqID_15474
  Gene Ontology: Mol. function=serine carboxypeptidase activity; Cellular component=cellulose and pectin-containing cell wall; Biological process=proteolysis
  Homolog annotation: Hit_ID=Q9FH05; Match level="QueryCoverage=53%, HitCoverage=94%, E-value=0.0, Identity=72%"; Hit description=Serine carboxypeptidase II-like
  Pfam annotation: Domain name=DUF150; Domain location=181-339; Score =10.4; E_value=1.4e-06; Accession=PF02576.8; Description =Uncharacterised BCR, YhbC family COG0779
  Pfam annotation: Domain name=Peptidase_S10; Domain location=381-783; Score=648.1; E_value=7.1e-192; Accession=PF00450.12; Description =Serine carboxypeptidase
  Pfam module annotation: Pfam domain module=DUF150::Peptidase_S10; Domain location=181-339::381-783
MGEGCCTQPYPCICKEAVSGFEPMTNKSPRHNFTAAPGLALKNPKGLDMWAWAVAVALAGITCFGCTNGFDKGLEVGTLSFFLLLPTLAELESLYFQFHVAKRRDSDSEPLLEPSIVQEVSFHDDNEEEEFLDEFEYVLECTDEDDGDGDEYYEEEEEYEEEAGGGISLTGTWWDKKALAIAKEVTLSFDGELQIYAFRTLVNCTIQVRIENLSKKSGSPSMEDIEAFSTTYRAKLDEAEIAKVVPDNICLEVSSPGVERIVRIPDDLDRFKDRPMYVKYAINDDQNNPAAEGDGVFKLESFDMETKCCTWGLADVKVNRQKAGKGRPLNKKQIVSGVGLGVVEMKRCWLVGVLIVVGCACMLGTVGVEGHPDEDLIVSLPGQPKVEFKQYAGYVDIDVKHGRSLFYYFVEAENVPDKKPLTLWLNGGPGCSSIGGGAFTELGPFYPKGDGRGLRTNSMSWNKASNLLFVESPAGVGWSYSNTTSDYNSGDSSTATDMLLFLLKWYQKFPSYRSRELFLTGESYAGHYIPQLANVLLDYNVHSTSFKFNIKGVAIGNPLLKLDRDAQATYEYFWSHGMISDEIGLAITNDCDFDDYVFASAHNMSKSCNEAINEANEIVGDYINNYDVILDATKISIGVDVCMTYERSFYFNLPEVQKALHANRTNLPYQWSMCSGDTDPNIDILPILKKIVQNHIPVWVFSGDQDSVVPLLGSRTLIRELAHDLKFKITVPYGAWFHKGQVGGWVTEYGNLLTFATVRGAAHMVPYAQPSRALHLFSSFVHGRRLPNTTSPSIDD

SEQ ID NO: 132253 - protein, 484 aa, Glycine max
  Coding DNA Sequence Number=SeqID_15475
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q5NA51; Match level="QueryCoverage=69%, HitCoverage=77%, E-value=1e-122, Identity=57%"; Hit description=Leaf senescence related protein-like
  Pfam annotation: Domain name=DUF231; Domain location=320-477; Score =125.6; E_value=1.4e-34; Accession=PF03005.6; Description=Arabidopsis proteins of unknown function
MEIWNSWWVLQIMQLLGLFSFWISFAKFRTLFSRAFGYGHKVVKGDCNAWIFVSFNGLVTVSSFIFFLLVLSWAYLYAIPSSQSLIRSHEIPNNSSDSFVQSHEIPNNSSDSFVQSHEIPNNSSDTLVQSYGVILKPNVSMDTCNVFEGSWVRDDSYPLYDASHCPFAERGFNCLANGRKDRGYTKWRWKPKNCEIPRFDVRGILERLRGKRVVFVGDSLSRTQWESMICLLMTGVEDKKSVYEIKGNKITKQIRFLGVRFSTFDVRIDFYRSVFLVRPGSVPRHAPQRVKTALRLDKIDDISHEWIDSDVLIFNSGHWWTRTKLFDIFSKEKQRIRFGKVGNSLKFGMPINSGFNTALLTWASWVENTINTNRTRIFFRTFESSHWSGQNHNSCKVTQRPWKRTNGKDRNPISNMINKVVKNMSAPVTVLHVTPMTAYRSDGHVGTWSDKPSVPDCSHWCLAGVPDMWNEILLSYLLPKEGAY

SEQ ID NO: 132254 - protein, 644 aa, Glycine max
  Coding DNA Sequence Number=SeqID_15476
  Gene Ontology: Mol. function=protein binding; Cellular component =Golgi-associated vesicle; Biological process=vesicle docking during exocytosis
  Homolog annotation: Hit_ID=O49048; Match level="QueryCoverage=88%, HitCoverage=99%, E-value=0.0, Identity=75%"; Hit description =Vacuolar protein sorting-associated protein 45 homolog
  Pfam annotation: Domain name=Sec1; Domain location=21-559; Score =378.4; E_value=1.1e-110; Accession=PF00995.13; Description=Sec1 family
MVVSSSARDYINRILQDISGMKILILDSQTVGIVSVVYSQSELLQKEVFLVELVDSISKSNESMSHLKAVYFLRPTSENIQLLRRQLASPRFGEYHLFFSNILKDTQIHLLADSDEQEVVQQVQEFYADFVAIDPYHFTLHVPSHYIYMLPAVVDPSTVQRFSDRVVDGLSALFLALKRRPVIRYQRTSDIAKRIAQEAAKLMYQEESGLFDFRRMEVSPLLLVIDRRDDPVTPLLNQWTYQAMVHELIGIQDNKVDLKSVGKFPKDQEEIVLSSEQDSFFKANMYENFGDIEDMAKFVDNYPEYRKMHGNVTKHVTLVTEMSKIVEERKLMSVSQTEQELACNGGQGAAFEEHDRDLGIMECLSPTSSSMRCLVEYLSGLAVTNLLNNESISDVDRLRLVMLYALRYEKDSPVQLMQLFNKLASRSAKYKPGLVQFLLKQAGVDKRTGDLFGNRDLMNIARNMARGLKGVENVYTQHQPLLFQLMESIVKGRLRDVDYPFVGNHFQQGRPQDVIIFIVGGTTYEESRSVALQNASNTGVRFILGGSSVLNSKRFLRDLEEAQRVARSSTTKELDVRNQTQSIVAAEDDHQPFNSLGTSWFIADECDLRYEYENFNVKPGPLSFVRGGKRVPMSLVPIFHPSEY

SEQ ID NO: 132255 - protein, 60 aa, Glycine max
  Coding DNA Sequence Number=SeqID_15477
MEYQDDTLSLCMPFFNIISSEHNLPYCLSDKDIGSEANARSDIFVHSTSANEIQDKVDRI

SEQ ID NO: 132256 - protein, 96 aa, Glycine max
  Coding DNA Sequence Number=SeqID_15478
MVCNCNNNQPPGPPPPLERQNYPPAPPPTPIIQETRHTDTRIVLEEEFSFPVVAFIEENASTEVTKVMPRMLKMRTRRKQVEAAGSARQIKKLGAE

SEQ ID NO: 132257 - protein, 86 aa, Glycine max
  Coding DNA Sequence Number=SeqID_15479
MACNCNSNQPPPPVEMENFLPTPPPTPNIEETCPEMDVMEMEFEEEFSFLVVVVATEQNAPNAFTEEKPAEDKNANLKEASPNNDD

SEQ ID NO: 132258 - protein, 90 aa, Glycine max
  Coding DNA Sequence Number=SeqID_15480
MACNCNNNQPRGPPPPLERQNYPPAPPPTPIIQETRPADTRIVLEEDFSFPVVAFIKENASTEVTKVMPEDVKNENPKEASGGSRKRKAN

SEQ ID NO: 132259 - protein, 43 aa, Glycine max
  Coding DNA Sequence Number=SeqID_15481
QVSSMLGVGGGVGGKFSISTGGGGWLELQLHAMVMEYNSYLQV

SEQ ID NO: 132260 - protein, 192 aa, Glycine max
  Coding DNA Sequence Number=SeqID_15482
  Gene Ontology: Mol. function=DNA binding; Cellular component=nucleus; Biological process=regulation of transcription
  Homolog annotation: Hit_ID=Q6Z538; Match level="QueryCoverage=84%, HitCoverage=42%, E-value=2e-77, Identity=83%"; Hit description =Putative NAC domain protein
  Pfam annotation: Domain name=NAM; Domain location=15-143; Score =294.2; E_value=2.5e-85; Accession=PF02365.6; Description=No apical meristem (NAM) protein
MEERNDNGEKLDEVMLPGFRFHPTDEELVGFYLKRKIQQRPLSIELIKQLDIYKYDPWDLPKMATTGEKEWYFYCPRDRKYRNSARPNRVTGAGFWKATGTDRPIYSSEGSKCIGLKKSLVFYKGRAAKGIKTDWMMHEFRLPSLTHPPSSLKKFMDKTIPANGILGNLQDLQENQCYSSKSSLTFLGLTIT

SEQ ID NO: 132261 - protein, 88 aa, Glycine max
  Coding DNA Sequence Number=SeqID_15483
MAKIQGLKEGKTYSNIYKEEWTQPWPMGSKIDPEVHENPRAFFSNSSPILLESSIQYPWGFGDHLSHNHHRLSHTAPSNHPTHNFDLA

SEQ ID NO: 132262 - protein, 242 aa, Glycine max
  Coding DNA Sequence Number=SeqID_15484
  Gene Ontology: Mol. function=diacylglycerol kinase activity; Cellular component=cytoplasm; Biological process=protein kinase C activation
  Homolog annotation: Hit_ID=Q1SSQ3; Match level="QueryCoverage=87%, HitCoverage=43%, E-value=2e-86, Identity=70%"; Hit description =Diacylglycerol kinase accessory region; Diacylglycerol kinase, catalytic region
  Pfam annotation: Domain name=DAGK_cat; Domain location=88-234; Score =96.4; E_value=8.7e-26; Accession=PF00781.14; Description =Diacylglycerol kinase catalytic domain
MDSPSSSTTGDTSKVPIKSSSSIVESLRGCGISSGTHVDKEELRKNLTMPKYLRFAMRDSIMFKDPTAGENLCIRSKDDHKAVAPSTPMIVFINPRSGGRHGPFLKERLQHLMSEEQVLDMLDVKPHEFLQYGLGCLEMLTGLGDSCAKETRKRIRIMVAGGDGSVGWVLGCLTKLHEQGREPIPPVGIIPLGTGNDLSRSFGWGGSFPFSWKAAIKRTLYKASIGPICRLDRYILSYSFAR

SEQ ID NO: 132263 - protein, 52 aa, Glycine max
  Coding DNA Sequence Number=SeqID_15485
  Gene Ontology: Mol. function=peptidase activity
  Homolog annotation: Hit_ID=Q6L3V4; Match level="QueryCoverage=71%, HitCoverage=16%, E-value=6e-10, Identity=68%"; Hit description=CAAX amino terminal protease family protein, putative
MDSDGSEKVNKQLGKFSRSEMCKGKNSSTNDNSNWRRNPTVRMMNEKNCTSK

SEQ ID NO: 132264 - protein, 106 aa, Glycine max
  Coding DNA Sequence Number=SeqID_15486
MVHISLLPITMILGAFPNTTNDLCNGLHRQNECLSKKSVNDVLPVLKLKVPLEHPDQFWMYGLRLFETTSNSTTEQVQEELCSVRIIMLNANLNPREIPLSAKGHT

SEQ ID NO: 132265 - protein, 158 aa, Glycine max
  Coding DNA Sequence Number=SeqID_15487
  Gene Ontology: Mol. function=peptidase activity
  Homolog annotation: Hit_ID=Q60D39; Match level="QueryCoverage=92%, HitCoverage=41%, E-value=3e-33, Identity=55%"; Hit description=CAAX amino terminal protease family protein, putative
MAYSQAMGGALAMANSFTDLSCLWIGRKMPSRDFLPILSNGLTEAIALPYLGIKPDVLSLDDKAEILLFDQSITTAVVLGIIYSVANTFQPLPEDFFKYDLREPFNLQKGWLLWAGIGLAGAILAISLTGVAVSFFNGETPQREVHVLFLKFYRKMQM

SEQ ID NO: 132266 - protein, 356 aa, Glycine max
  Coding DNA Sequence Number=SeqID_15488
  Gene Ontology: Mol. function=RNA-directed RNA polymerase activity; Cellular component=mitochondrion; Biological process=RNA-dependent DNA replication
  Homolog annotation: Hit_ID=Q09EL1; Match level="QueryCoverage=36%, HitCoverage=47%, E-value=6e-57, Identity=89%"; Hit description=NADH dehydrogenase subunit 6
  Pfam annotation: Domain name=Mitovir_RNA_pol; Domain location=1-351; Score=-319.3; E_value=0.064; Accession=PF05919.2; Description =Mitovirus RNA-dependent RNA polymerase
  Pfam annotation: Domain name=Oxidored_q3; Domain location=235-345; Score=14.4; E_value=7.3e-05; Accession=PF00499.10; Description=NADH -ubiquinoneplastoquinone oxidore
  Pfam module annotation: Pfam domain module=Mitovir_RNA_pol::Oxidored _q3; Domain location=1-351::235-345
MAVGRWALTGYPMGPFYHPATIWAAITGKLGCTCEGAGKRRIFAIGNYVLRRIPMDDQTAPLIRLVPSKTCLSYDLKSATDWWPLVFLFERLALLFDRSFASSVVNTTLGTNVFEVPFVKRALSQVSFVTGQPLGYYGYWPLFAFTHHVLVWWAAEQVRPGILFDRYAILGDDVLITDPLVAEQYRLGLQRLGVKISTHKSLISSTGAVELDGVQSVWRESFLLNAMILSVLSSPALVSGLMVARAKNPVHSVLFPIPVFRDTSGLLLLLGLDFSAMIFPVVHIGAIAVSFLFVVMMFHIQIAEIHEEVLRYLPVSGIIGLILWWEMFFILDNETIPLLPTQRNTTSLRYTVYAGK

SEQ ID NO: 132267 - protein, 175 aa, Glycine max
  Coding DNA Sequence Number=SeqID_15489
MENIPFDLPHTIYINILHTTNTLGGYEDILYSPLVNKILWEQGVATYPSMGGQGGIKSASSHEENAWSRHQRLFEENVRKTKKGKGVALAPTYPLEKEMKMHKTIKRTSKGPYIMFKSLKTNTNQMTNEERCRSRLRSQFGGTSATFFSSFFFFSLISLNGGPWNPLLNLPHAFL

SEQ ID NO: 132268 - protein, 66 aa, Glycine max
  Coding DNA Sequence Number=SeqID_15490
MTECVRLFDHPIIKVHILVLSGVDICVSWIIRPIKYPNIFQYEIKALLGAQLFDYPNILQLAHPSE

SEQ ID NO: 132269 - protein, 39 aa, Glycine max
  Coding DNA Sequence Number=SeqID_15491
MRWPLDSWTYLIEVTEQLPILIVRVGPTHCQCENPARKR

SEQ ID NO: 132270 - protein, 120 aa, Glycine max
  Coding DNA Sequence Number=SeqID_15492
MVSSRRPARFQKPDFMQTKPIGEEKLEVLRVAAAAVFLNEQNPEGESSEQEVMTNTGYGKNVRDETDNNDNGMELLATVATRIITKRVEKKKLRKEKLRKKKLPLPLDLRWGNQKLRAFS

SEQ ID NO: 132271 - protein, 134 aa, Glycine max
  Coding DNA Sequence Number=SeqID_15493
  Homolog annotation: Hit_ID=Q1T6D0; Match level="QueryCoverage=39%, HitCoverage=10%, E-value=5e-09, Identity=52%"; Hit description=Zinc finger, CCHC-type; Lipocalin
MKDHHIRLWKTQIGIELMDVGNDCYMVEFDAKDDKEKVTIDVPWVLFDHYFSVKANSFTSTHHNCKKLAIILPYHVYAQILPSSFSSGKEEFRPSPKGSWMHKLIEEKPTESENSNPAKACPNSTGASRKRKAK

SEQ ID NO: 132272 - protein, 139 aa, Glycine max
  Coding DNA Sequence Number=SeqID_15494
MKVARSGKLSCYFILKRPCSPRRARGLKKCKNDPFALPFEYFLHSFPKRQKTLRIAWQLALSSSIRLARIKMLANKGPWTKLGCVEAMPSKVILMMPKNQESSKFQRFKNEVFKNQDSRIINIKIQDSRFKNQEKNQSR

SEQ ID NO: 132273 - protein, 336 aa, Glycine max
  Coding DNA Sequence Number=SeqID_15495
  Gene Ontology: Mol. function=transcription regulator activity; Cellular component=nucleus; Biological process=regulation of transcription
  Homolog annotation: Hit_ID=Q9FK20; Match level="QueryCoverage=96%, HitCoverage=92%, E-value=1e-63, Identity=49%"; Hit description =Similarity to helix-loop-helix DNA-binding protein
  Pfam annotation: Domain name=HLH; Domain location=109-160; Score =58.3; E_value=2.5e-14; Accession=PF00010.16; Description=Helix-loop -helix DNA-binding domain
MDDNSLCDIFDDKEFGSDHFGGDDLFAILESLESDFTTDFPPLINEEAVVAAAVSKDINNEDVSRLVSQKSTSSSAPLDSETELETSPKTKRQKLTPTTPEEANPDGQQKMSHITVERNRRKQMNEHLTVLRSLMPCFYVKRGDQASIIGGVVDYISELQQVLQALEAKKQRKVYCEVLSPRLVSSPRPSPLSPRKPPLSPRLNLPISPRTPQPGSPYRPRLHQQQHGYNNIISPTISNVSLDPSPTSSANSSINDNINELVANSKSPTADVEVKFSGPHVLLKTVSQRIPGQALKIITALEDLALEIVHVNINCAADDTMLNSFTIKYLVTCITA

SEQ ID NO: 132274 - protein, 364 aa, Glycine max
  Coding DNA Sequence Number=SeqID_15496
  Gene Ontology: Mol. function=sequence-specific DNA binding; Cellular component=nucleus; Biological process=regulation of transcription
  Homolog annotation: Hit_ID=Q6R7N3; Match level="QueryCoverage=97%, HitCoverage=96%, E-value=4e-73, Identity=44%"; Hit description =Putative WRKY transcription factor 30
  Pfam annotation: Domain name=WRKY; Domain location=126-188; Score =132.7; E_value=1e-36; Accession=PF03106.6; Description=WRKY DNA -binding domain
MDHMGDPKSIIHELLQGLELARQLQVHLHMPSSSQETRDLLIQKIISTFEKVLEMVKWKGPVPAGESSQHPLGAALIRMSDSPLSSEDSDRDLKDQDPNAFKKRNTLPRWTKQIRVTPGMGVEGPLDDGYSWRKYGQKDILGALYPRGYYRCTHRNVQGCMATKQVQRSDEDPTIFEITYRGKHTCTVANNVGSSSPIPLENQEPSLNNTNIPQHQHQQNILQSHEQQQNELLLSLRKGLRVQTENLDSPEQPLVPFRFPLSTNIKNESHVFPSPVLENFTSPSYVSPAASGIGHFSVSPSGVVNSFEGNPNLANSESQINDMIPATTTTSAAPNSSTVGLEFPFDQFEFDGQNFTFDNPRFFS

SEQ ID NO: 132275 - protein, 333 aa, Glycine max
  Coding DNA Sequence Number=SeqID_15497
  Homolog annotation: Hit_ID=Q9FK19; Match level="QueryCoverage=17%, HitCoverage=13%, E-value=2e-11, Identity=55%"; Hit description =Arabidopsis thaliana genomic DNA, chromosome 5, TAC clone:K19E1
MVVSNSMSESCRCNELEERSMKAEMRCAELEFKLQKKDEQCEVLEAKLKALEDEVEVLRVSSEELKEKKEVGNVKERGVEAIIDLTNDDDDEVAQLMIENSVLECEKKKAESEVEVWKDKYWKLESLVSQLKLESDSYSNEENGKKWKATVIPMKKMERKRKVMQLTFEIEEIHSKKMAPSTPFAAKSSSIVVIDIIDSDDEPNIAQHAALDSQVSRNISVSSCFAAENEKLSSSYAQNNEEDMNSGEDLPFVVTPKRNEIVMLLQVSQKMMCRGSTLAEFLNHGDPRGGLKKSVKELQEYDPKAVEQCRTFAIRYSKQLYHIYKNKEDPFFP

SEQ ID NO: 132276 - protein, 162 aa, Glycine max
  Coding DNA Sequence Number=SeqID_15498
  Gene Ontology: Mol. function=catalytic activity; Cellular component =integral to membrane; Biological process=metabolic process
  Homolog annotation: Hit_ID=P0AEC0; Match level="QueryCoverage=97%, HitCoverage=30%, E-value=1e-53, Identity=64%"; Hit description =UPF0053 inner membrane protein yoaE
  Pfam annotation: Domain name=CorC_HlyC; Domain location=71-152; Score= 61.5; E_value=2.8e-15; Accession=PF03471.7; Description=Transporter associated domain
MDVATFAANTPPIVVPETLDPINLLGVLRRAKGSFVIVTNEFGVVQGLITPLDVLEAIAGEFPDEDETPDVVADGDGWLVKGGTDLHSLQQLLDHHELVDPDEDHASLAGLLIEQKGQLPLPGEIIDLPPLHFQIIEATDYRIDLVRVTKDKPHHDEEEGDA

SEQ ID NO: 132277 - protein, 69 aa, Glycine max
  Coding DNA Sequence Number=SeqID_15499
MWQKSKRGVFAQSVSFRNFFESNLARLSELGGHHTPRFVEKWDSGASGTPLFWVKKIVSVKKIKAEVLP

SEQ ID NO: 132278 - protein, 64 aa, Glycine max
  Coding DNA Sequence Number=SeqID_15500
MESGDMRRYLMVIRTFHQPRANEPVGAQRLTSSSTSLCHPDPWSQVFALVVQRHSSPTTHEILL

SEQ ID NO: 132279 - protein, 140 aa, Glycine max
  Coding DNA Sequence Number=SeqID_15501
  Homolog annotation: Hit_ID=Q1S0F5; Match level="QueryCoverage=51%, HitCoverage=15%, E-value=1e-07, Identity=43%"; Hit description=IMP dehydrogenase/GMP reductase
MGSSQKPSLKKRFYQVKIKSLEVTSLRKLGQLMGQLQRQAFRKAYEFLKSPNLGAGIRPPKASQKWGGRNTEKIFGGCPNVPLMGTRGCINYNPVLAIRQLGYPMRGAPLDESITPFIARGFSDHNARVLQGVRKAWDAV

SEQ ID NO: 132280 - protein, 89 aa, Glycine max
  Coding DNA Sequence Number=SeqID_15502
  Gene Ontology: Mol. function=chitin binding; Cellular component =extracellular region; Biological process=chitin metabolic process
  Homolog annotation: Hit_ID=UPI0000612705; Match level="QueryCoverage =98%, HitCoverage=90%, E-value=4e-09, Identity=27%"; Hit description =UPI0000612705 related cluster
  Subcellular localization annotation: CTP_CleavageSite=9; ConfidenceScore=5.23e-01
MARACSPLMAMTCRPLKVRTCIPLKLRTCSPLKVRACSPLKVRTCNHLEVRVWSPLIDRTCSPLMARMCSPIKVRGCSPLMATTCRPLK

SEQ ID NO: 132281 - protein, 275 aa, Glycine max
  Coding DNA Sequence Number=SeqID_15503
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-40, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTTRPRHQWAAHPHFKGLDVLAIRGLDALTFRGLHVLAIKGLHALTFRGLHILAISRLHVLAIRGLHALTFRGLHVLAFRGLHALAIRGLHVLAIKDLHALSFRGLHALTFSGLHVLTFRGLHVLGITGLHVLVIKDLHALTFRGLHVLAIRGLRALTFRRQHVLAFRGLHALTFGGLHVLPFRGLHVLTFIGVHVLAIRGVHVLPIKGLHVLAISGLDVLAIRGLHALTFRGLHVLAIRGLHDVAFRGLHALTFRGLHVLTFRGLHALTIRGLH

SEQ ID NO: 132282 - protein, 140 aa, Glycine max
  Coding DNA Sequence Number=SeqID_15504
  Gene Ontology: Mol. function=solute:hydrogen antiporter activity; Cellular component=integral to membrane; Biological process =regulation of pH
  Homolog annotation: Hit_ID=Q1MC32; Match level="QueryCoverage=91%, HitCoverage=20%, E-value=4e-34, Identity=57%"; Hit description =Putative transmembrane cell volume regulation protein A precursor
  Pfam annotation: Domain name=CorC_HlyC; Domain location=8-89; Score =31.2; E_value=3.6e-06; Accession=PF03471.7; Description=Transporter associated domain
ALPVADDDADFFGTFAISPARPAKELDAAYGPGLLAPAEQAMSIAELIETRLAGRADYADRVRLGSIVLIVRTLDEHEAIAGVGISLEPVEPATTLPIFISFSEIFKRVRDYLAQRRQSRSTATAQDVVAPSNTVRENEA

SEQ ID NO: 132283 - protein, 77 aa, Glycine max
  Coding DNA Sequence Number=SeqID_15505
MGKGWLRWRLPEDPFRVLPELPEEGVPEDFRKKGSSGSTERSSGRTGLLESFRNTSSRNSLDEVVLPETFRKKGSSG

SEQ ID NO: 132284 - protein, 68 aa, Glycine max
  Coding DNA Sequence Number=SeqID_15506
MAIKELQGSGTLKRVAWGLDVGTKVWPNQFLRPLVQQVVSELHSCIKFRSFQNNGLSKLLIPRRELYK

SEQ ID NO: 132285 - protein, 119 aa, Glycine max
  Coding DNA Sequence Number=SeqID_15507
  Homolog annotation: Hit_ID=Q1HRY1; Match level="QueryCoverage=60%, HitCoverage=97%, E-value=2e-27, Identity=79%"; Hit description =Chloroplast At1g16080 protein
MFLESTVLDLPDVKPTVSCPHSLLDYAHNLQPSLRWGDLVFFQNGMMEPWLESKGLEDANQVLAYFAVSKIGETPIDGRTDTNPKRLIAAYGKWASIVAARLNVGGLSCKVSSFYRHTY

SEQ ID NO: 132286 - protein, 204 aa, Glycine max
  Coding DNA Sequence Number=SeqID_15508
  Pfam annotation: Domain name=DUF623; Domain location=81-121; Score =28.5; E_value=6.7e-06; Accession=PF04844.4; Description=Protein of unknown function, DUF623
MRINSEAAAGKMKHKAKQPFSEETYKDKKNEDIDDNVIPSLTTGFLGVRKDAKKHGKREGTLKLKEKDNIGLGEEGKLLNDEKVSKEMDDLLACYLTLNAYEYHDLIIKVFWQVWSDMRQGGLGTLELNPDRLRELKAFDNSIVGVKGLLMKGVTAMTFGFLKAEKLTQKGHTQKLTHEQGSAGRFGGKVSRCCETHSREASAG

SEQ ID NO: 132287 - protein, 75 aa, Glycine max
  Coding DNA Sequence Number=SeqID_15509
MHGSSNGVEEANHMLIGVCMLNVVVKPGQWTWSGGRKKEKAYSYMDNKSPSKESKEVTRESLIAISNSLPDKTLE

SEQ ID NO: 132288 - protein, 132 aa, Glycine max
  Coding DNA Sequence Number=SeqID_15510
MQAMMKRTLNVAQDAPEGLHAAIVRWILIQSARRSTEFCFSINRIHNVLDHIVPPTDEKAKKAIDNAKAVDPDLWHHLDAVVLQWMGNDKKNNKNWGGQNFDKGGCGSGSDDGQGAGGGSHGQQQPSQTPWQ

SEQ ID NO: 132289 - protein, 66 aa, Glycine max
  Coding DNA Sequence Number=SeqID_15511
MEENRKGASTRVIGNRNNGNILRASLCTQEYFHWGTIYHQTEINRKGKRGVVDKLNMKHAWLSQSH

SEQ ID NO: 132290 - protein, 172 aa, Glycine max
  Coding DNA Sequence Number=SeqID_15512
  Gene Ontology: Mol. function=oxidoreductase activity
  Homolog annotation: Hit_ID=Q8SB92; Match level="QueryCoverage=83%, HitCoverage=47%, E-value=3e-18, Identity=36%"; Hit description =Putative ethylene-forming enzyme
  Pfam annotation: Domain name=2OG-FeII_Oxy; Domain location=109-172; Score=18.3; E_value=0.0019; Accession=PF03171.10; Description=2OG -Fe(II) oxygenase superfamily
MVRGGGLQSMDSDPIGSFFYSLLHEKAIDDAELDKLFTACKDWGFFQVVNHGVSSQLREKLKLEIEKFFKLPIEEKKKYQIRAGDVQGYGTGYLEVILQRIDETRYGTSGVIRKSHKHGDEGRLTPHSDATGITILHQVNGVEGLEIKKGGVWIPVTFLPDAFVVNIGDIME

SEQ ID NO: 132291 - protein, 377 aa, Glycine max
  Coding DNA Sequence Number=SeqID_15513
  Gene Ontology: Mol. function=hydrolase activity, acting on ester bonds; Cellular component=cellulose and pectin-containing cell wall; Biological process=lipid metabolic process
  Homolog annotation: Hit_ID=Q7X9E8; Match level="QueryCoverage=24%, HitCoverage=100%, E-value=2e-36, Identity=74%"; Hit description =Lipase
  Pfam annotation: Domain name=Lipase_GDSL; Domain location=46-366; Score=67.6; E_value=4.1e-17; Accession=PF00657.12; Description=GDSL -like LipaseAcylhydrolase
MDSHKQLFSLSCLPLLLLLLSGNMGMQLSEARLQRHEMNYYSPKTLFVFGDSYVDTGNYRINQAGSSWKNPYGETFPGKPAGRFSDGRVLTDYIGAFITISPVLAGLLHFVRKTKYLGLKSPVPYKFRKVMQQHLKYGMNFAFGGTGVFDTSSKNPNMTIQIDFFKQLIKENVYTTSDLNNSVVYVSVAGNDYNFYLATNGSIEGFPAFIASVVNQTATNLLRIKSLGVRKIVVGGLQPLGCLPSSTATSSFQQCNSTSNDLVVLHNNLLNQAVTKLNQQTNKDNSTFIVLDLFDTFTSVLNHPSTNNIKDPLKPCCVGLSSQDFCGKVDENNVKQYKVCDSPKSAFFWDNLHPTQAGWEAVYKKLQKTSALHQIRY

SEQ ID NO: 132292 - protein, 72 aa, Glycine max
  Coding DNA Sequence Number=SeqID_15514
MVGSVIKSPEISGLVPTLLKGLCHPKEHTKYSLNILLQVRLLILFSVVVSLAKQWAFEEPSVETITGENVLT

SEQ ID NO: 132293 - protein, 389 aa, Glycine max
  Coding DNA Sequence Number=SeqID_15515
  Gene Ontology: Mol. function=nucleic acid binding; Cellular component= oxygen evolving complex; Biological process=DNA integration
  Homolog annotation: Hit_ID=Q1ST43; Match level="QueryCoverage=87%, HitCoverage=26%, E-value=1e-105, Identity=58%"; Hit description =Integrase, catalytic region; Peptidase aspartic, catalytic
MSPPSSNESPISHQPSSPRRSASKTHPPSYLFDYQYKLPLIKSAKLNSLPLAHILSKLVSPMLKFLHLITTSLLSHLMKNQPASTKPVSINVGAMQCNAKLRPYSQIRLGMLFPPPHIVERYKARLVAKGYSQVEGINYFETFSSVVKMTIVRTILPFTSINQWHLQQLDVSNAFLPGDLSEDVYMDIPPGLPGYSSNQSCKLRKSLYGLKQENEKWYEKLSQLLLSCSYKHAHADHSLFIKSHGFDFTALIIYVDDIVLTDNSVQEIDYIKRTLHSNFHTKDSGQLKYFLEIEVAHSIKGISLCQRKYCLDLLKDTGLLGCKPSSTPMDSSLRLHVDSSGFLDDPLRYRRLIGRLVYLTSTRPDIAFATQKLSQFMSKPTKAHLAVAY

SEQ ID NO: 132294 - protein, 197 aa, Glycine max
  Coding DNA Sequence Number=SeqID_15516
  Homolog annotation: Hit_ID=Q8VXZ9; Match level="QueryCoverage=26%, HitCoverage=12%, E-value=1e-09, Identity=60%"; Hit description =Putative DNA binding protein ACBF
MRTSDEIGRTTTNKTSNTEHLLHRDHQILNTSWDHQWKAQGTTTESNRKQQQPKPSKESREGRSSKIIKRYLPEEASFGNILEDVLPEGVSEYFRKSQILLLEEAIMLGARSNSQGVVDDGHLVVVVSLHNPLSFGVGEELDETVALMLSRDLLVDDFDEDELVDNGPREGGGEWKKEHMSRKKRAKSEIKINASTC

SEQ ID NO: 132295 - protein, 363 aa, Glycine max
  Coding DNA Sequence Number=SeqID_15517
  Gene Ontology: Mol. function=nucleic acid binding; Cellular component= beta-galactosidase complex; Biological process=DNA integration
  Homolog annotation: Hit_ID=Q1S1G2; Match level="QueryCoverage=64%, HitCoverage=18%, E-value=7e-46, Identity=37%"; Hit description =Integrase, catalytic region; Zinc finger, CCHC-type; Peptidase aspartic, catalytic
  Pfam annotation: Domain name=zf-CCHC; Domain location=245-262; Score =13.8; E_value=0.0053; Accession=PF00098.13; Description=Zinc knuckle
  Pfam module annotation: Pfam domain module=Retrotrans_gag::zf-CCHC; Domain location=99-192::245-262
  Subcellular localization annotation: CTP_CleavageSite=64; ConfidenceScore=5.45e-01
MAGTPSTSSGEEDPPSPPPPPPFSDPSQNPSNPFYIHPSESPSSILVTPVLMGPNFQSWSRSVRMALVSKNKMDFLTGSIPIPSEADPLYPHWECCNTLLMSWLLNSLAPSIAQSVVFLEIAIDIWTDLRERFTQGDLLRVAELQEEIYSLQQGNLFVTDYYTKLKSLWEQLDNFRPLIPCPCFAKLASMNTLPWLAPRFCFSIPYLPLLHSAPPSSSLDGNPFVNAASGSRRGPQQQGGTKTSKKCDHCGRLGHTMDSCFQRTGTSPLKYAHCERVGHTEDVCYAKFGYPPGDPKYPRRPRLPHKSSSGGRASGGKAVNNAVAAPGNEARALPHIGDDKQVSSHGNGPNITPAQYQHLMTLL

SEQ ID NO: 132296 - protein, 421 aa, Glycine max
  Coding DNA Sequence Number=SeqID_15518
  Gene Ontology: Cellular component=transcription factor TFIID complex; Biological process=transcription initiation
  Pfam annotation: Domain name=Extensin_2; Domain location=3-350; Score= -137.1; E_value=0.06; Accession=PF04554.4; Description=Extensin-like region
  Subcellular localization annotation: CTP_CleavageSite=13; ConfidenceScore=5.48e-01
MDPQAPATATTARSAAAEPSQSQPPKPSPPLPLPPPSTSSTPPISAPPQPPPNTNPSPNPNPSPAPGPGPIQAPSPKPPTPTPTTTPTPPQPFNRALSPPSQPQFPHYSSPSPPSSAPGAAPPPRGGMAIGVPAHHQSPSPPFSSSFGQHFGGLGRTGVNVAESTSNSSTSQVRTPVQGTGMLGSQMRPSGIGAHQQRPVQSSLRPPPPSAPNNQPAGSQSFQGHGLMRSSSVGSPATPSPSSSLSMQSLNQPWLSSGPQGKPPLPSAAYRQQLNPQSMQQRPHIPLQQQSTPTPLLANQSQEHFGQQVLPPRAPLHVPHQPQIMRVHGPGNQKPSSLVAAQSSAAQPGTRSRLTNTDTDESSNSILSKRSIHELVNQLPVEIQKNFIISPKGPFMKFSDTPVPYQTCKELDGGLQVLIAT

SEQ ID NO: 132297 - protein, 73 aa, Glycine max
  Coding DNA Sequence Number=SeqID_15519
MILTGKGPALGSLWVANLPLKVGLKLMLMYQLVLEDTLLLVEVFSGILKGKNVMDVCQYSESSGANPSPQKLK

SEQ ID NO: 132298 - protein, 161 aa, Glycine max
  Coding DNA Sequence Number=SeqID_15520
  Homolog annotation: Hit_ID=Q1SL15; Match level="QueryCoverage=76%, HitCoverage=12%, E-value=2e-14, Identity=35%"; Hit description =Ovarian tumour, otubain
MDGDQWMYDSMMSEEVDMDYQNEEECGVNESHVFDSRDDVLQWARSVAHENGFVAVIIRSDTNTGCRERISFVLIGRERSAEYRCRKKEFVRRDTGTRKCGCPFNLRGKPLMCGIHNHELAKSLVGYPYAGRLTKAEKTLIADMTKSMVKPRNILLTLKEH

SEQ ID NO: 132299 - protein, 94 aa, Glycine max
  Coding DNA Sequence Number=SeqID_15521
MVAAVEVAVVHLWLTAVGLALAARIMIAGKDVAEEQCHPDLCQGGHASAHDPHSPSRHASCKDQWMPQELIDGIFNKGDPLAPHPGALIPNSFL

SEQ ID NO: 132300 - protein, 340 aa, Glycine max
  Coding DNA Sequence Number=SeqID_15522
  Gene Ontology: Mol. function=nucleic acid binding; Cellular component= beta-galactosidase complex; Biological process=DNA integration
MATPTTNPSQDPTNSLHLHHSDGPSLVLTSQPLDHKNYTTWSIAMKPKEKAPTYDAWTRANNVVISWLYNSVSKEIITNILFANTTKEIWDDLKTRFSRKNGLRIFQLKHQLMSLQQGTNDISTYYTKLKSIWEELVGYKPTFPCTCGGLQQLQTHNESEYVMSFLMGFNDFSLILQEKAQREIVVTHSPTNTLENIVFSVNFASKNQYDSNKGKYIKKERPKCAHCDMLGHTKDKCYKLVGYLPNYFKNRTSNSVNQVNDTPESSTSARAPTLTATQCQQLIYFLTNHMKTKNTIDAVATNVTGICMNADFNNDYHTWIIDTEDLKTLRRIGTAKQKQG

SEQ ID NO: 132301 - protein, 366 aa, Glycine max
  Coding DNA Sequence Number=SeqID_15523
  Gene Ontology: Mol. function=hydrolase activity; Cellular component =extracellular space; Biological process=biological_process
  Homolog annotation: Hit_ID=Q8S340; Match level="QueryCoverage=94%, HitCoverage=79%, E-value=1e-156, Identity=73%"; Hit description =Purple acid phosphatase
  Pfam annotation: Domain name=Metallophos; Domain location=141-333; Score=63.0; E_value=1e-15; Accession=PF00149.18; Description =Calcineurin-like phosphoesterase
MAKCNKSLVVILLLLHILCLQSQVNGFSRQPSRQLIFTPHKRSDSDPQQVHISLVGNDHMRVSWITDDKHSESVVEYGTKKGEYSTKATGEHTSYHYFLYESGKIHHVVIGPLQPNTIYYYRCGGSGSEFSFKTPPLKLPIEFVVVGDLGQTEWTTSTLKHVDSKDYDVFLLPGDLSYADTHHPLWDSFGRLVEPYASRIPWMVTEGNHEIETFPIIQPNGFKAYNARWPMPYKESGSTSNLYYSFDVASTHVIMLGSYTDFDAHSQQYTWLQSDLAKIDRKRTPWVIALLHAPWYNTNEAHQGEGEDMRQAMEELLYEARVDLVFAGHVHAYERFTRIYDNKADSCGPLYVTIGDGGNREGLALR

SEQ ID NO: 132302 - protein, 255 aa, Glycine max
  Coding DNA Sequence Number=SeqID_15524
  Gene Ontology: Mol. function=nucleic acid binding; Cellular component= oxygen evolving complex; Biological process=DNA integration
  Subcellular localization annotation: CTP_CleavageSite=32; ConfidenceScore=5.06e-01
SYAPLVCKLNKSIYGLKQASRSWFNKFRTTLTSQNYTHSKYDYTLFTKGTGSSFIAILIYVDDIVIASPDKTTINSAKIMLQHYFKLKDLGDLKFFLGLELSRSQVGIFMCQRHYTMSILEDIGMLACKPSAVPMEVDLKLNAESGSQLLDPGTYIRLIGRLLYLTILRPDICYNVHKLSQFVSDPRSGHMNAANILLRYLKHTAGQGILFKAKLDTSIHAYVDADWGSCIDSRKSTIGYCIFLGNSLISWKAKK

SEQ ID NO: 132303 - protein, 219 aa, Glycine max
  Coding DNA Sequence Number=SeqID_15525
  Homolog annotation: Hit_ID=Q47522; Match level="QueryCoverage=23%, HitCoverage=62%, E-value=8e-22, Identity=94%"; Hit description=LacZ protein
VLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEYAERTGGASRSLSIEVVAFDVQSSIIGSVALEKRHGAAPLTIKLIDTVDLEGGPVGKPVVPAALMNRPTRGERRFAYWALAECILAYYVGTDEGVSEVLHVAGEKRLH

SEQ ID NO: 132304 - protein, 117 aa, Glycine max
  Coding DNA Sequence Number=SeqID_15526
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGENPMPRKPKGSSARPKGVVDGQQVNIPVLPFVGPEGRKEA

SEQ ID NO: 132305 - protein, 92 aa, Glycine max
  Coding DNA Sequence Number=SeqID_15527
MTHFDGLYLFSSVVYKTKGETKDIELVEEEHARIGADSSSATSNKCENYKEEARNAAQKHKAKRVESVNADVEAFGDHWKVQIALCILKLKH

SEQ ID NO: 132306 - protein, 208 aa, Glycine max
  Coding DNA Sequence Number=SeqID_15528
MGEVEEIQEKMNADMEAIKEKMATMMEAMMSVKKIMEANAIAIAATSVVAKVNPTSPSGLKQMNHPTSNMVGKDLGSMDDPMMCKFKTSTPSRHMVCLPNYTPPNVVYIPNEDPCLGYAAEGQAVGGIPLQNTLEGPQYHPQPQPSRSTAVKTLMTMAGMGKLDHLEERLRAIEGGEDYAFANLKELFLVPNIITPPKFKVLDFDKYK

SEQ ID NO: 132307 - protein, 53 aa, Glycine max
  Coding DNA Sequence Number=SeqID_15529
MTNQYALYTGAKDTSIIHDQKAQKNQQEFKDPVIGPGCPVSEPPPRQSNEAQE

SEQ ID NO: 132308 - protein, 66 aa, Glycine max
  Coding DNA Sequence Number=SeqID_15530
MGACFIGGSFETCQNVPSYVTAMTSSLMLELASSMKSRNLQKARYLVFAKVSNGFQKCISKVLFRD

SEQ ID NO: 132309 - protein, 99 aa, Glycine max
  Coding DNA Sequence Number=SeqID_15531
EVEKRNWHKELTNFSEGSIDVAIVKEFYANLYDPEDKSPKQGTRKSRARGSEAPSTSAPPTSAPSTSSLPPALAAPVLSGPSAQSFPCLCCRACIRASS

SEQ ID NO: 132310 - protein, 275 aa, Glycine max
  Coding DNA Sequence Number=SeqID_15532
  Gene Ontology: Mol. function=sequence-specific DNA binding; Cellular component=intracellular; Biological process=regulation of transcription, DNA-dependent
  Homolog annotation: Hit_ID=Q8U712; Match level="QueryCoverage=71%, HitCoverage=67%, E-value=1e-51, Identity=53%"; Hit description =Transcriptional regulator, AraC family
MVCIIFDGPLIVLVLAHQKDETFGEAARGGDGGSNIGDGVLTDPDKGDAEQAGDDRVGTGRCADIFARDCLEISLQFLLVLLFGCLYQNTLQYRAYGVCARARRHRVSQPDFGGRQQRSAAAGAQSHAAGRAYGQPDEPRRRDIQPLIALRDLRFPDRKQKHVGAVCFQPEFRYAQRGGEGACRDLHAIGGKLAVQRHSTSKSAIMHYTSAFYMQLSLLNFDQRVGSLEEKDCPIERFGRNIMNNLKRRTLFCLLSGAALSAVSFSHATAHDRTS

SEQ ID NO: 132311 - protein, 202 aa, Glycine max
  Coding DNA Sequence Number=SeqID_15533
MTGRLLAGSLTFDNRIMHYIIVRIFLPQSSNLAQASEEDLILMWAFLTGCQIDWAHLVRYRMHKTLRANAPLPYPQLITLFLRHFQIPLDDEPFVQVKRSFTIGVGAVTSFGYRKDRNGQWLKKDALPPQDERTPSPPPQRDDSALMTEVLSELRGLRSYVGERFDSLDTRFAEMDIRLTQLEEDVSYICQSFDLPPPPPPS

SEQ ID NO: 132312 - protein, 167 aa, Glycine max
  Coding DNA Sequence Number=SeqID_15534
MSYGEGLGYSARQRDSNVSMTELVSAEDDTSKKNVCTDNHSGISSRQRDSNVSMTDLVSAEDDVNLRVSTGLLFVLQKAKKNVYTDNHSGISARLRDSNVSMTDLVSALFVLQTSKKNVYTDNHSGISARQRDSNVSMTDLVSAEDDVNLRVSTGLSAAIDEGRRRR

SEQ ID NO: 132313 - protein, 109 aa, Glycine max
  Coding DNA Sequence Number=SeqID_15535
  Gene Ontology: Mol. function=structural constituent of ribosome; Cellular component=ribonucleoprotein complex; Biological process =translation
  Homolog annotation: Hit_ID=P56804; Match level="QueryCoverage=78%, HitCoverage=86%, E-value=5e-32, Identity=77%"; Hit description =Chloroplast 30S ribosomal protein S14
  Pfam annotation: Domain name=Ribosomal_S14; Domain location=45-95; Score=59.1; E_value=1.4e-14; Accession=PF00253.11; Description =Ribosomal protein S14pS29e
MARKSVIQREKKRQKLEQKYHLIRRSSKKEISKVPSLSDKWKIHGKLESLPRNSAPIRLHRRCFSTGRPRANYRDFGLSGHILREMSNLVARKAHNLEVTGSNPVSATF

SEQ ID NO: 132314 - protein, 99 aa, Glycine max
  Coding DNA Sequence Number=SeqID_15536
MLGRHILAERKVEIYHTELDEFKGGLERRNFHKCLTNLADSSIDLALVKEFYTNLYSLEGPSPKQVRNRGHLIRIDADSLNSFLETPVVLAEGESCPPT

SEQ ID NO: 132315 - protein, 86 aa, Glycine max
  Coding DNA Sequence Number=SeqID_15537
  Subcellular localization annotation: CTP_CleavageSite=66; ConfidenceScore=5.43e-01
MRSDCLVQFSILTLFRSPMNGVFVHVFSTFESGAMRSDCLVQFSILTLLRSPMNGVSVHVSSTFELAAMRSDGLVQFSILNLFGAP

SEQ ID NO: 132316 - protein, 92 aa, Glycine max
  Coding DNA Sequence Number=SeqID_15538
  Subcellular localization annotation: CTP_CleavageSite=57; ConfidenceScore=5.25e-01
KQRRRGEESRGVGVKSKARGLVALRPSLVLGATLRVAAGTRLARSLKFMSALSATVLAKRVFRLAPLSGSGLAHCTSLVLALAKLLVLSGTT

SEQ ID NO: 132317 - protein, 80 aa, Glycine max
  Coding DNA Sequence Number=SeqID_15539
  Gene Ontology: Mol. function=electron transporter, transferring electrons within the cyclic electron transport pathway of photosynthesis activity; Cellular component=integral to membrane; Biological process=...
  Gene Ontology: Biological process=photosynthetic electron transport in cytochrome b6/f
  Homolog annotation: Hit_ID=Q6EW21; Match level="QueryCoverage=98%, HitCoverage=61%, E-value=5e-37, Identity=75%"; Hit description =Cytochrome b6-f complex subunit 4
  Subcellular localization annotation: CTP_CleavageSite=39; ConfidenceScore=5.23e-01
MVVATGRRNGFWNLLTFSKKGTVNNPKYHSGNISKGVANGSAGSPIMDGSRTAKPTLQAIVPRITTGKIYKRSLGHAGSP

SEQ ID NO: 132318 - protein, 58 aa, Glycine max
  Coding DNA Sequence Number=SeqID_15540
MTPSQQYHGPIPTPNAPLTKKKRGGIGAEEILIAKHEDGIDHVAHPHDITDTKMNDLH

SEQ ID NO: 132319 - protein, 158 aa, Glycine max
  Coding DNA Sequence Number=SeqID_15541
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=1e-15, Identity=34%"; Hit description= UPI00006A17C9 related cluster
MTDRLNESISCFLIRRVHAFTFRGLHVLAIRGLHALAIVRLHTLTFRGLHVLTFRGLNAPAFVGLHALTFRGLHVLTFRGLHVLVIRGLHVLAIRGLHALTFRGLHTLAFVGLHALTFRGLHFLIFKGQHVLTFRGRHALSYTSSPSEGYTSLPSEDY

SEQ ID NO: 132320 - protein, 431 aa, Glycine max
  Coding DNA Sequence Number=SeqID_15542
  Gene Ontology: Mol. function=transferase activity
  Homolog annotation: Hit_ID=Q1BDB6; Match level="QueryCoverage=99%, HitCoverage=91%, E-value=1e-131, Identity=56%"; Hit description =Glycosyl transferase, family 2
  Pfam annotation: Domain name=Glycos_transf_2; Domain location=82-243; Score=100.4; E_value=5.4e-27; Accession=PF00535.16; Description =Glycosyl transferase
ERLPDGFAVQVDRRVRVLDEGSALLGGSPTRLLRLAPAARTLLSGGRLEVRDATSAQLARTLLDATVAHPRPVGGPGYRDVTVVIPCRDNGFGLRRLLRALRGMRVIVVDDGSTIPIVASDLEGMHCHVEVVRHADSQGPAAARNTGLKLATTDFVAFLDSDVVPRRGWLEALLGHFSDPAVALVAPRIVGLVLSDNAIARYEAVRSSLDLGLREAPVVPYGPVSYVPSAAIVVRRSAIDEIGGFDEALQCGEDVDLCWRLIEAGSRLRYEPVSHVAHDHRLTLREWFARKAFYGKSAAPLSTRHPDKVAPMVISRWTLLVWILAAVGSGMGYLAAVGMAALAAGRVARTLRGVDTPPRDVVRVAAQGVGGAALQIASALCRHYWPLALFAAALSRRSRQVLVVAAIVDGVVDWMKRNDSSASPDDRIGLI

SEQ ID NO: 132321 - protein, 332 aa, Glycine max
  Coding DNA Sequence Number=SeqID_15543
  Gene Ontology: Mol. function=DNA-directed RNA polymerase activity; Cellular component=intracellular; Biological process=regulation of transcription, DNA-dependent
  Homolog annotation: Hit_ID=Q7W3E5; Match level="QueryCoverage=85%, HitCoverage=82%, E-value=2e-92, Identity=60%"; Hit description=LacI family transcriptional regulator
VRAAAGDFLQQQFQPQPPHLVHGRVDGGQADGQGARQRRVVVAHHGHVAAGLQAVLARRAHHAHRQEVVDREDGGGAVRAGQQARAHVAAGVGVERAFDAPCGRDLDAVPGTGREKARRAVAARAGEGFAHHHRDAPVAHGQQVLGRQPAAFEVIAGDGAVVVGMAADQHERHVAPRQFGQQRIGRGAVVAVGVAQDQAVHAPRQRHVDQLALLVGHVLGVGHEGQVAVFGRGLVDTFVDGGQHHVRQARHQHADGAAAARLEAGGVRIGLAELPRQALQRDRAGFVHGAGGYTHEYRPRALGGNLGFTRCRFLRSEHLALRNPNVWVNRLD

SEQ ID NO: 132322 - protein, 84 aa, Glycine max
  Coding DNA Sequence Number=SeqID_15544
SMVEHAWTALGDPFMGLRIRLENGELANSGRRSIRGAQESMVEDAWTALGNQCMGLRIRLEKGELANIARQSIRGAPDSMVEDA

SEQ ID NO: 132323 - protein, 95 aa, Glycine max
  Coding DNA Sequence Number=SeqID_15545
MKNGGKPSRNRLRKRLRSITEASRLGFSSWKQFFSLILSDSQIPGRVERICSALLPLFIGEKREVVAAQLAQASWVASTRRHRLLLEDPGRPKWA

SEQ ID NO: 132324 - protein, 123 aa, Glycine max
  Coding DNA Sequence Number=SeqID_15546
  Gene Ontology: Mol. function=structural constituent of ribosome; Cellular component=ribonucleoprotein complex; Biological process =translation
  Homolog annotation: Hit_ID=Q2MI98; Match level="QueryCoverage=98%, HitCoverage=72%, E-value=4e-50, Identity=71%"; Hit description =Chloroplast 30S ribosomal protein S4
  Pfam annotation: Domain name=Ribosomal_S4; Domain location=2-65; Score=43.2; E_value=8.8e-10; Accession=PF00163.9; Description =Ribosomal protein S4S9 N-terminal domain
  Pfam annotation: Domain name=S4; Domain location=66-113; Score=91.3; E_value=2.9e-24; Accession=PF01479.15; Description=S4 domain
  Pfam module annotation: Pfam domain module=Ribosomal_S4::S4; Domain location=2-65::66-113
  Subcellular localization annotation: CTP_CleavageSite=47; ConfidenceScore=5.01e-01
MSRYRGPRFKKIRRLGSLPGLTSKRPTVKSELRNQSRSKRQLLKYVRIAGKAKGSTGQVLLQLLEMRLDNILFRLGMAATIPQARQLINHRHVLVNGHIVDIPSYRCKPQDIITAKDDKNRKL

SEQ ID NO: 132325 - protein, 56 aa, Glycine max
  Coding DNA Sequence Number=SeqID_15547
MYFFLQPHGGILCEWLIATSVAARAGKVVGSVMRYNNCGVVHILGETQAIKVRGWD

SEQ ID NO: 132326 - protein, 68 aa, Glycine max
  Coding DNA Sequence Number=SeqID_15548
MGTEGVQYLLRALLAFMICVSLSCLGDMGKAYLFLKNGRQKVMRVREECTFFRDYQIMCRQRYVYQYQ

SEQ ID NO: 132327 - protein, 280 aa, Glycine max
  Coding DNA Sequence Number=SeqID_15549
  Homolog annotation: Hit_ID=Q8RYD1; Match level="QueryCoverage=44%, HitCoverage=36%, E-value=2e-15, Identity=33%"; Hit description=Auxin response factor 36
  Pfam annotation: Domain name=B3; Domain location=142-239; Score=18.7; E_value=0.00055; Accession=PF02362.12; Description=B3 DNA binding domain
CALHEKSAHVNGTKEPIDVPPETPPTENTFNAGVESSGVEQFTPDGGVTLAAVPSETANGKRIRNIVSAVKHVHTKRKGRPAKWHVRERTLDWVAALEAEPVSASRSGTYEVYKSNRRPVTDDETRKIESLAKAACTDDSIYVVMKPTHVYKRFFVSIRGTWIGKHISPSSQDVILRMGKGEWIARYSYNNIRNNGGLTGGWKHFSLDSNLEEGDACVFKPAGQINNTFVIDMSIFRVVPETVPLTPMSRGTRTGTRTGTGRRGRKPATMKSIQTQLSSP

SEQ ID NO: 132328 - protein, 60 aa, Glycine max
  Coding DNA Sequence Number=SeqID_15550
  Subcellular localization annotation: CTP_CleavageSite=50; ConfidenceScore=5.46e-01
MDNFFAPFSPWANIIRKATSCWFVSQTKASSSRSGGPVVLLESAMEIATRAPMIGPAITS

SEQ ID NO: 132329 - protein, 127 aa, Glycine max
  Coding DNA Sequence Number=SeqID_15551
MENNDGLWLLMVDVGDGESSWDFRNGFGRKKEEEMTFFLSYTKAKAEVRAHSIHLLKDPNGQIVETFLVKLQTKCREDPTVNEGWTAFFPRQLHAYREFGAKRNVEDSEPFLSLTCRECKEDGESAE

SEQ ID NO: 132330 - protein, 125 aa, Glycine max
  Coding DNA Sequence Number=SeqID_15552
MYNSIITYIGLHYSAHWQMVVILPNENVVIWFCLLHNRPDNYLKGIINSALKGLDDTQQSKSKPAARWIVVKCNRQKGSIEYEYYVMHWMSTIILGNFKNNRAMTNGTREIEGRAKYYLKVKNET

SEQ ID NO: 132331 - protein, 262 aa, Glycine max
  Coding DNA Sequence Number=SeqID_15553
  Gene Ontology: Mol. function=catalytic activity; Biological process =cellular metabolic process
  Homolog annotation: Hit_ID=Q3HLM7; Match level="QueryCoverage=85%, HitCoverage=78%, E-value=5e-27, Identity=58%"; Hit description =Progesterone 5-beta-reductase
MEGAWLRSFFDEKGRHRSNINNSSLTVWLAAHNQVGTPITNPLYPVRYLRPKRRRIKAVIFDRRHSRVLRLLDQKTHGGLKLPSQRCHVEERLRALIPNAPNLRHVSLQTGITSDPSNCSERSRWPMIRPSQRTCHVLTRRISITHMKTSCTWSLMNLVGTLCVYPGICKHEVLAERFGIKEYGFLEGEDLRLSEMMKDKGVVWEEIVKENQLLHTKLEEVGDGWFTDAMLGMEAVLDSMNKAKSMGFFWILGTLRNRFRIG

SEQ ID NO: 132332 - protein, 476 aa, Glycine max
  Coding DNA Sequence Number=SeqID_15554
  Gene Ontology: Mol. function=carbohydrate binding
  Homolog annotation: Hit_ID=Q2QN32; Match level="QueryCoverage=92%, HitCoverage=92%, E-value=1e-155, Identity=62%"; Hit description =Lipase, putative, expressed
  Pfam annotation: Domain name=DUF620; Domain location=181-430; Score =665.4; E_value=4.5e-197; Accession=PF04788.3; Description=Protein of unknown function (DUF620)
  Subcellular localization annotation: CTP_CleavageSite=31; ConfidenceScore=5.19e-01
MERKQGFFSALKDEVVRGLSPARSRAKSPARSASPMSSLLRRRRKHYAPPPELFIARSGSLRPAEALSPLKEGPDGTDDGGHDSTRGEGRWGQWMKGPLARAPSVSSSSSSSSCNNKKSDLRLLLGVLGAPLAPVHVCTTDPFPHLSIKDIPIETSSAQYILQQYIAASGGQRLQNSINNAYAMGKVRMIASEFETANKVTRSRNSSKAAESGGFVLWQMNPDMWYVELALGGSKVHAGCNGRLVWRHTPWLGAHAAKGPVRPLRRALQGLDPRTTASMFINARCIGEKKINEEDCFILKLFADPSTLKARSEGPAEIIRHVLFGYFSQKTGLLVHLEDSHLTRIQNNGGEAVYWETTINSFLDDYRPVEGIMIAHSGRSVVTLFRFGETAMSHTKTRMEEAWTIEEVAFNVPGLSLDCFIPPSELRFASMSEACELPQGQRVKTAVAAAAYHAKVAQLQKSHGSNTNNINWTVDV

SEQ ID NO: 132333 - protein, 56 aa, Glycine max
  Coding DNA Sequence Number=SeqID_15555
MEWGKGNLKKDGKWGPVGIFCFAVGTCWASDLSDANEIWACEKHGNNQACVSFKSN

SEQ ID NO: 132334 - protein, 405 aa, Glycine max
  Coding DNA Sequence Number=SeqID_15556
  Gene Ontology: Mol. function=acyl-CoA binding
  Homolog annotation: Hit_ID=Q4L0H4; Match level="QueryCoverage=26%, HitCoverage=30%, E-value=8e-24, Identity=52%"; Hit description =Membrane acyl-CoA binding protein
  Pfam annotation: Domain name=ACBP; Domain location=257-349; Score =29.6; E_value=2.4e-09; Accession=PF00887.9; Description=Acyl CoA binding protein
MELLMVVDDFFVTASLALLLTFIVLKLVEAMNDTHAAPKRHVVHLEPDHPVSRAKTKVGLISPVQEEIATCAVGAKHGIEKKAAVKSVRPRGKRFTVNPAQSKVKVEPVPPAQSESTIGFVSPVQSAMCVETERKVEEAMVEPELVQLVKTEGTVGFISPIQADTCVGTEDKKEEATVEFDSHVVVESPVKSDTDIVVTEEIAEGNEGTQELDDSAEKRIVESVEEINVEPSVVDSDGKENEDDYDDDWEGIERSELEKEFMAATEFVSGEENRLGGVGSNLRMELYGLYKVATEGLCREPQPMALKLAARAKWNAWQKLGNMNPEVAMEQYISLLSDKFPGWIKDTSAGMSEHETTRPEVSGSDASDLSTTLSHQQMIITERELEQESDSKDRSPLTETDLENN

SEQ ID NO: 132335 - protein, 156 aa, Glycine max
  Coding DNA Sequence Number=SeqID_15557
  Subcellular localization annotation: CTP_CleavageSite=58; ConfidenceScore=5.49e-01
MLGAPSKWLLLLSVSKTCSFSLRLEKRDQPPLALQGSSKMKKSQLKLNPSLSPRRLRRSNTETNLKGLTPTHTLCSQRICTNRSRSYHVSDLDNGLKMTKGRLSSLALSPYMRRKKTSGHVSDSESSFVKKRGSLSPFALSPLSPYVRTTCGHVSD

SEQ ID NO: 132336 - protein, 604 aa, Glycine max
  Coding DNA Sequence Number=SeqID_15558
  Gene Ontology: Mol. function=DNA binding; Biological process =regulation of transcription, DNA-dependent
  Homolog annotation: Hit_ID=Q1S2L8; Match level="QueryCoverage=81%, HitCoverage=98%, E-value=0.0, Identity=53%"; Hit description =Transcriptional factor B3; Cupredoxin; TonB box, N-terminal
  Pfam annotation: Domain name=B3; Domain location=285-384; Score=41.6; E_value=2.6e-09; Accession=PF02362.12; Description=B3 DNA binding domain
  Pfam annotation: Domain name=B3; Domain location=47-140; Score=54.8; E_value=2.8e-13; Accession=PF02362.12; Description=B3 DNA binding domain
  Pfam module annotation: Pfam domain module=B3::B3; Domain location =285-384::47-140
MRPKNENEREMSFGSTKARLHRFGQTSSTLLHETQPQPKLNVRKPHFYEVYSSAFSSHRLRLPDGFVCYMEGRAYGSVSLTGPSGNIWTVQLIKQDNDLFFHHGWSTFVVDHRLECGELLVFRYEGHLHFTVQIFDKDACEKEAAFHSECSQSSSDFDNIKGQKRDRKENSSLHIVVDGVPKKMRGSTNENQELELGVGKELLLYDVVRPISMFRENEETSKTCSANDVPVPFHMENSNEDEEADILYRSGNDDHHYILSGVSLSNVSAHDEKKVAQSFISSFPYFVRIMKSFNVSGSYTLNIPYQFSMAHLPNCKIKIILHNLKGEHWTVNSVPTTRVHTSHTLCGGWMAFIRGNNIKVGDICIFELVRECELRVRIAEVGKDGRDCQVGNVAMTRPSAGHAVSSKCMSMNPKVNSKCIRKVDLSDKKWSKIGQETILSIDLKKSSRASNTSKKMGLCPQSKAAHKKLAAPRRHRVEDELSSQAKAGLRMLFALDEQRVAQAFSSPFPSFVKIMKKFNVSGSYTLKIKYFKDLIYVKIVTTTTIIAGTTTIMIVIMTTVIVTYMTVTPTIAITVMTTVVFAAVITVIATNLTATIVAFTAARQ

SEQ ID NO: 132337 - protein, 50 aa, Glycine max
  Coding DNA Sequence Number=SeqID_15559
MREGSNKVSSSKRQRWVPARAEVSDGNYTALLSSLRFAKLVRIKVLIGKE

SEQ ID NO: 132338 - protein, 280 aa, Glycine max
  Coding DNA Sequence Number=SeqID_15560
MNGSAMCSEGKSDLWPFLHSTCMTLIPIRISGSASLVAYRARNSYAHIATTLISEDAIELLPEKCYHGRMFRKRACPIDSLSLRLSILEKVLRSLLERKILKDQLFGLLKANIKASAVVKFPLELERDLSNNATLNRTIPDWRTRPSFERFWFEILARVEGNTLKPLLIKKVMFVDSSVDLVICESSPILVKYYSCTHDWSCSRKYLRSTRLRQEKGLRTIGRFELAYGRVEAKAARFLDLAQFLTKLHKISSTSSNEDNRSKEQLCACKVYVAGHLALG

SEQ ID NO: 132339 - protein, 107 aa, Glycine max
  Coding DNA Sequence Number=SeqID_15561
  Gene Ontology: Mol. function=transmembrane receptor activity; Cellular component=membrane; Biological process=defense response
  Homolog annotation: Hit_ID=Q2HS00; Match level="QueryCoverage=85%, HitCoverage=10%, E-value=5e-15, Identity=63%"; Hit description=TIR
MDKQQRTTLEEKTLDRRNFRGHLYKALKDEKVNTYIDDQLKKGDEISSKPSKIIQDSGIPESPRTDCNTNILQHRFIPCEEACSLEATSRPLQNMREILGATTGKML

SEQ ID NO: 132340 - protein, 129 aa, Glycine max
  Coding DNA Sequence Number=SeqID_15562
MAKLRDTVRLMMKGVISLPIPQHDTCPTLPRKVELMMGSGRSRRRLHSERAIMTPFQENWLRQEKGLRTIGRFELAYGRVEVKAARFLDLAQFLTKLHKISSTSSNEDNRSKEQLCACKVYVAGHLALG

SEQ ID NO: 132341 - protein, 194 aa, Glycine max
  Coding DNA Sequence Number=SeqID_15563
  Gene Ontology: Mol. function=transporter activity; Cellular component= membrane; Biological process=transport
  Homolog annotation: Hit_ID=Q1S2K6; Match level="QueryCoverage=99%, HitCoverage=29%, E-value=3e-72, Identity=77%"; Hit description =Xanthine/uracil/vitamin C permease
MWFYDLLLYFWYYIPPETRKFGAFFASIPLPIFAAIYCVLFGIVAATGISFIQFANTNSIRNIYVLGLTLFLAISIPQYFVMNTAPDGHGPVRTGGGWKFRQYLRCNLPVPNVKNEYGSTWMFNDILNTIFSSAPTVAIIVGTLVDNTLEGKQTAVDRGLPWWGPFQNRKGDVRNDEFYRLPLRINEYMPTRFL

SEQ ID NO: 132342 - protein, 572 aa, Glycine max
  Coding DNA Sequence Number=SeqID_15564
  Gene Ontology: Mol. function=protein binding; Cellular component =intracellular; Biological process=defense response
  Homolog annotation: Hit_ID=Q1S2K5; Match level="QueryCoverage=77%, HitCoverage=57%, E-value=1e-158, Identity=67%"; Hit description =Disease resistance protein; AAA ATPase
  Pfam annotation: Domain name=NB-ARC; Domain location=168-497; Score =48.9; E_value=2.1e-13; Accession=PF00931.13; Description=NB-ARC domain
MVLTEFFHAEISSELWKMLVSISRKALRCKSSAKSLISYVHELLPTIEEIKYSGVELPAPRQSQVDRLSEILRSGVELSHQALSSSRWNVYRNFQLAKKMEKLEKHVTRFLQVPMQAHILADVNHVRFEMAERFDRVEAANQRMEKFIGEMKIGVNGGGWVEEAVRSMQEDETWVEGCNGNNNGFGVGLEFGKNKVMEMVFTRSDVSVVGIWGIGGSGKTTLAREVCRDDQLNQYPQDCNQLEMVKNAVVNVFFRTLGEIIFTSWDDESCYFKERILFLTVSQSPNLEQLRARIWGHVMGNQGLNGTYAVPQWMPQFECKVETQVLVVLDDVWSLPVLEQLVWKIPGCKFLVVSRFNFPTIFNATYRVELLGEHDALSLFCHHAFGQKSIPMGANVSLVKQVVAECGRLPLALKVIGASLRDQNEMFWLSVKSRLSQGQSIGESYEIHLIDRMAISTNYLPEKIKECFLDLCSFPEDRKIPLEVLINMWVEIHDINETEAYAIVVELSNKNLLTLVKEARAGGMYSSCFEISVTQHDILRDLVLHLCNRGSIHQHRRLVMAKRKENGLLPKE

SEQ ID NO: 132343 - protein, 48 aa, Glycine max
  Coding DNA Sequence Number=SeqID_15565
MGFLPPIWMIEVVVGPSRGSLSSFVGVESYNKGKHDNSGISASRLFSP

SEQ ID NO: 132344 - protein, 120 aa, Glycine max
  Coding DNA Sequence Number=SeqID_15566
  Gene Ontology: Mol. function=protein-tyrosine kinase activity; Cellular component=integral to membrane; Biological process=protein amino acid phosphorylation
  Homolog annotation: Hit_ID=Q9FVN2; Match level="QueryCoverage=79%, HitCoverage=15%, E-value=1e-22, Identity=58%"; Hit description=Dual -specific kinase DSK1
MQVRMKIKVVTGTPSGAVAAEARWSGSHWVILDKKLKQEVKHCMDELNCSIVVMNGSQAKILRLNLGSNSNELQTPFFSATSSPGIEIEKLKSRRLKHSTPVSSPEEAGTSATRNIGVNS

SEQ ID NO: 132345 - protein, 145 aa, Glycine max
  Coding DNA Sequence Number=SeqID_15567
  Gene Ontology: Mol. function=protein serine/threonine kinase activity; Cellular component=integral to membrane; Biological process=protein amino acid phosphorylation
  Homolog annotation: Hit_ID=Q9C890; Match level="QueryCoverage=57%, HitCoverage=13%, E-value=7e-19, Identity=50%"; Hit description =Protein kinase, putative; 86372-89112
MLRDESVGSRSARHSASTATVSNKVLVAVKAEKVISNTALAWALTHVVHSSDSITLLAIYSPHKTGRRFWTFSRLAGDCTNGPAGKLPERISDISESCAQMVLQLHNQIEQVLAKTRGLKLNKYIRGDAIASKYRSINIKKLINI

SEQ ID NO: 132346 - protein, 203 aa, Glycine max
  Coding DNA Sequence Number=SeqID_15568
  Gene Ontology: Mol. function=single-stranded DNA binding
  Homolog annotation: Hit_ID=Q10GW0; Match level="QueryCoverage=30%, HitCoverage=43%, E-value=4e-15, Identity=59%"; Hit description =Single-strand binding protein family protein, expressed
MERVVGGEERFPIPLLFSFPFSPQQQRFLFSTHNRHSFDEAVPGCSAVYQHVLKFQRPPTIRWSPHLENTASFIGTVAREPTRVNSTTGKFGVYTVLKLEVKEFEFVAQSSGYLGDKKLESVEVFFSNPNEWWDQRKSKRNPKQPDFKHKDTGEALWLSEYDPPWVKRQLQLFDSKIAGGSAVCGGSGDVGLIGPRQEPTTDP

SEQ ID NO: 132347 - protein, 109 aa, Glycine max
  Coding DNA Sequence Number=SeqID_15569
MAGSNSSSSTSNNMEGNCSSYSSDEEDLTMGSEGSEEVEGSEGESEEGLMEENKEESEGESQEGRTEDDSKEESEVDSEEEESEDDHVSANMSMLDGETGGESESEDDC

SEQ ID NO: 132348 - protein, 169 aa, Glycine max
  Coding DNA Sequence Number=SeqID_15570
  Homolog annotation: Hit_ID=Q9LTT4; Match level="QueryCoverage=94%, HitCoverage=40%, E-value=7e-23, Identity=36%"; Hit description=WD domain protein-like
MSMLDGETGGESESKDDDTLRSGIDTKIITAQEARDLNDVQGIKWAAEKKDRTDFRRARLRRMGAKHITLMPTLVWSTSKHDVYMAGNFKIIHWSGLSSKMTDVLDTAEHVTSSEDYPGNYEIGFHQSQINTVSVRFNLLIVGGNFGQLICKRIDRPDVSFCYKMSCRR

SEQ ID NO: 132349 - protein, 111 aa, Glycine max
  Coding DNA Sequence Number=SeqID_15571
MICSEAGPSSNSLGNSHEDNSFDDNKLDNNEMLKMWFLKLYETKFHLLFVLILINISWYLEAILIVFLDKEKVRVTRHNTGRTCSMIRSLTDSRIAVDNNSDDIVFFHWMR

SEQ ID NO: 132350 - protein, 90 aa, Glycine max
  Coding DNA Sequence Number=SeqID_15572
MMLYGGGVGGKIWRLERSRGMGMNNWFWWKSQFGNFTVKSTYYVLFDYKFGGHRVEDLALWKNENCFLWRLMINRLPSTDNFLRRNIEVG

SEQ ID NO: 132351 - protein, 47 aa, Glycine max
  Coding DNA Sequence Number=SeqID_15573
MQQSKCDTNEALMDEMKLQKIKVPYGMQVLFDVVRHGVVRMSPKRQN

SEQ ID NO: 132352 - protein, 131 aa, Glycine max
  Coding DNA Sequence Number=SeqID_15574
MALGSSLWQSPPPEPCSWAAEAPPPLEGEGWDPGQATYVSNSSMLMMDDKRAGSWNGDGARSVKIRGVGAMEEEGVVVSSGAEVVGTSDLLPLAFLGPLNVTVGSSRFQHFFLIYAKLMAGLKLSRDLESD

SEQ ID NO: 132353 - protein, 48 aa, Glycine max
  Coding DNA Sequence Number=SeqID_15575
MENHSNLNTRVNLCLMEVSLPFIAVPVEMFIAFVGAADRAVGNEEAHE

SEQ ID NO: 132354 - protein, 587 aa, Glycine max
  Coding DNA Sequence Number=SeqID_15576
  Homolog annotation: Hit_ID=Q10Q83; Match level="QueryCoverage=76%, HitCoverage=90%, E-value=5e-61, Identity=38%"; Hit description =Expressed protein
  Pfam annotation: Domain name=DUF566; Domain location=216-585; Score =269.8; E_value=5.3e-78; Accession=PF04484.3; Description=Family of unknown function (DUF566)
  Subcellular localization annotation: CTP_CleavageSite=77; ConfidenceScore=5.67e-01
MVAAISTAINPKRAQTPTPRRTPLLPSESDNALAPPRRPKAREVTSRYMSSSSSSSSSVSSPPRRCQSPLVVTRTVNSAKTKQTPTPTPTPTPFAKRSQSAERRRQGTPRPTTEAPAAQKVLFTSTRSLSVSFQGESFPIQVRTTKPPPPSQSFRKSTPERRKAATTTTPTPVRNGNSDHTENARSLDRHRWPAKSQYADSTARKQTDAPASVARSLQNVMADVRGSLDATTLRSESYKTNGSEFQHEAESIASDTESVTSGSSSGEGIRGSRGLVVPARFWQEHNNRLRRQTETPSSRNGVIGNKGTVSTPSPRLLVQKKTALDCPVSSPRGVLNSRALQGSPIRSAVRPASPSKLATPSLWSPSRGVSPSRAQNGVVSGLSSRFGGGSEPSVLSFAVDVSRGKVAENRIFDAHLLRLFHNRLLQWRFVNARADAALSAQTLNAEKSLYDAWIAMSNLRESVRAKRAEFQLLKQQFKLISILKDQMVYLEDWATLDRLYSSSLSGATEALRASTLRLPVVGGAKTDLLNLKDAISSAMDVMQAMASSICLLSPKMLNLNYTCDEDMSVAFQSRTKVVMDVMEKIRK

SEQ ID NO: 132355 - protein, 92 aa, Glycine max
  Coding DNA Sequence Number=SeqID_15577
MESSSREKSIQIGADTKEECVIKNVLGFNWCHYLEQGGTEGVAEGVASGVQIGKKMKRYQLPTIEKKVEKGIGLAATHAKADVSINKAKGPT

SEQ ID NO: 132356 - protein, 148 aa, Glycine max
  Coding DNA Sequence Number=SeqID_15578
  Homolog annotation: Hit_ID=P0ACY9; Match level="QueryCoverage=64%, HitCoverage=100%, E-value=1e-18, Identity=50%"; Hit description =Hypothetical protein yebG
  Pfam annotation: Domain name=YebG; Domain location=1-75; Score=127.7; E_value=3.2e-35; Accession=PF07130.2; Description=YebG protein
MAVETGYVVVRKGEEKMTFANAKDADAWDKMLDMADAFTDWLQQHQPAMDEAQAEALGMLLAEQKDAVQHILRTSKLPDAVKDSGETAADDSDTAAPEKEKKPPEEQRVRFALLLNPGQPLCWPGNRAKDQCVKREKAIKFPDCAPIE

SEQ ID NO: 132357 - protein, 126 aa, Glycine max
  Coding DNA Sequence Number=SeqID_15579
MAELRDSEGFVGNNGSKEEEEGFQKQRRRKRDTCPTLPRKVELMMGNGDRGDGYTVNVRSVLQSKSLVRTCSNRKERRVFKKEFPGSKEYLRSTKLRQERGLRAIGQFELVYGRVEVEAARVLDLA

SEQ ID NO: 132358 - protein, 110 aa, Glycine max
  Coding DNA Sequence Number=SeqID_15580
MAQLLHLRFPKHRREPKGEMTVQPNVYMPFPMAPNFKSIFSLFCFVYGRVLRPEALKTPVGDGCEDFKGEDSSLGMATFAVASNNSSTRQFARSLAYKLASGPSKKGPGH

SEQ ID NO: 132359 - protein, 79 aa, Glycine max
  Coding DNA Sequence Number=SeqID_15581
MVLMLVLLLLCHIVWLNKNHEPLQPPNKRALVKVHVLVVASEERRGWLKKLEEIKEGKGHLMISEMREKANRLCLKGKR

SEQ ID NO: 132360 - protein, 100 aa, Glycine max
  Coding DNA Sequence Number=SeqID_15582
  Gene Ontology: Mol. function=kinase activity; Cellular component =nucleus; Biological process=regulation of progression through cell cycle
  Homolog annotation: Hit_ID=Q9M4K9; Match level="QueryCoverage=99%, HitCoverage=29%, E-value=4e-30, Identity=66%"; Hit description =Cyclin A3.1
  Pfam annotation: Domain name=Cyclin_N; Domain location=1-98; Score =53.9; E_value=5.3e-13; Accession=PF00134.13; Description=Cyclin, N -terminal domain
MQVDPSMRPLPDYVQNVQREVSADMRCVLVEVAEEYEHVSVTLYLCVAYADRFLSLNAVSTKGLQLLGVAAMLIASKYEEIKAPAVGKFCYIMDYTYSKE

SEQ ID NO: 132361 - protein, 50 aa, Glycine max
  Coding DNA Sequence Number=SeqID_15583
MVQKQHCRSCQKMELIKLREKLEAYWNSCSEWKGVAVQGYCILFRLAPDS

SEQ ID NO: 132362 - protein, 98 aa, Glycine max
  Coding DNA Sequence Number=SeqID_15584
MSAEKYQSGLYNDRCQEMFGRRHQLGHCVSSRVNDEDMFKSKGKDPLEGLGGPMTRARARKAKEALQQVLSILFEYKPKFQGEKSKVVSCIMAQMEED

SEQ ID NO: 132363 - protein, 481 aa, Glycine max
  Coding DNA Sequence Number=SeqID_15585
  Gene Ontology: Mol. function=protein-tyrosine kinase activity; Cellular component=integral to membrane; Biological process=protein amino acid phosphorylation
  Homolog annotation: Hit_ID=Q9FVN2; Match level="QueryCoverage=89%, HitCoverage=69%, E-value=1e-123, Identity=55%"; Hit description=Dual- specific kinase DSK1
  Pfam annotation: Domain name=Pkinase; Domain location=131-410; Score =108.4; E_value=2.1e-29; Accession=PF00069.15; Description=Protein kinase domain
  Pfam annotation: Domain name=Pkinase_Tyr; Domain location=131-410; Score=105.4; E_value=1.7e-28; Accession=PF07714.7; Description =Protein tyrosine kinase
  Pfam module annotation: Pfam domain module=Pkinase::Pkinase_Tyr; Domain location=131-410::131-410
  Subcellular localization annotation: CTP_CleavageSite=58; ConfidenceScore=5.41e-01
PPTSWTRPTSSVASDNKTIFWTPQNHVVDKKFQKTKNNSVIQRTKSPTSKTLLENFIRCDQETRTNELGFDQAKSRSYVPNWGIRDNSIPLGRTTSIPPPLCSQCQNKAPVFGKPPKRFSYKELEEATDMFSDESFLAEGGFGVVHKGILKDGQVVAVKQLKFGGSQADLDFCREVRVLSCAQHRNVVLLIGFCIESNLRILVYEYICNGSLDLYLQADESMPLDWNSRLKIAIGTARGLRYLHEDCRVGCIVHRDFRPKNILLTHDFEPLVADFGLARWHSEWNIDTEDRVIGSSGYLAPEYLDAGNLTYKVDVYAFGIVLLELITGRRISELEQFNGQYSYLSEWFHPIRILEPSHILQNVRSLKPCFDSEESLEFNLQLQAMARAASLCLRVDPDARPPMSKILRVLEGGDPVRPMGLDINSVGNTSGHLRGLKSHTPPKGSIIHLKLHRIYCWQYRNSRTLIETFRQAQHLVASGKN

SEQ ID NO: 132364 - protein, 56 aa, Glycine max
  Coding DNA Sequence Number=SeqID_15586
NPSTEAEFPTWLAVSVENGDPNLIGHFLSRLVWNRQARTKRNLQVTRRGIRGVAHY

SEQ ID NO: 132365 - protein, 223 aa, Glycine max
  Coding DNA Sequence Number=SeqID_15587
  Gene Ontology: Mol. function=ATP binding; Cellular component =contractile ring; Biological process=electron transport
  Pfam annotation: Domain name=WD40; Domain location=137-173; Score =29.2; E_value=1.4e-05; Accession=PF00400.22; Description=WD domain, G-beta repeat
  Pfam annotation: Domain name=WD40; Domain location=179-223; Score =7.9; E_value=4.4; Accession=PF00400.22; Description=WD domain, G -beta repeat
  Pfam annotation: Domain name=WD40; Domain location=94-132; Score=9.2; E_value=3.1; Accession=PF00400.22; Description=WD domain, G-beta repeat
  Pfam module annotation: Pfam domain module=WD40::WD40::WD40; Domain location=137-173::179-223::94-132
  Subcellular localization annotation: CTP_CleavageSite=18; ConfidenceScore=5.11e-01
DSSIVVVLSGSTTQNSVMDQTLRCRFVFEPFRRQNLFILRVVGQDNQGVEDFGLQVLGVHPRARRRGELRRVRGRGRDVFRLGGWHRQGKGLKHAAVKTLLKQEYAVTALAVGEAGSMVYCGASDGLVNCWGSGKNYAHGGVLKGHKLAVLCLAAAGTLVFSGSADKTLCVWKREGVIHTCVSVLTGHNGPLKCLAVEENRESGEKGEQDRRWVLYSGSLDKS

SEQ ID NO: 132366 - protein, 70 aa, Glycine max
  Coding DNA Sequence Number=SeqID_15588
MSEIEEVQEQMKADMEAMKEKMTTLMEAMMSMRKMMEVNTDTVVSASTATEVDQTHPSSLNQVNRPASDM

SEQ ID NO: 132367 - protein, 71 aa, Glycine max
  Coding DNA Sequence Number=SeqID_15589
STKAGLLLLCTLHRRGNQTYVVLFKGESSDYFYLEGGHFKALDLKNDLFYLARKRLNDRLKLVKTEERNRN

SEQ ID NO: 132368 - protein, 248 aa, Glycine max
  Coding DNA Sequence Number=SeqID_15590
  Gene Ontology: Mol. function=DNA binding; Biological process =regulation of transcription
  Homolog annotation: Hit_ID=Q2PF88; Match level="QueryCoverage=83%, HitCoverage=42%, E-value=1e-32, Identity=43%"; Hit description =KANADI-like transcription factor FEATHERED
  Pfam annotation: Domain name=Myb_DNA-binding; Domain location=56-107; Score=41.3; E_value=3.3e-09; Accession=PF00249.21; Description=Myb -like DNA-binding domain
  Subcellular localization annotation: CTP_CleavageSite=40; ConfidenceScore=5.37e-01
IEVRIRNCGFESAPSSSTRCSKKLHSPPPPTSHLWPRFKRSARVVHGVKRSVRAPRMRWTTTLHAHFVHAVQLLGGHERATPKSVLELMNVKDLTLAHVKSHLQMYRTVKSTDKGITAAGHGQTGIGLMNPRPGINVHLHALSPICDTPNLPDPIQSSHRTPWQSSIETKTNNRRQEEPEIGLTYSHLKGNNNNNETTVDGHNNYGGLDSTPLSRSEEAMLDLEFTLGRPNWQKDHTESSRELTLLKC

SEQ ID NO: 132369 - protein, 249 aa, Glycine max
  Coding DNA Sequence Number=SeqID_15591
  Gene Ontology: Mol. function=RNA-directed DNA polymerase activity; Cellular component=chromatin; Biological process=chromatin assembly or disassembly
MTSNDQFTSWPIFLQALQTRFALSQYKDPTGSLFKLTQKGSVEQYLSEFEELVNHVVGLPPSFLLSCFVSGLSPDIRREVQAHQPLTLAQASALARLQEDCPPPPRQRPSPAPTLGPPRHTLLPSLLASPPRPLPSQPNPPTPTFKRGLYFNCDERYHRGHRCALRVFLLIAEDKDSSDPALPLINPTDPNPDSTLAPDPYLTQISLNSLAGHLAPEMLRLVGVTSGQAVLLLVDGGSTHNFIQQHLVN

SEQ ID NO: 132370 - protein, 360 aa, Glycine max
  Coding DNA Sequence Number=SeqID_15592
  Gene Ontology: Mol. function=RNA-directed DNA polymerase activity; Cellular component=chromatin; Biological process=chromatin assembly or disassembly
MLQKGLIQPNTSSFSSSVLLVKNHDGSWRFYVDYRALNAITIKDRFPIPTIDELLDELGSARCFSKLDLLQGYHQIRMHEANTLKTAFRTHHGHYEFKVMSFGLCNTPSSFQATMDMIFQLYLRHFIIIFFDDILIYSGSPEDHLHHLATTFQVEYLGQLVSHKWVEPLALKVAAIQQWPTPHSIKVVRSFLGLAKFYCRFICGYATIPALMAFDELKHALSTAPVLALPNFKLPFTVETDASGVGMRTVLSQKVHPIIFFSKPFPPKLMRTSTCVRELAAITTAVKKWRLKELLNQVIQTPEQHMYLAHLMGYDYDIQFCSGSHNQAELRRQLDDHPHYQRHLQEVLENSTKHPGFCVS

SEQ ID NO: 132371 - protein, 461 aa, Glycine max
  Coding DNA Sequence Number=SeqID_15593
  Gene Ontology: Mol. function=RNA-directed DNA polymerase activity; Cellular component=chromatin; Biological process=chromatin assembly or disassembly
  Pfam annotation: Domain name=Chromo; Domain location=342-388; Score =11.0; E_value=0.048; Accession=PF00385.14; Description='chromo' (CHRromatin Organisation MOdifier
  Pfam annotation: Domain name=rve; Domain location=105-222; Score =10.5; E_value=0.00079; Accession=PF00665.16; Description=Integrase core domain
  Pfam module annotation: Pfam domain module=Chromo::rve; Domain location=342-388::105-222
MENFVWPGLLDDVAQFVASCVECQVTKYEMKKAAGLLCPLSVPHRPWEDLSLDFIIGLPAYQGNKNFVWPGLLDDVAQFVANCVECQVTKYETKKAAGLLCPLSVPHRPWEDLSLDFIIGLPAYQGVHLDMLPPSHTALTIASLFLDIVVKLHGLPRSLVSDRGPLFVSRFWQELFRAIGTQLQMSSAYHPQTWGKLLPWVKLSHNTSWNGGMGTTPYEIMYGQKPFNFLEYVAGTSKVNDVEEILTDREDTFKIIRKKLLKAQATMKQQANKKCRKLAKRYYGPFCIQERVDTMAYRLQLPEEAQIHPVFHYSLLKPFHGSLKGIEATALPPHFANNQPLICPLAILDYRRASPTDPWEVLVQWQGLAPDKTSWEDWSQLCSDYHLEDKVSLQGPRDNNRDNSHKIKNRGATNRKAQKKTHQTSIPQRLCVRKWTKLPAPEDLAWMVLSILRGDALTNLA

SEQ ID NO: 132372 - protein, 215 aa, Glycine max
  Coding DNA Sequence Number=SeqID_15594
  Homolog annotation: Hit_ID=Q47522; Match level="QueryCoverage=28%, HitCoverage=82%, E-value=1e-21, Identity=76%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLFKRLFANGHDAKSLDGMQMPEKARNLRLGLASDVMNSFGNLSTNHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 132373 - protein, 56 aa, Glycine max
  Coding DNA Sequence Number=SeqID_15595
MENWRTALHNNFAGLQTRSGEWRIGGQRYAITSRGSRLEGGGHMNSARQLHSWVSE

SEQ ID NO: 132374 - protein, 164 aa, Glycine max
  Coding DNA Sequence Number=SeqID_15596
  Pfam annotation: Domain name=B_lectin; Domain location=64-154; Score=- 4.4; E_value=0.0059; Accession=PF01453.15; Description=D-mannose binding lectin
  Subcellular localization annotation: CTP_CleavageSite=44; ConfidenceScore=5.18e-01
MCLFILILILILILHSPTCSSTIILQGNATLQSPNNTFRLGLFSFSPNSSFYLAIRHTSLPFPNTIWLANRLHPSPSQTASSLQLTQTGQLLLTHSNTTLWTTTISNIHPSNFSSLSLKLLDSGNLILTAPNGVVLLAELRFPHRHVAPRHEPYSPQLSSLLAN

SEQ ID NO: 132375 - protein, 181 aa, Glycine max
  Coding DNA Sequence Number=SeqID_15597
  Gene Ontology: Mol. function=zinc ion binding; Biological process =ubiquitin cycle
  Homolog annotation: Hit_ID=Q9FN65; Match level="QueryCoverage=90%, HitCoverage=80%, E-value=7e-33, Identity=42%"; Hit description =Arabidopsis thaliana genomic DNA, chromosome 5, P1 clone:MYC6
  Pfam annotation: Domain name=zf-C3HC4; Domain location=130-170; Score= 38.1; E_value=3e-08; Accession=PF00097.15; Description=Zinc finger, C3HC4 type (RING finger)
  Pfam annotation: Domain name=zf-MIZ; Domain location=130-173; Score= -13.2; E_value=0.068; Accession=PF02891.10; Description=MIZ zinc finger
  Pfam module annotation: Pfam domain module=zf-C3HC4::zf-MIZ; Domain location=130-170::130-173
MMRYLKYSCFQCPPTLEEHESLTSNDGTATSLTTGLLVGLNLETSTPDTYHPPPAPLPYDMVLGGPASTDSESGRETVSGSSFETLITCKDPEESDCKIKANSAPISPSKAGLSKSKEFHALVTEEEDGCPICLEEYDVENPKTLTKCEHHFHLSCILEWMERSDSCPICDQVWLSASIPS

SEQ ID NO: 132376 - protein, 325 aa, Glycine max
  Coding DNA Sequence Number=SeqID_15598
  Gene Ontology: Mol. function=metal ion binding; Cellular component =intracellular; Biological process=metabolic process
  Homolog annotation: Hit_ID=Q6ETD1; Match level="QueryCoverage=98%, HitCoverage=56%, E-value=7e-68, Identity=34%"; Hit description =Putative pentatricopeptide (PPR) repeat-containing protein-like protein
  Pfam annotation: Domain name=PPR; Domain location=108-142; Score =48.1; E_value=2.9e-11; Accession=PF01535.11; Description=PPR repeat
  Pfam annotation: Domain name=PPR; Domain location=143-177; Score=2.7; E_value=3.6; Accession=PF01535.11; Description=PPR repeat
  Pfam annotation: Domain name=PPR; Domain location=179-212; Score=9.1; E_value=0.63; Accession=PF01535.11; Description=PPR repeat
  Pfam annotation: Domain name=PPR; Domain location=7-41; Score=42.7; E_ value=1.2e-09; Accession=PF01535.11; Description=PPR repeat
  Pfam module annotation: Pfam domain module=PPR::PPR::PPR::PPR; Domain location=108-142::143-177::179-212::7-41
MVIRNVVAWNTIIVGYGNRREGNEVMKLLREMLREGFSPDELTISSTISLCGYVSAITETMQAHAFAVKSSFQEFLSVANSLISAYSKCGSITSACKCFRLTREPDLVSWTSLINAYAFHGLAKEATEVFEKMLSCGIIPDQISFLGVLSACSHCGLVTKGLHYFNLMTSVYKIVPDSGHYTCLVDLLGRYGLINEAFEFLRSMPMEAESNTLGAFVASCNLHANIGLAKWAAEKLFTIEPEKNVNYAVMSNIYASHRHWSDVERVRRMMGNKCDARVPGCSWIEITNQVHSFVSNDKIHPKALEMHATLKMLLWPMKEKSGMNS

SEQ ID NO: 132377 - protein, 590 aa, Glycine max
  Coding DNA Sequence Number=SeqID_15599
  Homolog annotation: Hit_ID=Q4RSL6; Match level="QueryCoverage=26%, HitCoverage=21%, E-value=8e-08, Identity=26%"; Hit description =Chromosome 12 SCAF14999, whole genome shotgun sequence
MDVLTCILMFSLVTVDIPPWFSAVSISLNSDVDLDVSRVERVPKSSLPLICFRDGSPPLPDALNTSLKDSAVKGINGLDVEQCFPMEKNITMKLTNEQISPGAWYIGLFNGIGASRTQSKMIIRGSAYSFSANISVEACSNSMMRGELCNSTVYPLSCTASDVYNSMKATVKKPMMENAMTCKSNLEMFCSQEGVPEFYSLDITNMAEELTIMAANVTFNTTALNNTFSANDVSLMCFARHGAIPSETLHDYSGDLNKAPLVIRYPLIGRLYISILPVNVTKMLGGTQGGNLKVCYSMESQVLQCPLGKAGSNCTMDSYTLQTVLRRGATPFESYFLPVAVGEGASSANFPLEPLLNKSSNVGETGDIWTYFTLDIPRGAAGRNIHIRLSADVKISYEVYARFGGLPSLHSWDYYYANRTRKSDQSVFFMLYDSSDDEIDFYIIYAREGTWGIGLRHLYIGSDSLKAQTVMSISLEGCPKQCSSHGDCKYSFDASGLTSYSFCSCDRNHGGFDCSIEIVSHKGHILQSIFLIGSNAAAILPAYWSLRQKAFAEWILFTSSGIASGLYHACDVGTWCALNFNVLQVTALFL

SEQ ID NO: 132378 - protein, 454 aa, Glycine max
  Coding DNA Sequence Number=SeqID_15600
  Gene Ontology: Mol. function=binding
  Homolog annotation: Hit_ID=Q338F8; Match level="QueryCoverage=61%, HitCoverage=83%, E-value=9e-73, Identity=53%"; Hit description =Expressed protein
  Pfam annotation: Domain name=DUF383; Domain location=92-271; Score =253.8; E_value=3.6e-73; Accession=PF04063.4; Description=Domain of unknown function (DUF383)
MATEMEELVSFLSSTSPQITKAAVDIVRGLTGSMEGLQSLANYSNALLPALSRLLTLPKEVSEAAAEALVNLSQNSSLAEAMVGIGLVKTTMDVLYKPECSIARLLVMLLVNLTQLEAGAASLLQTEDEKVHGLYVMKLVRSFCRTSHESNDDAFEHVGSILVNISKQRKGRELLLDPKRGLLKQIIRQFDSNSSLRKKGVSGTIRNCCFEAENQLQNLLLVSEFLWPALLLPVASNKIYREQDRLKMPLELGTALSIEREPVNDPEIRIQALEAIYLIILQFLKYNFKISLKVCLCGGDDNADVISNNSYRDISDCRGDGGSGGSGGGGGHDNVVVAANGGDVGVVGGDGGGISCEGFKSLWGQLSPLCLKWICPYGGGDEGGISGGDGGVNSIGGNDDNSAGHGVVVVANGCSVVVTMTMVVMVTVLAVAVVVATKGVIIKCGKCLFFYTKL

SEQ ID NO: 132379 - protein, 607 aa, Glycine max
  Coding DNA Sequence Number=SeqID_15601
  Gene Ontology: Mol. function=catalytic activity; Cellular component =intracellular; Biological process=metabolic process
  Homolog annotation: Hit_ID=Q1SCU6; Match level="QueryCoverage=68%, HitCoverage=98%, E-value=1e-100, Identity=48%"; Hit description =Tetratricopeptide-like helical
  Pfam annotation: Domain name=PPR; Domain location=146-180; Score =34.1; E_value=5e-07; Accession=PF01535.11; Description=PPR repeat
  Pfam annotation: Domain name=PPR; Domain location=248-282; Score =45.5; E_value=1.8e-10; Accession=PF01535.11; Description=PPR repeat
  Pfam annotation: Domain name=PPR; Domain location=349-383; Score =27.8; E_value=3.7e-05; Accession=PF01535.11; Description=PPR repeat
  Pfam annotation: Domain name=PPR; Domain location=385-419; Score=8.9; E_value=0.65; Accession=PF01535.11; Description=PPR repeat
  Pfam annotation: Domain name=PPR; Domain location=421-455; Score=7.9; E_value=0.86; Accession=PF01535.11; Description=PPR repeat
  Pfam annotation: Domain name=PPR; Domain location=487-521; Score=8.1; E_value=0.81; Accession=PF01535.11; Description=PPR repeat
  Pfam annotation: Domain name=PPR; Domain location=80-114; Score=1.0; E_value=5.7; Accession=PF01535.11; Description=PPR repeat
  Pfam module annotation: Pfam domain module=PPR::PPR::PPR::PPR::PPR::PP R::PPR; Domain location=146-180::248-282::349-383::385-419::421 -455::487-521::80-114
SSAGIRQFGSDHLLTDPEIILQANNLMQLQGYFAYGLMQKFFGKRCKNYYFRNHSKSASTYRVLESLSGMNGSTEKPIKYVLCTVLSSCAKTLNWHLGIQIHAYMIRSGYEDNLFLSSALVDFYAKCFAILDARKVFSGMKIHDQVSWTSLITGFSINRQGRDAFLLFKEMLGTQVTPNCFTFASVISACVGQNGALEHCSTLHAHVIKRGYDTNNFVVSSLIDCYANWGQIDDAVLLFYETSEKDTVVYNSMISGYSQNLYSEDALKLFVEMRKKNLSPTDHTLCTILNACSSLAVLLQGRQMHSLVIKMGSERNVFVASALIDMYSKGGNIDEAQCVLDQTSKKNNVLWTSMIMGYAHCGRGSEALELFDCLLTKQEVIPDHICFTAVLTACNHAGFLDKGVEYFNKMTTYYGLSPDIDQYACLIDLYARNGNLSKARNLMEEMPYVPNYVIWSSFLSSCKIYGDVKLGREAADQLIKMEPCNAAPYLTLAHIYAKDGLWNEVAEVRRLIQRKRIRKPAGWSWVEVDKKFHIFAVDDHNSSIDLLASLRVHIYNLALDAYLLAPPLAESDSVQKPVLFEHKVKKRSVFALGLLAVMIISLFSSHT

SEQ ID NO: 132380 - protein, 456 aa, Glycine max
  Coding DNA Sequence Number=SeqID_15602
  Homolog annotation: Hit_ID=Q5XWK4; Match level="QueryCoverage=81%, HitCoverage=94%, E-value=1e-159, Identity=70%"; Hit description =Expressed protein-like
  Pfam annotation: Domain name=DUF616; Domain location=126-446; Score =677.7; E_value=9e-201; Accession=PF04765.4; Description=Protein of unknown function (DUF616)
MVNCSLREETSLMQFSILLKKVIMALEFYVVVEAKMESKFSTIPHSIQEERNLQENIVVSDDGKTSKENIVVSDDGNTSKENIVVSDVGNTSKGKRRKHFPCEVGLLESVDGLVEPKNYMNFTWFSLEYVDHEDRTSKIDLFEPRFGGHQTLEERENSFYAKNQTLHCGFVKGKPGHPSTGFDINEKDKAYMYRCKVAVSSCIFGSSDFLRRPTSRLISQYSKDNVCFVMFLDDQTLSKLSSEGSSPDERGYIGLWKIVVVKNLPYEDMRRTGKVPKFLSHRLFPHSRYSIWLDSKMRLNSDPMLIIEYFLWRRKAEYAISNHYDRHNVWEEVLQNKRLNKYNHTAIDEQFNFYQSDGLPKVDPSKPNDPLPSYVPEGSFIIRAHTPMSNLFSCLWFNEVDRFTSRDQLSFAYTYLKLRRMNPERPIQLYMFKDCERRALLKLFRHRELPSPRETA

SEQ ID NO: 132381 - protein, 97 aa, Glycine max
  Coding DNA Sequence Number=SeqID_15603
MSASDPSLKSTWNRVIEIPEGYCVCFWNKATRVISRESPPLSFSPGIGRRTMFGFGYDPSSEKYKVVAIALTMLSLDVSEKTEMKVYGAGDSCWKKP

SEQ ID NO: 132382 - protein, 104 aa, Glycine max
  Coding DNA Sequence Number=SeqID_15604
  Homolog annotation: Hit_ID=Q9M4K9; Match level="QueryCoverage=33%, HitCoverage=12%, E-value=6e-08, Identity=68%"; Hit description =Cyclin A3.1
MTCTSVGEGPLCKLSNVWQQHHLLPRYLFLFLNLRGRFLGNCNLAILGMALVSTIGRKVFPNTRDESFRHFVALVCREREVLARNAATTYYAGLTDFVIELVCQ

SEQ ID NO: 132383 - protein, 467 aa, Glycine max
  Coding DNA Sequence Number=SeqID_15605
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=92%, HitCoverage=96%, E-value=1e-118, Identity=47%"; Hit description=UDP -glucosyltransferase HRA25
  Pfam annotation: Domain name=UDPGT; Domain location=4-467; Score= -92.3; E_value=5.7e-06; Accession=PF00201.9; Description=UDP -glucoronosyl and UDP-glucosyl transferase
MATPHFLLIPYPVLGHVNPLIQLSQILIKHGCNITFLNTEFSHKRLNNNTGAAGLDNLRRSGIKFVALPDGLGPEDDRSDQKKVVLSIKTNMPSMLPKLIQDVNASDVSNKITCIVATLSMTWALKVGHNLGIKGALLWPASATSLALCDFIPRLIHDGVIDSRGVPIRRQQIQFSSNMPLMDTQNFPWRGHDKLHFDHLVQEMQTMRLGEWWLCNTTYNLEPAIFSISARLLPIGPLMGSDSNKSSFWEEDTTCLEWLDQQLAQSVVYVSFGSMAVMDPNQFNELALGLDLLDKPFIWVVRPSNDSKVSINEYPHEFHGSRGKVVGWAPQKKILNHPALACFISHCGWNSTVEGVCGGIPFLCWPFAKDQLVNKSYVCDVWKIGLGLDKDENGIISKGEIRKKVDQLLLDEDIKERSLKMKELTMNNIGKFADTSQNRVRPRAWFFLPKLVPSIDFKKHFQNLTSM

SEQ ID NO: 132384 - protein, 133 aa, Glycine max
  Coding DNA Sequence Number=SeqID_15606
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=95%, HitCoverage=47%, E-value=7e-44, Identity=70%"; Hit description=Class III chitinase
  Pfam annotation: Domain name=Glyco_hydro_18; Domain location=8-133; Score=-37.4; E_value=0.0022; Accession=PF00704.18; Description =Glycosyl hydrolases family 18
MVLMLQNCNLLGPEWQLGTLDEACATGNYDYVIIAFLPTLGDGQTPMINLAGHCDPYSKGCTGLSSDIESCQAKGIKVLLSLGGGAGSYSIASTQDASQLSSRPLGPAILDDIDFDIEDGSNQHWGDLAKFLK

SEQ ID NO: 132385 - protein, 1148 aa, Glycine max
  Coding DNA Sequence Number=SeqID_15607
  Gene Ontology: Mol. function=protein binding; Cellular component =nucleus; Biological process=cell cycle
  Homolog annotation: Hit_ID=Q1SBK0; Match level="QueryCoverage=63%, HitCoverage=99%, E-value=0.0, Identity=91%"; Hit description=Cullin family
  Pfam annotation: Domain name=Cullin; Domain location=29-631; Score =906.3; E_value=1.3e-269; Accession=PF00888.12; Description=Cullin family
  Pfam annotation: Domain name=zf-CCHC; Domain location=906-923; Score =12.2; E_value=0.0097; Accession=PF00098.13; Description=Zinc knuckle
  Pfam module annotation: Pfam domain module=Cullin::zf-CCHC; Domain location=29-631::906-923
MSNQKKRNFQIEAFKHRVVMDPKYADKTWKILEHAIHEIYNHNASGLSFEELYRNAYNMVLHKFGEKLYSGLVATMTGHLKAIAQSVEAAQGGSFLEELNRKWNDHNKALQMIRDILMYMDRTYIPSTQKTPVHELGLNLWKENVIYSSQIRTRLLNTLLELVHSERTGEVIDRGIMRNITKMLMDLGPSVYGQDFETHFLQVSAEFYQAESQKFIECCDCGDYLKKAERRLNEEMERVSHYLDSRTEKKITNVVEKEMIENHMLRLIHMENSGLVHMLCDDKYEDMSRMYNLFRRVTDGLSKIREVMTSHMRESGKQLVTDPERLKDPVEYVQRLLDEKDKYDKIINLAFINDKSFQNALNSSFEYFINLNPRSPEFISLFVDDKLRKGLKGVSEDDVEVTLDKVMMLFRYLQEKDVFEKYYKQHLAKRLLSGKTVSDDAERSLIVKLKTECGYQFTSKLEGMFTDMKTSQDTMQGFYGCHPELSDGPTLTVQVLTTGSWPTQSSVTCNLPAEMSALCEKFRSFYLGTHTGRRLSWQTNMGTADLKATFGKGQKHELNVSTYQMCVVMLFNNADRLSYKEIEQATEIPASDLKRCLQSLALVKGRNVLRKEPMGKDIGDDDAFYVNDKFSSKLYKVKIGTVVAQKESEPEKLETRQRVEEDRKPQIEAAIVRIMKSRKQLDHNNLIAEVTKQLQSRFLANPTEVKKRIESLIERDFLERDDSDRRFAASPAPSISVAAPTTKETNQKTHSTKKVKIDGNEDFASDAFVVETTPTLYKDCLVGKDVAMKEHFLDLNIDPKDIIDGVREDICACLDIEDEETMHEHPFNPKPNIKVVVVTYDRRSVTYFFHYLSKDRGSYLILSNTSIQNRGKFTRICMELDLECELVSSVTVLGTNFNLEYKGLHLICFHCGKYGHKDSQCLFASLTSGTTHQLGASSGAWNEFQFGVQGIPMLPMELYNSEFLYKVGDLLGTTLKIDVNMPIQNRGKFARICVELDLECELVPSVTVLGMDFNLEQIPDGSPEDLEPSSTGLRFGVLETKPILPIETLKPNPESTLNLNTHVPSHGQDGIISPGSPPEVPPFMGNPIPRKPPNPLSEVPMLVDGEKNVEVEVSQAIVLDTHLMIIPVAGALSHDNQSMVIPVNEGIP

SEQ ID NO: 132386 - protein, 121 aa, Glycine max
  Coding DNA Sequence Number=SeqID_15608
MVMVEVTLVVVVIVGVTISDDDISIDEGGGDEGDINDEGFKSLWGQLLPSRLKWIRPYDSGGCGGNNVGGVNDNSDDIDKGGMILVFVAIITGQLGAAPSPTSTTFASHHNNKIEKYNIMI

SEQ ID NO: 132387 - protein, 530 aa, Glycine max
  Coding DNA Sequence Number=SeqID_15609
  Gene Ontology: Mol. function=RNA-directed DNA polymerase activity; Cellular component=extracellular region; Biological process=RNA -dependent DNA replication
MGDRNTHYFHQSFLTKRHKNKIDVFQDDNQIWIYDEDRIRNMVQSHYIDLFSSEDHGVLALQTISTFPLISEGDYDFLNMEFTFEETRFALFTMGNYKSPGPDGFHPAFFKSQWEIIGKLIFGFIVHVRHNSTNITSVNQALLTLVPKTSDASSISQFRPIAFRNLNVPITKNLDTYLSFKILPKRKTVSHFSFLVDKVRKKLSGWKGRKLYMAGRVTMAQSCLLSFPPYVLQATLISIATCNEIEKICRDFILCSDANNRKIHLMSWEMTCKPKDQGGLGFRSLRMLNQAYFLKLDAWIPGVPAIDSLIPEDIHSHVSNLPVSAYGVDGHWRWEGLNVLVPPYICAMIASINPPSGTDDDTPLWKDSLDGRFTISNAYHYLSNLDEPSSGPVNLLFASIWKLGYCNVILAELWSLKYGIKLAIDLNTQFSLFEMDAREAVHMIDVIKSVPSSLRPLAADIRRVLWANGWQSSIVHINREANSAANWAAKFGHQRNWSSFLVDEIPFVLKALVANDVRRAAASPLRLPYS

SEQ ID NO: 132388 - protein, 151 aa, Glycine max
  Coding DNA Sequence Number=SeqID_15610
NPLDPDKSNRALGFPALITGLCQSFEVPVAPSKAADAPPPHQAGPAGSFDTEQYLRHLVRQQAANHRAHVQTNDCLYQMSLSLQSQGFTSFPCPTPDQFRAEVAWPGDWPEARAREAPAEAPAEAPDEADEAREDEEMADLLDFLGGSGAT

SEQ ID NO: 132389 - protein, 72 aa, Glycine max
  Coding DNA Sequence Number=SeqID_15611
MELEEEVVRELEMSLKLPKYGELNLLLYFISVCFFLDHVDACFVRIIQQWKLFWSSLVQQEESEDDAWSGLG

SEQ ID NO: 132390 - protein, 312 aa, Glycine max
  Coding DNA Sequence Number=SeqID_15612
  Gene Ontology: Mol. function=RNA binding
  Homolog annotation: Hit_ID=Q32SG0; Match level="QueryCoverage=93%, HitCoverage=37%, E-value=7e-56, Identity=45%"; Hit description=KH -domain protein
  Subcellular localization annotation: CTP_CleavageSite=42; ConfidenceScore=5.28e-01
MTEDSSVRVSSSDKTSAANDASQTRQRKKRKWDQPAESLMPVGMAVPGALPLSNAVSLGGVAFPAMAPMISGALLRNPLAASSQLPQHTVAAAVAAQKLNQMFSAFEMAITHYMEVQVKCKQRLPEPDYLIHLYFSESMLIHRFSEWVLGCGQKIQDELIIAREIVINDAESSVRYKLTKRQTQEEIQRCTGAIVITRGKYRLPNAPHDGGKPLYLHISAGAHIKETAERILAVDRAAAMIEEMLKQEQNSQSISSASPSALVNILKMLSTCVFLGFDADPSLNIVARIRGPNVLKVIFRWMELENGSSDDF

SEQ ID NO: 132391 - protein, 169 aa, Glycine max
  Coding DNA Sequence Number=SeqID_15613
MRLASSSSFNEEIKQIYHISIILNSTFVPLGISLSICRTCLLQKIRPIPRSCDSGSELLGSRPWVRVRVLAMLVQCILIEVVIELHLALMNWQRPMINVENPSALLDLSGSTGPTNIWVEGDQSYGHWEGVTEQAHHLDLSQSGHANVHDPYPPPCSLREKSCPGEQSS

SEQ ID NO: 132392 - protein, 81 aa, Glycine max
  Coding DNA Sequence Number=SeqID_15614
MKIKFNPSPLHLTPIVISNLMNQQRRWRWRWRWRWMLVLRLWSEGVHSREAVEDTLKVLEMMIAMETQFVFEVEDTFKALA

SEQ ID NO: 132393 - protein, 353 aa, Glycine max
  Coding DNA Sequence Number=SeqID_15615
  Gene Ontology: Mol. function=RNA binding
  Homolog annotation: Hit_ID=Q32SG0; Match level="QueryCoverage=78%, HitCoverage=39%, E-value=7e-43, Identity=42%"; Hit description=KH -domain protein
MNETGATVVLRGRGSGNNECLNGEDGQQPLHLFLSSNNAKSLEDAKLLAENLLDTICTECGALRVSSCKVYSAVPPPQQVYTAVPPPQQVYSGPSLLKQIPTAISPPQQVYSAVPPPQQLLTGVQSSGIDLEAGTSLTSSSMSAAGVLTPVPPASLVGVTGVTGSLTLGTPSQSIGHLSSGPQANMIGYTPPPLVSGGTSYIGYGGLYPQATPLQQVALALRHSPPVTSTDAPTTSASNGESRPTSSSDLEKEKRPPQRRKFQELPVGSKGTTKLNQGFQFWRSRRVLVASQHMPCPIQDVILIFSFIGKIAAIYFVACFSAMPSSSPAYMDCQFPEEKGLPYQHQIDANSLN

SEQ ID NO: 132394 - protein, 194 aa, Glycine max
  Coding DNA Sequence Number=SeqID_15616
  Gene Ontology: Mol. function=RNA-directed DNA polymerase activity; Biological process=RNA-dependent DNA replication
MVELCLVPGVIIPSMFKVPDFDKYKGTTCPKNHLKMYCKKIGAYVKDEKLLMHFFQEGLTEATVTWYTNLEPFEVHSWKDLVISFIRQYQYNSDMAPDRMQLQNMCKKEHESFKEYAQRWRDLAAQVAPPMMEREMITMIVDTLPVFYYEKIMGYTPSSFANLVFTGERIKVGLRRGKFDYLALMNRKSGANGE

SEQ ID NO: 132395 - protein, 211 aa, Glycine max
  Coding DNA Sequence Number=SeqID_15617
  Gene Ontology: Mol. function=phosphoribosylaminoimidazolecarboxamide formyltransferase activity; Biological process=purine nucleotide biosynthetic process
  Homolog annotation: Hit_ID=Q84XA4; Match level="QueryCoverage=69%, HitCoverage=23%, E-value=8e-38, Identity=60%"; Hit description =Aminoimidazolecarboximide ribonucleotide transformylase/inosine monophosphate cyclohydrolase
  Pfam annotation: Domain name=AICARFT_IMPCHas; Domain location=90-211; Score=-178.1; E_value=0.0086; Accession=PF01808.9; Description =AICARFTIMPCHase bienzyme
RVHLLGGCYTENKRGYISCGSVQVEGTSIWLFKENKGGYIPCGSLACKGFYKVERNLKNRLVAWGLNEAELAKETKNIISKPSVLMGLQNHKDVLVVVDTEDYPSFLEFLKGNQDDIKFKIKLAWKAFNMLLPMTQQYLSGCGNRVWEVLLFLVYKFPPSLTMPLSLKSPLGYGENPHQKAAFYVDKSLSEVNAGGIATAIQHHGKVGINY

SEQ ID NO: 132396 - protein, 267 aa, Glycine max
  Coding DNA Sequence Number=SeqID_15618
  Gene Ontology: Mol. function=nucleic acid binding; Cellular component= cytoplasm; Biological process=induction of apoptosis
  Homolog annotation: Hit_ID=Q941H9; Match level="QueryCoverage=92%, HitCoverage=99%, E-value=2e-42, Identity=39%"; Hit description=RNA -binding protein precursor
  Pfam annotation: Domain name=GRP; Domain location=102-182; Score= -24.6; E_value=0.025; Accession=PF07172.2; Description=Glycine rich protein family
  Pfam annotation: Domain name=RRM_1; Domain location=62-135; Score =96.4; E_value=8.7e-26; Accession=PF00076.12; Description=RNA recognition motif. (a.k.a. RRM, R
  Pfam module annotation: Pfam domain module=GRP::RRM_1; Domain location=102-182::62-135
  Subcellular localization annotation: CTP_CleavageSite=55; ConfidenceScore=5.31e-01
MCKNVTGGGTSVCRRAQVSAMAFLNKIGNLVKNSAVKHINQDFSVSTPSLFQAIRSMSSAKLFVGGISYSTDDMSLRESFARYGEVIDGKVKVIMDRETGRSRGFGFITFATSEDASSAIQGMDGQDLHGRRIRVNYATERSRPGFGGDGGYRGSGGSDGYNRGGNYGGGYNSGSDGYNRGGNYGSGNYNVTSSYSDGNAETSYTSGANAGNYQFNENSGGVFGSASGEFSSNQNDATGADNDEFIEPLEDNVRENNDEPTDYAQNR

SEQ ID NO: 132397 - protein, 680 aa, Glycine max
  Coding DNA Sequence Number=SeqID_15619
  Gene Ontology: Mol. function=transmembrane receptor activity; Cellular component=exocyst; Biological process=exocytosis
  Homolog annotation: Hit_ID=Q9FNR3; Match level="QueryCoverage=95%, HitCoverage=95%, E-value=1e-128, Identity=39%"; Hit description =Leucine zipper protein-like
  Pfam annotation: Domain name=Exo70; Domain location=87-669; Score =368.1; E_value=1.4e-107; Accession=PF03081.6; Description=Exo70 exocyst complex subunit
MAVEESEPVIGELEREENLIAAVRHIVKALGPNKTLTSDAKKILADLGTRLSSMSVPSEKEEGKQGQGKDDGDNCDGGGDLYDEDDDDDEGISAIEEKLNVIQEKIMRWEEDQSMIWDLGPEEASEYLNAANEARRLIEKLESLNLKKEDQEYKFMQRAYSVLQTAMARLEEEFRNLLIQNRQPFEPEYVSFRSSEEDAVDENSIVSLGDESVEESLQRDSVSRASEEHIIYLVHPAVIPDLRCIANLLFASNYVQECSNAYIIVRRDALDECLFILEMERLSIEDVLKMEWGTLNSKIKRWIWAVKIFVRVYLASERWLSDQLFGEGEPVGLSCFVDASKASILQLLNFGEAMSIGPHQPEKLFRVLDMYEVLQDLMPDIDALYSDEVGSSVKIECHEVLKRLGDCVRVTFLEFENAIATNVSSTPFVGGGIHPLTKYVMNYLRTLTDYSDILNLLLKDQDEDAISLSPDMSPGTEEDSRSQGSPGRVSSMALHFRSIASILESNLEEKSKLYKEVSLQHLFLMNNLHYMAEKVKGSELRLIHGDEWIRKCNWKFQQHAMKYERASWSPILNLLKDEGIHVPGTNSVSKSLLKERLRSFYLGFEDVYRIQTAWIIPDIQLREDLRISISLKVIQAYRTFVGRHNSHISDKIIKYSADDLENYLLDFFEGSQKWLQNPHR

SEQ ID NO: 132398 - protein, 333 aa, Glycine max
  Coding DNA Sequence Number=SeqID_15620
  Gene Ontology: Mol. function=serine carboxypeptidase activity; Cellular component=cellulose and pectin-containing cell wall; Biological process=proteolysis
  Homolog annotation: Hit_ID=Q9SGA9; Match level="QueryCoverage=94%, HitCoverage=67%, E-value=1e-152, Identity=78%"; Hit description =Putative serine carboxypeptidase II
  Pfam annotation: Domain name=Peptidase_S10; Domain location=1-327; Score=334.6; E_value=1.7e-97; Accession=PF00450.12; Description =Serine carboxypeptidase
MTNESYTCMLMCSIHCSAQDSLEFVIQWLERFPRYKTRELYITGESYAGHYVPQLAKEIMTYNAKTKHPINLKGIMVGNAVTDNYYDNLGTVTYWWSHAMISDQTFRQLMSRCDFHRQKESDECESVYSYAMDQEFGNIDQYNIYDPPCNNSDGSSSGSGSATRRTMRLPHRPHVAFRHWSGYDPCTEKYAEIYYNRPDVQKALHANKTGIPYRWTACSEVLNRNWNDTDVSVLPIYRELIAHGIRVWVFSGDVDSVVPVTATRYALAQLKLSTKIPWYPWYVKNQVGGWTEVYEGVTFATVRGAGHEVPLFKPRAALQLFTSFLTGKPLPKS

SEQ ID NO: 132399 - protein, 313 aa, Glycine max
  Coding DNA Sequence Number=SeqID_15621
  Gene Ontology: Mol. function=RNA-directed DNA polymerase activity; Biological process=RNA-dependent DNA replication
MMNYFLWGSTLQPRKGINFLYRDKLTMKKKFRDHQRHEWQAGFIEVTFNHSDAHAIQSIPLINSSDNDRLIWKFSLNGSYSVKTAYHNIIEAMLGTELLKANGNWSAVWKLHTPPKIKHFVCRSLSAKLWDVIQPKIKTAESYNDFIFNLLEQLHPHKSSQSAMILWYIRKTRNQKVWENVETTSSIVVSLALQSYSEWLSADASNNIYISASPPSTSQQIWTPPAIGLPKCNFDAIIFKDQNVFGIGMCLRDDNGTFIKAKTKHYQGTPQPQEAEVYALHQALVWIQQFKMMKDNLAATKPRASLSTIQKSL

SEQ ID NO: 132400 - protein, 560 aa, Glycine max
  Coding DNA Sequence Number=SeqID_15622
  Homolog annotation: Hit_ID=Q94GE4; Match level="QueryCoverage=88%, HitCoverage=55%, E-value=1e-158, Identity=57%"; Hit description =Putative dex1 protein
  Pfam annotation: Domain name=FG-GAP; Domain location=328-352; Score =10.4; E_value=0.34; Accession=PF01839.13; Description=FG-GAP repeat
  Pfam annotation: Domain name=FG-GAP; Domain location=40-69; Score =21.5; E_value=0.0031; Accession=PF01839.13; Description=FG-GAP repeat
  Pfam annotation: Domain name=FG-GAP; Domain location=409-438; Score =30.8; E_value=4.7e-06; Accession=PF01839.13; Description=FG-GAP repeat
  Pfam annotation: Domain name=FG-GAP; Domain location=455-484; Score =24.9; E_value=0.00028; Accession=PF01839.13; Description=FG-GAP repeat
  Pfam module annotation: Pfam domain module=FG-GAP::FG-GAP::FG-GAP::FG- GAP; Domain location=328-352::40-69::409-438::455-484
MACDGKLEIVVPSFVHYLEVLEGADGDKMPGWPAFHQSTVHSSPLLYDIDKDGVREIALATYNGEVLFFRVSGYMMSDKLEVPRRKVLKKWFVGLDPDPVDRSHPDVHDDQLVQDATIKNSMSQMNGSRHEAKSSAATSTENHLETKNLSNPEPEKKINGSQVDESIKVPNPEPEKKINGSQIDEIIKVPNPEPEKKINGSQVDESIKVPTVVDNSSVNAGSLETVHADNKTSTGRRLLEDNNSKGAVQGSSESKVKEGIHAATVENDEGLDADADSSFELFRNSEDLADEYSYDYDDYVDETMWGDEEWTEVKHEKLEDYVNVDSHILCTPVIADIDNDGVSEMIVAVSYFFDHEYYDNQEHRKELGDIDIGKYVAGGIVVFNLDTKQVKWTAELDLSTDTSNFRAYIYSSPTVVDLDGDGNLDILVGTSYGLFYVLDHHGKVRQKFPLEMAEIQGAVVAADVNDDGKIELVTADTHGNVAVWTPKGDLIWEKHLKSLIPQVEKNIRGSGCITPVLYLVHFPLALGILLDVLEDEKRLKDEEIEHATIEESMQQCAGLQ

SEQ ID NO: 132401 - protein, 98 aa, Glycine max
  Coding DNA Sequence Number=SeqID_15623
  Homolog annotation: Hit_ID=Q9LFA7; Match level="QueryCoverage=37%, HitCoverage=6%, E-value=1e-07, Identity=78%"; Hit description=MRNA capping enzyme-like protein
VLRSIRDNITEEDLLNEISEIIRLPMYADRIRIDSKANQHANVARRSMFDGSPVTATHSTSSSGNLPWKDEEGGNCVNCLAVVKMCKVQINGCGKKQC

SEQ ID NO: 132402 - protein, 58 aa, Glycine max
  Coding DNA Sequence Number=SeqID_15624
MKGLLLQKLESSEVLLSPIALKVVGPLLLDSNSSRDGTNPPSNSLYGNPQTRKQRDKK

SEQ ID NO: 132403 - protein, 326 aa, Glycine max
  Coding DNA Sequence Number=SeqID_15625
  Gene Ontology: Mol. function=RNA-directed DNA polymerase activity; Cellular component=intracellular; Biological process=RNA-dependent DNA replication
  Pfam annotation: Domain name=rve; Domain location=170-318; Score =103.9; E_value=4.6e-28; Accession=PF00665.16; Description=Integrase core domain
MADALATLSSMYEVSHRNNLPTIRIQRLERPAHVFAVEEVVDDKPWFHDIKCFLQSQEYPPEVSNKDRRTLRRLSGNFFLNGDVLYKRNFDMVLLRCVDKQEAEFLMHEIHEGSFGTHSNGHAMARKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKDWHEMLPAYFNRGNPLLFGVWYGSSTPCGG

SEQ ID NO: 132404 - protein, 67 aa, Glycine max
  Coding DNA Sequence Number=SeqID_15626
DLGDVRQAPDSQPIKEQRPQSKEACVVAGQLWILSGIWNLASGNRLPREVEMASGNRLPRGVIDYKA

SEQ ID NO: 132405 - protein, 228 aa, Glycine max
  Coding DNA Sequence Number=SeqID_15627
  Gene Ontology: Mol. function=2-methylcitrate dehydratase activity
  Homolog annotation: Hit_ID=Q3KCA6; Match level="QueryCoverage=83%, HitCoverage=42%, E-value=3e-53, Identity=56%"; Hit description =MmgE/PrpD
MTCGSLLPARWPRTGRRSRITMPIIRQRCLPGSAEANMDTTLDRLADFIAATRFAQLPEPLVAQAKRHLLDTLGAALAGCDSPIWRECRALVAEEGGSTVAQLWGCAQQASPRQAAWLNGVAAHMYELDDTGGCDHSGAVVLPALLAALPLATQPVDGRAFLTAMVVGYDIGRRVLEACGGYAAHNGAGWHSTASCGVFGAAAAVSCLLRLPAAQCASALGIAASFSG

SEQ ID NO: 132406 - protein, 215 aa, Glycine max
  Coding DNA Sequence Number=SeqID_15628
  Gene Ontology: Mol. function=DNA-directed RNA polymerase activity; Cellular component=mitochondrion; Biological process=transcription
  Homolog annotation: Hit_ID=O47884; Match level="QueryCoverage=88%, HitCoverage=20%, E-value=2e-49, Identity=60%"; Hit description=RNA polymerase
MTIYAESRSGDSLETSGSELSDEENKNLRCVLSESDKSLLVELGEHSIECLLVHTLGHLFNLENIVSLASLVDRIERNVRDYASSSTLYYNSRVCNLSMDAVDKGTKASKTRAYPFGTALVEFLVSRGLLRLVTYNVDLLNFSDDSGPKTVVKNVVKKGHNYYRSSLVYAECLFNPALLPIKLNLPMVFPPKDWEPHKPEQKPTLRAKSTALNGV

SEQ ID NO: 132407 - protein, 145 aa, Glycine max
  Coding DNA Sequence Number=SeqID_15629
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=97%, HitCoverage=56%, E-value=1e-24, Identity=46%"; Hit description=Class III chitinase
  Pfam annotation: Domain name=Glyco_hydro_18; Domain location=27-145; Score=-53.1; E_value=0.041; Accession=PF00704.18; Description =Glycosyl hydrolases family 18
MALKSAAITLTFLSLVSLPLASDSNGGIIAIYWGQKNNEGTLAEACATGNYDYVSQDITYCQAKGIKVLLSLVGGGGSYSNADNSTQDVCQVAAHLWNNFLGGQSSSLGPLGPAVLDGIDFGIVHDIEDGPKQYSRDLGITLKCT

SEQ ID NO: 132408 - protein, 48 aa, Glycine max
  Coding DNA Sequence Number=SeqID_15630
MAEQLKFPIASLPALEPFPSANKTKHKNLIESDDFNAIVKREIPMKLF

SEQ ID NO: 132409 - protein, 387 aa, Glycine max
  Coding DNA Sequence Number=SeqID_15631
  Gene Ontology: Mol. function=nucleic acid binding; Cellular component= intracellular; Biological process=DNA integration
  Homolog annotation: Hit_ID=Q1S1X7; Match level="QueryCoverage=76%, HitCoverage=28%, E-value=2e-59, Identity=39%"; Hit description =Integrase, catalytic region; Zinc finger, CCHC-type; Peptidase aspartic, catalytic
MESKDSKSSLHMIDSLKALDENDEDLQMHPQHQNLALVEGTDWTGGKWIFKKKSGSSTKEVIGYNACLVVKGYNQKEGMDYNKIFSPKDILMQQAKGFEVEGKENFVYRLKRSLYGLKKSPRQKYKIFDEFIVSNGYIRSPNGSHVYHSTVEDGSHIYLLLYDMGATEKILGMEIMRDQDQKVLNHFGMTSAKPTCTPLTTSIHLSKLYTTQSEPEKEYMSHVPYASIVGSLMYAMVYTRPNLTQVIGVVSRYMGNLRKENWQAMKCIFRYLKGTTNIRLVYHGDTSCAFVGYSDFDYAANLDARRCVIGYRSRLATLLAIHICMIPNDCVRARGGIAVSMRSLCEAVEENSEHRTYVLTMQIKEKWLSLGSDDIGRGAYNLGYMAL

SEQ ID NO: 132410 - protein, 778 aa, Glycine max
  Coding DNA Sequence Number=SeqID_15632
  Gene Ontology: Mol. function=nucleic acid binding; Biological process= DNA integration
MAGSLSKIIPDMSKIEPLDGSNYRRWSQKLLILFEALEVDYVLFEDPPADVNASESSTPETPATPVVTPLPAETKKADEEAKKKYEKDNKTARGHLLTHMADNLFDLFINQKSAKTIWDTLLKRYGDDDAGRKKYVVGNWLRFQMMDDKPIMEQIHEYENIVGDILNEGMKMCEILQANVLLEKFPPSWSDYRNQLKHKKRDLSLQELINHMKTEEANRLKDKHANMVDNKVDWILDTGASKHLCANKELFHQIEDADDGECVFMGNSATAGVLVWGCLAKVALPDFKRTNVGTKTFDCVFIGYAQNSAAYRFLRLNDNSICESRNAEFFEQEFPLTKHVNELISSCNTTSVPLHLRTSSSVTNEQVNEPRRSKRKRIESSFGPDFVTAFVVENNDVDKINDVFVSTFLIEEDPKTYNEAVTSIDANFLEKGTAIHGLIVHQMDVKTAFLNGDLREEIYVEQPKGYVIQGQENKVCKLRKSLYGLKQAPKQWYEKFDQTLVSDGYIVNSSDTCVYSKLFGQECVIICLYVDDMLIFGTNVTVVEKTKLFLSSHFDMKDLGEADVILGVKMRKSDNGFSLCQSHYIEKILKKFNCYDELPVRTPYDPSIHLKKNNGSSVSQTEYAKIIGSVMFLMNCTRPDIAYAVSRLSRYTHNPGFCDANWVTDNDEVSSTSGYVFTLGGGAISWKSSKQTCIARSTMESEFIALDLAGQEAEWLRNLLADVPLWGKLSIPVSLHCDSKAAIGIAKNKNNLADPFTKGLTKKVVLESSRGMGLKPLC

SEQ ID NO: 132411 - protein, 126 aa, Glycine max
  Coding DNA Sequence Number=SeqID_15633
  Homolog annotation: Hit_ID=Q1S023; Match level="QueryCoverage=55%, HitCoverage=20%, E-value=2e-08, Identity=41%"; Hit description =Cyclin-like F-box; F-box protein interaction domain
MDCTRTAEERTAKNSISQETAKIIHSISVVHTLRDNVMNFNMAKPSFGHNHRNATQTSTKAKGNNFEDAHNLPSATESKIFQLQTPSLSKQQNKKDTGNLSRLIFGNFEKTIGHQQISVCLAPHII

SEQ ID NO: 132412 - protein, 223 aa, Glycine max
  Coding DNA Sequence Number=SeqID_15634
  Gene Ontology: Mol. function=nucleotide binding; Cellular component =membrane; Biological process=small GTPase mediated signal transduction
  Homolog annotation: Hit_ID=Q9LH50; Match level="QueryCoverage=98%, HitCoverage=98%, E-value=1e-104, Identity=86%"; Hit description=GTP -binding protein-like
  Pfam annotation: Domain name=Arf; Domain location=1-176; Score=-60.0; E_value=3.8e-05; Accession=PF00025.11; Description=ADP-ribosylation factor family
  Pfam annotation: Domain name=MMR_HSR1; Domain location=16-131; Score=- 10.5; E_value=0.0092; Accession=PF01926.13; Description=GTPase of unknown function
  Pfam annotation: Domain name=Miro; Domain location=17-131; Score =83.6; E_value=6.3e-22; Accession=PF08477.3; Description=Miro-like protein
  Pfam annotation: Domain name=Ras; Domain location=17-178; Score =313.3; E_value=4.4e-91; Accession=PF00071.12; Description=Ras family
  Pfam module annotation: Pfam domain module=Arf::MMR_HSR1::Miro::Ras; Domain location=1-176::16-131::17-131::17-178
MSNLYGDYHQKIDYVFKVVLIGDSAVGKTQLLARFARNEFSLDSKATIGVEFQTKTLIIDNKTIKAQIWDTAGQERYRAVTSAYYRGAVGAMLVYDMTKRQSFDHMVRWLEELRGHADQNIVIMLIGNKCDLGSLRAVPMEDAEEVAQRENLFFMETSALESTNVETCFLTILTEIYRIHAKKSLTASDDDNWGSGLLKGSRIIVPNQEIDNGGKKGGCCFAS

SEQ ID NO: 132413 - protein, 300 aa, Glycine max
  Coding DNA Sequence Number=SeqID_15635
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=99%, HitCoverage=99%, E-value=1e-136, Identity=80%"; Hit description =Class III chitinase
  Pfam annotation: Domain name=Glyco_hydro_18; Domain location=26-287; Score=166.0; E_value=9.8e-47; Accession=PF00704.18; Description =Glycosyl hydrolases family 18
MALKSPISVTFLCLVLLALANGSYAGKITTYWGQNGDEGTLAEACATGNYDYVIIAFLPTFGKGQTPMINLAGHCDPHSNDGCTGLSSDIKSCQAKGIKVLLSLRGDVGSPSIDPSQAATYLWNNFLGGHSSTTRRPLGSAVLDGIDFDIEGGSNKHWGDLARILKGYGMAKQSKKVYITAAPQCPFPDAWIGNALTTGLFDFVWVQFYNNPPCQYNSSGAISNLEDAWKQWITSIPANKIFLGLPASPLAAGSGFIPSADLISNVLPAIKGSSKYGGVMLWSRYYDVLSGYSSSIKKYV

SEQ ID NO: 132414 - protein, 103 aa, Glycine max
  Coding DNA Sequence Number=SeqID_15636
MPRLWSFLAIRSMAEEIDRFGFESREGSNEWGIWKQHFSSSYLLHGTWMNKNMRACCHPLMLHTICANMNRVLIEKFCLRCLMIAFGGLAVLEESIEEDDNLK

SEQ ID NO: 132415 - protein, 39 aa, Glycine max
  Coding DNA Sequence Number=SeqID_15637
MESLAEATSGVIGSLLSTTMLCPLDTCTTKFQSTGHNQL

SEQ ID NO: 132416 - protein, 114 aa, Glycine max
  Coding DNA Sequence Number=SeqID_15638
  Gene Ontology: Mol. function=transporter activity; Biological process= transport
  Homolog annotation: Hit_ID=Q8U7C4; Match level="QueryCoverage=99%, HitCoverage=25%, E-value=5e-46, Identity=66%"; Hit description=ABC transporter, substrate binding protein
MVGINATIKPYDTNSWGGWTFDYDNTAYSMYHSGEKWNPYDKDEKLDKMLEAQRSVLDRGEREKLLQEIAHYAADRALEMPLYNLKAIFGVNKRVKNFVPVPDSRLRLTDVTVE

SEQ ID NO: 132417 - protein, 155 aa, Glycine max
  Coding DNA Sequence Number=SeqID_15639
MSLLVLFVVALWRGCVMCHASKFEQFITIIMMGCLVKETLGCGKQLPNQNGQKHYENLEDMVHQAKKVERQLERKHSYRKTYYYDSSSGKDKSKKDGSSPPKQQGSKFPSGKHVPNLALLLLLGVVQLNTLNAWVKLPQKHVTSCWVNRDKLKEM

SEQ ID NO: 132418 - protein, 76 aa, Glycine max
  Coding DNA Sequence Number=SeqID_15640
  Gene Ontology: Mol. function=protein tyrosine/serine/threonine phosphatase activity; Biological process=protein amino acid dephosphorylation
  Homolog annotation: Hit_ID=Q8GSD7; Match level="QueryCoverage=77%, HitCoverage=8%, E-value=1e-13, Identity=61%"; Hit description=MRNA capping enzyme-like protein
MGVEEENHETDTRMTNDDVLGDEIPTDQQDALRQFCYQTLKLGVGARGHTQFPGSHPVSLNRVLLTSALRELVKEH

SEQ ID NO: 132419 - protein, 121 aa, Glycine max
  Coding DNA Sequence Number=SeqID_15641
MDLNASPVPEEDEDIFEEKIHVEEFHEPEERIETGADIARREREERKRRLKRERPDDRPVHVSQSHAYDQLFHTKNQRSYDKSRLPPGYGSCETQGFHGICNDHGGMSLEKKEAKGLGHVT

SEQ ID NO: 132420 - protein, 318 aa, Glycine max
  Coding DNA Sequence Number=SeqID_15642
  Gene Ontology: Mol. function=nucleic acid binding; Biological process= DNA integration
  Homolog annotation: Hit_ID=Q1SZQ0; Match level="QueryCoverage=65%, HitCoverage=21%, E-value=6e-26, Identity=30%"; Hit description =Integrase, catalytic region; Zinc finger, CCHC-type; Peptidase aspartic, catalytic
MAGNLSKIIPDMSKIEPLDGSNYRRWSKKLLILFEALEVDYVLFEDPPANVNASESSTPETPATPVVTPLPAETKKADEEAKKKYEKDNKTARGHLLTHMADNLFDLFINQKSAKTIWDTLLKRYGDDDAGRKKYVVGNWLRFQMMDDKPIMEQIHEYENLVGDILNEGMKMCEILQANVLLEKFPPSWSDYHNQQKHKKRDLKGQQSNNSKLAAPHAPQAHLAENEEVIAAVVVEANMVDNKVDWILDTGASKHLCANKELFHQIEDADDGECVFMGNSATAGVLGKGTILLKLTSGKTLSLSDVLYVPSLRRNLIS

SEQ ID NO: 132421 - protein, 198 aa, Glycine max
  Coding DNA Sequence Number=SeqID_15643
  Gene Ontology: Mol. function=transcription factor activity; Biological process=regulation of transcription, DNA-dependent
  Homolog annotation: Hit_ID=Q7WGP5; Match level="QueryCoverage=73%, HitCoverage=48%, E-value=4e-13, Identity=33%"; Hit description=LysR -family transcriptional regulator
  Pfam annotation: Domain name=LysR_substrate; Domain location=1-195; Score=93.1; E_value=8.4e-25; Accession=PF03466.10; Description=LysR substrate binding domain
MAERKLPALITRYGDEHPDVTLELLPGMTMEQLIEQVTTRETDVAFIRAPLPTLPQTLRTMPFDRSRLCVALPERHVLANRPQVSVSDILHEKLLLPVDEIGLGLSSSALSLFEDAGCTPQVGLRIANVNTILALVEAGAGISILPESTVLSARGTAAVSLDSAEAWSDCVLLVRRGALALHVEAFVNMARRAYRLSL

SEQ ID NO: 132422 - protein, 278 aa, Glycine max
  Coding DNA Sequence Number=SeqID_15644
  Gene Ontology: Mol. function=transferase activity; Cellular component= beta-galactosidase complex; Biological process=DNA integration
MDVKTTFLNGDLREEIYVEQPEGYVIQGQENKVLEKTKLFLSSHFDMKDLGEANVILGVKMRKSDSGFSLCQSHYIEKILKKFNCYDELPVRTPYDPSIHLKKNNGSSVSQTEYAKIIGSVMFLMNCTRPDIAYAVSRLSRYTHNPGGGAISWKSSKQTCIARSTMESEFIALDLAGQEAEWLRNLLADVPLWGKRSIPVSLHCDSEAAIGIAKNSVYNGKRRHIRIRHSSVRELLKNGVISLQFVRSENNLADPFTKGLTKKVILESSRGMGLKSLC

SEQ ID NO: 132423 - protein, 329 aa, Glycine max
  Coding DNA Sequence Number=SeqID_15645
  Gene Ontology: Mol. function=ATP-dependent helicase activity; Cellular component=chromosome; Biological process=regulation of translation
  Homolog annotation: Hit_ID=Q8RXK6; Match level="QueryCoverage=72%, HitCoverage=48%, E-value=1e-76, Identity=63%"; Hit description=DEAD -box ATP-dependent RNA helicase 8
  Pfam annotation: Domain name=DEAD; Domain location=145-305; Score =90.2; E_value=6.5e-24; Accession=PF00270.19; Description=DEADDEAH box helicase
MGEELAGQLLKIQQQYPDYVKEVRGRGLFIGVEFNSKNLFPVSGYEGKSALSPETLLKYIDELPLCARYYGTVSGMGVVVAACILQPYVISSNSQHWKARLKIPPADTRHRIEDVTATKGNEFEDYFLKHELLMGIYEKGFERPSPIQEESIPIALIVSDILARAKNGTGKTAVFCIPALEKIDQDNNVIQGSAGVVVTSRTFKFEGHINCYTGPNLRIGIANFSSVQRAWKALENSSYGYNRILDLAKKGVCILKDCAMLVMDEADKLLSPEFQPSIEQLIHFLPTTRQILMFSATFPVTLKDFKDRFSYMLPLKYDDADDGFCFSSK

SEQ ID NO: 132424 - protein, 67 aa, Glycine max
  Coding DNA Sequence Number=SeqID_15646
  Gene Ontology: Mol. function=mismatched DNA binding; Biological process=mismatch repair
  Homolog annotation: Hit_ID=Q6DTM5; Match level="QueryCoverage=98%, HitCoverage=8%, E-value=2e-25, Identity=79%"; Hit description=MSH4
MIGNSFAHMISTKPVDRYTRPEFTENGPLAIDSGRHPILESIHNDFVANNIFLTEALNMAIVMGPNM

SEQ ID NO: 132425 - protein, 52 aa, Glycine max
  Coding DNA Sequence Number=SeqID_15647
MKAKTNNAEAFFFSVIVHSTFGGNPLASAVAIASLEVIKIERLVERHHQHLK

SEQ ID NO: 132426 - protein, 149 aa, Glycine max
  Coding DNA Sequence Number=SeqID_15648
  Gene Ontology: Mol. function=mismatched DNA binding; Biological process=mismatch repair
  Homolog annotation: Hit_ID=Q6DTM5; Match level="QueryCoverage=96%, HitCoverage=15%, E-value=4e-45, Identity=74%"; Hit description=MSH4
  Pfam annotation: Domain name=MutS_IV; Domain location=43-136; Score =6.8; E_value=0.071; Accession=PF05190.8; Description=MutS family domain IV
MYFMHAFLLSPALNNALLLRLELMASWIFHEEHFVKLVKCNLSWNAAYHICVLKAFGVTFTAIHNLANNYREDFKLPNLKLTYKNRQGFHFVIPQKNIQGKLPSKFIQVVKHGNNIRCSSLELAFLNARNKSAAAECYTRTEVCLEGST

SEQ ID NO: 132427 - protein, 70 aa, Glycine max
  Coding DNA Sequence Number=SeqID_15649
  Gene Ontology: Mol. function=receptor activity
  Homolog annotation: Hit_ID=A0EJF1; Match level="QueryCoverage=83%, HitCoverage=10%, E-value=9e-12, Identity=54%"; Hit description=Beta -glucan-binding protein 2
MERTVVMERDVGFVTEAIVISATKVWYNTAVVKRRRGHEAESEKFEVLMRAKFWKKEFVGSGDETRFEEK

SEQ ID NO: 132428 - protein, 208 aa, Glycine max
  Coding DNA Sequence Number=SeqID_15650
  Gene Ontology: Mol. function=transporter activity; Cellular component= integral to membrane; Biological process=auxin mediated signaling pathway
  Homolog annotation: Hit_ID=Q673E8; Match level="QueryCoverage=99%, HitCoverage=44%, E-value=9e-78, Identity=75%"; Hit description =Putative auxin efflux carrier protein 6
MVPLYFAMLVAYGSVKWCKMFTPDQCSGINRFVAVFAVPVLSFHFISMNNPYQMDARLFGLAHHSLLARHLAQHTCHGYPAAPSHVRRLHAIAYGATRRAPVHHMVHSTPLLVRVQSGDGSDPTAVPGANGGVHSEVRGRRRCDIARRPRHAAADGVGDRRPGPDPSADPPLGLIGAGDELLYRRQHCRCHAAAVQPLERGHILDQHA

SEQ ID NO: 132429 - protein, 57 aa, Glycine max
  Coding DNA Sequence Number=SeqID_15651
MVVTQVQLDRAKDTRRELGMEIIEEHTVMEYSKMRSSDKGQTTFYTCTGCGHQSQEN

SEQ ID NO: 132430 - protein, 129 aa, Glycine max
  Coding DNA Sequence Number=SeqID_15652
MVVISGNSVVIVEVLQIQAFHFPLPWLLHILFQLRFQLQGRSSVTKGKQGRVKETEGVLNGAVYSHCHGFFSVQKILRKKPRFFVQQEEAQVVITKKTKKGLRRLKRYSLDLVPLSVLKVFITIVSQKL

SEQ ID NO: 132431 - protein, 82 aa, Glycine max
  Coding DNA Sequence Number=SeqID_15653
MVLCQKNDGMKLKETQTFPISNPNNSGQEQSRREDIKPVIVNTRGDQTCKEEHRSDGERELEQQWHESSSDNNLRDLKRQRL

SEQ ID NO: 132432 - protein, 120 aa, Glycine max
  Coding DNA Sequence Number=SeqID_15654
MNDLVYVMYNLKLKSKQNRKSIALPFDEIESDDEWITKEGYNDEDEQPQGEGDGGNVELVGDVGGSLNDLVVDAFDLDNLILVEPNDDAQSEEDLDDDGDGDESDDIHGDDPIRGLDMFL

SEQ ID NO: 132433 - protein, 138 aa, Glycine max
  Coding DNA Sequence Number=SeqID_15655
  Gene Ontology: Mol. function=transporter activity; Cellular component= integral to membrane; Biological process=auxin mediated signaling pathway
  Homolog annotation: Hit_ID=Q673E8; Match level="QueryCoverage=99%, HitCoverage=26%, E-value=1e-58, Identity=81%"; Hit description =Putative auxin efflux carrier protein 6
  Pfam annotation: Domain name=Mem_trans; Domain location=2-138; Score=- 128.3; E_value=0.075; Accession=PF03547.8; Description=Membrane transport protein
  Subcellular localization annotation: CTP_CleavageSite=44; ConfidenceScore=5.19e-01
MTDKEISFRDSTKVSKPADPKDTVASSQKMPHAFVMMRLILVVVGRKLSRNPNTYSSVLGLLWSLISFKWNMEMPSLIKASVKIISDAGLGMAMFSLGLFMALQPRIIACGTKRAVMGMVIRFVCGPLVMSASSISIG

SEQ ID NO: 132434 - protein, 383 aa, Glycine max
  Coding DNA Sequence Number=SeqID_15656
  Gene Ontology: Cellular component=nucleus; Biological process =abscisic acid mediated signaling
  Homolog annotation: Hit_ID=Q10Q07; Match level="QueryCoverage=78%, HitCoverage=72%, E-value=5e-31, Identity=32%"; Hit description =Expressed protein
  Pfam annotation: Domain name=DUF1675; Domain location=70-377; Score =247.4; E_value=3e-71; Accession=PF07897.2; Description=Protein of unknown function (DUF1675)
  Subcellular localization annotation: CTP_CleavageSite=37; ConfidenceScore=5.09e-01
MAEVEDRDNNTRHHHHYISSTTTTQSPMNNFPRDLLRTFMGVNNNNNNNNNSNNNNHHNLPMPVVKLEEELELSLDLSMNGRFGVDPTAKKIKRTTSIPEFASDKEMGFATVGCTGSLVRTCSLPTETEEEWRKRKELQTLRRMEARRKRSEKQRNMKALREQQQRVVGVVGSQGSNPVDQGAGEYGEVAVAPPLARTVSLTTRVCGLGLNGDSEKEKKSGIVLPPPSPSQGSIGSSGISEAESQQGQGTTPMDVRSPTSANLLPDSELKSPAGVAENNTGKNAAAAVVTMRSQSNKHSPPQSRTKDIVRNLLEDMPCVSTKGEGPNGKRIEGFLYRYGKGEEVRIVCVCHGSFLTPSEFVKHAGGGDVANPLKHIVVSPSLL

SEQ ID NO: 132435 - protein, 76 aa, Glycine max
  Coding DNA Sequence Number=SeqID_15657
MMGRKSKEYSLAKIPNLSNRLSITTRGYLWHVDILTDNSLILHISWLMKGEKKLQPQRRISALRKSMIETIITLLD

SEQ ID NO: 132436 - protein, 203 aa, Glycine max
  Coding DNA Sequence Number=SeqID_15658
MTGRLLAGSLALEICILHYLIVCILLPRSSNLAQVSEEDLIVMWAFHTGRKIDWAHLVRYRMHKALRLNAPLPYPHLVTLFLQHFNIPLDSEPYVPIKRSFLIGAVVVTSFGYCKECDGSLVKKGVQPNDDEGHLPVEGDSSFLQSILDRFDGLQTYVGERIVIIKKEEIVEPMTSKNYFDDAKESRVKQVPKNQESKSFKNQ

SEQ ID NO: 132437 - protein, 68 aa, Glycine max
  Coding DNA Sequence Number=SeqID_15659
MENNDGCYTASGGGLGDMTPVEARNLIEKMASNSQQFSARNDAIVLRGVHDVATDSSSSVENKKLEGK

SEQ ID NO: 132438 - protein, 33 aa, Glycine max
  Coding DNA Sequence Number=SeqID_15660
MSSRRLGSSSPESYSLHPATVILLPRTRFVIIT

SEQ ID NO: 132439 - protein, 210 aa, Glycine max
  Coding DNA Sequence Number=SeqID_15661
  Gene Ontology: Mol. function=transcription factor activity; Cellular component=nucleus; Biological process=regulation of transcription, DNA-dependent
  Homolog annotation: Hit_ID=Q2HUA6; Match level="QueryCoverage=76%, HitCoverage=84%, E-value=9e-44, Identity=61%"; Hit description =Pathogenesis-related transcriptional factor and ERF
  Pfam annotation: Domain name=AP2; Domain location=32-89; Score=72.9; E_value=1e-18; Accession=PF00847.10; Description=AP2 domain
MTPCFITGMTFTFFVTNSIHHSIPRSLSPALVRQDSSGQHGAIKEIQRKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 132440 - protein, 378 aa, Glycine max
  Coding DNA Sequence Number=SeqID_15662
  Gene Ontology: Mol. function=structural constituent of ribosome; Cellular component=intracellular; Biological process=translation
  Homolog annotation: Hit_ID=Q2R0M9; Match level="QueryCoverage=66%, HitCoverage=41%, E-value=6e-31, Identity=31%"; Hit description =Expressed protein
MQIFPTNVRNLWNEWELRVMVLASLSFHSILILLGNKRKYCTRTILRITLWFAYLLAEWLATFSLGVLSNKVGENEGDFVEPKYVIISLWAPILLLHLGGSDTIIAYSMEDNELWSRRFLSFCVQVLMALYISQRAWTNTDLNILAIPIFIAGPNYAKDMETYIAASHEGFIVDVQGLKTHSVGDDHTHAPAEANIIPLPQTHDSYGPEISFENGNGNGKKVFQVIEVELGFMYDLFYTKAAVTYSFMGSFLRLVTLSCHGKLRGNCQENLHTLWETEKEILAEKIVQLNQLHSLKLRSVNEIGDPKKLIVNSMSKLENLSSLQVFGKLEDELHMRCLPQNLTNLTLSKSKLSEDPMPELQSLLKLKSLCFYEDSSLD

SEQ ID NO: 132441 - protein, 129 aa, Glycine max
  Coding DNA Sequence Number=SeqID_15663
  Homolog annotation: Hit_ID=Q1SKJ4; Match level="QueryCoverage=54%, HitCoverage=10%, E-value=4e-07, Identity=36%"; Hit description=RNA -directed DNA polymerase
MMMPKGHKRLAMCNLKAMKQVGRMNFAWNFKHHKGKLWVNVLRAKYGRDQLQLHNIEVKVIDSPIWKSIAKVWPMLRCGKLEMGELLVCGLYIEALKMKRITQPEEGVTNLDERRGHVERRFTSLSNLS

SEQ ID NO: 132442 - protein, 542 aa, Glycine max
  Coding DNA Sequence Number=SeqID_15664
  Gene Ontology: Mol. function=mating pheromone activity; Cellular component=nucleus; Biological process=regulation of transcription, DNA-dependent
  Homolog annotation: Hit_ID=Q4VYC8; Match level="QueryCoverage=98%, HitCoverage=99%, E-value=0.0, Identity=68%"; Hit description =Nodulation signaling pathway 1 protein
  Pfam annotation: Domain name=GRAS; Domain location=131-450; Score =246.0; E_value=8.2e-71; Accession=PF03514.5; Description=GRAS family transcription factor
MIMEPNPTPDHSLDWFEGSVSYFPPFLDYPYNSSDIQEYQLWEQDIASNYQTDTNTSSPNATNIVTITTPLETCDSNNLPLSDLPKKRSATDESSPKPPQNHKHKKIKSKPRNNEADNGDAEATTTTTATVRKSGGNKKGGAKANGNNCNNKDGRWAEQLLNPCAAAITGGNLNRVQHLLYVLHELASPTGDANHRLAAHGLKALTQHLSSSPTSTSSGSITFASAEPRFFQKTLLKFYEVSPWFSFPNNIANASILQVLGEDTDNSRTLHILDIGVSHGMQWPTFLEALSRRAGGPPPLVRLTVVTASSSTENDTPFCIGPPGDNFSSRLLGFAQSMNVNLQINKLDNCPLHSLNAQSVDASPDEIFVVCAQFRLHQLNHNAPDERSKFLTVLRNMEPKGVILSDNNLGCCCNCCGDFATGFSRRVEYLWRFLDSTSSAFKGRESEERRVMEGEAAKALTNQRETNEGKEKWCERMKEAGFVEEVFGEDAIDGGRALLRKYESNWEMKVEDDNRSVGLWWKGQSVSFCSLWKLDGNDQSST

SEQ ID NO: 132443 - protein, 713 aa, Glycine max
  Coding DNA Sequence Number=SeqID_15665
  Gene Ontology: Mol. function=catalytic activity; Biological process =guanosine tetraphosphate metabolic process
  Homolog annotation: Hit_ID=Q76JT3; Match level="QueryCoverage=99%, HitCoverage=99%, E-value=0.0, Identity=76%"; Hit description=RelA -SpoT like protein PsRSH1
  Pfam annotation: Domain name=HD; Domain location=234-338; Score=42.5; E_value=1.5e-09; Accession=PF01966.12; Description=HD domain
  Pfam annotation: Domain name=RelA_SpoT; Domain location=428-538; Score=168.5; E_value=1.7e-47; Accession=PF04607.7; Description =Region found in RelA  SpoT proteins
  Pfam module annotation: Pfam domain module=HD::RelA_SpoT; Domain location=234-338::428-538
  Subcellular localization annotation: CTP_CleavageSite=98; ConfidenceScore=5.26e-01
MAVSTIALYASPPSGVCSTSHQINCHAGYDFELGSRSSSPAGSTAPPSTSQKPVMGGLSCLFSSPAPPRKHAPQLSSNFSGEEDEMKELSSSFSYSPSKFAGSSWKRDQSPVSVFHGPVSCSSSGRSSTGSTPIRSFRGGTSGLFDGFVRNALGSSCLDYDLDAGDSSAMVDELTFNLEDNFVEGGFHFEPYAKKLLLGAQMRHKIFCEEFVIKAFCEAEKAHRGQMRASGDPYLQHCLETAVLLALIGANSTVVAAGLLHDSLDDAFLTYDYIVGVFGTGVADLVEGVSKLSHLSKLARENNTASKSVEADRLHTMFLGMADARAVLVKLADRLHNMMTLDALPGAKQQRFAKETLEIFAPLANRLGISTWKEQLENLCFKHLNPSQHEELSSKLVESYDDAMITSAIERLEQALKDEGISYNVISGRHKSLYSIYCKMLKKKLTIDDIHDIYGLRLIVDKEEDCYKALTVVHRLWSEVPGKLKDYICRPKFNGYQSLHTVVMGEGKVPLEVQIRTKDMHLQADFGFAAHWRYKEDDCQHSSFVLQMVEWARWVVTWQCEAMSRDCSSVGYADSVKPPCKFPSHAEDCPYSYKPDCGQNGPVFVIMIENDKMSVQEFSANSTVLDLLKRSGRASSRLTTYRFPLKEELRPRLNHKPVSDPNSKLKMGDVIELTPAIPDKSLTEYREEIQRMYDRGLTVSSMGTAASTMAGSR

SEQ ID NO: 132444 - protein, 110 aa, Glycine max
  Coding DNA Sequence Number=SeqID_15666
MAMRRVEYGYCLHNPLFRLFNIFSYPYPILDGFEFIVPSPYPSDFKWRDGFGFGIGTGLVIPYPYSYPTFGYRRKPEPEPEPIPDQLGYYPSKSGRIRVDTHEYGFSCHV

SEQ ID NO: 132445 - protein, 138 aa, Glycine max
  Coding DNA Sequence Number=SeqID_15667
MEEREPLKFPTKYNIQIGMRWLIQGSQSGDSLFISSDCLGRRLGPRLLGRADDSGVNNSIVFETPYFYIAAKARNDVESASYYIGADVDTDVESAGYYIGPDVTTDVENTFSNLLMMSFPCSKATLLHRWFRWHRCRN

SEQ ID NO: 132446 - protein, 53 aa, Glycine max
  Coding DNA Sequence Number=SeqID_15668
MKEEGLVWFYVAFTSRLVGKQEIMKKACMGLVHGARIIRQRECIYKEDKGYKR

SEQ ID NO: 132447 - protein, 75 aa, Glycine max
  Coding DNA Sequence Number=SeqID_15669
MWVQDIGLFAQLTRAPEFGLPRPFNQKLLVLHICHFFHSSLLQGCENKTTIDTSKPYTRAMRGTMHKPQANLGAD

SEQ ID NO: 132448 - protein, 188 aa, Glycine max
  Coding DNA Sequence Number=SeqID_15670
MTGRLLVGSLAFESRILHYLIVRILLPRSSNLAQVSEEDLIIMWAFHTDRQLDWAHLVRYRMHQALRLNAPLPYPQLVTLFFCHFQIPLDSEPYVPIKRSFLIGAAAIASFGYRKERDGSWVKKGTQPADEEGNLPDEDNSTLLRRLMDKFDGLQTFVGDKFDAMELQVDMCHTLISSGDYYLITYNK

SEQ ID NO: 132449 - protein, 263 aa, Glycine max
  Coding DNA Sequence Number=SeqID_15671
  Gene Ontology: Mol. function=protein binding; Cellular component =integral to membrane; Biological process=xylan catabolic process
  Homolog annotation: Hit_ID=Q1SWI7; Match level="QueryCoverage=97%, HitCoverage=85%, E-value=3e-78, Identity=39%"; Hit description =Leucine-rich repeat
  Pfam annotation: Domain name=LRR_1; Domain location=117-138; Score =3.6; E_value=60; Accession=PF00560.23; Description=Leucine Rich Repeat
  Pfam annotation: Domain name=LRR_1; Domain location=145-166; Score =12.2; E_value=1.5; Accession=PF00560.23; Description=Leucine Rich Repeat
  Pfam annotation: Domain name=LRR_1; Domain location=169-191; Score =3.1; E_value=75; Accession=PF00560.23; Description=Leucine Rich Repeat
  Pfam annotation: Domain name=LRR_1; Domain location=193-215; Score =10.9; E_value=2.6; Accession=PF00560.23; Description=Leucine Rich Repeat
  Pfam annotation: Domain name=LRR_1; Domain location=217-240; Score =11.5; E_value=2; Accession=PF00560.23; Description=Leucine Rich Repeat
  Pfam annotation: Domain name=LRR_1; Domain location=47-70; Score =10.1; E_value=3.7; Accession=PF00560.23; Description=Leucine Rich Repeat
  Pfam annotation: Domain name=LRR_1; Domain location=72-105; Score =5.2; E_value=30; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=117-138::145-166::169 -191::193-215::217-240::47-70::72-105
MEIHASGNNFTLKVGPNWLPNFQLFHLDVRSWQLGPSFPSWIKSQNKLEYLDMSNAGIIDSIPTQMWEALPQVLYLNLSHNHIHGESGTTLKNPISIPVIDLSSNHLCGKLPYLSSDVSQLDLSSNSFSESMNDFLCNDQDEPMQLQFLNLASNNLSGEIPDCWMNWTFLGNVNLQSNHFVGNLPQSMGSLAELQSLQIRNNTFSGIFPSSLKKNNQLISLDLGENNLSGCIPTWVGEKLLKVKILRLRSTVLPATFQMKYVR

SEQ ID NO: 132450 - protein, 308 aa, Glycine max
  Coding DNA Sequence Number=SeqID_15672
  Homolog annotation: Hit_ID=Q7VUK1; Match level="QueryCoverage=45%, HitCoverage=90%, E-value=3e-71, Identity=96%"; Hit description =Putative dnaK suppressor protein
AVQLLPHFAPFLRFQREGGGGTGQQARDADGFAGFLAPAVFATVDAGDGLLHLLQQLALAVAGAQLQGVFFLDGGAVGGIRHELRFTQVLGGFAGVGQDVLFELFEPFLEERQLAFVHVVGLGHGQQFLLAGQINRRIALLPSSHRVTYPKRGLPRQALLQAPGENLLGQLAADEDHLGGRLFGRGPRFAGFGAHHHVHTLEQHAAVDALHVQDALVTQQVRAIDLHHAAQEFLEAGRIERLVGAEHEGADLVVVLGVVMMRVIAVRPAFAVVIVVMVVTVVVVAVIMIVAVPVGMAVGGIGMLIGQE

SEQ ID NO: 132451 - protein, 405 aa, Glycine max
  Coding DNA Sequence Number=SeqID_15673
  Gene Ontology: Mol. function=ATP-dependent helicase activity; Cellular component=nucleus; Biological process=mRNA processing
  Homolog annotation: Hit_ID=Q56XG6; Match level="QueryCoverage=84%, HitCoverage=77%, E-value=1e-166, Identity=85%"; Hit description=DEAD- box ATP-dependent RNA helicase 15
  Pfam annotation: Domain name=DEAD; Domain location=1-169; Score =129.2; E_value=1.2e-35; Accession=PF00270.19; Description=DEADDEAH box helicase
  Pfam annotation: Domain name=Helicase_C; Domain location=237-313; Score=120.0; E_value=6.9e-33; Accession=PF00271.21; Description =Helicase conserved C-terminal domain
  Pfam module annotation: Pfam domain module=DEAD::Helicase_C; Domain location=1-169::237-313
MDVICQAKSGMGKTAVFVLSTLQQVDPVPGQVAALVLCHTRELAYQICHEFERFSTYLPDIKAAVFYGGVNIKVHKELLKNECPHIVVGTPGRILALARDKDLGLKNVRHFILDECDKMLESLGLFLPPPPLWKFAYMRRDVQEIFKLTPHDKQVMMFSATLSKEIRPVCKKFMQDPMEIYVDDEAKLTLHGLVQHYIKLQETEKNRKLNDLLDALDFNQVVIFVKSVSRAAELNKLLVECNFPSICIHSAMSQEERLKRYKGFKEGKQRILVATDLVGRGIDIERVNIVINYDMPDSADTYLHRVGRAGRFGTKGLAITFVSSTADSEVLNQVRPYFHGDFRNISFVLPLGKWRRNQGTYSPTVPFINKFLYADVRCTKFCLIWKYDVFQCQTDDVLELLGGRS

SEQ ID NO: 132452 - protein, 364 aa, Glycine max
  Coding DNA Sequence Number=SeqID_15674
  Gene Ontology: Mol. function=nucleotide binding
  Homolog annotation: Hit_ID=Q6ZD37; Match level="QueryCoverage=98%, HitCoverage=86%, E-value=1e-133, Identity=66%"; Hit description=AP2 domain-containing protein AP29-like
  Pfam annotation: Domain name=DUF246; Domain location=19-335; Score =321.0; E_value=2.2e-93; Accession=PF03138.5; Description=Plant protein family
RGGGYMECSETHGMETLQLVATRPSNSSTIRNLWIYQSGLLWGAQSDAKRYVYDVDYFIQHMNGFVKVVKELPPEIASKEPVRVDCSKRKGQFDYVESVLPSLLKHKYISITPAMSQRRDRYPLYAKAALCQACYKALRLTRSLEMKASQLLDAIPKPFLSLHLRFEPDMVAYSQCEYPDLSPASMKAIEAAQVDRKPWTGELARVWRLRGKCPLTPNETALILQSLSIPPTTNIYLAAGDGLMEIEGLTDTYTNIVTKSSILSREDFTSMHGNTKAALDYYVSINSDSYIATYFGNMDKMVAAMRAFNGLYKTLFLSRRGFAQLTSQGLRGKKLMQALWKLHRDDFANGRGSALSECFCEFKL

SEQ ID NO: 132453 - protein, 113 aa, Glycine max
  Coding DNA Sequence Number=SeqID_15675
  Gene Ontology: Cellular component=chloroplast thylakoid membrane
  Homolog annotation: Hit_ID=Q672Q7; Match level="QueryCoverage=100%, HitCoverage=45%, E-value=3e-24, Identity=55%"; Hit description =Hypothetical protein precursor
  Subcellular localization annotation: CTP_CleavageSite=39; ConfidenceScore=5.31e-01
MACALQATLAANTYAFSSRRFSLKHQKNSKRRFSLFTVRADSDDSDCNEEECAPDKEAEKMRQNMIKVGKVSVEWLAGEKTKVVGTFPPRRKPGWTGYVEKDTAGQTNIYSVE

SEQ ID NO: 132454 - protein, 88 aa, Glycine max
  Coding DNA Sequence Number=SeqID_15676
MPGCQINTYIQLSISTIKTFPKEHGKEGNKKEANSQSQTQKLERMPTEDINASAEAFIKNFRHHLLLQRLQSIENHKQMLAKGKVADK

SEQ ID NO: 132455 - protein, 142 aa, Glycine max
  Coding DNA Sequence Number=SeqID_15677
MKADMEAMKEQMSTMMEAMMSMKRMMEVNAATVVASSTTTEVDPTHPFGFDQVNHPASDMVGQTIQNKHSFPSYGLPPNYMAPNVAHTPNENVDNSVPMPIESQQPQSDHAHVSQLMGEMHEASRDHNLVDSELCLEHATEG

SEQ ID NO: 132456 - protein, 227 aa, Glycine max
  Coding DNA Sequence Number=SeqID_15678
  Subcellular localization annotation: CTP_CleavageSite=49; ConfidenceScore=5.29e-01
MKFWNSSSKSCLCHSNDSMILTKVPFISSVPCRFGICHTPLEVTSSQLIASEVFPLFIVKALLYPGALAKAICKLKTIQSYRNLLNLYQFNTRAVSAASDLQRLEVLAGSYLSVGGAITGLIKPGRMSLFGILLLMWGLIRESIMGKSGFAHAKGIHIYPAMYIALISAFFSIRKDVRKIIRTFTRKHVVKAKRYKSKTLSSSFIAVQNSGLTKFFRKCTVQLIVPL

SEQ ID NO: 132457 - protein, 76 aa, Glycine max
  Coding DNA Sequence Number=SeqID_15679
  Gene Ontology: Mol. function=peptide deformylase activity; Cellular component=mitochondrion; Biological process=translation
  Homolog annotation: Hit_ID=Q9FV53; Match level="QueryCoverage=58%, HitCoverage=17%, E-value=1e-16, Identity=86%"; Hit description =Peptide deformylase, mitochondrial precursor
MAAVPKVACATVQLGFYNMSVTTWMELYMLIRWYPKLFEPGTTWTCLLPRGAPNLVLADPCFHTVAVSDKAFNADF

SEQ ID NO: 132458 - protein, 90 aa, Glycine max
  Coding DNA Sequence Number=SeqID_15680
MGVARRLESKQTRQNPLGFQKFVFFIATEHPYVLTEKLYFSFGADINNVDFNENMSSKFWCNVNILHRDASTSYISGMEKGTGVDGWDSL

SEQ ID NO: 132459 - protein, 116 aa, Glycine max
  Coding DNA Sequence Number=SeqID_15681
MAGLQRSEVSFRRQGSSGLVWDDKLLSGELNKNEDPKGAHGGDLNLNLNVRTTPPIQRSRSNGGYRTGKVSPAIEPPSPKLSACGFCSAFGKTGEKGRRAKPRAKHRSRNFGLCTK

SEQ ID NO: 132460 - protein, 176 aa, Glycine max
  Coding DNA Sequence Number=SeqID_15682
SDDSAAVRNGVSRLVDLIFRGQYIPKGALVIFDGLNKELCVGIHLVVIRIVHLGRKSGWLFCAFYFKQAASSLMMAYGGDEFVHPDNAVPVSLTRSGYPRIIPSHHRRMILKKDEKADMLGTQWSHGCLWPPRIRYAFDGPFYHPATIWAAITGKLGCTCEGAGKRRIFAIGNYVR

SEQ ID NO: 132461 - protein, 657 aa, Glycine max
  Coding DNA Sequence Number=SeqID_15683
  Gene Ontology: Mol. function=choline kinase activity; Cellular component=cytoplasm; Biological process=phosphatidylcholine biosynthetic process
  Homolog annotation: Hit_ID=Q42811; Match level="QueryCoverage=78%, HitCoverage=100%, E-value=0.0, Identity=88%"; Hit description=GmCK3p
  Pfam annotation: Domain name=APH; Domain location=286-517; Score =85.4; E_value=1.8e-22; Accession=PF01636.13; Description =Phosphotransferase enzyme family
  Pfam annotation: Domain name=Choline_kin_N; Domain location=234-285; Score=53.1; E_value=9.3e-13; Accession=PF04428.5; Description =Choline kinase N terminus
  Pfam annotation: Domain name=Choline_kinase; Domain location=310-513; Score=283.0; E_value=5.9e-82; Accession=PF01633.10; Description =Cholineethanolamine kinase
  Pfam module annotation: Pfam domain module=APH::Choline_kin _N::Choline_kinase; Domain location=286-517::234-285::310-513
MGAAEDLVNSTPGAAESKANHTPGPSENPIKDNTSTSENPVKDKALGAEIPEAGGAENPGSDQKNVEQNPASEQVSIAENMVNDQAGVTDNTAKEQVAGSAEDPTKNQAAGGAEDPPKDQVAGGAENPLNDLIDLAQNPDSEQAGSEENLLNNQAGGVENSAKNHAAAGAGDPPNDQAADGSENSAKNISARSAGDPPHDQTADGIENSLSNQSEATEKLVNDEQGPAESFVEDEVHVIETPEKCQKYGVETPISSKAERLPEEAKEILKSLASKWEDVFDANALQVIPLKGAMTNEVFQIKWPTTTGELSRKVLVRMYGEGVDVFFNRDNEIQTFEFMSKNGQGPRLLGRFMNGRVEEFIHARTLSASDLRDPSISALIATKMKEFHDLDMPGEKKVHLWDRLRNWFSEAKRLSSPKEFEAFYLDTIDKEISILEKELSGPHQRIGFCHNDLQYGNIMLDEETNSVTIIDYEYASYNPVAFDIANHFCEMAANYHTEEPHILDYNKYPDFEERQRFVQAYLSTSGEQLSNSEVEQLLQEIEKYTLANHLFWGVWGIISVSPITVLLDVGINKAFVFFWEAQVNTIDFDYKEYAKQRFQEYWARKPYLLINSEAPSPYNVPEGTGELASALPTKSKNSGIFRKMKRVLGLGLFKSKS

SEQ ID NO: 132462 - protein, 116 aa, Glycine max
  Coding DNA Sequence Number=SeqID_15684
  Gene Ontology: Mol. function=cytochrome-c oxidase activity; Cellular component=mitochondrial envelope; Biological process=electron transport
  Homolog annotation: Hit_ID=Q0KKQ5; Match level="QueryCoverage=83%, HitCoverage=57%, E-value=5e-40, Identity=78%"; Hit description =Cytochrome c oxidase subunit Vb
  Pfam annotation: Domain name=COX5B; Domain location=4-104; Score =45.2; E_value=2.2e-10; Accession=PF01215.9; Description=Cytochrome c oxidase subunit Vb
DATAIKKKVEDIMPIATGHEREELQAELEGRNILEIDHPEGPFGTKEAPAVVKSYYDKRIVGCPGGEGGGEQLVLITEDEHDVVWFWLEKDKPHECPLEVVGPGGPPDGHGDDDHH

SEQ ID NO: 132463 - protein, 262 aa, Glycine max
  Coding DNA Sequence Number=SeqID_15685
  Gene Ontology: Mol. function=hydrolase activity; Cellular component =cytosol; Biological process=fatty acid metabolic process
  Homolog annotation: Hit_ID=UPI000034F493; Match level="QueryCoverage =94%, HitCoverage=92%, E-value=5e-97, Identity=70%"; Hit description =carboxylic ester hydrolase
  Pfam annotation: Domain name=Abhydrolase_2; Domain location=15-256; Score=116.9; E_value=5.8e-32; Accession=PF02230.7; Description =PhospholipaseCarboxylesterase
MPSAGSRTASRSLEFGKTHVVRPKGKHQATIVWLHGLGDNGLSSYQLLESLPLPNIKWICPTAPSRPVTILGGFSCTAWFDMGELSEDGPVDWESLDASASHIANLLSTEPADVKVGIGGFSMGAAVAQYSATCFAMGRYGNGIPYPVNLRAVVGLSGWLPGSSHMLMVDNFCLCRSLRNKIEVSHEARRRAALLPVLLSHGISDDVVLYKYGEKSAQSLSSAGFRYITFKSYDGLGHYTVPREMDEVSNWLSSRLGLGGST

SEQ ID NO: 132464 - protein, 513 aa, Glycine max
  Coding DNA Sequence Number=SeqID_15686
  Homolog annotation: Hit_ID=Q10MP8; Match level="QueryCoverage=55%, HitCoverage=44%, E-value=9e-27, Identity=30%"; Hit description =Transducin family protein, putative, expressed
MVKDKLKKHVLTAFTPNEDSVAILSANEVAKGTSLLALSTIDGSVIAVDVSTGERKLTTSHPGGICGLSFANKGRLLRIVGHNGVAYEVNTETGEVLKEFKISKKSITSLAFSNDEKYLAIVSSRLRIISWEIGKEILKFPNDLGNVQLISISSDAKNLVTSDFEGKHLQVWKCDLNSGNVGRGPTLPIRHPPLILDCHSGCNKEDVVVLAVTGRGSAYIWNLNASSEDQIQPTKLNTKTKIVETEKENGVSSKKRHASIIASRLQPVEEDKQIKALVTYGSVDHPQFSVLNISNSGENIVLYVGDETDSVQQHDSPSGKAIPMESKKVKKRQATSDPDPPTSTDEEDLDQHEAAEGVLLDDDLNEPTMGEKLASLSLLDENKSRSEIEQESSVPAKPPSADSVHVLLKQALNADDRTLLLDCLYTQDEKLIESRVSTFKSAIQLSSCLDTLHIGAIDEEEDEGEMVPVIYEDKDSSDEESDDTMETDPDEQQPEEQFHAARYIDASDDDMSD

SEQ ID NO: 132465 - protein, 136 aa, Glycine max
  Coding DNA Sequence Number=SeqID_15687
  Homolog annotation: Hit_ID=O49817; Match level="QueryCoverage=95%, HitCoverage=98%, E-value=9e-30, Identity=48%"; Hit description=Late embryogenesis abundant protein 2
  Pfam annotation: Domain name=LEA_4; Domain location=32-75; Score =20.2; E_value=0.0076; Accession=PF02987.7; Description=Late embryogenesis abundant protein
MASHEQSYRAGEAKGRNQEKTNQMMGNMGQKAQAAKDKAQQAAHAAKDKTQQAAHSVNEKAQEKSGQTKEKASEMGQFTKEAAQSGKQNTGGFLQQTGEKVKEMAQGATEAVKQTFGMAPQNDEDKDYYPTQHGRE

SEQ ID NO: 132466 - protein, 58 aa, Glycine max
  Coding DNA Sequence Number=SeqID_15688
MEARSCLLGSFIHSYHSIEIEIKLSHGLNSSNFLFQFFLVPHKILDCKINMRHTQDIY

SEQ ID NO: 132467 - protein, 224 aa, Glycine max
  Coding DNA Sequence Number=SeqID_15689
  Gene Ontology: Mol. function=metal ion binding; Cellular component =integral to membrane; Biological process=ubiquitin cycle
  Homolog annotation: Hit_ID=Q9FL42; Match level="QueryCoverage=75%, HitCoverage=93%, E-value=5e-36, Identity=49%"; Hit description =Putative RING-H2 finger protein ATL5E
LISSPGVESQRNELRQRRGGRRRQRRGHRGVPAEGTRGTHLEPLIDALSVEAVAALRNAPYGLLGKILAQANRARALVAGPGQAFALSDHDLGPVAGLDGGLLHAQDHNARPIRGVTKTTIVIIIIIVVDAVVVTVASDDDDVGFDSDAGVGGEHDGGDEDQDAHGDGNAVAESLGGGDGGGWRSRREHEKEKERVWLVRNLELDCVIRTAFRGKKLNACLKRL

SEQ ID NO: 132468 - protein, 166 aa, Glycine max
  Coding DNA Sequence Number=SeqID_15690
MGEVEEVQKQMKADMEAMKEQMATMMKAMMSMKKIMKANAVAVTATSAVAKVNPKPPSGLNQMNHPTSDMVGEDLGSMDDPYYVQIQNKHAFPPYGLPPNYTPPNVAYTSSENVNNSTPILIESRQPQTDHAHVSQTMRETHEIPHHNLADFEPCLGYATEGQAVG

SEQ ID NO: 132469 - protein, 387 aa, Glycine max
  Coding DNA Sequence Number=SeqID_15691
  Homolog annotation: Hit_ID=Q1SKD7; Match level="QueryCoverage=52%, HitCoverage=52%, E-value=5e-09, Identity=26%"; Hit description =Ankyrin
MPCPHQWEAANWDTSRFTSEIAWHRYQDNIQLRNILPERNVELGPRMFDEFLQELRRRRWDQVLTHLPEKRIDVALVKEFYSNLYDPEDHSPRFCRVRGQVVRFDADTINDFLDTPVILEDGEEYPAYTRYLSTHPDPDTIAATLCTPGGRFVLNADGLPWKLLRKDMMTLAQTWSVLSYYDLAPTSHTSDVNLDRARLIYGLVSRMDMDVGSFISQQISQIVQSSTSRLGFPALITALCDIQGVVSDTLIFESLSPAINLAYVKKNCWNPADPSITFPRPRRTRTRASASAPEAPLPTQSPSQPSQRPRHPPASTSASMDMHGQMLRSLHVGQQLIMENMHRLSLHLQMDPPLTTPEAYRQRVAWPGDQPSTDRGEEPSGAAEDPA

SEQ ID NO: 132470 - protein, 85 aa, Glycine max
  Coding DNA Sequence Number=SeqID_15692
  Gene Ontology: Mol. function=DNA photolyase activity; Biological process=DNA repair
  Homolog annotation: Hit_ID=O48652; Match level="QueryCoverage=69%, HitCoverage=11%, E-value=2e-11, Identity=53%"; Hit description=6-4 photolyase
MIYTNGVGCIIWHDILLHFSNSRRSVVSHDSASKECPRKMGEAYALNKELNGLVSEDDLKNLRRKLDESEGQDSGAKTYKQQLIG

SEQ ID NO: 132471 - protein, 652 aa, Glycine max
  Coding DNA Sequence Number=SeqID_15693
  Gene Ontology: Mol. function=catalytic activity
  Homolog annotation: Hit_ID=Q5VQE5; Match level="QueryCoverage=91%, HitCoverage=91%, E-value=0.0, Identity=56%"; Hit description =Alpha/beta hydrolase-like
  Pfam annotation: Domain name=Abhydrolase_1; Domain location=399-638; Score=48.9; E_value=1.8e-11; Accession=PF00561.10; Description =alphabeta hydrolase fold
MGKGGQCFFEKLRRCVRTVFFVVALVASLAVTSLPVVVAVVDVLVPCVLIPNFTCVKCYSIKEHFHRYAFKSSFTDIPLVSVIRSLIILCVYSVCDGPALSHGPYLGTVTLCSFLSIVLLSVKACVFTVNSHMEAEASVSLRKHRLHLKKPWGMPVLFLSSVVFALGHSVVAYRTSCRARRKFLFHRVDPEAVLSCKNVFSGYPKVPRSPTPSAGRTPKSDCEMRRRPFGTARDEELLVRLLANSDSLFITCQGLTLHYKLNLPGSPPHTLSSMSCIDSKSSCSTSSMAAGLAKSNKHLPSTSPNIQPQLYRSYSNQFHGSSLHIPLLDGPINSIISEDIPVFHLDGVCEDETSKLNFQSLEQDLENIDQLGIVLVHGFGGGVFSWRHVMGCLARQSSCTVAAFDRPGWGLSSRPRREDWEEKELPNPYKLESQVDLLLSFCSEIGFSSVVLIGHDDGGLLALMAAQRIQTSMNYFNVNVKGIVLLNVSLSREVVPSFARILLHTSLGKKHLVRPLLRTEITQVVNRRAWYDSTKMTAEVLTLYKAPLSVEGWDEALHEIGKLSSETILSAKNAESLLQAVGDIPVLVIAGAEDSLVSLKSCQAMALKLVNSRLVAISGCGHLPHEECPKALLAAMSPFISRLLSASDSQRQ

SEQ ID NO: 132472 - protein, 94 aa, Glycine max
  Coding DNA Sequence Number=SeqID_15694
MKDNIQMRILQGAEVVAATFPWRSCCHHRAKHVWLAHASHRSFCSSTKTLIEVTVGAYTNRSHPWTVIPLGVPGATNLLFDLDQNDVSVLDSRS

SEQ ID NO: 132473 - protein, 74 aa, Glycine max
  Coding DNA Sequence Number=SeqID_15695
MIVFQNGFLDCTNPPMGMIPESHKAISKGPMLCVDIDEAVYPSRAVQSSPSKGTEYEEIPGAPRLSFSFRVCHA

SEQ ID NO: 132474 - protein, 511 aa, Glycine max
  Coding DNA Sequence Number=SeqID_15696
  Gene Ontology: Mol. function=protein binding; Cellular component =membrane; Biological process=defense response
  Homolog annotation: Hit_ID=Q1SPY2; Match level="QueryCoverage=94%, HitCoverage=25%, E-value=1e-82, Identity=39%"; Hit description =Disease resistance protein; AAA ATPase; Zinc finger, C2H2-type
  Pfam annotation: Domain name=NB-ARC; Domain location=15-315; Score =121.8; E_value=1.9e-33; Accession=PF00931.13; Description=NB-ARC domain
MAQLNQNSKFDPFSKIPELPGMNYYSSKGFVLFESKKSSYNKLLEALKEESVCMVGLVRIGGLGKTALAKEVGKEAEKLKLFEKIVIATVSETPNIRSIQAQISDQLGLKLEEESDIGKARRLSERLSEGTTFLILDDVGENLDFESLGIPINENKKGCGVLQITWKREVCTSMQCQCTVELNLLTGEEAWTLFKLYAKITDDSTYALKGVATKIVDECKGLPIAIVTVGSTLREKTLKDWKLALSRLQDSKPLVIPKGLRSPNAFLQLSYDNLKDELAKSFFLLCSIFPEDYEIDLEDLFRFGRGLRITGTFETIEEAREEMLLAVGILMDSCLLLHAGNEKVKMHDMVRDVALWIASERGQAILASTAKDLRAVIKDETIKDKRAISLWDLKNGQLSNGNHMNCPTLKILLLHSSIIGFEVSNEFRFWGPKRCTSSLPQSTESLKNLHNLCSRSCKLGDISILENLQALEILDLRCSCFDELPNGIVELKKLKVLDLYNCRIKENNAYE

SEQ ID NO: 132475 - protein, 446 aa, Glycine max
  Coding DNA Sequence Number=SeqID_15697
  Gene Ontology: Mol. function=signal transducer activity; Cellular component=membrane; Biological process=response to light stimulus
  Homolog annotation: Hit_ID=Q9LRP8; Match level="QueryCoverage=94%, HitCoverage=100%, E-value=1e-129, Identity=57%"; Hit description =Putative non-phototropic hypocotyl protein
  Pfam annotation: Domain name=NPH3; Domain location=45-296; Score =340.5; E_value=2.7e-99; Accession=PF03000.5; Description=NPH3 family
MPNTVPTTATSSSSTSLFELLTEMKKQSCPESLILQAKSPSQFSSECWFDDACILDMDYFVKTLSGIKAKGVRADLIGFIITHYASKWLPDLSAGDMAEKGLTQFEESPESVTASWMKKRFFVETLVGVLPPEKDAIPCNFLLRLLRTANMVGVEGTYRQELEKRISWQLDQASLKELVIPSFSHTCGTLLDVELVIRLVKRFVSLDSEGAKSVASLVKVAKLVDSYLAEAAVDANLSFNDFVTLAAALPSHARATDDGLYRAIDTYLKAHPGVSKQERKGLCRLIDSRKLTAEASLHAAQNERFPVRAVIQVLLSEQSKLNRHVDWSGSLVSVTRSPGGLDLPTRCLSKREVNAQQLEIRRLKEDVYRLQSHCNAMQAQMERMVVEKKKGFFKWKKFAFGKSEHDKMEQELQGNGMYTPADLKTRLVNAKGTSKNNTHKWRKSMS

SEQ ID NO: 132476 - protein, 214 aa, Glycine max
  Coding DNA Sequence Number=SeqID_15698
MKFPFSAIVALWFVCDLVLANSRYPEGMYSFDRSSHVTYKYDRMSEVQKQCASVLSASSELRYQYSVTGMKGELSFANGDWRQDGGKFPIMPFDANKSPGTLSGDRAPLNLVSFWVSDVDHDHRLKKLIPINGFMVIGITRDGNFVDNAYDVNAEFQLWPSHSQLSIPFQGIYTESKKNGGERVLCLLGNTMLPTREADPANPWEWMKNPSDIP

SEQ ID NO: 132477 - protein, 172 aa, Glycine max
  Coding DNA Sequence Number=SeqID_15699
  Gene Ontology: Mol. function=transporter activity; Cellular component= integral to membrane; Biological process=transport
  Homolog annotation: Hit_ID=Q9ASA0; Match level="QueryCoverage=67%, HitCoverage=31%, E-value=3e-40, Identity=66%"; Hit description =Sulfate transporter protein-like
RCNSANSVIAVCKLSGDLFPEREASAMHVSVSVGLMNFVGCWFGAMPCTSGGLAGQYRFGGRSGASVVFLGIAKLFPIEILGVLLLFAGIELAMAAKDMLVCEAVSLTGSSGALGFFVGIVLGVMRAPGFLPNYDAMDCWRAVGLGNIRTWLKILRTSQSIIQCFGIWMYSL

SEQ ID NO: 132478 - protein, 852 aa, Glycine max
  Coding DNA Sequence Number=SeqID_15700
  Gene Ontology: Cellular component=membrane
  Homolog annotation: Hit_ID=Q9FLR4; Match level="QueryCoverage=37%, HitCoverage=68%, E-value=9e-83, Identity=52%"; Hit description =Arabidopsis thaliana genomic DNA, chromosome 5, P1 clone:MBK20
  Pfam annotation: Domain name=BT1; Domain location=415-829; Score =346.1; E_value=5.7e-101; Accession=PF03092.7; Description=BT1 family
  Pfam annotation: Domain name=MFS_1; Domain location=405-779; Score =26.0; E_value=2.1e-05; Accession=PF07690.6; Description=Major Facilitator Superfamily
  Pfam module annotation: Pfam domain module=BT1::MFS_1; Domain location=415-829::405-779
MHLSDPKSKTLTLIPNSTLIILDRTLLLSDELLLRILSKLPDSSQQRNSNSLVCKRWLNLQGRLVRTLRVLDWSFVLSGRLINRFPNLNHVDLVPGSFTSSSVNTTTTIVVSHRLLSMHVDSAWRIGVEKNLLPVETVDAGLKSLASGCPNLRKLEVAGCSEVGISTIGAECATLQELELQRCDDAVLGGVAGCENLQILKIVGCVKGFYESVVSDIGLTILAQGCKRLVRLELVGCEGSFDGVKAIGQCCVMLEELVIVDHRMDDGWLAGVSYCENLKTLRVQSCKVIDGSPGLEEHLGCCEALERVHLHKCQVRDRNAVGALFSVCRNAREIVLQDCWGLDDATLSLAVVCRNHNNPNSNSAVDNRPTFTANTVTRHVFFKEKKYEENEREVVGSSNCNRQMMLLCGFGYWVQGFRCFPWLALNFHMASNLNLHPSTLQLVQNLANLPMVAKPLYGILSDAIYIKGAHRIPYVVIGVFSWSLLALVPVAHKVLPNIIVFVLLSNMGASITEVAQDALVAEYGKKHKIGSLQSYAFMALAAGGILGNLIGGYLLLKLPPRAMFFIFSSLLSLQLAISFSTREESLGIAQLSGQNLAKRSISENIKKQVSNLVMAISDKSISKPLIWIVGSIAMVPMLSGSIFCYQTQCLNLDPTVIGCSRVIGQFVLLSGTMLYNRYWKKIPLRKLIGMVQILYASSLLLDFILVKQINLKWGIPNEVFALCCSGLAEVVAQFKLLPFSVLFANLCPKGCEGSLTAFLASALCLSSIASAFLGVGFASCLGITSSDYSGLTWGILVQFIAALIPLRWIHSLPMSQSVEKQRKRSMSRRARRNRRVGKVVFGYVDVYRPERE

SEQ ID NO: 132479 - protein, 77 aa, Glycine max
  Coding DNA Sequence Number=SeqID_15701
MDKLSKAAMMMAAKETMVIAAVVTAPPDYKRHKILVLHIWNSGLVPSLVPELPILTGKIPTSDQSVLYIGHSIILDP

SEQ ID NO: 132480 - protein, 702 aa, Glycine max
  Coding DNA Sequence Number=SeqID_15702
  Subcellular localization annotation: CTP_CleavageSite=30; ConfidenceScore=5.35e-01
MAQMISADVICERATSKSNTGSARVSTVFRAVSPSENQYTAAKRSGPSNTSLAAEGIWKPSSGQLCMVGCLGLVDAGGSSCNTRICMYIPTTFSLKQHSIILGTLSPINNSSAFFPLSFEQLVLPYELWNYFKLTNPNYSYSKINLAGTVLEKNEPFSFTTVIKKSLLTFPKLEDNEAYQDSLSVLSEDLTFHVSGFPDPVPNVLAPKVDIQMEILSIGPLFGRYLYTKNSSESEQETPDLAKAAEYTEKQLLINVSAQLSLTGKGYSNFSVLFLEGLYDPHVGKLYLIGCRDVRAPWKVLYQSYDLEAGMDCLIQVVVAYPPTTTRWLVDPRATISIESQRTDDDALRFDPIKLKTFPIIYRKQREDVLSRRGVEGILRILTLSFAIGCILSQLFYIQQNVDSLSYISLVVLGVQALGYSIPLVTGAEALFKKMVSESYDVSSSELESSEWLHVIDYTVKLLLIVSLLVTLRLFQKVWKSRIRLQMRTPLEPHRVPSDKLIFLCTVTIHVIGYVIVLMIHGTKTSQKALIAKTYLVDGRNSHSLPGWATDLEEYVGLVEDFFLLPQIIGNLVWHIDCKPLRKLYFIGITLVRLLPHIYDYIRAPVPNPYFSEDSEFVNPNLDFYSKFGDIAIPVTAIILAIVVYIQQRWGYEKLSQFLTFGQYKLLPTFRYQRLSSRAGESELVPGINGAAVKENEQVDVE

SEQ ID NO: 132481 - protein, 83 aa, Glycine max
  Coding DNA Sequence Number=SeqID_15703
MSVQEFIRSHLEATIARLLCLVEWLNCPLDGVEWLYSQIESLEGVLEKKNRLLEATAVLKVAHTFYYDLGLGWWGTFVLVARI

SEQ ID NO: 132482 - protein, 223 aa, Glycine max
  Coding DNA Sequence Number=SeqID_15704
  Subcellular localization annotation: CTP_CleavageSite=94; ConfidenceScore=5.77e-01
MDKTASTLSGRHNLTELPPSPRLVRSRSGSSPAAAITTPERSSHRLSSSQRFTITSIQRSKSTSRTRTTNNERNNINLNPTLTTSVSSKPKNNRVQEKKSRDDGFGKFLQRGVSPDNINVGASKRSTSKSPSAWALSPGRWSLGSPIWSQPPAKTNGSDNGNNDSSVGGGVTKVLKYFKQRKVSSVQEEEYHRFRILHNTLLQWRFINARAEVAMANVKNIAE

SEQ ID NO: 132483 - protein, 257 aa, Glycine max
  Coding DNA Sequence Number=SeqID_15705
  Homolog annotation: Hit_ID=Q9ZUY2; Match level="QueryCoverage=89%, HitCoverage=33%, E-value=1e-46, Identity=52%"; Hit description =Putative membrane transporter
  Subcellular localization annotation: CTP_CleavageSite=68; ConfidenceScore=5.39e-01
MSNSNPNNRNRHAPSPPEPKPMPPSSWAKKTGFRPKLSGETNVTDSGPITTPPPNVDLEAGRVRTPATANGVTNGDKAPVPVPPPPAAAKKRRDSDGVPKSSVLSTNGQAPAAEPPPRRTARHEEVVDGLPADDDEFVSRHSHMKYELRDSPGLVPIGVYGIQHYFSILGSLVLIPLVIVPTMGGTHCFNLGGEVVDVLVSVGGNFYGGIDRALCLGGDNSLAYCFWLQVALDSGPFFCLSRTGARDNQLPGVSRIE

SEQ ID NO: 132484 - protein, 107 aa, Glycine max
  Coding DNA Sequence Number=SeqID_15706
  Subcellular localization annotation: CTP_CleavageSite=35; ConfidenceScore=5.22e-01
MKSEWALLSLRRLGRVNVDSQVWPSLQARYACVVVVATVQSGSASGRMRVSFATVRVCGGRVDGEVRGRDDVEGSQSHYTFLFSVLFSLFILRDMFSSFSSFFSLKN

SEQ ID NO: 132485 - protein, 102 aa, Glycine max
  Coding DNA Sequence Number=SeqID_15707
  Homolog annotation: Hit_ID=Q10Q83; Match level="QueryCoverage=98%, HitCoverage=22%, E-value=9e-07, Identity=32%"; Hit description =Expressed protein
MLRKITIQKRIELRKVKQLVKLYQILDGQLYLLTEWAQLERRNQESVARLTRKLSALSTILPLTHTVKVIKVDTESVFEALNTAAKVMESIEPLMAKYQTKL

SEQ ID NO: 132486 - protein, 82 aa, Glycine max
  Coding DNA Sequence Number=SeqID_15708
  Subcellular localization annotation: CTP_CleavageSite=42; ConfidenceScore=5.39e-01
MMITSSTTTSPSSRKPHNLFLTSHAAIEHPPRPPSFARKNKRCDIVRRVSGEGSGTRHGGAVVRGGRSIAGASIIVGVVVAD

SEQ ID NO: 132487 - protein, 206 aa, Glycine max
  Coding DNA Sequence Number=SeqID_15709
  Gene Ontology: Mol. function=transporter activity; Cellular component= integral to membrane; Biological process=transport
  Homolog annotation: Hit_ID=Q9ZUY2; Match level="QueryCoverage=92%, HitCoverage=26%, E-value=4e-76, Identity=71%"; Hit description =Putative membrane transporter
  Pfam annotation: Domain name=Xan_ur_permease; Domain location=3-200; Score=-147.1; E_value=0.012; Accession=PF00860.11; Description =Permease family
YLRKISVLGHRIFLIYAVPLGLAITWAFAFMLTEAGVYSYKGCDANIPSSNMVSEHCRKHFSRMRHCRVDTSQALKSSSWFRFPYPLQWGTPVFHWKMAIVMCVVSLISSVDSVGSYHASSLLVASRPPTPGVLSRGIGLEGLASVLAGLWGTGTGSTTLTENVHTIAVTKMGSRRAVQLGACFLIVLSLIVTLKFHFAGLQYFGQ

SEQ ID NO: 132488 - protein, 379 aa, Glycine max
  Coding DNA Sequence Number=SeqID_15710
  Gene Ontology: Mol. function=oxidoreductase activity; Cellular component=cytoplasm; Biological process=gibberellic acid mediated signaling
  Homolog annotation: Hit_ID=O22377; Match level="QueryCoverage=98%, HitCoverage=100%, E-value=1e-114, Identity=57%"; Hit description =Gibberellin 3 beta-hydroxylase
  Pfam annotation: Domain name=2OG-FeII_Oxy; Domain location=207-307; Score=143.3; E_value=6.3e-40; Accession=PF03171.10; Description=2OG -Fe(II) oxygenase superfamily
MPSLSEAFRGHPVYLHHKHSDFNSLQELPDSYSWTQPHDHHLPNYPSNNKTKIFVPVIDLNHPNAPNLIGHACKTWGVFQVVNHDIPMSLFSDIQRASLALFSLPFTRSSKQLAPPTASPAMAALASPPSSPSSCGLSASQFSIPLLIFSSNSGHKTMLNTGTDIVVEYEAAMKKLAAKLMCLMLASLGITKEDTKWAGPKGEFNGACAALHLNSYPSCPDPDRAMGLAAHTDSTLLTILHQNNVNGLQVLKEGEGWVAVPPLHGGLVINVGDLLHILSNGLYPSVLHRVRVNRTQQRFSVAYLYGPPANVQISPHVKLVGPTRPALYRPVTWNEYLGTKANLFNKALSAVRLSASINGLFDINEDQNNDFQVGFNLDI

SEQ ID NO: 132489 - protein, 596 aa, Glycine max
  Coding DNA Sequence Number=SeqID_15711
  Gene Ontology: Mol. function=RNA-directed DNA polymerase activity; Cellular component=intracellular; Biological process=RNA-dependent DNA replication
  Homolog annotation: Hit_ID=Q6EPP6; Match level="QueryCoverage=78%, HitCoverage=98%, E-value=1e-116, Identity=47%"; Hit description =Pentatricopeptide (PPR) repeat-containing protein-like
  Pfam annotation: Domain name=PPR; Domain location=105-139; Score=6.5; E_value=1.3; Accession=PF01535.11; Description=PPR repeat
  Pfam annotation: Domain name=PPR; Domain location=140-174; Score =13.5; E_value=0.19; Accession=PF01535.11; Description=PPR repeat
  Pfam annotation: Domain name=PPR; Domain location=175-208; Score =16.3; E_value=0.088; Accession=PF01535.11; Description=PPR repeat
  Pfam annotation: Domain name=PPR; Domain location=209-243; Score =40.6; E_value=5.5e-09; Accession=PF01535.11; Description=PPR repeat
  Pfam annotation: Domain name=PPR; Domain location=244-278; Score =47.4; E_value=4.9e-11; Accession=PF01535.11; Description=PPR repeat
  Pfam annotation: Domain name=PPR; Domain location=279-313; Score =52.7; E_value=1.2e-12; Accession=PF01535.11; Description=PPR repeat
  Pfam annotation: Domain name=PPR; Domain location=314-348; Score =35.5; E_value=1.9e-07; Accession=PF01535.11; Description=PPR repeat
  Pfam annotation: Domain name=PPR; Domain location=350-384; Score =39.2; E_value=1.4e-08; Accession=PF01535.11; Description=PPR repeat
  Pfam annotation: Domain name=PPR; Domain location=385-419; Score =34.5; E_value=3.6e-07; Accession=PF01535.11; Description=PPR repeat
  Pfam module annotation: Pfam domain module=PPR::PPR::PPR::PPR::PPR::PP R::PPR::PPR::PPR; Domain location=105-139::140-174::175-208::209 -243::244-278::279-313::314-348::350-384::385-419
MFLFQKGSHLHRLLLSKKYYYHFPLPRNAVTIADSVEHPSDATIAKLVLESDPRTVSEALTKPTIQWTPDLVNKVMKRLWNHGPKALQFFKHLDRHHPSYTHSPSSFDHAVDIAARMRDFNSAWALVGRMRSLRLGPSPKTLAILAERYASNGKPHRAVRTFLSMAEHGIRQDLHSFNTLLDILCKSKRVETAHSLLKTLTSRFRPDTVTYNILANGYCLIKRTPMALRVLKEMVQRGIEPTMVTYNTMLKGYFRSNQIKEAWEFYLEMKKRKCEIDVVTYTTVIHGFGVAGDVKKAKRVFHEMVKEGVVPNVATYNALIQVLCKKDSVENAVVVFEEMAREGVCVPNVVTYNVVIRGLCHVGDMERALGFMERMGEHGLRACVQTYNVVIRYFCDAGEVEKALEVFGKMGDGSCLPNLDTYNVLISAMFVRKKSEDLVVAGKLLMDMVDRGFLPRKFTFNRVLNGLVITGNQDFAKEILRMQSRYSKLKEDNLHGSELLKVYCLFNWRACPHSVILTKFLHSGELSGDEPTISENLALKVSSFRCSKELIAVLRRTKWNEKKINYQNGQNNETYFACYSFTTLGKYYMIGLTIPG

SEQ ID NO: 132490 - protein, 428 aa, Glycine max
  Coding DNA Sequence Number=SeqID_15712
  Gene Ontology: Mol. function=prephenate dehydratase activity; Cellular component=cytoplasm; Biological process=L-phenylalanine biosynthetic process
  Homolog annotation: Hit_ID=Q6JJ29; Match level="QueryCoverage=93%, HitCoverage=93%, E-value=1e-166, Identity=71%"; Hit description =Prephenate dehydratase
  Pfam annotation: Domain name=PDT; Domain location=133-312; Score =318.9; E_value=9e-93; Accession=PF00800.9; Description=Prephenate dehydratase
  Subcellular localization annotation: CTP_CleavageSite=33; ConfidenceScore=5.12e-01
MQTLTPPYPNPLNYLTRARHSVIRVAPTRFTVKCGYGFESASFSQGLGASRADWQSSCAILASKVVSQREDSPADGDDHDNNVGDVNGHNAAVTNLNIVPVKADGENIKPIPPKPLTISDLLPAPMHGSQLRVAYQGVPGAYSEAAAGKAYPNGEAIPCDQFEAAFQAVELWIADRAVLPVENSLGGSIHRNYDLLLRHRLHIVGEVQLPVHHCLLALPGVRKEFLTRVISHPQALAQCEHSLTKLGLTVTREAVDDTAGAAEFVAANDLRDTAAIASARAAELYGLQILADGIQDDPNNVTRFVMLAREPIIPRTDRPFKTSIVFAHDKGTSVLFKVLSAFAFRNISLTKIESRPHRSRPIRVVDDESEGTAKHFEYLFYIDFEASMAEVRAQNALAEVQEFTSFLRLLGSYPIDITPWTPSSPRQN

SEQ ID NO: 132491 - protein, 64 aa, Glycine max
  Coding DNA Sequence Number=SeqID_15713
MMMDSTVKENTSDRRFCISMEISKKAKDHSNSGILKKMAELVILELLVAILLSPLIILHRHSVI

SEQ ID NO: 132492 - protein, 249 aa, Glycine max
  Coding DNA Sequence Number=SeqID_15714
  Subcellular localization annotation: CTP_CleavageSite=96; ConfidenceScore=5.22e-01
MLCVSDSCVKPLPLKKKNPFSLFVQHQWLPRAAGYSKAQMCFFKILRIISSTPPSKQQQPFPTKGVGIDLNLRFRSVTETEESESSRSDNDNASATAQTNSNEGFPEKSVEVSEKLDNNNNNNTTNEVNNHAETASFKGRDGNCFDLLIEAARVVSGKEESDSEELGGELRTRRASKVKRREKWVVVDLYGDVLGEREPVVRSKRGRNQALPYRFKDSVVEPLKRATRSQRPSSTTHLTKRLLRSSPTT

SEQ ID NO: 132493 - protein, 44 aa, Glycine max
  Coding DNA Sequence Number=SeqID_15715
MGHKQCSNLFVDELRHSVELTEARKLELGNSKTLLDFFGSTGCL

SEQ ID NO: 132494 - protein, 151 aa, Glycine max
  Coding DNA Sequence Number=SeqID_15716
  Homolog annotation: Hit_ID=Q10RE9; Match level="QueryCoverage=37%, HitCoverage=25%, E-value=7e-07, Identity=39%"; Hit description =Expressed protein
MDNFCPCFFVSLFTCDVSATSSTQLMSNQTQDDLLNICDFVYCGKGTCQLSSAELLGFTCDCESGWKKPNIGSIELPPCSFPNCTVNFNCGNGSPAPPSSPPTQVSDRTFGGDCNGFDLGFSSETPPPPATSGTASPGTTASTYPSKHSLT

SEQ ID NO: 132495 - protein, 235 aa, Glycine max
  Coding DNA Sequence Number=SeqID_15717
  Gene Ontology: Mol. function=microtubule-severing ATPase activity; Cellular component=microtubule
  Homolog annotation: Hit_ID=Q9SEX2; Match level="QueryCoverage=63%, HitCoverage=28%, E-value=1e-38, Identity=58%"; Hit description =Katanin p60 ATPase-containing subunit
MVGGSLAGLQEHLKLARDYALEGLYDTSIIFFDGALAQINKHLSTVQDPLIRAKWMNVKKSLSEETEVVKQLDAERRAFKDNPIGRRPASPPISVKSSSSFVFQPLDEYPTSSSGSGPVDDPDVWRPPSRDTTSRRPARPGQVGARKSAQDGAWARGATTRSGAAGRGAKAGATGRVNSGTRASTTGKKGGAASGKASKTDAAAAAVTVSFSFDEAVCWRKFTVSRYLVGWRSCF

SEQ ID NO: 132496 - protein, 37 aa, Glycine max
  Coding DNA Sequence Number=SeqID_15718
MAEVAKVDTVDVVNIDIRDGEGGSHRRIKPMWEEVRE

SEQ ID NO: 132497 - protein, 72 aa, Glycine max
  Coding DNA Sequence Number=SeqID_15719
  Subcellular localization annotation: CTP_CleavageSite=36; ConfidenceScore=5.32e-01
MQIASMNSATLRHATRGCVASATGDSTDVATCNGVLAMQGGVAGQTSASPRVSGTAFAGEPAFAVQLKTPGP

SEQ ID NO: 132498 - protein, 540 aa, Glycine max
  Coding DNA Sequence Number=SeqID_15720
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q8S563; Match level="QueryCoverage=93%, HitCoverage=66%, E-value=1e-152, Identity=59%"; Hit description=KAP-2
  Pfam annotation: Domain name=Ku; Domain location=23-216; Score=96.7; E_value=6.8e-26; Accession=PF02735.6; Description=Ku70Ku80 beta -barrel domain
  Pfam annotation: Domain name=Ku_C; Domain location=301-396; Score =13.0; E_value=0.0037; Accession=PF03730.4; Description=Ku70Ku80 C -terminal arm
  Pfam annotation: Domain name=Ku_PK_bind; Domain location=413-536; Score=235.7; E_value=1e-67; Accession=PF08785.1; Description=Ku C terminal domain like
  Pfam module annotation: Pfam domain module=Ku::Ku_C::Ku_PK_bind; Domain location=23-216::301-396::413-536
  Subcellular localization annotation: CTP_CleavageSite=21; ConfidenceScore=5.38e-01
MQPIGSVPMNAGSSTFLTQICASSISNTGFPSKIRQVMVYKKTTEEKFPSMKKYSDKAPPNDKFAKHEVKIDYEHKSSKDPDKVVPPDQRIKGYPYGPQIVPISSAEWEAVKFKPEKGVKLMGFTDSSNVFRHHYMKDVYVFLPEPGNTRAMIAVSAVARAMKEMNKVAIPDSFYLNVLPFAEDVREFQFPSFTNFPASWQPNGQQLEAAANLIKTLDLAPHGQEEVLLPDFTPNPVLELISLFKLRTPLPRGSSLCEGMGEGYCTQPYPCICKEAVSGFEPMTNKSPRHNFTAAPGLALKNFVPHCPEALRYAKRFYRYLELKSKDPDVAVPPLDGTLKKITEPDTDLLLQNKSEIDSFCRSFELKGNPLKKSRRLLGGKRSFSNDEEVKGNITAQPANLTGNASVNVGKIGDLTPVQYFEALISRRDSPDWVVKAINEMKNKIFDLVEDSHEGDNYPKALECLVALRKGCILEQEPEQFNDFLKHLWNFCQEKNLPSFCEYLASKELTLISKTEAIDSENTDDKARKGFLVKSEPKVD

SEQ ID NO: 132499 - protein, 97 aa, Glycine max
  Coding DNA Sequence Number=SeqID_15721
  Gene Ontology: Mol. function=protein dimerization activity; Cellular component=nucleus; Biological process=regulation of transcription, DNA-dependent
  Homolog annotation: Hit_ID=P13088; Match level="QueryCoverage=79%, HitCoverage=38%, E-value=5e-34, Identity=89%"; Hit description=Auxin- induced protein AUX22
  Pfam annotation: Domain name=AUX_IAA; Domain location=2-83; Score= -5.7; E_value=4.9e-09; Accession=PF02309.7; Description=AUXIAA family
MKGNRTKQKAKNNYEQRKLIFVCRNLLTVEALKNADNSEHVPIYEDKDGDWMLVGDVPWEMFMESCKRLRIMKRSDAKGFGLQPKGSLKGFIESAAK

SEQ ID NO: 132500 - protein, 189 aa, Glycine max
  Coding DNA Sequence Number=SeqID_15722
  Gene Ontology: Mol. function=oxidoreductase activity; Cellular component=membrane; Biological process=electron transport
  Homolog annotation: Hit_ID=Q1S4Y7; Match level="QueryCoverage=72%, HitCoverage=25%, E-value=9e-60, Identity=77%"; Hit description =Berberine and berberine like, putative
  Pfam annotation: Domain name=BBE; Domain location=77-134; Score =110.3; E_value=5.7e-30; Accession=PF08031.2; Description=Berberine and berberine like
MIELGKTGFVFNPYGGKMSEVSSDATPFPHRAGNLFKIQYSVNWDDPGVELEKNFTSQAKMLYSYMTPFVSSDPRSAFLNYRDLDIGTNSFGKNSYEEGAVYGVKYFNDNFKRLVKIKTEVDPENFFRNEQSIPIHPVWNLGSSRHCITSVPGPDTGAIKSGAGKLLHLTLYWSVMVKVGWLFILELFI

SEQ ID NO: 132501 - protein, 51 aa, Glycine max
  Coding DNA Sequence Number=SeqID_15723
  Gene Ontology: Mol. function=oxidoreductase activity; Biological process=electron transport
  Homolog annotation: Hit_ID=Q9AYM8; Match level="QueryCoverage=84%, HitCoverage=8%, E-value=1e-12, Identity=79%"; Hit description=CPRD2 protein
MENKKGRVLNRTTMGEDLFWAIRGGGGASFGVIVSWKIMLVPVLQVVTVQK

SEQ ID NO: 132502 - protein, 637 aa, Glycine max
  Coding DNA Sequence Number=SeqID_15724
  Gene Ontology: Mol. function=catalytic activity; Cellular component =intracellular; Biological process=metabolic process
  Homolog annotation: Hit_ID=Q84WG8; Match level="QueryCoverage=93%, HitCoverage=94%, E-value=0.0, Identity=68%"; Hit description =Putative selenium-binding protein
  Pfam annotation: Domain name=PPR; Domain location=135-169; Score =31.8; E_value=2.4e-06; Accession=PF01535.11; Description=PPR repeat
  Pfam annotation: Domain name=PPR; Domain location=233-267; Score =36.3; E_value=1.1e-07; Accession=PF01535.11; Description=PPR repeat
  Pfam annotation: Domain name=PPR; Domain location=332-366; Score =41.6; E_value=2.7e-09; Accession=PF01535.11; Description=PPR repeat
  Pfam annotation: Domain name=PPR; Domain location=403-437; Score =12.8; E_value=0.23; Accession=PF01535.11; Description=PPR repeat
  Pfam annotation: Domain name=PPR; Domain location=469-503; Score=4.3; E_value=2.3; Accession=PF01535.11; Description=PPR repeat
  Pfam annotation: Domain name=PPR; Domain location=69-103; Score=14.1; E_value=0.16; Accession=PF01535.11; Description=PPR repeat
  Pfam module annotation: Pfam domain module=PPR::PPR::PPR::PPR::PPR::PP R; Domain location=135-169::233-267::332-366::403-437::469-503::69-103
MRGVSKHLQLLRPTSSRCCSYSVNSSLVSPHYVPPETESLLNHCYRRDLPSAMHVLDSMERRGVWADSITYSELIKCCLAHGAVREGKRVHRHIFSNGYHPKTFLTNILINMYVKFNLLEEAQVLFDKMPERNVVSWTTMISAYSNAQLNDRAMRLLAFMFRDGVMPNMFTFSSVLRACERLYDLKQLHSWIMKVGLESDVFVRSALIDVYSKMGELLEALKVFREMMTGDSVVWNSIIAAFAQHSDGDEALHLYKSMRRVGFPADQSTLTSVLRACTSLSLLELGRQAHVHVLKFDQDLILNNALLDMYCKCGSLEDAKFIFNRMAKKDVISWSTMIAGLAQNGFSMEALNLFESMKVQGPKPNHITILGVLFACSHAGLVNEGWYYFRSMNNLYGIDPGREHYGCMLDLLGRAEKLDDMVKLIHEMNCEPDVVTWRTLLDACRARQNVDLATYAAKEILKLDPQDTGAYVLLSNIYAISKRWNDVAEVRRTMKKRGIRKEPGCSWIEVNKQIHAFILGDKSHPQIDEINRQLNQFICRLAGAGYVPDTNFVLQDLEGEQREDSLRYHSEKLAIVFGIMSFPKEKTIRIWKNLKICGDCHKFAKLIAELEQRHIVIRDPIRYHHFQDGVCSCGDYW

SEQ ID NO: 132503 - protein, 300 aa, Glycine max
  Coding DNA Sequence Number=SeqID_15725
  Gene Ontology: Mol. function=oxidoreductase activity; Cellular component=membrane; Biological process=electron transport
  Homolog annotation: Hit_ID=Q1S4Y9; Match level="QueryCoverage=89%, HitCoverage=48%, E-value=1e-106, Identity=71%"; Hit description =Berberine and berberine like, putative
  Pfam annotation: Domain name=FAD_binding_4; Domain location=85-224; Score=94.8; E_value=2.7e-25; Accession=PF01565.13; Description=FAD binding domain
MEKSSLFPSGTFLFLLLVLLNVSASVAAPTPESVYTSFLECLTNYTKAQDQVSNIVFAQTNASFSSVLQAYIRNARFNTTSTPKPLLVVTPSEDPHVQGAVICAKSIGIQLKIRSGGHDYEGISYVSDQPFIILDMFHFRNITVDVENEVAVVQAGATLGEVYYRIWEKSKVHGFPAGVCPTVGVGGHLSGGGYGNMLRKHGLSVDHVVDAKIVDVKGRILDKESMGEDLFWAIRGGGGASFGVILSYTVKLIPVPEVVTVFRIAKSLDQNESATELVLQWQQVAPHTDHRLFMRLLLQP

SEQ ID NO: 132504 - protein, 54 aa, Glycine max
  Coding DNA Sequence Number=SeqID_15726
MDGLDVSERENEEIYLYRPLVLQLHCTFPSHAALYSGTDSDPLQLFLKLHASSP

SEQ ID NO: 132505 - protein, 75 aa, Glycine max
  Coding DNA Sequence Number=SeqID_15727
MNYKRTPIDTQVSQSFSIAQANINITIQSSVPPPAASCDLIQKEPWKKENRGEEDDGGGVKCSNRKGARGDPRIS

SEQ ID NO: 132506 - protein, 187 aa, Glycine max
  Coding DNA Sequence Number=SeqID_15728
  Gene Ontology: Mol. function=oxidoreductase activity; Cellular component=membrane; Biological process=electron transport
  Homolog annotation: Hit_ID=Q1S4X9; Match level="QueryCoverage=99%, HitCoverage=35%, E-value=2e-79, Identity=74%"; Hit description =Berberine and berberine like, putative
  Pfam annotation: Domain name=BBE; Domain location=129-185; Score =100.5; E_value=5.1e-27; Accession=PF08031.2; Description=Berberine and berberine like
MTWIQSVLHYAGYSIDESLEVLLRRNQSSPSFKAKSDYVKEPIPLHGLEGLWKMLLLENSPLLILTPYGGIMSEISESETPFPHRKGNLYGIQYMVNFASNEEAPKHIDWIRRLYAYMTPYVSKFPRQAYLNYRDLDLGVNQGKPWYEKAKSWGLKYFNCNFERLALVKARVDPGNFFRDEQSIPPL

SEQ ID NO: 132507 - protein, 103 aa, Glycine max
  Coding DNA Sequence Number=SeqID_15729
MIEEGSMFHLLDLESKKEVQFSHHRHLKLFLHTTRKILIRWMAAEWRRKRERRRHFKEKMSLVEAHHHRRPWIRAWRKKEMNEGRGREEHEILCSKRALKSEV

SEQ ID NO: 132508 - protein, 97 aa, Glycine max
  Coding DNA Sequence Number=SeqID_15730
  Subcellular localization annotation: CTP_CleavageSite=40; ConfidenceScore=5.40e-01
MIGSVSVVPLLLLPLRFLLSISNLPMVPPFSRKLTARSCSAASLGDRRCTADWVQDTTIVRTVSYQVPWGPLVGTHNKLKKHFCRSTNACSGCSSVE

SEQ ID NO: 132509 - protein, 117 aa, Glycine max
  Coding DNA Sequence Number=SeqID_15731
MGSNQRPPWDLVADGSDDGCVLNPVSERRYHGQVADTQEKTQRQQKQRHDRDGTDHKFQNCPPPLNVDQLRLKEPSILDEAAEPEVELEIDDLIPDRQPSRVGNVLATEAKWFTAEQ

SEQ ID NO: 132510 - protein, 49 aa, Glycine max
  Coding DNA Sequence Number=SeqID_15732
MARVRGPKLLTLRQPLRKALIETPQDRLGIEQSSAFRLSRARLRMTTYW

SEQ ID NO: 132511 - protein, 49 aa, Glycine max
  Coding DNA Sequence Number=SeqID_15733
  Gene Ontology: Biological process=electron transport
  Homolog annotation: Hit_ID=Q9AYM8; Match level="QueryCoverage=97%, HitCoverage=14%, E-value=4e-10, Identity=68%"; Hit description=CPRD2 protein
MVLGTYYGDLNVGNDQSWSGCKQLWRLRFRYWDNYKDIEQSFHEYLLKK

SEQ ID NO: 132512 - protein, 590 aa, Glycine max
  Coding DNA Sequence Number=SeqID_15734
  Gene Ontology: Mol. function=oxidoreductase activity; Cellular component=membrane; Biological process=electron transport
  Homolog annotation: Hit_ID=Q9AYM8; Match level="QueryCoverage=63%, HitCoverage=78%, E-value=1e-136, Identity=60%"; Hit description =CPRD2 protein
  Pfam annotation: Domain name=FAD_binding_4; Domain location=230-357; Score=68.0; E_value=3.1e-17; Accession=PF01565.13; Description=FAD binding domain
MMLFAHYNIVFGTPLLNCIIQGHDGNISLTSTFRAFSDAEEDEEDDEEEDQDQDNVSTDEYDDVSGEAFDEADVFARHGGFKWQRVDKLCNEVREFDADLIDVDELTSVYDLIDTDLIDVVYQSCSIGLALPVYSTFKAIENNDPYEQQRMVISFCAGVSASTAHTWTTLSGTGANDVRVMTRKSVDDPGRPLALFLVLPLLFGFLFLLNESLTSSVIKTLGMSDASSKPLVIVTPLVVSHIQATIICSQRHGLQIRTRSGGHDYEGLSYVAKFPFVLIDLINLREIKVNVENKTAWVQAGATIGELYYKINEKSPNTWITSSGGGYGFLMHKYGLAADNVIDAHIVDVKGNLLDRKSMGEDRLWAIRGGGGASFGVIVAWNVKLVPVPSTVTVFNVPRTLQQNATEIIHKWQLVANKLGNGIMIRVNLVRSFPELGLVREDCTEMSWIDSILYMARCTNGQPREALMNRTGCGLPFFKAKSEYVRDPIPEVGLKGLWLLFYEDEAQGAIIQFTPYGGKMYEISESEIPFPHRSGNIFHINYLVVIWKEEGNEAEQRHINRIRRMYSYMETYVSKSPRASYLNYRDLDTG

SEQ ID NO: 132513 - protein, 64 aa, Glycine max
  Coding DNA Sequence Number=SeqID_15735
MLLYPIAWFLISFFLLFLNLCSKEHNVDKDNHELKPPQRSELASDEFEQWQNKPRRQVGLQNHH

SEQ ID NO: 132514 - protein, 664 aa, Glycine max
  Coding DNA Sequence Number=SeqID_15736
  Gene Ontology: Mol. function=transferase activity; Biological process= biosynthetic process
  Homolog annotation: Hit_ID=Q9LSB5; Match level="QueryCoverage=95%, HitCoverage=93%, E-value=0.0, Identity=57%"; Hit description =Glycosyl transferases-like protein
  Pfam annotation: Domain name=Glycos_transf_1; Domain location=478 -639; Score=50.0; E_value=7.8e-12; Accession=PF00534.10; Description =Glycosyl transferases group 1
MEDCNNKGEVHVHLTKQKQSSSRSEEKSKGDAQCYGSNRLLLWLLLITLWAYLGFYVQSRWAHDDKEEEFSGFGSRQSDTTNSYVGQNQHLDLIAKNISLSVNIELVENKTVDVALAKKEYGVLSQLKASSKKRNRRKRSTHALRGTRRRKHILESSDIEEQEPEIPLRNDTYGFLVGPFGSIEDRILQWSPQRRYETCDKKGEFARLVWSRRFVLIFHELSMTGAPLSMMELATELLSCGASVSAVVLSRKGGLMQELARRRIKVLDDKAYLSFKIANKADLVIAGSAVCTSWIEQYIEHFPAGANQVAWWIMENRREYFDRAKDVLQRVNTLVFLSESQSRQWQKWCVEEGIKLSSQLALVPLSVNDELAFVAGIPSTLKVPSFSAAKMDERRKLLRDSIRREMGLNDNDILVMTLSSINRGKGQLLLLESARSMVEHGPLQQDDKKIPESSDDGEYLSTLARRHHIRNLLKDNSVALNNISSNFINRTREVLSQNNGTMAQSLKILIGSVGSKSNKVDYVKGLLSFLARHSNLSKSVLWTSATTRVASLYSAADVYAINSQGLGETFGRVTIEAMAFGLPVLGTDAGGTQEIVEHNVTGLLHPIGRAGNRVLAQNLRFLLENRLAREQMGMEGRKKVQRMFLKQHMYEKLVEVLVKCMRRI

SEQ ID NO: 132515 - protein, 537 aa, Glycine max
  Coding DNA Sequence Number=SeqID_15737
  Gene Ontology: Mol. function=metal ion binding; Biological process =metal ion transport
  Homolog annotation: Hit_ID=Q5JL93; Match level="QueryCoverage=18%, HitCoverage=25%, E-value=3e-13, Identity=42%"; Hit description =Glycine-rich protein-like
MASTVEEKNNVEYDSDPEEAKRPLTMRRREASDDEVTEAEAEAEGEEVTDKMEDSRVEVRSDDEGGVEDYDDDVEEEEEELEEEEEEEEVEVEEEVYEEKGATSGGVEVDEGSADVVKESQDDVRPPLEDSIEDHSEEKKENEPFAVPTAGAFYMHDDRFRDNAGARQRRIHGERSLWESKDDRKWGHDKFEEITLHEKHHEERGRPYKGNYRGRGKSRGTYRGGYVQGNRTGYNDSSNQNQVPKRVVKGRGPQKYERTNKSNGPSSAVQNKHSERTSTHASKVESGSVPVKNQVVASNLNSASPPFYPSGSSNKDINLAQKREVQTGGSSRNISPVVVDEGFPVQQNNARLRGNNVVDSISMAKLYIDESIPLSVGKPGSSAVSASQSPHLRASGTGRGASIPIQMNYQHAPSQNKVSPSQFQVIQTSSAPGRNSTSVQATAPQLGNRPDSGSQSSSPLETSMPISSHDSGEVDAASESGKVKGAMVGKGREGSQGAGRGSFIYGGAQVMGTTGNAAVSHGDPNFPAFLPGLYQHC

SEQ ID NO: 132516 - protein, 74 aa, Glycine max
  Coding DNA Sequence Number=SeqID_15738
MQISCTKPGRLKKSGSYSKDARYKVVGQTEVDVVVERMRGVDSVLKTNQEKGTTYGSPTILYILHVLEHFQVSC

SEQ ID NO: 132517 - protein, 732 aa, Glycine max
  Coding DNA Sequence Number=SeqID_15739
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P27480; Match level="QueryCoverage=99%, HitCoverage=80%, E-value=0.0, Identity=77%"; Hit description =Lipoxygenase 1
  Pfam annotation: Domain name=Lipoxygenase; Domain location=11-716; Score=1544.3; E_value=0; Accession=PF00305.9; Description =Lipoxygenase
MLQAYLPNDTPTPLVKYRKEELENLRGDGRGERKELDRIYDYDVYNDLGNPDENDDLARPILGGSSKHPYPRRGRTGRKPTKKEMLYIVTSNCNFILKVSPILIVVIDDTVLISPLSNFSDPRCERPTSDTYIPRDENFGHLKSSDFLTYAIKSLTQNVLPQFNTAFGFNNEFDSFEDVRCLFDGGVYLPTDVLSKISPIPVLKEIFRTDGEQALKFPPPHVIKVRESEWMTDEEFGREMLAGVNPGMIQRLQEFPPKSKLDPTEFGDQTSTITKEHLEINLGGLTVEQALKGNKLFILDHHDAFIPFMNLINGLPTAKSYATRTILFLQDDGTLKPLAIELSLPHPRGHEFGADSRVVLPPAAVNSAEGTIWLIAKAYVAVNDTGYHQLISHWLNTHATIEPFVIATNRHLSVLHPIHKLLLPHYRDTMNINALARQSLINADGVIERSFLPGKYSLEMSSAVYKSWVFTDQALPADLIKRGMAIEDPCAPHGLRLVIEDYPYAVDGLEIWDAIQTWVKNYVSLYYPTDDAIKKDSELQAWWKEAVETGHGDLKDKPWWPKLNTPQDLVHICSIIIWIASALHAAVNFGQYPYGGLILNRPTLTRRFLPEPGSKEYEELSTNYQKAYLRTITRKIEALVDLSVIEILSRHASDEIYLGKRDSDDWTDDQKAIQAFEKFGTKLKEIEAKINSRNKDSSLRNRNGPVQMPYTVLLPTSEEGLTFRGIPNSISI

SEQ ID NO: 132518 - protein, 922 aa, Glycine max
  Coding DNA Sequence Number=SeqID_15740
  Gene Ontology: Mol. function=RNA-directed DNA polymerase activity; Cellular component=chromatin; Biological process=chromatin assembly or disassembly
  Pfam annotation: Domain name=RVP; Domain location=359-463; Score= -1.9; E_value=0.006; Accession=PF00077.10; Description=Retroviral aspartyl protease
  Pfam annotation: Domain name=RVP_2; Domain location=365-477; Score= -39.5; E_value=0.0012; Accession=PF08284.2; Description=Retroviral aspartyl protease
  Pfam module annotation: Pfam domain module=RVP::RVP_2::RVT _1::Retrotrans_gag; Domain location=359-463::365-477::596-782::100-190
MSDQPPINPSTKLEDILVALTTQQLSLSHKIDDLIQHIAPVLHSAPAITSSVPRPYPNPATSHRLKLEVPRFDGTDPIGWIFKVNQFFDYNGTPEHERLQIVSFYMEGRAFSWFQWMIGNAQFTSWPAFIQALQTRFAPSQYEDPIGILCKLTQKHTVTAYLSEFEDVANRIVGIPPAFLLDCFISGLTPEIHREVQAHQPLTLTQAAGLAKLQEEKLLESRPFPTSTRPRPPSALFPSTPSTLPTQPPPRPSPFMKPTPPLNPVTPRPIPPPPFKRLTSEEIASRRERGLCFSCDEKYHCGHRCASRVFLLLAEDGDSLTLPDSPLITNLDPDPSLDPTHDPDPYPAQLSLNSMAGHLAPETLRFIATIAGNDVVLLVDGGSTHNFIQQQLVDTLGLPSRPTSPLCVMVGNGQQLKCHTICEAILILIQTHEFRVDLYVLPISGANIVLGMQWLKSLGPVLTDYNTLLMKFFHGGGLITLQGDFDASLTSLSSVRRQARKTDNAIYYHITILPDHNPETQVIPSSIQPLLDQFAILFQPPHSLPPPRTTDHHIHLLPNMAPVNVRPYRYPHYQKKEIEDQVDSMLQQGLIQPSTSPFSSPVLLMKKNDGSWRFCVDYHALNALTVRDRFPIPTIDELLDELGGASYFSKLDLLQGYHQIQMHSDDILKTAFRTHHGHYEFKVMPFGLCNAPSSFQATMNQIFQPYLRRFIIVFFDDILIYSASMADHCHHLELTFQPQVEYLGHLVSNAGVEPLPAKIAAIRNWPTPHTTKALRSFLGLAGFYRRFIQGYATIAAPLVKATTTDPFQWSPEAQSAFEHLKLALSSTSVLALPDFTITFTVETDASGIGMGAILSQKGHPIAFFSKPFSAKLLRSSTYVRELFAITVAIKKWRQYLLGHRFIILTDLRSLKELLTQAVQTPE

SEQ ID NO: 132519 - protein, 76 aa, Glycine max
  Coding DNA Sequence Number=SeqID_15741
MIVNDVSVKYLITWFVEEELLDVGDLPVDVIRDGGGRVENGKVAFAVNFLLVVLLYGGGDFEDGDKVVSDLKVKDR

SEQ ID NO: 132520 - protein, 73 aa, Glycine max
  Coding DNA Sequence Number=SeqID_15742
  Subcellular localization annotation: CTP_CleavageSite=4; ConfidenceScore=5.06e-01
MWVSISFFWTLPPFAPPLFDLVLLVAPLSWLAGETNTSTKTAIQNQEFSSREVQLEVRPKRAVNRPSYLKDYI

SEQ ID NO: 132521 - protein, 398 aa, Glycine max
  Coding DNA Sequence Number=SeqID_15743
  Homolog annotation: Hit_ID=Q7XIY9; Match level="QueryCoverage=89%, HitCoverage=95%, E-value=1e-40, Identity=60%"; Hit description =Putative MAGE
  Pfam annotation: Domain name=MAGE; Domain location=25-353; Score =133.5; E_value=5.6e-37; Accession=PF01454.9; Description=MAGE family
MANAAEDFSQFGISKEEKDKLVGELIRYMLFKTHQNSGCPIKREELTQLVTKNYHQRNLPTFVINEAKEKLSFVFGYEMRELQRAHPSSKAQTRSSQQKQTMSGHGEDQMATSSSLISQSWFTYYNVLVSSFMEMSHQCQDLMMLPPAATCVAALAPPDETGLRRDCVIPSSGNLMTTNRAANRMRLEILDSEVPYRLVEPIRRHNFDVRDRALYIAVQPRGPATQVYGSSSHLCVADSKSYILISQLPPNVYEKYVVDVNTAHLSGFTFVIISIVYLAGGKIPEENLWSQMRRMGLGETEASHPVLGNVKQALELLVQQRYLQKDKVNGPEGNTVYYELAERALDGPMNDRVKEYISQGMDEHQKQAKHPNYVGTHELDFLHSLPFPILSTSLIAIR

SEQ ID NO: 132522 - protein, 133 aa, Glycine max
  Coding DNA Sequence Number=SeqID_15744
MKHREKSKRGKKKPYKMRRLGFRLAFEDDYRVFDFGPSIPGDACASLKGHRPIIRLWSDTTSLQLPTLGLNEEVLEVSSNTSVSMMISSASTPEKDSSSTSSGEFSKFSTFLNQLPKRVVDNIEKVPDVGTRF

SEQ ID NO: 132523 - protein, 259 aa, Glycine max
  Coding DNA Sequence Number=SeqID_15745
  Gene Ontology: Mol. function=endonuclease activity; Biological process=response to biotic stimulus
  Homolog annotation: Hit_ID=Q9MB25; Match level="QueryCoverage=91%, HitCoverage=99%, E-value=6e-74, Identity=88%"; Hit description=S1-1 protein
  Pfam annotation: Domain name=Bet_v_I; Domain location=1-155; Score =139.1; E_value=1.2e-38; Accession=PF00407.9; Description =Pathogenesis-related protein Bet v I family
MVVLTFTDEFTSNVKPRRLFKALILDAPNLIPKLMPEAIKNVQLVEGNGGPGSIQEITIAERDNIKHLKHRIDAIDLEKLTYSYAVIEGDAALEKVDSISHEIKFEATEEGGCKTKNVSKYHPKEGVDVKGEDFKAAREEGLALLKVVDAYLVANPEAYAEGNINSVHFKLNMEVLTFTDEFTSTVQPGRLFKALVLDAPNLIPKLMPEAIKNIQLVEGNGGPGSIQEITIVEGQLIGIQGGVGKLAYESSKYPPNCKP

SEQ ID NO: 132524 - protein, 190 aa, Glycine max
  Coding DNA Sequence Number=SeqID_15746
MKVLEKCAIDVEASNKFNKKEVMRLESALGTTEKERDAKIEEKIWIKQKTYNEVYKAHDFEFNHYLLKVLFHCERGTRWWATNYLPGETQMANPGEDDVLSSSIGKSSYNGVDDTSQLIKGFFLPFSRPALASSPFSLRVMTTIPFSSFVMVLPIVVVTPIGLRLVDKILWVPHLDEALYLVLQDTTLFS

SEQ ID NO: 132525 - protein, 125 aa, Glycine max
  Coding DNA Sequence Number=SeqID_15747
  Gene Ontology: Mol. function=hydrolase activity; Biological process =response to biotic stimulus
  Homolog annotation: Hit_ID=Q96381; Match level="QueryCoverage=98%, HitCoverage=80%, E-value=9e-19, Identity=40%"; Hit description =Pollen allergen Car b 1
  Pfam annotation: Domain name=Bet_v_I; Domain location=1-116; Score =9.5; E_value=9.6e-07; Accession=PF00407.9; Description=Pathogenesis -related protein Bet v I family
MGIVTTESELVSAVAPARLYKTIALDYSNFFPKVLPNLVKSVEIIEGDGRPGAIKKFTIPEGYVNQKADVVDVNNYVYDYTIVEGNVLSDREDKMCNEYKLVVNLMEDASSRSHASTTPEAMLNS

SEQ ID NO: 132526 - protein, 279 aa, Glycine max
  Coding DNA Sequence Number=SeqID_15748
  Homolog annotation: Hit_ID=Q4KYL1; Match level="QueryCoverage=43%, HitCoverage=76%, E-value=4e-33, Identity=51%"; Hit description =Pathogenesis-related protein 10
  Pfam annotation: Domain name=Bet_v_I; Domain location=1-152; Score =119.9; E_value=7e-33; Accession=PF00407.9; Description=Pathogenesis -related protein Bet v I family
MGATTFTHDYSSPVAPSRMFKALITDSRTLLPKLLPQIIKEVNLIQGDGEAGSIEQVNFAEAFPFKYVKHRIDEVDKDNFVCKYTMIEGDPLEDKLESIAYEVKFEATSDGGCLCKMTTKYNVIGGFEVKEEEIKEGRESSLGVCKTRKIATICNIEPIESPSQPEEPSSQPTEPKPEENDAQNHEATQPVEISPTQAESQEEPPKETPPEATPSPIHAGNNQNQQSPRTKDVGEVHVMHHNPTNFGNRFGSGHNYAGHWGDRYRYHNSPTFLQEPPQP

SEQ ID NO: 132527 - protein, 127 aa, Glycine max
  Coding DNA Sequence Number=SeqID_15749
METLKVKDLVDHLSGGWNVPLINNLFEPHDAQAILQSRDKRSLTMKDRVRMSGDWKLIWELEVPPRVKMKHVVDALTLQAESCLQMVMMLFIFNQVCSDKRKRVAMLLWCLWRQRNEKLWDNIDRYF

SEQ ID NO: 132528 - protein, 84 aa, Glycine max
  Coding DNA Sequence Number=SeqID_15750
MNKYPLDTVAYTVGICALLRGRRTQEACTLYDQMKNDGMLMVYKQNIKHQAEDNTEWNLILDTSSSEDLSDVAASVGWSLMLAM

SEQ ID NO: 132529 - protein, 1320 aa, Glycine max
  Coding DNA Sequence Number=SeqID_15751
  Gene Ontology: Mol. function=binding; Cellular component =intracellular; Biological process=metabolic process
  Homolog annotation: Hit_ID=Q1RXQ0; Match level="QueryCoverage=65%, HitCoverage=99%, E-value=0.0, Identity=75%"; Hit description =Tetratricopeptide-like helical
  Pfam annotation: Domain name=PPR; Domain location=104-137; Score =24.9; E_value=0.00028; Accession=PF01535.11; Description=PPR repeat
  Pfam annotation: Domain name=PPR; Domain location=240-274; Score =33.8; E_value=6.1e-07; Accession=PF01535.11; Description=PPR repeat
  Pfam annotation: Domain name=PPR; Domain location=275-309; Score=4.5; E_value=2.2; Accession=PF01535.11; Description=PPR repeat
  Pfam annotation: Domain name=PPR; Domain location=341-375; Score =34.1; E_value=5e-07; Accession=PF01535.11; Description=PPR repeat
  Pfam annotation: Domain name=PPR; Domain location=40-74; Score=12.2; E_value=0.27; Accession=PF01535.11; Description=PPR repeat
  Pfam annotation: Domain name=PPR; Domain location=411-445; Score=0.0; E_value=7.4; Accession=PF01535.11; Description=PPR repeat
  Pfam annotation: Domain name=PPR; Domain location=473-507; Score =37.4; E_value=4.9e-08; Accession=PF01535.11; Description=PPR repeat
  Pfam annotation: Domain name=PPR; Domain location=574-608; Score =38.9; E_value=1.8e-08; Accession=PF01535.11; Description=PPR repeat
  Pfam annotation: Domain name=PPR; Domain location=609-643; Score=4.4; E_value=2.3; Accession=PF01535.11; Description=PPR repeat
  Pfam annotation: Domain name=PPR; Domain location=645-678; Score=1.4; E_value=5; Accession=PF01535.11; Description=PPR repeat
  Pfam annotation: Domain name=PPR; Domain location=711-745; Score=6.8; E_value=1.2; Accession=PF01535.11; Description=PPR repeat
  Pfam module annotation: Pfam domain module=PPR::PPR::PPR::PPR::PPR::PP R::PPR::PPR::PPR::PPR::PPR; Domain location=104-137::240-274::275 -309::341-375::40-74::411-445::473-507::574-608::609-643::645 -678::711-745
MSYMQLSQKFYDAFKLCGSPPIARKLHAQLILSGLDASLFLLNNLLHVYSNCGMVDDAFRVFREANHANIFTWNTMLHAFFDSGRMREAENLFDEMPLIVRDSVSWTTMISGYCQNGLPGHSIKTFMSMLRDSNHDIQNCDPFSYTCTMKACGCLASTRLALQLHAHVIKLHLGAQTCIQNSLVDMYIKCGAITLAETIFLNIESPSLFCWNSMIYGYSQLYGPYEALHVFTRMPERDHVSWNTLISVFSQYGHGIRCLSTFVEMCNLGFKPNFMTYGSVLSACASISDLKWGAHLHARILRMEHSLDAFLGSGLIDMYAKCGCLALARRVFNSLGEQNQVSWTCFISGVAQFGLGDDALALFNQMRQASVVLDEFTLATILGVCSGQNYAASGELLHGYAIKSGMDSSVPVGNAIITMYARCGDTEKASLAFRSMPLRDTISWTAMITAFSQNGDIDRARQCFDMMPERNVITWNSMLSTYIQHGFSEEGMKLYVLMRSKAVKPDWVTFATSIRACADLATIKLGTQVVSHVTKFGLSSDVSVANSIVTMYSRCGQIKEARKVFDSIHVKNLISWNAMMAAFAQNGLGNKAIETYEAMLRTECKPDHISYVAVLSGCSHMGLVVEGKHYFDSMTQVFGISPTNEHFACMVDLLGRAGLLNQAKNLIDGMPFKPNATVWGALLGACRIHHDSILAETAAKKLMELNVEDSGGYVLLANIYAESGELENVADMRKLMKVKGIRKSPGCSWIEVDNRVHVFTVDETSHPQINKVYVKLEEMMKKIEDTGRYVSIVSCAHRSQKYHSEKLAFAFGLLSLPPWMPIQVTKNLRVCNDCHLVIKLLSLVTSRELIMRDGFRFHHFKDGFCSCRDYCTSTDPQAPKLLDDILRRYSQHDLFAAFNYLKEKKVLVVHPCVFGKIPNTYSSYEIHFKIIGSHTLLGREFGTNSIPKVGGTGNERFELSQHFLQSVSKSPFPFNTGKQAVKFSAWLEERGKDLTEVGANLAEDLQCGDIFHLLALVSSGELSISPFLPDNGVGEAEDLRSAKRKYDTTESSYSDKAKKSKSFFGVEGEIISRREKGFPGIIISAHQTTISRADILNLLKDNDNYGQTFDEDFQLNIGQSSNYSLPDNILEITKSSDPVPLEENHSESPWEAMAGYARHLLSEYSNKKHAYAICAEVFRVVYAAIQKAGDQGLSMGEISRVINLPGAETDVLIVDALQAFEQALKVNAYDTVRVVDVLYRHKYFLTPMSDFHLCVVQPSSTKTIKKSDHTCELYELEISNRIIKEDKKDILRERELGKQEVKNDIKPLNFVLQFGIYRLE

SEQ ID NO: 132530 - protein, 95 aa, Glycine max
  Coding DNA Sequence Number=SeqID_15752
  Subcellular localization annotation: CTP_CleavageSite=40; ConfidenceScore=5.12e-01
MKISTRVLFIIGTSSVAATHGSGATATGDTGGIATCTDALAMQGGVAAFQVDGSSFSALWQCPNVDGSSFSVDGSVTVRCIQLLEEGAITFGDLG

SEQ ID NO: 132531 - protein, 171 aa, Glycine max
  Coding DNA Sequence Number=SeqID_15753
MLMCNDQFSCVGPIELLCTVGRTPDGIINLLERTMPRTHDAILYYNGKWNMPPQNKFVGCAFIRKNPKKFQIPSTCTIDELKNLIKQVAPKGIPPLGIHESQTVRRLFFHQPARFEYSDTLIKYEINELMTNKELLKVLVQSNYWKKYGPIEILAVFTKYVVKIEDEVTGT

SEQ ID NO: 132532 - protein, 149 aa, Glycine max
  Coding DNA Sequence Number=SeqID_15754
  Gene Ontology: Mol. function=hydrolase activity; Biological process =response to biotic stimulus
  Homolog annotation: Hit_ID=Q43560; Match level="QueryCoverage=99%, HitCoverage=100%, E-value=1e-39, Identity=50%"; Hit description =Class-10 pathogenesis-related protein 1
  Pfam annotation: Domain name=Bet_v_I; Domain location=1-146; Score =98.2; E_value=2.4e-26; Accession=PF00407.9; Description=Pathogenesis- related protein Bet v I family
MGVVTHEYDTPADVPPTRLFKAMTLDFHNLFPKIVDSIHGVVFIEGSGGPGTIKKMTIIEGQVDAIDEAAYVYNFSIIGGTALADTLEKVSFESKLVEGSNGGSIRKVHVQFFTKGNATFSEEEVKANQAKVEGLVKLVEGYLLANPDY

SEQ ID NO: 132533 - protein, 76 aa, Glycine max
  Coding DNA Sequence Number=SeqID_15755
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q1SLQ8; Match level="QueryCoverage=98%, HitCoverage=13%, E-value=2e-31, Identity=88%"; Hit description =Dihydrolipoamide succinyltransferase
  Pfam annotation: Domain name=2-oxoacid_dh; Domain location=1-76; Score=-120.8; E_value=3.2e-05; Accession=PF00198.13; Description=2 -oxoacid dehydrogenases acyltransferase (catalytic domain)
QFCAIINPPQAGIQAVGSCENTERRVVPGSGAEEFKFASFMSVTLSCDHRVIDGAIGAEWLKAFKGYIENPETMLL

SEQ ID NO: 132534 - protein, 155 aa, Glycine max
  Coding DNA Sequence Number=SeqID_15756
  Gene Ontology: Mol. function=membrane alanyl aminopeptidase activity; Biological process=proteolysis
  Homolog annotation: Hit_ID=Q1SLQ6; Match level="QueryCoverage=73%, HitCoverage=14%, E-value=3e-36, Identity=62%"; Hit description =Peptidase M, neutral zinc metallopeptidases, zinc-binding site
MEQKQQSIDPFKGKTRLPSFAIPERYELHLIPDLSACTFSVTVQISLTINASTEFLVLNALELVIQNTHFTNSQGQQHIPHDVVVDNDDEILVLVFHEFSGILNEHPRGFYKCNTIMNHDYYFGSTLYILVATNNNPNTVMCLEKNNPVLPLALK

SEQ ID NO: 132535 - protein, 126 aa, Glycine max
  Coding DNA Sequence Number=SeqID_15757
  Homolog annotation: Hit_ID=Q1SLQ6; Match level="QueryCoverage=40%, HitCoverage=5%, E-value=1e-14, Identity=70%"; Hit description =Peptidase M, neutral zinc metallopeptidases, zinc-binding site
MEEKWIETDRPELGKLNFPFIGFLLSSASLFLCFLNCLVCLARHSAKCTCPAGSSDHALSAGCALADDNCVFQSLINICELIQSIGDDLNSNEKKYEVNSQENIWVKVNDDQRGFYRVNYEGKLAV

SEQ ID NO: 132536 - protein, 410 aa, Glycine max
  Coding DNA Sequence Number=SeqID_15758
  Pfam annotation: Domain name=Extensin_2; Domain location=1-346; Score= -135.2; E_value=0.051; Accession=PF04554.4; Description=Extensin-like region
MRTETEEEEEKEIGIDNVATAPPQSPPQQGMEAVGRNVKRAYQVETVEEHKKEDLDAQISPPPPATRSKGVRRNVKRTYQAEAVEKHETNDFPVMDSRPPPVTITKGVRRNAKRTYQPETMEKRETNDFDEQNSQTLPSPPPPPVTRRRGVRRNAKPEGNDSVVKSSPPPPPPPPPLPAEEARTVSGKKKRGSATKEFLISLRGKKKKQRQRSVENFDIILGSESLFSQPPPPPPLPPPKVFQNLFSLKKGKHKNRHIASVATTTTSVSNKRDHGSSSRLQDNVTMAGNESPLNPIPPPPPLPPFKLPGWKFRVQGDFVRVDSMGSSRSGSPDDLDEVSVDTPTTSTHDETSQVNSPFAKDSEDSASVSAPSLFCPSPDVDTKAHNFIESFRAGLRMAKMNSMKERQGIG

SEQ ID NO: 132537 - protein, 172 aa, Glycine max
  Coding DNA Sequence Number=SeqID_15759
  Pfam annotation: Domain name=GRP; Domain location=1-159; Score=-26.8; E_value=0.042; Accession=PF07172.2; Description=Glycine rich protein family
MASRFLLLALLGALVCTVIDARKLGSEKGSFRDEKNFFHRPGFGGGGGGGFGGGGGGGLGGGAGGGLGGGAGGGFGAGAGAGAGAGAGGGAGGGFGGGGGGGFGSGGGVGGGSGFGGGAGFGGGAGAGGGLGGGGGGGFGGGGGGGLGGGAGGGFGGGAGAGAGAGAGGGFP

SEQ ID NO: 132538 - protein, 228 aa, Glycine max
  Coding DNA Sequence Number=SeqID_15760
  Homolog annotation: Hit_ID=Q9FLQ5; Match level="QueryCoverage=96%, HitCoverage=34%, E-value=1e-56, Identity=55%"; Hit description =Arabidopsis thaliana genomic DNA, chromosome 5, P1 clone:MCO15
FLDELKHIKWRPPHIGTKQDWQDRINNMRKGRKEVEVTDKVGDVSMASAPFYDENMYILNVKNDLDAKASEAIPSVEGLTAATKYPIPPSSVLKQLAIAIESGRQTNSMKDFVASSRGSSPAREKAGLSLSSVKALVLREKEDKLTSEFSSDEKVVYLINSLFDQEGEFLKRNSDPEETFISSLPRDIHGAPLESLVVKLAEVIGNFKTLREMSLFWSRVVDEVCLTQ

SEQ ID NO: 132539 - protein, 731 aa, Glycine max
  Coding DNA Sequence Number=SeqID_15761
  Gene Ontology: Mol. function=protein serine/threonine kinase activity; Cellular component=ubiquitin ligase complex; Biological process=protein amino acid phosphorylation
  Homolog annotation: Hit_ID=Q1SLQ3; Match level="QueryCoverage=96%, HitCoverage=99%, E-value=0.0, Identity=62%"; Hit description=Protein kinase
  Pfam annotation: Domain name=Pkinase; Domain location=440-700; Score =99.6; E_value=9.3e-27; Accession=PF00069.15; Description=Protein kinase domain
  Pfam annotation: Domain name=Pkinase_Tyr; Domain location=440-703; Score=89.3; E_value=1.2e-23; Accession=PF07714.7; Description =Protein tyrosine kinase
  Pfam annotation: Domain name=Usp; Domain location=15-159; Score=20.8; E_value=0.0049; Accession=PF00582.16; Description=Universal stress protein family
  Pfam module annotation: Pfam domain module=Pkinase::Pkinase_Tyr::Usp; Domain location=440-700::440-703::15-159
MSLIQSSSLPHAVGGGSIAIAVNGGRHSHCAIKWAVEHLLKKNSSCILIHVQTKTMHPHDVDDVPKDGRPPTKEELHQFFLPFRGFCARKGITTKELVLHDLDVPSALTNYVVVNCVSTVVVGAAASPWNTLTRIFNKDDVATTLARSLPDTCTLYVISKGKVQHIRPTGHHSQHIKVTPTRSIRDTVTLLQNTPLVHPNKNLVDAPTDSEDTHRKPIKDANIGRESSKLWESLREIKDFMLIEDTNSPRGPAEYNLSQNSSARSSPGNSDSTGQHLGPSLLDKSHGNHEVVNSDKPKNIASSKSPVNLDIEMKKLKLELKKTTEKYGMACKQAVLAKQKATELEKCRQEKERDLEEAKLAEDTALALVEVERQKTKVAMESVEMSQRLAELETQKRKDAELKAKHEKEERNKALHEVVCNSIPYRRYKFEEIEAATNKFDNTLKIGEGGYGPVFRGVIDHTVVAIKAVRPDIAHGERQFQQEVIVLSTIRHPSMVLLLGACPEYGCLVYEYMENGSLEDRLFMKDNTPPIPWKTRFKIALEIATGLLFLHQTKPEPLVHRDLKPANILLDKNYVSKISDVGLARLVPPSVADKTTQYRLTNAAGTFCYIDPEYQQTGLLGVKSDVYSLGVVLLQIITGKAPMGLSHLVEKAIKNHTFSEVLDPSVSDWPVEEALSLAKLALKCCELRKRDRPNLGTVVLPELNRISRIWDCDDTHYPRNCYMIQDHLDPN

SEQ ID NO: 132540 - protein, 97 aa, Glycine max
  Coding DNA Sequence Number=SeqID_15762
MDKDQWTYDYTMSQEVHMDYDYDNKEECGVNEPHVDCSNAFNTSQWARTVTHENGFVVVIMRSDTDTGSRGRSSFVLIGCERSGFMGNQCMEGKVGW

SEQ ID NO: 132541 - protein, 105 aa, Glycine max
  Coding DNA Sequence Number=SeqID_15763
MSPSSEGLILVVRISSFAVDLLEKVNSKMVKTFSERRIVNFRKKNCELSEELLPEIPSRRRIVNFRKNFFQKKNCELSEEVVPESSSGSSQFFFRKKFFRNINFF

SEQ ID NO: 132542 - protein, 588 aa, Glycine max
  Coding DNA Sequence Number=SeqID_15764
  Gene Ontology: Mol. function=amino acid transporter activity; Cellular component=integral to membrane; Biological process=amino acid transport
  Homolog annotation: Hit_ID=P76037; Match level="QueryCoverage=74%, HitCoverage=94%, E-value=0.0, Identity=91%"; Hit description =Putrescine importer
  Pfam annotation: Domain name=AA_permease; Domain location=26-454; Score=89.8; E_value=8.5e-24; Accession=PF00324.11; Description=Amino acid permease
  Pfam annotation: Domain name=Aa_trans; Domain location=14-417; Score=- 148.6; E_value=0.03; Accession=PF01490.8; Description=Transmembrane amino acid transporter protein
  Pfam module annotation: Pfam domain module=AA_permease::Aa_trans; Domain location=26-454::14-417
  Subcellular localization annotation: CTP_CleavageSite=28; ConfidenceScore=5.08e-01
MAANLPAVNAAQAGKPRLRKSLKLWQVVMMGLAYLTPMTVFDTFGIVSGISNGHVPASYLLALAGVLFTAISYGKLVRQFPEAGSAYTYAQKSISPHIGFMVGWSSLLDYLFLPMINVLLAKIYLSALFPEVPPWVWVVTFVAILTAANLKSVNLVANFNTLFVLVQISIMVVFVILVVQGLHKGEGVGTVWSLQPFISENAHLIPIITGATIVCFSFLGFDAVTTLSEETPNAARVIPKAIFLTAMYGGIIFIVASFFMQLFFPDIHRFKDPDAALPEIALYVGGKLFQSIFLCTTFVNTLASGLASHASVSRLLYVMGRDNVFPERIFGYVHPKWRTPALNVIMVGIVALSALFFDLVTATALINFGALVAFTFVNLSVYNHFWRRKGYNKTWKDRFHYLLLPMVGALTVGVLWLNLEATSLTLGLVWAALGLLYLTYLTRRFRKPPPQFDATKAEQAWESADDNIPAGAVLNQIAQFYLRAPNPNARWQNEAAWLPHELALLDKNYRSAVYTDVTVPEVVTQLMKNSGYFKGYNIDFDRLSYTYPRREMIIQWKETDLQFIRRLLAEIGIWFRFENHHKVQTETV

SEQ ID NO: 132543 - protein, 130 aa, Glycine max
  Coding DNA Sequence Number=SeqID_15765
MGEVDEVQEQIKANIEALKEQMATMMEAMMSMKKIIMVNAAADVATSVVANVDPTPPSGLNQINHPTSNMVGQGGRELGSTDDPQFVQVQNKHAFLPYGLPPKYTPPNVVHTPDKSCHNSTLILVESQQP

SEQ ID NO: 132544 - protein, 179 aa, Glycine max
  Coding DNA Sequence Number=SeqID_15766
MAYRKRKAPSTPTQARFDRSRFTSQEAWERYTDIVVPRKLLPERNVVVYYTEFDEFKEELERCHWDEEFTEFMDGNIDVAITPVVVEEGETLCAYSRFALLRPNPQDLAAKLCIPGRGFELNADGQPLKILRKNMTTLAQTWSVLSFSNLIHTSHTYYVTLDRAKLIYGIIMKMDMKCG

SEQ ID NO: 132545 - protein, 99 aa, Glycine max
  Coding DNA Sequence Number=SeqID_15767
  Subcellular localization annotation: CTP_CleavageSite=41; ConfidenceScore=5.11e-01
MNCVFVHVSSTFEFGAMRSDCLVQFSILNPFRSPMNCVFVHASSTFEFGAMFHDCLSADPQGNPPFSTYFSEPHECHCLALFMCPPLSSAKPLKRVVMD

SEQ ID NO: 132546 - protein, 226 aa, Glycine max
  Coding DNA Sequence Number=SeqID_15768
  Homolog annotation: Hit_ID=Q47QR6; Match level="QueryCoverage=57%, HitCoverage=87%, E-value=4e-12, Identity=36%"; Hit description =Putative membrane protein
IPAHHGGAAPLAGNLDRCQCSERCPRQVAQQRIPGQHPEPEHGIGQYPHQRVEHARADAGDVQQHQQQERQADDQQRVHRHRAGQVEVDQGIQAARAATARAVQAGQGVERAARQRIAGDIRIDVAQDHRGTHGQAGGNQQRCPAGESGTDGKRGHATTDPAQAPDPSRRISSRCCSSRPCRRAQRRTARTARPRRPRRWPTRWPTSWPWQPNPGRRRCRQRPACR

SEQ ID NO: 132547 - protein, 1753 aa, Glycine max
  Coding DNA Sequence Number=SeqID_15769
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=98%, HitCoverage=56%, E-value=0.0, Identity=51%"; Hit description =Aldo/keto reductase; Sigma-54 factor, interaction region
  Pfam annotation: Domain name=AAA_3; Domain location=140-281; Score =51.2; E_value=3.3e-12; Accession=PF07726.2; Description=ATPase family associated with various
  Pfam annotation: Domain name=AAA_5; Domain location=140-287; Score =64.9; E_value=2.7e-16; Accession=PF07728.4; Description=ATPase family associated with various
  Pfam module annotation: Pfam domain module=AAA_3::AAA_5; Domain location=140-281::140-287
MTECRRTDGSRGVAQLLSGTGLSKRDAAELRERCFSFLLQKLGWNAHICIFNVLDKLEMLPKLFLQVDESNSNLSRIGNYGWGEFGTTMDVSHSDDLFGIDAFYINKGIGICEDGGFEFKAPTTCRNALRVLRAMQLPKPVLLEGSPGVGKTSLIIALGKCSGHRVVRINFSEQTDMMDLLGSDLPVESDEGMKFSWSDGILLQALKEGCWVLLDEINLAPQSVLEGLNAILDHRAEVFIPELGNTYKCPPSFRVFACQNPSHQGGGRKGLPKSFLNRFTKVYVDELVEEDYLSICESKFSTIPRTLLSKLIIFNKRMHEDTTVNQKFAKDGFPWEFNLRDVFRSCEIIEGAPKYSGLYSFFNIVYIQRMRTVDDRKEVLRVFKEVFEVTPFINPYPRIQLNSHHLIVGNATIKRNHVQLTMSSSKQLLMLPEIRQSLEAAAQCVERQWLCILTGPSCSGKTSLIRLLANLTGNVLNEVNLSSATDISELLGSFEQYDALRNFSRVVAQFECYVNEYISLQLETSNVAIFRETDFYIRWMAFLSGLKFDSLSSATNCFENLCSLIGQLKLQIQKNSIPVSYSFHELDLAMKTVLKMKADAVSTKFEWVTGLLIKAIQQGEWIVLENANLCNPTVLDRINSLVEPCGSITVNERGIVDGNPLVIHPHPNFRIFLTVNPHYGEVSRAMRNRGVEIFMLQPYWALDDKSGYNDEDVEFKDVRRFLVLSGIPIGHLVDSMARAHTYAKNKGSELNDHITYLELSHWVHLFLQLLKNGCCPIWSLKISWEHIYLSSLGVEGENIINFAKTKYLSVTNLAGYDDLTACPLGLPGGWPLPLTVRDYVYYSKEASIKQNCMYLEFLGTQIASHQYQVARKRHSTTCLQTPNDHVRVYLMDLMTLHELMFPKASNVMISDERECKFDSELTNKMLYFAANWTIEQATESDFKFYLLRFKWFSSQMQPFCQFFSNFLIVIEQMIKHPIWEYISCRDKLDVDLKLMPLLSLDLVNLAPSNKKIKYLCNAVSFFDPLRLTYQQRNIESQHSFDDEANIESQNSFDEKASCFIQLLKSLHFLQDEILHKFVASTPKLIEDQSFDYKLQLYSNLIEDHVFFWRYFISSKFIDICPEAVDQMIISWHSLVKDAQKFTDICPQAVDIFLMESKKFEEFSFSVNSEKSLLWIHGGHPFLPSSSDLHDRQHQLYKFVETIWPRKTGSCYQGILSSHLADVVASFDHDLRFLVTQDVSNSSFLMAKWSHEDGIHIVKKLEEMHQIVLRRFEHEKHKLQLITGSKDLSAFAENSPACCSFTPEMLCEKSVFEAWQDTFLPVDYTSLFCDMELLQKLTSIHLDDLEGLHQAVGRLSNLLDFALKFSLSFSSRPPQMFFPHQKILCTLNTWASVDAVNLKIASFILEMWFKWHESLWVYFPKSVKGVARIDGSDEIVVPHMLVEPFSASTVFQITQCIHAIKEFWVQCLKCRVTLLNLWHCSHHGTHLPDFLLSAARSLFQQIIYAHRKSFDAVQFARIKSIFCSSEKNVLTYEERKKNFVTINNSQAYQTRTGHQLGQGIRSGSDPEESIDLLSSLVASSRHHRLKNSVQKFIVPLLREMYLQSNTADFNYTIGCAWARIGALRINLLLSSKDIDPAMKYHCKYSQLVETISSLELEIQVRKECSYLAGQFLTQEADKRKAQRMEKLQAECRKLQRKIVFRTEPRKYKKLIKECENFLKQHDALEVLVRSRGTAEELREFADHACSWQMWNPPK

SEQ ID NO: 132548 - protein, 105 aa, Glycine max
  Coding DNA Sequence Number=SeqID_15770
MHLLLLLLVLAEKKKKSVLCCVVLLLYLNVRTPGAGNGGSRELLRVQSANCVPFRSRESGACSHGLQNRSRWVMILISNFTTSLGGSGAMNLLGVRRFEDAFICL

SEQ ID NO: 132549 - protein, 1841 aa, Glycine max
  Coding DNA Sequence Number=SeqID_15771
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=99%, HitCoverage=41%, E-value=0.0, Identity=60%"; Hit description =Aldo/keto reductase; Sigma-54 factor, interaction region
MDEYAAYCDIIQPIQVAVYEMKFGLSLVLSSIWEKECLNILGQENINTVMEMIYTLMRFPRAASCKFISVKHDIGLDMLPSYQLDSSTGFYLVDADLMERLVTLSNNVAADKKVSVVQCRAAAVYWNILVKIAHFTANAKIIDDKSYMLMHKIFDEFAMLWLNRKDYAKSKSDIDTQQYKFKPRAFEIESVIEDELPPLANSYSPETFLEWKEFSYDEKSSDKMVPPEDEEWKKLEETILSHVVLIHNRLFGSSDLVQTPGIFEVSDEDRLHSFIDSYTLGIDLIRGVHSTHLPGLDAKLMPENLFYLCLDYRKKYLLSHKSAARYNFYKDSNASEMVQILKVLAPLQQQILPLLNEWEDRNDLQKFLDIIEMLLTLPLDTPLAKGCSFYCTKLKLCKKMVQSSPSQIELDSWPSLLDEVTDQFENNAGKMLGSPTSLASVLGFKMKSNMVSEPIVHSVKSPILVGSPVLAGICGEVLGDILQEPVSIFLRQEVAQRGAKAQSFHGHQPIYDVLNKGLVDGAFDLTLFSENRFMWFDNCIEELESSLQNLLLKKTSLLDVLPLHQKSVEEIQSIFRPYGDSQRTLYLKGWRAVWYTIEKIYTTAVDYGNLWKEEKKGQGKRRALSELLKLLENNGLSRHKSAYTALSGNIPYLLLTNSRLPCVTSGIPELENKNSPEESLLMEWKTAIDYYFKSVVSVLLLQQTCLNPHKDITLEQVDSSSSFLNQLVQIQQKQLSAATAFDKQLKCFRECVSTLGKLFSFSSSTDNSMNYMSSIISQQFATYKCMWQQKQLFDTLCATSQEELLLLRILENSHLNTCQRERPSARQMIASIEEFFSSFSKSKESLDCYLIGRTKAVTAVTSSSRFCIVTREMEHLVSENFKTIRDFKDNFLELQDHDLDRSTVRKVLIQHFQEIADKAKLIEEEFTTAIKGNSNQVDSSEDISERNFVELNARFNEALMSTYQHLATVLQNLCLSSNIPMVDESMEEDGTLNTSGDASGTGMGEGVGLKDVSDQIADEDQLLGTREQQNEKQDDSNEVPSSNNTGIEMEQDFQADAMSLSEDSGEDDDIDGENEELESEMGPTGPDSEAVGEKVCDENEDETLNDTREKYESGPSVKDRDGGNRELRAKDDYTTNEPGDGNCDEDDAREDDTVTPDDVEDGENADDMTMDKEAAHSDPTGLKPDELDQTLDMDLDINEDTDLMEDGELDEQGDLAENENEGNQVEETCSPDEVMEEAHTEVDVNSGKDDQGQEHQENANMNSTESKKDVSRPSELINEQVSPAELASQSKVDWQTSGSENVAAESNVSNSHHDFDSTLLGGLPSSCMSDMDIKMSDSSNSGGFGENQPKSHHPRIERSLIQEKHTNPHRSIGDALEYQKERVNVSGDLPEDNSENQGEMEDENADEYGYVSEFEKGTTQAMGPATLEQVDRNIDCDKLDKECLAGEDAKLQFEKEKSEINSISNSSLIPPQNEKREKVNTSTVEKSREDGPVNPLASMDIDLENHLEDLVSFRNSYFSESNDNISQPFLHDEDLGKCQEPYDVPDHVKDNATALWRRFELSTTKLSHELTEQLRLVMEPTVASKLQGDYRTGKRINMKKVIPYIASDYSKDRIWLRRTRPNKRDYQVVIAVDDSHSMSENGCGDVAIEALVTVCRAVSQLEMGSLAVASFGTKGNIKLLHDFDKPFTGESGVKEQMISNLTFKQENTIADEPVVDLLKYLTNKLDTAVAKARLPSGHNPLQQLVLIIADGRFVEKKKLKQCVRDVSTGNRMVAFLLLDNSQESIMDLKEVSVEGGQTKIFKYMDSFPFPYYIVLRNIEALPRTLANLLRQWMELMQHSTG

SEQ ID NO: 132550 - protein, 1149 aa, Glycine max
  Coding DNA Sequence Number=SeqID_15772
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=96%, HitCoverage=38%, E-value=0.0, Identity=40%"; Hit description =Aldo/keto reductase; Sigma-54 factor, interaction region
  Pfam annotation: Domain name=AAA; Domain location=601-788; Score= -32.4; E_value=0.06; Accession=PF00004.19; Description=ATPase family associated with various cellular activities (AAA)
  Pfam annotation: Domain name=AAA_2; Domain location=600-740; Score= -36.3; E_value=0.0052; Accession=PF07724.4; Description=ATPase family associated with various
  Pfam annotation: Domain name=AAA_3; Domain location=601-739; Score =13.8; E_value=1e-05; Accession=PF07726.2; Description=ATPase family associated with various
  Pfam annotation: Domain name=AAA_5; Domain location=601-745; Score =105.2; E_value=1.9e-28; Accession=PF07728.4; Description=ATPase family associated with various
  Pfam annotation: Domain name=AAA_5; Domain location=902-1069; Score =56.6; E_value=8.1e-14; Accession=PF07728.4; Description=ATPase family associated with various
  Pfam annotation: Domain name=Arch_ATPase; Domain location=589-770; Score=-98.4; E_value=0.088; Accession=PF01637.9; Description =Archaeal ATPase
  Pfam module annotation: Pfam domain module=AAA::AAA_2::AAA_3::AAA _5::AAA_5::Arch_ATPase; Domain location=601-788::600-740::601 -739::601-745::902-1069::589-770
MIPSLDNRDLQEIIKVRHPNLELHVGKLIETFERVNSISMVQAGFHMGSSASVYCPCRFSLRDLLKWCKRIAGLGFCFDGTLSENQCFSVYTEAVDIFASFSSSIKNRLSVMKEIAGLWKVPVSAAETLYPRDKPIIQDSFTDLRIGRVSLQYTKPSLQHHKRPFVEIRSSLHVLERIACSVKYNEPVLLVGETGTGKTTIVQNLALMLDQKLTVLNLSQQSDVGDLLGGFKPMDAQSVCVSLYNEFLTLFTKTFSVELLLMASIYAAVQNNQGLITSMHKVLEDYRQKLLIDKNGEALLKRLRIEVGKSVKLIQPGSSKKRKRPLEEQLIQEWERFCIKLRSVCQSNRSSAMMFSFVEGSFVTALKNGDWVLLDEVNLAPPETLQRIIGVLEGEHGVLCLAERGDMDYIHRHPNFRIFACMNPATDAGKRDLPFSLRSRFTEYFVDDVLDDEDLSLFISQFISSGYMDQQLVNKIVRFYKEAKKESEERLQDGANQKPQYSLRSLYRALEYTRKAERKFGFQKALYDGFNMFFVSLLDGPSAEIMRQKISSLLLKGPPDVDFIHYLDTSKCDGYTGNYVLTKSVQEHLGNLARSVLMRYPVLLQGPTSSGKTSLVRYLAAITGHDFVRINNHEHTDLQEYLGSYITDTSGKLVFNEGVLVKAVRNGYWIVLDELNLAPSDVLEALNRLLDDNRELYVPELQERIKADPNFMLFATQNPPTLYGGRKMLSRAFRNRFVEIHVGEIPDSELSEILAERCKIYFGHAKRMVEVMKDLRLHRQSSRVFAGKHGFMTPRDLFRWADRFQRFGNSYEDLAKDGYYLLAERLRNEDEKSIVQKVLENHLPVKLNIKILYDQILFRGHSSSNLNVGLGGGSKSLESVLLTKSMQRLYFLVERCYNLREPVLLVGETGGGKTTSVSSDINHASSTLDLLNGMIRNCKEGHVCSLDVSREDINALEQINLDLNGLHQKWQSIFMWQDGPLIKAMRDGDLFLVDEISLADDSVLERLNSVLEPERMLSLAEKGGSDLEKVTAHSNFFVMATMNPGGDYGKKELSPALRNRFTEIWVPPVNDQDELQGIAMKRISMFKFAGNLDPTYQKTLVNAMISFFEAFLSLKRNGLANCKYGEAKKNRSLIMKGKNKKIELLQKMI

SEQ ID NO: 132551 - protein, 72 aa, Glycine max
  Coding DNA Sequence Number=SeqID_15773
MEGREGFSSGVTVIGAEAPSAYHMAPRSEALSQVPPPVPEATAGAIGVSPVSVGLDGTATKKKSDSILAREC

SEQ ID NO: 132552 - protein, 61 aa, Glycine max
  Coding DNA Sequence Number=SeqID_15774
MLERCQCYDKAKDIEKLMFALKFIGGIGHFWTQAMASETVWTTKERRGQRQIPSLFQPKRV

SEQ ID NO: 132553 - protein, 226 aa, Glycine max
  Coding DNA Sequence Number=SeqID_15775
  Gene Ontology: Cellular component=chloroplast; Biological process =response to high light intensity
  Homolog annotation: Hit_ID=Q8L7T2; Match level="QueryCoverage=90%, HitCoverage=90%, E-value=3e-46, Identity=47%"; Hit description=Small heat shock protein
  Pfam annotation: Domain name=HSP20; Domain location=122-226; Score =90.4; E_value=5.5e-24; Accession=PF00011.11; Description=Hsp20alpha crystallin family
  Subcellular localization annotation: CTP_CleavageSite=43; ConfidenceScore=5.78e-01
MASALPNVGFHARTSSSRMNKFSNVKLLPLTSKRNRTFCSNVKAMAGGETSLQKSKQQVQPKMKVPQASPKVLLNQFPVARTVQQMMDTMERMVEDPLVYGSTSPLIVVGDDEYSKGKIPWAIKEGQKDYKMRFNMPGMNKNDVKVWVEQNMLVVKAEKALQENHEGQADGNEDWPANSYGRYNHRIALPENIEFDKIKAQVKDGILYVTIPKASTSSKVIGIDVQ

SEQ ID NO: 132554 - protein, 291 aa, Glycine max
  Coding DNA Sequence Number=SeqID_15776
  Gene Ontology: Mol. function=diacylglycerol kinase activity; Cellular component=intracellular; Biological process=protein kinase C activation
  Homolog annotation: Hit_ID=Q9FJY7; Match level="QueryCoverage=90%, HitCoverage=63%, E-value=2e-55, Identity=38%"; Hit description =Selenium-binding protein-like
  Pfam annotation: Domain name=PPR; Domain location=69-103; Score=12.9; E_value=0.22; Accession=PF01535.11; Description=PPR repeat
  Pfam annotation: Domain name=PPR; Domain location=7-41; Score=45.2; E_ value=2.2e-10; Accession=PF01535.11; Description=PPR repeat
  Pfam module annotation: Pfam domain module=PPR::PPR; Domain location =69-103::7-41
MSEKDVVSWSAMISGYAQHECFLEALALFQEMQLQRVRPDETALNSHLTCLRHYFNPMIHKHKIEANIKHYGCMVDLLGCAGLLKEAEELIKSMPMAPDVATWGALLGACRNHHDNEMGEMLGRKLIQLQPGHDGFHRGVMAQHRVVKTPGCSMIEANGSVHEFLAGDKTHQEINDIKHMLDVVAAKLKIESYVLTTSEVSLDIDEEEKETALFRHSEKLAVAFGLITISLPTPIRVTKNLRICNDCHTVVKLISKAFDREIVQIVRAIKVSDYPMLQEAAPNFHNVLDWN

SEQ ID NO: 132555 - protein, 350 aa, Glycine max
  Coding DNA Sequence Number=SeqID_15777
  Homolog annotation: Hit_ID=Q75K33; Match level="QueryCoverage=80%, HitCoverage=84%, E-value=6e-76, Identity=55%"; Hit description =Expressed protein
  Subcellular localization annotation: CTP_CleavageSite=49; ConfidenceScore=5.75e-01
MVLAYAATLSSTLSFQKSVPLNSQRSGTSFGSSFLFSRENGSVVPSLVVCHAKKKLSFMEQILDYIEGGPKLRKWYGAPDILEKDGTAIEDDEDDYPEDEVRDAVLVTDGDSETGQMVILSLIVKKARVKTLVKDKRVALEAFGSYVEFCLFFSLIIDHMMLVAKSMAGDTSDKRFLKKALRGVRTIICPNEGFLSSVGSLQGVQHVIVLSQLSVYGGKSGFQSMMKSNAKKLAEQDESVLKTSGIPYTIIRTGALLDAPGGKRGFTFDEGCAARGSISKEDAAFVCVAALDCVPQTGFIFEVANGDNKVSDWKECLATLMEETKCIPNEEGKPCAFPYLKVIKIVAFRL

SEQ ID NO: 132556 - protein, 168 aa, Glycine max
  Coding DNA Sequence Number=SeqID_15778
  Gene Ontology: Mol. function=transcription regulator activity; Cellular component=nucleus; Biological process=regulation of transcription
  Homolog annotation: Hit_ID=Q8LRU0; Match level="QueryCoverage=89%, HitCoverage=23%, E-value=2e-64, Identity=80%"; Hit description=Myc -like regulatory protein
MANNGSPKHEKMQKNLCTQLAVAVRSIQWSYGIFWSPSTTEERVLEWREGYYNGDIKTRKTVQATELEIKADKIGLQRSEQLKELYKFLLAGEADHPQTKRPSVALAPEDLSDLEWYYLVCMSFVFNHNQSLPGRALEIGDTVWLCNAQHADSKVFSRSLLAKVRFCP

SEQ ID NO: 132557 - protein, 479 aa, Glycine max
  Coding DNA Sequence Number=SeqID_15779
  Gene Ontology: Mol. function=transcription regulator activity; Cellular component=nucleus; Biological process=regulation of transcription
  Homolog annotation: Hit_ID=Q8LRU0; Match level="QueryCoverage=99%, HitCoverage=75%, E-value=1e-179, Identity=70%"; Hit description=Myc -like regulatory protein
TVVCFPYQKGVIEIGTTELVAEDPSLIQHVKACFLEISKPTCSDKSSSILDKPHDDKYPTCTKGDQRVLDTMALENPCSLEEKIKFDHEPINELQDDNNEGSNGCEHHFPMDGSMIEGINGVPSQVHFVNDDALVIGAPDSLSSCDCMSEASENQGKDSKNVGQTQLMELQDCHKPKRSSLDVGADEDLCYIRTLCAILGNSSTFKPNPYAGNSNCKSSFAKWKKGRVSERKRPKLHQSMLKKTLFKVPFMHRSYSSLKSQKGNDRMEWTSKLENDDHGLIGKAFSDKKREIKNFQVVKSMVPSSISEVEKISILGDTIKYLKKLETRVEELESYMEVTGPEARKRSKCPDVLEQMSDNYGTRKICMGMKPWMNKRKACGIDEIDTELERITSEEAKALDVKVNVKDQEVLIEMKCPYRKYILYDIMDTINNLHLDAQTVESSTSDGVLTLTLKSKFRGAATAPMRMIKEALWKVSGNI

SEQ ID NO: 132558 - protein, 319 aa, Glycine max
  Coding DNA Sequence Number=SeqID_15780
  Gene Ontology: Mol. function=oxidoreductase activity; Cellular component=cytoplasm; Biological process=gibberellin biosynthetic process
  Homolog annotation: Hit_ID=Q2HTI9; Match level="QueryCoverage=98%, HitCoverage=98%, E-value=1e-140, Identity=77%"; Hit description=2OG -Fe(II) oxygenase
  Pfam annotation: Domain name=2OG-FeII_Oxy; Domain location=160-261; Score=123.8; E_value=4.8e-34; Accession=PF03171.10; Description=2OG -Fe(II) oxygenase superfamily
MSMSEYVVELPILDISQPLQPSSLTSLSKACKDWGFFHIINHGISKDLCSQIHYLSKYLFSLPSEAKLKLGPFSSIKSYTPHFIASPFFESLRINGPNFYASAKSSEDILFDKQTSKFSETLQEYCSKMVDLSERILKLVLMSLEDGFEKLFYDSEFNKCHGYLRINNYSAPESFEDQVEGLGMHTDMSCITILYQDEIGGLQVRSHEGKWIDISPSEGTLVVNIGDMMQAWSNDKLRSSEHRVVLKQSVSRFSLAFFWCFEDEKVVLAPDEVVGDGNKRLYNPFVCSEYLKFRENNQRGRFEKVGYTVKDFAGIKSNL

SEQ ID NO: 132559 - protein, 56 aa, Glycine max
  Coding DNA Sequence Number=SeqID_15781
MEGCINFFNFCADLEVFFNKNNLVILKFKPLPLRANLTRSSSIFGPAVEAALYRQG

SEQ ID NO: 132560 - protein, 930 aa, Glycine max
  Coding DNA Sequence Number=SeqID_15782
  Gene Ontology: Mol. function=protein-tyrosine kinase activity; Cellular component=integral to membrane; Biological process=protein amino acid phosphorylation
  Homolog annotation: Hit_ID=Q1SX58; Match level="QueryCoverage=99%, HitCoverage=91%, E-value=0.0, Identity=50%"; Hit description =Tyrosine protein kinase, active site
  Pfam annotation: Domain name=APH; Domain location=643-820; Score= -15.7; E_value=0.075; Accession=PF01636.13; Description =Phosphotransferase enzyme family
  Pfam annotation: Domain name=LRR_1; Domain location=103-126; Score =13.6; E_value=0.72; Accession=PF00560.23; Description=Leucine Rich Repeat
  Pfam annotation: Domain name=LRR_1; Domain location=128-150; Score =17.6; E_value=0.046; Accession=PF00560.23; Description=Leucine Rich Repeat
  Pfam annotation: Domain name=LRR_1; Domain location=152-174; Score =15.7; E_value=0.17; Accession=PF00560.23; Description=Leucine Rich Repeat
  Pfam annotation: Domain name=LRR_1; Domain location=176-198; Score =12.4; E_value=1.3; Accession=PF00560.23; Description=Leucine Rich Repeat
  Pfam annotation: Domain name=LRR_1; Domain location=200-222; Score =11.6; E_value=1.9; Accession=PF00560.23; Description=Leucine Rich Repeat
  Pfam annotation: Domain name=LRR_1; Domain location=224-246; Score =9.4; E_value=4.9; Accession=PF00560.23; Description=Leucine Rich Repeat
  Pfam annotation: Domain name=LRR_1; Domain location=272-294; Score =7.0; E_value=14; Accession=PF00560.23; Description=Leucine Rich Repeat
  Pfam annotation: Domain name=LRR_1; Domain location=296-318; Score =10.5; E_value=3.1; Accession=PF00560.23; Description=Leucine Rich Repeat
  Pfam annotation: Domain name=LRR_1; Domain location=31-53; Score =15.1; E_value=0.26; Accession=PF00560.23; Description=Leucine Rich Repeat
  Pfam annotation: Domain name=LRR_1; Domain location=320-342; Score =12.9; E_value=1.1; Accession=PF00560.23; Description=Leucine Rich Repeat
  Pfam annotation: Domain name=LRR_1; Domain location=344-366; Score =13.4; E_value=0.83; Accession=PF00560.23; Description=Leucine Rich Repeat
  Pfam annotation: Domain name=LRR_1; Domain location=368-390; Score =12.5; E_value=1.3; Accession=PF00560.23; Description=Leucine Rich Repeat
  Pfam annotation: Domain name=LRR_1; Domain location=392-414; Score =17.0; E_value=0.067; Accession=PF00560.23; Description=Leucine Rich Repeat
  Pfam annotation: Domain name=LRR_1; Domain location=416-438; Score =14.6; E_value=0.36; Accession=PF00560.23; Description=Leucine Rich Repeat
  Pfam annotation: Domain name=LRR_1; Domain location=440-459; Score =12.5; E_value=1.3; Accession=PF00560.23; Description=Leucine Rich Repeat
  Pfam annotation: Domain name=LRR_1; Domain location=462-484; Score =13.5; E_value=0.78; Accession=PF00560.23; Description=Leucine Rich Repeat
  Pfam annotation: Domain name=LRR_1; Domain location=486-508; Score =17.1; E_value=0.063; Accession=PF00560.23; Description=Leucine Rich Repeat
  Pfam annotation: Domain name=LRR_1; Domain location=510-531; Score =6.3; E_value=19; Accession=PF00560.23; Description=Leucine Rich Repeat
  Pfam annotation: Domain name=LRR_1; Domain location=55-77; Score =14.8; E_value=0.31; Accession=PF00560.23; Description=Leucine Rich Repeat
  Pfam annotation: Domain name=LRR_1; Domain location=6-29; Score=15.2; E_value=0.24; Accession=PF00560.23; Description=Leucine Rich Repeat
  Pfam annotation: Domain name=LRR_1; Domain location=79-101; Score =11.8; E_value=1.7; Accession=PF00560.23; Description=Leucine Rich Repeat
  Pfam annotation: Domain name=NICE-3; Domain location=558-734; Score= -70.8; E_value=0.07; Accession=PF07406.2; Description=NICE-3 protein
  Pfam annotation: Domain name=Pkinase; Domain location=640-911; Score =133.9; E_value=4.5e-37; Accession=PF00069.15; Description=Protein kinase domain
  Pfam annotation: Domain name=Pkinase_Tyr; Domain location=640-911; Score=71.0; E_value=3.7e-18; Accession=PF07714.7; Description =Protein tyrosine kinase
  Pfam module annotation: Pfam domain module=APH::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::NICE-3::Pkinase::...
  Pfam module annotation: Pfam domain module=Pkinase_Tyr; Domain location=643-820::103-126::128-150::152-174::176-198::200-222::224 -246::272-294::296-318::31-53::320-342::344-366::368-390::392 -414::416-438::440-459::...
  Pfam module annotation: Domain location=462-484::486-508::510-531::55- 77::6-29::79-101::558-734::640-911::640-911
MWTLRSLRGLDLSQCSELSGEIPNSIANLSNLSYLDLSVCNFSGHIPPEIGKLNKLENLRISRNKLFGSIPPEIGMLTNLKDIDLARNVLSGTLPETIGNMSNLNLLRLSNNSYLSGPIPSSIWNMTNLTLLYLDKNNLSGSIPASIENLANLEQLTVANNHLSGSIPSTIGNLTKLIKLYLGMNNLSGSIPPSIGNLIHLDALSLQVNNLSGTIPATFGNLKMLIVLELSTNKLNGSIPQGLTNITNWYSLLLHENDFTGHLPPQVCSAGALVYFSAFGNRFTGSVPKSLKNCSSIQRIRLEGNQLEGDIAQDFGVYPNLEYIDLSDNKFYGQISPNWGKCPKLETLKISGNNISGGIPIELVEATNLGKLHLSSNHLNGKLPKELGNMKSLIELQLSNNHLSGTIPKKIGSLQKLEDLDLGDNQLSGTIPIEVVELPKLRNLNLSNNKINGSVPFEFRQPLESLDLSGNLLSGTIPRQLGEVMGLKLLNLSRNNLSGGIPSSFDDMSCLISVNISYNQLEGPLPNNKAFLKAPIESLKNNKGLCGNVTGLMLCPTINSNKKRHKGILLALCIILGALVLVLCGVGVSMYILFWKESKKETHAKEKHQSEKALSEEVFSIWSHDGKIMFENIIEATDSFNDKYLIGVGGQGNVYKAELSSDQVYAVKKLHVETDGERHNFKAFENEIQALTEIRHRNIIKLYGFCSHSRFSFLVYKFLEGGSLDQVLSNDTKAVAFDWEKRVNTVKGVANALSYMHHDCSPPIIHRDISSKNVLLDSQYEALVSDFGTAKILKPDSHTWTTFAGTFGYAAPELAQTMEVTEKCDVFSFGVLSLEIITGKHPGDLISSLFSSSSSATMTFNLLLIDVLDQRLPQPLKSVVGDVILVASLAFSCISENPSSRPTMDQVSKKLMGKSPLAEQFPAIRLGQLF

SEQ ID NO: 132561 - protein, 1030 aa, Glycine max
  Coding DNA Sequence Number=SeqID_15783
  Gene Ontology: Mol. function=RNA-directed DNA polymerase activity; Cellular component=chromatin; Biological process=one-carbon compound metabolic process
  Pfam annotation: Domain name=Chromo; Domain location=880-926; Score =15.7; E_value=0.014; Accession=PF00385.14; Description='chromo' (CHRromatin Organisation MOdifier
  Pfam annotation: Domain name=rve; Domain location=624-780; Score =79.5; E_value=1e-20; Accession=PF00665.16; Description=Integrase core domain
  Pfam annotation: Domain name=zf-H2C2; Domain location=565-606; Score =27.3; E_value=5.6e-05; Accession=PF09337.1; Description=His(2) -Cys(2) zinc finger
  Pfam module annotation: Pfam domain module=Chromo::Retrotrans _gag::rve::zf-H2C2; Domain location=880-926::1-74::624-780::565-606
MTSNAQFTSWPAFLQALQTRFAPSQYDDPTCTLFKLTQKGTIAEYLSKFEDLANRIIRLPPPFLLACFISGLSAEIRREVQAHQPLMLVQAASLARLQEEKLSDLRPPSQPRPPPLPHLQVRSPPLPLLLPSPTRNQSPFVRCLTLDELTSVRLLNLIFGHRVTVLIDGGSTHNFVQPQIVAQLGLPSRKIETPQRVMVGNSQYLECTSLCEVVPVDIQDHSFTLHLYILPISGANVVFDTSYFHITMLSEPVPSPSTPAPPPEVQHLLNKFKLLFRQPQPLPPERTTDHHIHLLPHALIVNVRPYRYLHYQKQEIEAQVDSMLQQGIIQPNTSPFSSPVLLVRKSDGTWRGRPMFFEARSVARVPSNQNEFKATMNMLFQSYLRQFIIVFFDDILIYSSSFEAHLQHLETAFQGVEPIALKFAAIQQWPLPRSIKASLLSNPSSDPQAQIAFENLKLALSTAPVLALPDFTVPFTIETDASGVGMSAVLSQKGHPIAFFSKTFPPKLLGALAYVRDLCAITTTVKKWRQYLLGHHFVIITDHKSLKELLTQDIPMIPVLLAGYHTTPTGGHAGITKTLAHITENFHWTGLHEDVKRFVANYVDCQVTKYEAQKMAGLLCPLPVPCRPWEDLPLDFIVGLPPYQGNTTILVVVDRFFKGIHLGLLPTAHTAHMTASLFVNIVVKLHGIPRSFVSDRDPLFISRFWQELFRASGTLLRMSSSYHPQSDGQTEVLNRVVEQYLRAFVHRRPSLWGKLLPWVEWSHNTSWNAGTGATPYEVTFDETFQSIRNKLLKAQAKMKKQADEKRREVQYKIGDWVLLKLRPRRQTTAKGSKALSGKLAQRVKIHLVFQLSKMKPFKGAPDSMAGVELPTDCLNDQPLVYPLAILDYRKASPEDPWEVLIQWNGLSPDDTSWESWTHLCENYHLEDKVVLQAPTDDTNMQVTEEATDKKDEGSQLLEDPWLDHGLLARDNLSNYVWFLETVVAAEAKETILEKQTTWGEGIFGLQEYNQRLQILASEWCIVVRTCKNWS

SEQ ID NO: 132562 - protein, 411 aa, Glycine max
  Coding DNA Sequence Number=SeqID_15784
  Gene Ontology: Mol. function=identical protein binding; Cellular component=cellulose and pectin-containing cell wall; Biological process=negative regulation of enzyme activity
  Homolog annotation: Hit_ID=Q1SX49; Match level="QueryCoverage=69%, HitCoverage=66%, E-value=3e-68, Identity=59%"; Hit description =Protease-associated PA; Proteinase inhibitor I9, subtilisin propeptide
MRAYLLHLVGCTLIANKSATHVDVVHLEAFRDLGESGRFSWGVAALVHMHDQLNEVSQTTTRQIVGYITLLQCWIYEHFSSVHDSVIDDAYDETSPRLRWDAIVITHRPDKVARQFGYQQITCSGLQLTKCVGLLPILQVASCYGADVLAAIDQAIDDGVDVINVSFGVSYVVTAEGIFTDEISIGAFHAISKNILLVASAGNDGPTPGTVANVAPCVFTIAASTLDRDFSSNLTINNQLIEDAFDKTLADAFAYGSGHVRPDLAIDPGLVYDLSLTDYLNFLCASGYDQQLISALNFNRTFICSGSHSVNDLNYPSITLPNLRLKPVAIARTVTNVGPPSTYTVSTRSPNGYSIAVVPPSLTFTKIGERKTFKVIVQASSAATRRKYEFGDFRWTDGKHIVRSSITVKRR

SEQ ID NO: 132563 - protein, 56 aa, Glycine max
  Coding DNA Sequence Number=SeqID_15785
MEERTRAPNCYGYPLLADHDQAKDLLEVGYPHPSSHVVVELGLFGRHLYKLTFGRL

SEQ ID NO: 132564 - protein, 298 aa, Glycine max
  Coding DNA Sequence Number=SeqID_15786
  Homolog annotation: Hit_ID=Q1SCT7; Match level="QueryCoverage=90%, HitCoverage=63%, E-value=2e-70, Identity=52%"; Hit description =Ataxin-2, N-terminal
  Pfam annotation: Domain name=PAM2; Domain location=173-190; Score =25.6; E_value=0.00017; Accession=PF07145.5; Description=Ataxin-2 C -terminal region
MATLDHSKLSQSSTGVDLCRSGSNYHAKQLASELPAQSCSFSDGKSRIQQNSVNNLHGVNDNTVEENWIQTEDVQLSKSEDLQSSLKLKKDGSDEGGLSTNVASCAPSTHILSTTPEETGSVGETRSVISHGRLGSFTSMGSDYVAATSGPGLSPSSSVGSMSSEKSTLNPNAKEFRLNPNAKSFVPSQSHARPRSPVSDGSFYFPTTVPTVPNMPAMPMGIGVGTTFVGPQPVIYNPQAAQMPSQPYFHPNGPQYGQLGHPRQVLYVPSYLPAFDLDLNKLSYIVYFQEMPYKGRDY

SEQ ID NO: 132565 - protein, 203 aa, Glycine max
  Coding DNA Sequence Number=SeqID_15787
  Gene Ontology: Mol. function=acyl-CoA thioesterase activity; Biological process=acyl-CoA metabolic process
  Homolog annotation: Hit_ID=Q56XD4; Match level="QueryCoverage=97%, HitCoverage=58%, E-value=3e-58, Identity=58%"; Hit description=Acyl CoA thioesterase
  Pfam annotation: Domain name=cNMP_binding; Domain location=33-121; Score=40.6; E_value=5.5e-09; Accession=PF00027.19; Description =Cyclic nucleotide-binding domain
MESEKAFEFLGCVPLLQRLPSSSLRKIAQLVDVKHCEPGEYVVREGEPGDGVYFILDGEAEVLGSVSANDENRPEFQLKQYDYFGYGLSNTVHQADVVALSKLTCLVLPHEHSTLLQPKSIWRAENSLETCSPVENILHLEPLEVDIFQGITLPDAPRFGKVFGGQMIGQALAAASKSVGSLKVVHSLHAYFILAGDLNSKHA

SEQ ID NO: 132566 - protein, 233 aa, Glycine max
  Coding DNA Sequence Number=SeqID_15788
  Homolog annotation: Hit_ID=Q9LVJ8; Match level="QueryCoverage=84%, HitCoverage=31%, E-value=3e-45, Identity=50%"; Hit description =Arabidopsis thaliana genomic DNA, chromosome 3, P1 clone: MDC16
MGLVGQGLWVRMNLQQVGQPKSSNGYGCWKSEKEGATKSDNKIPSGKSNASSRLASVVTGNKGGSYGSPSHDRLVYLKTCLIGQHVEVQVKNGSIYSGIFHATNSGKDFGIILKMAHLTKDAALQGKESGVEFVSKAPFKTLIIPANDLVQVIAKDVAVSRDGLPSESHYDMHQEIMVDSVISQSCHVETGRELQRWVPDEDDPQCPELENIFDGPWNRWFYTSLVIPKIFLS

SEQ ID NO: 132567 - protein, 127 aa, Glycine max
  Coding DNA Sequence Number=SeqID_15789
  Homolog annotation: Hit_ID=Q56XD4; Match level="QueryCoverage=45%, HitCoverage=17%, E-value=4e-17, Identity=65%"; Hit description=Acyl CoA thioesterase
MNISFPVPITYQVHRLRDGKSFASRKVDGIQKGNVIFTLMASFQKEESGMVHQEVAIPSVPTPDKARYKLMSVMIFCFCQWKSFGRDVLLTLVYQWKPISFPSIHPCFKFEPGISKLGCLVLNHRNV

SEQ ID NO: 132568 - protein, 633 aa, Glycine max
  Coding DNA Sequence Number=SeqID_15790
  Gene Ontology: Mol. function=phosphatidylcholine-sterol O -acyltransferase activity; Cellular component=endoplasmic reticulum; Biological process=lipid metabolic process
  Homolog annotation: Hit_ID=Q6XSH3; Match level="QueryCoverage=92%, HitCoverage=87%, E-value=0.0, Identity=72%"; Hit description =Lecithine cholesterol acyltransferase-like protein
  Pfam annotation: Domain name=LACT; Domain location=147-599; Score =61.5; E_value=3e-16; Accession=PF02450.6; Description=Lecithin:choles terol acyltransferase
MSLLRRRKGSEPEKGPSPSSEPKVLSEDETEDDKNNKKNKKKRDEMMPSSIPQYVTEAFTGPMPDPPGLKLKKEGLKVKHPVVFVPGIVTGGLELWEGHLCAEGLFRKRLWGGNGFRSWKQPLLRQEPHALDCHSCCFGVTIGTAEFFEMPLLTYPELPSCWVDHMSLDNETGLDPPGIRVRPVSGLVAADYFAAGYFVWAVLIANLARIGYEEKTMYMAAYDWRIAFQNTEWVEAPAPTGGGGGPDWCSTYIKAVVNIGGPFLGVPKAIAGLFSAEARDIAVARTIAPGFLDNDLFRIQTLQHVMKMTRTWDSTMSMIPRGGDTIWGGLDWSPEEGYHPSQRKHSNNNTQLKDHETNQTNFVNYGRMISFGRDVAEAHSPEIQMTDFRGAIKGRSIANTTCRDVWTEYHEMGFEGVRAVAEHKVYTAGSVVDLLQFVAPKMMARGSAHFSYGIADNLDDPKYNHYKYWSNPLETKLPNAPDMEIFSMYGVGLPTERSYIYKLTPFAECYIPFEIDTTQDGGSDEDSCLQGGVYTVDGDETVPVLSSGFMCAKGWRGKTRFNPSGIRTYVREYDHSPPANLLEGRGTQSGAHVDIMGNFALIEDVIRVAAGAKGEDLGGDKVYSDIFKWSEKI

SEQ ID NO: 132569 - protein, 216 aa, Glycine max
  Coding DNA Sequence Number=SeqID_15791
  Homolog annotation: Hit_ID=Q9FV01; Match level="QueryCoverage=66%, HitCoverage=45%, E-value=7e-18, Identity=39%"; Hit description=SKP1 interacting partner 4
  Pfam annotation: Domain name=F-box; Domain location=23-70; Score =31.4; E_value=3.1e-06; Accession=PF00646.23; Description=F-box domain
MEHIDKGKESSNSDNEVEATNSPIICGLPDDIFLMCLARIPRKYHSVLKRVSKRWRNFICCEECEFLDSTDEVYSYDASSNCCAQASSLSTARLVSLFLFFLEANSGGGGSNSSYHSWETFDPLTNCWTSQTDPKIVNEIKDSVILDGKIYIRCSRYPVTPHVFAVVYEPSSGTWEYADKDIVSGWTGPAVAVDGTLYVLDQMWLLMLVIWGMRIK

SEQ ID NO: 132570 - protein, 239 aa, Glycine max
  Coding DNA Sequence Number=SeqID_15792
  Gene Ontology: Mol. function=protein binding; Cellular component =actin cytoskeleton; Biological process=cytoskeleton organization and biogenesis
  Homolog annotation: Hit_ID=Q9FV01; Match level="QueryCoverage=99%, HitCoverage=77%, E-value=2e-51, Identity=46%"; Hit description=SKP1 interacting partner 4
  Pfam annotation: Domain name=Kelch_1; Domain location=1-43; Score =15.0; E_value=0.079; Accession=PF01344.15; Description=Kelch motif
  Pfam annotation: Domain name=Kelch_1; Domain location=45-90; Score =33.6; E_value=7e-07; Accession=PF01344.15; Description=Kelch motif
  Pfam module annotation: Pfam domain module=Kelch_1::Kelch_1; Domain location=1-43::45-90
MGFEALGSKLFLLGGCSGFLDFTDEAYSYDASSNCWAVAASLSNARCYLTCEVLDEKLYAIGGLVSNSSNHSWDTFDPLTNCWTFHIDPNIGSDIKDSVVLDGKIYVRCARHPDVTRRVFVVVYEPSSGTWQYADADMVSGWTGPAVVVDGTLYVLDKSLGTSLMMWHKDQVGKLSPWLTRPSCQLVAVGKSIFIVGINLSTVVVDVGDLGNEGQVMMGSSIPGLLSDFNVISCKCLSI

SEQ ID NO: 132571 - protein, 225 aa, Glycine max
  Coding DNA Sequence Number=SeqID_15793
  Homolog annotation: Hit_ID=Q9FV01; Match level="QueryCoverage=99%, HitCoverage=77%, E-value=5e-33, Identity=36%"; Hit description=SKP1 interacting partner 4
  Pfam annotation: Domain name=Kelch_1; Domain location=1-43; Score =16.0; E_value=0.059; Accession=PF01344.15; Description=Kelch motif
MGFEALGNKLFLLGGCSEFLDSTDEVYSYDASSKCWAQATSLSTASLNFSPYCTVEITIFFYIRFQTDPKIVSEIKHSVVLDRNIYVRCTSKYPVTPHVSAVVYKPSSGTWQYADDDMVSGWRGPVVVVDGTLYVLDQSLGRTRLMMSLKERREWIPVGRLLPSNARPPFQLVAVGKSIFIVGRVLSTVVVDVGDLGNEDQMIVGSALPGLLFDVNVISVKCLSI

SEQ ID NO: 132572 - protein, 56 aa, Glycine max
  Coding DNA Sequence Number=SeqID_15794
MQTASPIGGQSHWRFRHARRLASQTGELQAKAQAQLFRLSVGHLFRWQGRVKAKGD

SEQ ID NO: 132573 - protein, 76 aa, Glycine max
  Coding DNA Sequence Number=SeqID_15795
MKEHKGKRDEALVLATRDGDILEAQVKGCSSQLPAPAPLPLRACECCLQVASQTSGLTTISCLPVIVATCHMSQPQ

SEQ ID NO: 132574 - protein, 372 aa, Glycine max
  Coding DNA Sequence Number=SeqID_15796
  Homolog annotation: Hit_ID=Q75K31; Match level="QueryCoverage=81%, HitCoverage=37%, E-value=1e-14, Identity=28%"; Hit description =Expressed protein
MSYGGVVRCLNDPFHEVKRRRDRKKETQNVGNKGQPSADSRRSSENNSGQGMKFNAPSERNVRRTNYSRNTLPGISKEFRVVRDNRVNHIYKEVKPLTQQHSTSATEQLNVNTPDKGSSTSTNHRSSGSRNSSLASNGPSDSHARYLKDAVPNIIDRKIASEDKDKQGMISNAAGRVQPIKPNNAHQNSASVASTSSAVGVYSSSTDPVHVPSPDSRSSGVVGAIRREVGVVGVRRQSSDNKAKQSFAPSISYVVGKDGTSADSFQSVGAVSKTEQFSQTNVTEPSLSGMPVSRPSLNNQYNNRPHQQLVGHQRVSQQNKEWKPKSSQKPNSNSPGVIGTPKKAAVAAASPPAENSGDIESNTTELQDKLSQ

SEQ ID NO: 132575 - protein, 430 aa, Glycine max
  Coding DNA Sequence Number=SeqID_15797
  Homolog annotation: Hit_ID=Q287W0; Match level="QueryCoverage=55%, HitCoverage=60%, E-value=2e-21, Identity=34%"; Hit description =Expressed protein
MDKWDNKPSRKQHHRENPSFSSTLLDVIYRSIDEDPTDEKEEAQLIFYRETMRNQKQSNCFREEKPEAEKHNSRRARKVENWMEKKANEKVVMGRNSLTEFERRTRSNSISNTLSMYSSSTSSESSSVGGFSSSESESFYGVQRPKPIKTSVSDKTKTKTTFDASLHSHNFRSHSSQSQKPKHENGSGKTKSKALKILYGELKKAKQPISPGAKLASFLNSLFTSSGNAKKAKVSTTTTTTTTSTYRPVLIPVATDRTADTKSAAQQQQQPGSTCSSASSFSRSCLSKTPSSRSGAKRSVRFCPVSVIVDEDCRPCGHKNLHEGEESNGKNRSEELRLHVMQESRRVEELARDLLKNYQKKSEVEFDDVMHYEDEEEEEDDDDVASCSSSDLFELDNLSAIGIERYREELPVYETTHFNTNRAIANGFIL

SEQ ID NO: 132576 - protein, 374 aa, Glycine max
  Coding DNA Sequence Number=SeqID_15798
  Homolog annotation: Hit_ID=Q69NN2; Match level="QueryCoverage=76%, HitCoverage=31%, E-value=6e-56, Identity=42%"; Hit description =Hydroxyproline-rich glycoprotein-like
  Pfam annotation: Domain name=Extensin_2; Domain location=39-368; Score=-141.0; E_value=0.086; Accession=PF04554.4; Description =Extensin-like region
MKNQTNKRDMPLNWLEIDWKTCWRLMGQCQKMKNRPLGVKKLAGKSVNVKIQTLSPNDWAYDPPAGYDIPYFRPTIDETVRGQGLSSPQEALISHATNNPPASTIAMVQQQQPPVPQMYPQVHVSHFANLMPYRQFLSPVYVPPMAMPGYSSNPPYPHPTNGSSYLLMPGGGSHLNANNLKYGVQQFKPVPAGSPTGFGNFANPTGYAMITPGVVGGATALEDSSRVKYKDNLYVPNPQLILLEVSIMSGRCQKVLTSNHAETSEIWLQNPRDLPGMQSTPYYNMPGQTPHAAYMPSHTGHASFNAAAAQSSHMQFPGMYHTPPQPAAMASPHHLGPPAIGNNVGVGVAAAAPGAQVGAYQQPQLGHINWTTNF

SEQ ID NO: 132577 - protein, 297 aa, Glycine max
  Coding DNA Sequence Number=SeqID_15799
  Gene Ontology: Mol. function=nucleic acid binding; Biological process= DNA integration
  Pfam annotation: Domain name=zf-CCHC; Domain location=186-203; Score =20.3; E_value=0.00044; Accession=PF00098.13; Description=Zinc knuckle
FEDDGIEEPDQALREKRKKDAKALFIIQQALDDEVFPRIAAASTAKEAWHILNQEYVRDKKVVNVRLQSLIREFESFQMKEKENMQECLSRISSTVQQIRTLGEEIKESQVMSKVLRSLTKKYDHVVVAIEESKDMETYTFDELKGSLHSHEERICKGRGSRGRGRGRGQSNEEKDQSSQNYQGSFKCYYCKKPGHKEASCWKKEEDEQKGRDQKSNFVEQEEKLFLAQHTSNNDAEGGVWYVDSGCSNHISSAKPIFRTLDETAKTKVRLGDGKQLEVERKRHDCNHNRARQHQAL

SEQ ID NO: 132578 - protein, 370 aa, Glycine max
  Coding DNA Sequence Number=SeqID_15800
  Homolog annotation: Hit_ID=Q1SBE3; Match level="QueryCoverage=99%, HitCoverage=37%, E-value=1e-71, Identity=48%"; Hit description =Unnamed protein product; contains similarity to pherophorin gene _id:T5M7.14-related
MLEYAGSEHGQGDTDLDCYFSHSSSPGSEDFENASSFDSSMHKHSGVSKKTSLIQKLKKWGKSKDDSSALSSAARYLSGVSPSRMSMSNRPRDSLESLMQRNAGDSVTITTSGQKDQEPTDSPETLALPNIRRVSSSDSLNSVAASFQLMSNTVVAYLDEKYPAYKDRHKLALQREKQIKEKAEKARAEKFGDNSNLNMTKAERERTTSLLPKLTQLKEKAYVSGSPNDHPDNVKNVDNQTISKMKLAHIEKRPPRVPQPPPKPSDGAPVSANSNPSNGVSCAPPQPPPPPPPEPPGGSLPTPLGNLSRGELAGDKVHRAPELVEFYQTLMKLEAKKDTSLISSTTYPFDARSNMIGEIENRSSFLLAVH

SEQ ID NO: 132579 - protein, 162 aa, Glycine max
  Coding DNA Sequence Number=SeqID_15801
  Subcellular localization annotation: CTP_CleavageSite=50; ConfidenceScore=5.24e-01
MDAPSSQDTLAPQHPLPTLVASKATGAMAQVPKKVAPKKQQPSSTTKCLRALNETKSDEDGLVFRKKKVAPPLDETTAPQMNKVKPTPQVPPSPLPITQRIKRPMGKTEVIHFKNKKKTESTTGMDNEIQHQAPLSPIHLDRFQHQGQPTIETQAHCLRHHK

SEQ ID NO: 132580 - protein, 105 aa, Glycine max
  Coding DNA Sequence Number=SeqID_15802
MSFPMLLSFITSLDENMGQVKGSALHKMGVPNLIFKFDELGASTLTISSLSDELIDEFRHPHLGVLKEMVDASQHEVCLDNISNILQRFNVKEVFGVNFGFFILQ

SEQ ID NO: 132581 - protein, 85 aa, Glycine max
  Coding DNA Sequence Number=SeqID_15803
MSPQISASPQQLDLAPYASGPYNAQWNAPGLLHDKHTLRSSRILGEIEVDEPWLGLRLPLNYQVDMGVIEAVPESNKHENAVTKK

SEQ ID NO: 132582 - protein, 156 aa, Glycine max
  Coding DNA Sequence Number=SeqID_15804
MEEHLRAQCVISSLSEEFVSSRLSAPSSLNGFSITRAKRAFKDRKPFLRLKLEKSIIRLRERGLERAALRWKAKHLCWEILLKLDAKFNETFENEVIWFIWTWRLKLLGDETTQKGGEKSCKKGQESHTGASEAHRMAEDQPRRVTLEDYSSSTVP

SEQ ID NO: 132583 - protein, 224 aa, Glycine max
  Coding DNA Sequence Number=SeqID_15805
  Homolog annotation: Hit_ID=Q9SMB7; Match level="QueryCoverage=29%, HitCoverage=19%, E-value=2e-26, Identity=86%"; Hit description =Quinolinate phosphoribosyltransferase
  Pfam annotation: Domain name=QRPTase_C; Domain location=95-224; Score= -28.9; E_value=8.6e-06; Accession=PF01729.9; Description=Quinolinate phosphoribosyl transferase, C-t
MLGAQAIELVRKITSTARDDCEPKLNDPDLAPLSRAPAESLAEWAGLRGPLAEWPHILILREWRNLRHENFKCLDVLIDSGCLVEELKLRKRITHLVVAVTLEQHAFERGPIVAPGESEQHNKVSYISVHIAVTNWESSLTLVETRTLEEVEEVLHYSSQTKTSLTRIMLDNMVVPLPNGDVDISMLKEAVQLINGRYETEASGNVTLDTVHKIGQSGVTYISR

SEQ ID NO: 132584 - protein, 633 aa, Glycine max
  Coding DNA Sequence Number=SeqID_15806
  Gene Ontology: Mol. function=RNA-directed DNA polymerase activity; Cellular component=chromatin; Biological process=chromatin assembly or disassembly
  Pfam annotation: Domain name=Chromo; Domain location=528-582; Score =22.2; E_value=0.0019; Accession=PF00385.14; Description='chromo' (CHRromatin Organisation MOdifier
  Pfam annotation: Domain name=rve; Domain location=291-429; Score =25.0; E_value=4.8e-05; Accession=PF00665.16; Description=Integrase core domain
  Pfam module annotation: Pfam domain module=Chromo::rve; Domain location=528-582::291-429
MPQDLQHVLDQHASVFTARKGLPPQRAHDNSINLLPMNSTCECKFSFGLPSIDYLGHVISAQGVAMDPDKVKAELDWPVPVNAKEVRGFLGLTGYYHQFIKDYASGQGFGAVLMQDCQPIAYFSKALSAGTLSKSVYEKEIMALALSIQHCISFNNVSPPQISNAENKADYTLSCQFPSTEFNTISISPYWVDFPAVRNKVQNDPGLVKLSSQLQSDSDSLQHYTLRDGLLFNKDRLMLPKTSSLIPTLMAEFHDTGMKATIMEYIHQCDVCQRKKYQALSPTGLLQHIPIPEIVWDDISLDFITSLPHSQGYDVILVVIDRLSKYAHFLSLKHPYTACSVAEVFIKEVVKLHGFPKSIISDHDPLFLSKFWSELFHLQGTVLRMSTTYHSQTDSQTDVNFDTILHPILQWASSPFEIVYSRNPLSVLRYLIGETQVDSIASVLIDRDKALRQLKFHLHRAQQTMKKYADAHHRHVTYEVGEYSSKRSSSAFPCQGGGVQVALKCSAKSGSSVTILPPRLAVDNPKTPRPEDILAIGEGKHLRNSVEEWLILWKSQPVVEATWENTAPIKDRFPNFCLEDKAVVLEGGIDRKLASKWDRLFKVRNISVIIGIVGLAVGYDGFGIKSGAQRTFL

SEQ ID NO: 132585 - protein, 119 aa, Glycine max
  Coding DNA Sequence Number=SeqID_15807
  Gene Ontology: Mol. function=nicotinate-nucleotide diphosphorylase (carboxylating) activity; Cellular component=chloroplast; Biological process=pyridine nucleotide biosynthetic process
  Homolog annotation: Hit_ID=Q9SMB7; Match level="QueryCoverage=66%, HitCoverage=22%, E-value=2e-32, Identity=85%"; Hit description =Quinolinate phosphoribosyltransferase
  Pfam annotation: Domain name=QRPTase_C; Domain location=26-118; Score= 7.0; E_value=2.9e-08; Accession=PF01729.9; Description=Quinolinate phosphoribosyl transferase, C-t
MASYNDVCKCNETYQCHKYENKLTFRAFPQAMANAAYPAYMLETRKTAPGLRLVDKWAVLIGGGQNHRMGLFDMVMIKDNHISAAGGVADALKAVDLYLEQNNLQMEVEVQQDDRNRFY

SEQ ID NO: 132586 - protein, 190 aa, Glycine max
  Coding DNA Sequence Number=SeqID_15808
  Gene Ontology: Mol. function=nicotinate-nucleotide diphosphorylase (carboxylating) activity; Cellular component=chloroplast; Biological process=pyridine nucleotide biosynthetic process
  Homolog annotation: Hit_ID=Q9ZU32; Match level="QueryCoverage=70%, HitCoverage=38%, E-value=3e-54, Identity=76%"; Hit description=NADC homolog
  Pfam annotation: Domain name=QRPTase_N; Domain location=41-130; Score= 142.6; E_value=1.1e-39; Accession=PF02749.6; Description=Quinolinate phosphoribosyl transferase, N-terminal domain
MSATEVTSSRISYESFAIKPPEHPTYDLKGIIKLALEEDAGDRGDVTCLATIPFDMEVEAYFLAKEDGIIAGIALAEMIFHEVDPSLKVEWSKNDGDFVHKGLQFGRVRGRAHNIVVAERVVLNFMQRMSGIATLTKVLAQLHYAKCIAWHYATCIAADFKHNSPELSWDETRFSLVGDEFFSVWDNKHK

SEQ ID NO: 132587 - protein, 134 aa, Glycine max
  Coding DNA Sequence Number=SeqID_15809
  Pfam annotation: Domain name=Chromo; Domain location=1-49; Score=8.7; E_value=0.091; Accession=PF00385.14; Description='chromo' (CHRromatin Organisation MOdifier
QPQEITDRRTKSLRGKEIALVKVQWGTDEGDSTWELEDRMRELYPILSKTGPDGRRETRETGTREMARNPRQDFSVSKLSLSLFLTLLFPSPPFSIEAPHKASTFGAHFCSKSRKESIFGVVKCVATSGTSKIQ

SEQ ID NO: 132588 - protein, 71 aa, Glycine max
  Coding DNA Sequence Number=SeqID_15810
MDVYFTIKILMFPTNANVVVWPIMQRTKQDNNIFLRQNDDHFPHKGTGTGAFGSLTSSTPTFTWPGNKGVL

SEQ ID NO: 132589 - protein, 77 aa, Glycine max
  Coding DNA Sequence Number=SeqID_15811
MAHLRFVILFGRNNQHENTEKGVPMNPKRIKVIPEWPAPPSVLRKKAQRFKNLGDLRSNPFQGRRGMMQSYPAKDIG

SEQ ID NO: 132590 - protein, 150 aa, Glycine max
  Coding DNA Sequence Number=SeqID_15812
MAPHLTSPRSPDPRDISQGTTLWSTNKSRKTDSSTLSYIKLIGLWALVICGTRWRSSDGANQLSHFHKPGISTPSPVAHLYIELTHSYIALILVPLNTGSPSTPPSFHNIQRIQFHLSWNYPKPRKIEWRQKTLHKTHPNSTVFPTHLPQ

SEQ ID NO: 132591 - protein, 218 aa, Glycine max
  Coding DNA Sequence Number=SeqID_15813
FERLSPVINLAYIRKNYWNPEDLIVSIRGARRARARPAKLSSTSTAPTPAPTSAAPSVPAQIDSQHFEAMLQNIHQEQIILLQSLQVVAPPGSIPSVEQFTKMVAWPGTQPSLHREDGGPTAQPIIIEEEAEETQVRQVVAATPERSLEATSDPSTQGEDIPSPQPAVDPSTPLLEMSEDPTTSFLAMDTSPPATLVLHLTDKEDVQTQDTQDQSQEF

SEQ ID NO: 132592 - protein, 93 aa, Glycine max
  Coding DNA Sequence Number=SeqID_15814
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q2HTG1; Match level="QueryCoverage=81%, HitCoverage=18%, E-value=3e-21, Identity=60%"; Hit description=GTP -binding signal recognition particle SRP54, G-domain
  Pfam annotation: Domain name=SRP54; Domain location=1-88; Score= -50.9; E_value=1.6e-07; Accession=PF00448.13; Description=SRP54-type protein, GTPase domain
GKSCMLVAGDVYKPAAIDQLAILGKHVDVPVYTAGTDVKPSEIAKQGLEEAKKKKIDVVIVDTTEVLLVVDAMTRQEVVGSSGLRIIKKGGLN

SEQ ID NO: 132593 - protein, 67 aa, Glycine max
  Coding DNA Sequence Number=SeqID_15815
MRWDRKARLCDRKVDRTIEQDDWDRTVEESCGTDKESPDNTAADQGIPVVGPTGEEEVTWLTSYNYN

SEQ ID NO: 132594 - protein, 97 aa, Glycine max
  Coding DNA Sequence Number=SeqID_15816
MESNLKTKRGQIMSEVESGDPREQIEGEAYLEVVGGGEGDDGVLNDGVSVRRWGLEEELVGEGEGESGAGEPEEGRGDEEVVEEGGHGGMGVEGGSF

SEQ ID NO: 132595 - protein, 69 aa, Glycine max
  Coding DNA Sequence Number=SeqID_15817
MVTDPLVHVEGDDGVLNDGVSVRRWGLEEELVGEGEGESGAGEPEEGRGDEEVVEEGGHGGMGVEGGSF

SEQ ID NO: 132596 - protein, 111 aa, Glycine max
  Coding DNA Sequence Number=SeqID_15818
  Subcellular localization annotation: CTP_CleavageSite=22; ConfidenceScore=5.07e-01
MPIPLASPVPIGGRQAVVEIKRTTTRVGSGINGTGRPRIPSGRGGLRNDSFRGRGNYVGGRGYGRNDYVSRGGFSGAEEEELNGNWVNNQEQELLNTVLLKDEDNVVKWCL

SEQ ID NO: 132597 - protein, 400 aa, Glycine max
  Coding DNA Sequence Number=SeqID_15819
  Gene Ontology: Mol. function=nucleic acid binding; Cellular component= intracellular; Biological process=transport
  Homolog annotation: Hit_ID=Q9FME2; Match level="QueryCoverage=94%, HitCoverage=74%, E-value=1e-72, Identity=44%"; Hit description =Similarity to RNA-binding protein
  Pfam annotation: Domain name=NTF2; Domain location=17-133; Score =151.0; E_value=3.2e-42; Accession=PF02136.11; Description=Nuclear transport factor 2 (NTF2) domain
  Pfam annotation: Domain name=RRM_1; Domain location=333-392; Score =26.0; E_value=0.00013; Accession=PF00076.12; Description=RNA recognition motif. (a.k.a. RRM, R
  Pfam module annotation: Pfam domain module=NTF2::RRM_1; Domain location=17-133::333-392
MALQTATPPTTPSAQVVGNAFVEQYYHILHHSPGSVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDSAAVTVTPELGKIIIQKIVSSLSKFIQELHSCCSPFFTEPSHVADSCAPEPTNSHVNKGQTVAENAYELSNNHERQIPVENEGNVESHFQSNGNDDSQATELASSAQDDAPKKSYASIVKVQKGSSVPTKVYVPTNTLKSGPNKTESKVVESVESTEVPEAALESVSNPESSDAHEEVEGHSIYIRNLPLNVTVAQLELEFKKFGPIKPGGIQVRNNKQQGYCFGFVEFLSLNSMNSAIQMVMIWHKNYI

SEQ ID NO: 132598 - protein, 77 aa, Glycine max
  Coding DNA Sequence Number=SeqID_15820
  Gene Ontology: Mol. function=DNA binding; Biological process=DNA integration
MEDILMQQPEGFAVEGRENFKVGDGSHIYLLLYMDDMLIASQNLLAILKLPSLLNSEFEIKDMGATGKILGMEIKNN

SEQ ID NO: 132599 - protein, 99 aa, Glycine max
  Coding DNA Sequence Number=SeqID_15821
MVACHGFSGVEHGASIALGPVKLRHGSCDDGGVGAANLEGGEAHAEQSAVVVEGFEITFNSNNWNGNESERDIEREEKETERAKREEKEARREGRSAAQ

SEQ ID NO: 132600 - protein, 142 aa, Glycine max
  Coding DNA Sequence Number=SeqID_15822
  Gene Ontology: Mol. function=RNA-directed DNA polymerase activity; Cellular component=mitochondrion; Biological process=RNA-dependent DNA replication
MGLLRGVPICPQDLYKLFDPSFLGFIQPFIQLPQNHLVSYLGLPYSYGKGYENVHSPNGKRPRGDHWIEIFSRLMYQISMFLALETLLYKIQAVHLEGWPIVVGPQNSSGHGPFFGMQATYTLMQFLEDIVSLVSIKALKLR

SEQ ID NO: 132601 - protein, 147 aa, Glycine max
  Coding DNA Sequence Number=SeqID_15823
  Gene Ontology: Mol. function=nucleic acid binding; Biological process= DNA integration
MVNTIKIEKFTRNIALTFGASRCEPCCKKMTSRILSSANRQRLISQCLSYKRKYLAFPNDGTLEGPNSQNGHSPTRSMLCAQALGTSSDDASYKCNAHKTEEVLPCDFHVSLACLEYPDLFHSCGPDTDAIENYQTSHWTHDFWIVK

SEQ ID NO: 132602 - protein, 64 aa, Glycine max
  Coding DNA Sequence Number=SeqID_15824
MCTCGEGAEVESEEELEEDVIAKNVGEDNRGKVIVGREIGVGDDENGEGGAVQEIRSEGHEGGE

SEQ ID NO: 132603 - protein, 295 aa, Glycine max
  Coding DNA Sequence Number=SeqID_15825
MGVLRILNVAPMQQHPNKNDYSGQRQHECFQLGSAKPDRCRKAKTQEAEPSGASKGLRDHSRHREGTSREKRLKQSMLGFQPTTATTLENMATLTNQSFFNNNFWSNRLIQSKIISEHGCQVLSKGDNAANWANFWVFLSRVPIIAQHLQGSSNIKALKEQLLKAKDSLNSTLQANMKLAGDNKILEERVLPLLNDAKRLETRALNVEALLMPTRRRRRLMLKRKGFSKRPLMMSIMHMRLHMCDISDLSVFDINKDVHEVLIDDISEDDIALSPHKPTTLVEEPHVKEIKDGEF

SEQ ID NO: 132604 - protein, 169 aa, Glycine max
  Coding DNA Sequence Number=SeqID_15826
  Gene Ontology: Mol. function=RNA-directed DNA polymerase activity; Biological process=RNA-dependent DNA replication
MSGPYDAIVGTLNVRRALPAHLRRLRNWLKGKRKKSVEIVENDGDSFAKRVRRENVENVPGKGVIAKMLRDSTAQVLADFANEFHPAPPQFEQEWWAMHVDNSSNRHGGGVGVILEGPNGVVMAQSLHFGFNATCNQAEYEAILVGLRLAKEVGAQRVQCRSHSKIIVE

SEQ ID NO: 132605 - protein, 89 aa, Glycine max
  Coding DNA Sequence Number=SeqID_15827
MCYLNNRSDNAMYRRATSVSVMCTFRVYLAVLLRNVSHKLDSDLESSKKRNWDTDVLVLTLEEEAITVAHALANRWTGREGRNNHVINL

SEQ ID NO: 132606 - protein, 391 aa, Glycine max
  Coding DNA Sequence Number=SeqID_15828
  Homolog annotation: Hit_ID=Q9M2J9; Match level="QueryCoverage=19%, HitCoverage=62%, E-value=3e-27, Identity=79%"; Hit description=Bet1 -like SNARE 1-1
  Pfam annotation: Domain name=SNARE; Domain location=250-312; Score =44.9; E_value=2.7e-10; Accession=PF05739.9; Description=SNARE domain
MLMVLISYIETAESTESTEGSQRAVPNHKRNVLTVLKWYLLYLIWDTYKLVLQGQNDDILGKELSTDSSQHVCSALALVIMGMPPVLGKTSFSALGHSVYFAVSHMNLLIVVHWPLDIKHDNDAFSMFHAASMLNWSLIPLLDLMAFLFIQYTASRKGFRVHHQSLISWSVLMLSSLTLLSHAVFHIVLVIEGDQWSTVDAQWDQLIGFIRVQSWKTLLREYFLDGFGLEEGGIRASSVYSSSHEIEEHDNEQPLDGLQDRVNLLKRLSGDINEEVDRHNHMLDRMGNDMDASRGVLSGTMDKFKMCMRYLAHNGFFEIVRIHDNIEEKEAYALTVVSELHPEHNKSFNETMASDSQMMNLVLRDCNWVLEGLESIVDVGGGTGITVKITC

SEQ ID NO: 132607 - protein, 120 aa, Glycine max
  Coding DNA Sequence Number=SeqID_15829
MSDFGEVIIDMGDSIKCHLGDKLLIGTRHDNRVRTCETCPRLTSILTRKIQVDRGRGRIRDFISMSGRGGTGETQLHWGGDGVNLHSYWVLGAGTGKMGNWGRGWDKQNSASTRPVAMPI

SEQ ID NO: 132608 - protein, 281 aa, Glycine max
  Coding DNA Sequence Number=SeqID_15830
  Homolog annotation: Hit_ID=Q1SMK2; Match level="QueryCoverage=67%, HitCoverage=25%, E-value=4e-17, Identity=30%"; Hit description =Retinitis pigmentosa GTPase regulator-like protein
MNLHEIEHMYFPFPAIIDFLLNVDHSKRMCEFLSSWTPNIFVVAVVDSSNFTLKTTLKENEILISKQLLADLLGVLADGKRQYDEWFDIMGLKKSMIMRKFFEEKNDEFKSKSLTSFWRIVHWISMHSVLPRAGTYQEINDHELLVIYFLWKKIPLSLSSLIINHMIMATKPIKSTSSVPNGMLMTLVFKHFGVPLEDEAQDEEMLTWGGEKNVATLKLNPQPWMKKTCTCSNKEPSPPLFDLIKSGERLKKVTSEGTHNSKEEVFEDHSEKVQNEEEKEE

SEQ ID NO: 132609 - protein, 286 aa, Glycine max
  Coding DNA Sequence Number=SeqID_15831
  Homolog annotation: Hit_ID=Q47522; Match level="QueryCoverage=21%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKTGCNVFWVDGNEYSKSLTNCMKTRIPIPIRIEIGHIKVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132610 - protein, 159 aa, Glycine max
  Coding DNA Sequence Number=SeqID_15832
MAEPSKKRKGSSSRSQRHSEVQDTPIPSSISSSSLFSSEEQCIQYINLFSFRSIIDPKFIDMDFFSDESFECIQAFKNSNLIPFMSLKLPVYSELIKAFYSNLEIQESTLISEVYGIKMVIDQSLIYDLTQLTNDGVPFEGALDDDWKFDFSVHDACRL

SEQ ID NO: 132611 - protein, 74 aa, Glycine max
  Coding DNA Sequence Number=SeqID_15833
  Gene Ontology: Mol. function=structural constituent of ribosome; Cellular component=ribonucleoprotein complex; Biological process =translation
  Homolog annotation: Hit_ID=P59223; Match level="QueryCoverage=77%, HitCoverage=38%, E-value=4e-22, Identity=84%"; Hit description=40S ribosomal protein S13-1
  Pfam annotation: Domain name=Ribosomal_S15; Domain location=2-70; Score=23.3; E_value=5.2e-06; Accession=PF00312.12; Description =Ribosomal protein S15
MEEVYNNYKNEVGPMLEIPEDLYHLIKNAVSIRNHLERNKKEKDSKFRLILVDSRIHRLARYYNKTKELPQVWK

SEQ ID NO: 132612 - protein, 127 aa, Glycine max
  Coding DNA Sequence Number=SeqID_15834
  Gene Ontology: Mol. function=nucleic acid binding
  Homolog annotation: Hit_ID=Q1SJY4; Match level="QueryCoverage=51%, HitCoverage=13%, E-value=2e-10, Identity=51%"; Hit description=Zinc finger, CCHC-type
MAIYRKNHLGQGQLAQASSLLHLEGISSPLLKAKERKTTHQRIKKILRSQPKIWRPKVTTIKETKNLKILAMDELIGSLKNIDYEIFVEDEEELAFLIKEIQSLLKKRKRLRSDGSLLVKLLWRLDL

SEQ ID NO: 132613 - protein, 121 aa, Glycine max
  Coding DNA Sequence Number=SeqID_15835
MSSAVAVFGCKWWCLRVGKIRISGCSGTTTSESACSAQNLDVRLGHVTTKPKQEAPMVISTKPSNTTLALSGSPITLPSTLIVMLPGFGRCHTTCLTTRLAQQRKSSSMNGVMEMASEAKC

SEQ ID NO: 132614 - protein, 240 aa, Glycine max
  Coding DNA Sequence Number=SeqID_15836
  Gene Ontology: Mol. function=nucleic acid binding
  Homolog annotation: Hit_ID=Q1T6D0; Match level="QueryCoverage=38%, HitCoverage=17%, E-value=6e-14, Identity=39%"; Hit description=Zinc finger, CCHC-type; Lipocalin
MEYYDESILMALVVVVGKPVKVDIKTINVSHGKFAHICVEIDQNQPVVGRVWFRNTWFNVEYEGMHLICNRATQAKEGGSGVNPSNHNIMRARPDSSKGSNGNFGQLVILTHEANMNITKAIDNHKGTERQLEGGRHDGGGLNFWSSVRRASNIYVFCHGTLWALPTSGVMAMKRSKIHGLRRPSREWYIDNQILHEEAIKYFKTLFCSRESISSKELRFVPDAFVMGHFDARIIETFLV

SEQ ID NO: 132615 - protein, 192 aa, Glycine max
  Coding DNA Sequence Number=SeqID_15837
  Homolog annotation: Hit_ID=Q1SDG1; Match level="QueryCoverage=34%, HitCoverage=5%, E-value=3e-16, Identity=61%"; Hit description =Integrase, catalytic region; Zinc finger, CCHC-type
MMGELKFFLGLQIIQKDDVIFIHQEKYTKDFLKRFRMDNAKSMVTPMHPSTVIEKDKKDNDTFEKQYTYKGKGKAIEVSSRSDSETTITLTPPCSKGVAIRSSKRKSSMKKEKTGKKRRRLEYEVVALFKDKKMEEKFDGSFVNKKVVNGRHNDLMEIKECGWDIVCFLKKKWTRFLMHMNCRSKLHDDESS

SEQ ID NO: 132616 - protein, 170 aa, Glycine max
  Coding DNA Sequence Number=SeqID_15838
  Gene Ontology: Mol. function=xylose isomerase activity; Biological process=carbohydrate metabolic process
  Homolog annotation: Hit_ID=Q1SZG0; Match level="QueryCoverage=38%, HitCoverage=16%, E-value=1e-24, Identity=66%"; Hit description =Xylose isomerase
MEVEGSSKKTIVMQQKEIAEARVPLSYRDQCAHLLIPRNRCRFNVAFWHTFRGTGADPFGAPTKYWPWEDVRANFEFISKLSVDFWCFHDKDIAYEGKTLVIREERMQTQFYTGSATSNAYIQYSSNPLEISTIFVKSITKSEPHRDNLSLVFRNPLQQETHSLLTNLIE

SEQ ID NO: 132617 - protein, 172 aa, Glycine max
  Coding DNA Sequence Number=SeqID_15839
  Gene Ontology: Mol. function=RNA-directed DNA polymerase activity; Biological process=RNA-dependent DNA replication
MTKPKSFGGLGIRMTRNQNTTLLGKRVWDLIHLANQLWVSILTSKYLREGNLFMAKGRKGSISWNSISKVLEVLEDGFRIKLGDGNMWFWFDAWVVKELLAKRVSWVDIHDIHLKVKEVWVSPEWTFEGLYTALPWVLGCRKVSLGVRPCLKHWSIACFHVFTLGHCGWLAV

SEQ ID NO: 132618 - protein, 201 aa, Glycine max
  Coding DNA Sequence Number=SeqID_15840
  Gene Ontology: Mol. function=3'-5'-exoribonuclease activity; Biological process=RNA processing
  Homolog annotation: Hit_ID=Q2PYZ2; Match level="QueryCoverage=97%, HitCoverage=48%, E-value=5e-39, Identity=52%"; Hit description=3'-5'- exoribonuclease/RNA binding protein-like protein
MIDLKELSLVSGKAAWMAYLNAAFIMQDIYCLDADGALFDAALLSAVASLSHSLAKEATFGKLLVIFMKTIGFFSRNKGHFVRRLMYMGLPVQIPVVAMNDDGKIVLVSEEDGQKREQEPVNKEKRKLTLRSIPFSLTCILHKNYILADPTAEEESIMETHVTVVLDTSGQLISLYKPGGPVLAYTSAIQVSLHIAMELTR

SEQ ID NO: 132619 - protein, 395 aa, Glycine max
  Coding DNA Sequence Number=SeqID_15841
  Homolog annotation: Hit_ID=Q1SM20; Match level="QueryCoverage=21%, HitCoverage=21%, E-value=9e-12, Identity=39%"; Hit description =Nucleic acid-binding, OB-fold
MAHVPDKIKSIDGSRETLKLSVRITDLWFIGIPEKSEQAEMVIVDSDGDEIHVVCKQDQLKSWKADLMENLTYVMHNFKVMKNDDTDILIHLLLFASDSRQVLSCTLWKNCLQFLSYLNEVEDERLIVILLTHARIKEGLGSYPPSVNNSLKASKLMINELVLEIQEFKERLLDLGIEVRSILMPIGQGSSQVSRYSVEVMVNHKGEYTKFLLWDRECVELIGQSADEVNRLKIVDGDVDLNVSSQALDRLLGCFLAFKVKVQPRFRNIVVLKYSDESDLINVVLDMLPDTEVVFCQPCCKIESSILDSTDPTELEFQFVFVTMDDDRSMLDSTDPTELESQFVSVTADHDPLLRIPLTPTKRISSDELDDEPKKFEISPAQVSSNKLRKHCQAE

SEQ ID NO: 132620 - protein, 144 aa, Glycine max
  Coding DNA Sequence Number=SeqID_15842
  Gene Ontology: Mol. function=RNA-directed DNA polymerase activity; Biological process=RNA-dependent DNA replication
MVIIVGITNLDARKVLIDGGSMTDILFLFTFQRVQVHTHDVVKLETTFGIGKLSRTLLVQYVLIDTDSSYNVLTGRTSLNALSSIVSTPHLAMKFPNLKGDIITIRSNQMEARECYARSLLVKPNTTPRVVDINNVGGADSREK

SEQ ID NO: 132621 - protein, 86 aa, Glycine max
  Coding DNA Sequence Number=SeqID_15843
MASLWMRNDLSREWIGDGEYGGVDGDRGDGGCGTYKRDLVIKSIVPKAIHRTRRDNGSMVSRALDVWPTVRTTRPYQEEMPNGLPS

SEQ ID NO: 132622 - protein, 199 aa, Glycine max
  Coding DNA Sequence Number=SeqID_15844
  Subcellular localization annotation: CTP_CleavageSite=40; ConfidenceScore=5.45e-01
MPSKIILMMPKTQFKNQEPSKFQESKSRSIKASFKYQRVVQSRFKTNRLRYLLFTLTKIQGTNRLRILCLNTLEGTSFVVQLKRTSTWVVILRTREGTSLVDQFKWSVHPLGCSKRTKEASNSKGRGVVITLEGPDNISIEQSVKYNWKPIHNQAEYIALITGLNLAIEVGIKKLKCQSNSKLVTEQGNEVFQAKEEKM

SEQ ID NO: 132623 - protein, 148 aa, Glycine max
  Coding DNA Sequence Number=SeqID_15845
MTVEVAVGNEVFGPRDTRVVPTSFIPSFLLAFFDWPLFCYSLSSVDMPFGPLFLLSNHLRLLLLLWGMGLPSVGLNINSSPLKGLSINSSPLKELNINSSPLKGFSINSSPLKGLSINSSPLKGLSINSSPVKGLSINSSPLKGLIVV

SEQ ID NO: 132624 - protein, 126 aa, Glycine max
  Coding DNA Sequence Number=SeqID_15846
GNNFPQQFREREVPRRLNPFFFTPPPIYSKIGEELATQLAQESKVAFSRSNSLLEEGSEGPTFEEVTETHELRKNTSFRFPPHYEISQIAQACFLLISDTSRDFIYCATKDAKYLKEANQRLHVIK

SEQ ID NO: 132625 - protein, 124 aa, Glycine max
  Coding DNA Sequence Number=SeqID_15847
  Gene Ontology: Mol. function=nucleic acid binding; Biological process= DNA integration
  Subcellular localization annotation: CTP_CleavageSite=43; ConfidenceScore=5.55e-01
MNGCPKIKGISSSSSISMITKSTRKVKWWTLTKTSSTTLYGLVMERFASWSVILVGSIFWFPILGHMEKGIKLMLAPKSIRAFPTNAFPIEYGMITLPGFLNLGGSYWITALQLPSTTMVSVIP

SEQ ID NO: 132626 - protein, 297 aa, Glycine max
  Coding DNA Sequence Number=SeqID_15848
  Gene Ontology: Mol. function=RNA-directed DNA polymerase activity; Cellular component=intracellular; Biological process=RNA-dependent DNA replication
MKEEVRKEVLKLLEAALIYPILIVLGMCIDYQKLNEAIRKDHFPLSFIDQMLGRLARQSFYYFLDGYSRVPFGLCNAPTTFQRGMLTIFANMVKKYIEAFIDDFSVFGPSFDCCLTNLELVLQRCVEANLVLNLEKCHFMVQEGIVQPEALRFIKGLSKIAKPLSNLFNKDAIFKLDEECLEEFELMCDANDYAVGANLGHRRDKIFHAIYYVNKVLNNAQLNYATTEKEILVNVYALEKFQCYLPKAYCGTIKTHLMEAIMVEIGQLSEYFRLDFSGLPFSRMLMTMYFTVINASE

SEQ ID NO: 132627 - protein, 126 aa, Glycine max
  Coding DNA Sequence Number=SeqID_15849
  Gene Ontology: Mol. function=O-methyltransferase activity; Biological process=lignin biosynthetic process
  Homolog annotation: Hit_ID=O22308; Match level="QueryCoverage=92%, HitCoverage=32%, E-value=7e-49, Identity=81%"; Hit description =Isoflavone-7-O-methyltransferase 6
  Pfam annotation: Domain name=Methyltransf_12; Domain location=26-114; Score=12.2; E_value=0.036; Accession=PF08242.2; Description =Methyltransferase domain
  Pfam annotation: Domain name=Methyltransf_2; Domain location=1-126; Score=32.0; E_value=7.5e-11; Accession=PF00891.8; Description=O -methyltransferase
  Pfam module annotation: Pfam domain module=Methyltransf _12::Methyltransf_2; Domain location=26-114::1-126
MASDSQMSNLALRDCKLVFEGLESIVDVGGGTGTTAKIICEAFPNLKCIVFDRPQVVENLSGSLNLTYVGGDMFKSIPKVDAVLLKWILHNWIDKDRIKILKNCKEAISNEGGKRGKVIIIDVVII

SEQ ID NO: 132628 - protein, 412 aa, Glycine max
  Coding DNA Sequence Number=SeqID_15850
  Gene Ontology: Mol. function=acyltransferase activity; Cellular component=nucleus; Biological process=regulation of transcription, DNA-dependent
  Homolog annotation: Hit_ID=Q1SCF6; Match level="QueryCoverage=64%, HitCoverage=85%, E-value=1e-75, Identity=49%"; Hit description =Anthocyanin acyltransferase-like protein-related
  Pfam annotation: Domain name=Transferase; Domain location=4-411; Score=-31.3; E_value=1.9e-09; Accession=PF02458.6; Description =Transferase family
  Subcellular localization annotation: CTP_CleavageSite=13; ConfidenceScore=5.17e-01
MGSHNIKIQYHSRVSPPSATQTSLSLTFFDLFWLRFHPVERIFFYTLPTPQSNPSIFYSKIVPKLKTSLSHTLQHFPPLAGNVVWPNDSPNPIVQYTPGNSVSFVVAESEADFNHDSSDSHASIVSLQITLFPNRGFSIGISTHHSVLDGKSSTLFIKAWSSLCQTNDDESSESSSPSLAPKLVPFFNRSVIRTPRELGLNFPTNWTEALTKLFPTGNSDGRCLKLLPFPPRLEDEVRARFVLTGADLEKLRKGVLSKWDIVERGTESEAPRLSSFVLTCAYAVVCIAKAIHGVEKEKEKFAFAFTVDCRARLEPPIPENYFGNCVWGNLVDADPLDFIKEEAFGIVAKSIHSKIKEMLDKGIFHGADSSFSKYESMAKEKVEVFAIAGSNRFGVYGTDFGWGKPAKVEITS

SEQ ID NO: 132629 - protein, 180 aa, Glycine max
  Coding DNA Sequence Number=SeqID_15851
  Gene Ontology: Mol. function=catalytic activity; Biological process =metabolic process
  Homolog annotation: Hit_ID=Q9FWQ0; Match level="QueryCoverage=50%, HitCoverage=18%, E-value=1e-22, Identity=56%"; Hit description =Putative enoyl-CoA-hydratase
  Subcellular localization annotation: CTP_CleavageSite=77; ConfidenceScore=5.68e-01
MNSGRICGPLKTAGTQVGYRGKAFFNFRVRASFQTQSNTTVQSTNIKHLLCTQKPESKMQRFKALLPQQTRSSLRTFCSHRRAFSAQPNYSEHHDDDSQEQILVEGRAKSRAAILNRPSSLNSLNASMVARLKRLYDSWEENSDIGFVLMKGSGRAFCSGADVVRLYQSLNEVSILQVVT

SEQ ID NO: 132630 - protein, 46 aa, Glycine max
  Coding DNA Sequence Number=SeqID_15852
MGENPRSWPERLLQQHNNLISQPHDAKVGHLENIRAHGPGLTRMED

SEQ ID NO: 132631 - protein, 267 aa, Glycine max
  Coding DNA Sequence Number=SeqID_15853
MNQGTEGEPERNGEKRPGGKLLIVRCERAEILRTESIRPLFRYFKWQETCKRALSCDGHCSPVNKARPKAKGGGCSVTLARDVSCGVHELPLPEKGHVWGHCGGPIVSAGTVHPQRKLHTDVFVRGTLVNVVVEVDSEGGLVEAMKHNKTRPNNQPNEGVERGPPEVGNGSRGVARGWSHRKRRHTPMCEEHMSYPHWREEARVSTCRGVAGRDSGSKACTVAAAGAMSGVEVIGRRKNDRRKAAGKRAHLGQWVLSNGRFFLIPST

SEQ ID NO: 132632 - protein, 181 aa, Glycine max
  Coding DNA Sequence Number=SeqID_15854
  Gene Ontology: Mol. function=catalytic activity; Cellular component =mitochondrion; Biological process=metabolic process
  Homolog annotation: Hit_ID=Q9SZ48; Match level="QueryCoverage=83%, HitCoverage=36%, E-value=2e-58, Identity=71%"; Hit description=Enoyl- CoA hydratase-like protein
MAQMKSSIFENKRVAILDGITMGCGSGISLPGMFRVVTDKTIFSHPETQIGFHPDAGASYILSRLPGYLGEYLALTGDKLNGVEMIACRLATHYSLNARLALLEERLGKLITDEPSVVEASLAQYGDLVYPDRSSVLHRIDTIDRCFSQETVEEIIEALVSIVLNMFMIIDKSGLRKELNY

SEQ ID NO: 132633 - protein, 75 aa, Glycine max
  Coding DNA Sequence Number=SeqID_15855
MSHGHGSSGGVNQAPRPAPWHIGLWILYSVLEVYIQHETVINRSPVAAIAPMANSLDGDTCNAPTKAFRILLGMF

SEQ ID NO: 132634 - protein, 236 aa, Glycine max
  Coding DNA Sequence Number=SeqID_15856
  Gene Ontology: Mol. function=acyltransferase activity
  Homolog annotation: Hit_ID=Q9LRQ8; Match level="QueryCoverage=85%, HitCoverage=46%, E-value=1e-20, Identity=33%"; Hit description =Anthocyanin 5-aromatic acyltransferase/benzoyltransferase-like protein
MVWDLQPSEDASRGSSKLSRSDVEKLKQSVVSKKKKNTNLHLSSFVLSIAYAWVCRVRAEEIKNKSVALALTVDCRWRLEPPLPATYFGNCVGFRLPIAETRELLGEEGLVVAVEAVSDTLETLKDGAVSGAENWSSWLLDGMGAEADVKKIGVAGSPRFEVYSSDFGWGRPKKVEMVSIEKTAVFGLSDSRNGDGIEIGFASLFVNGLESRVSLSLLGRELTVQPQNIPYEHFVW

SEQ ID NO: 132635 - protein, 237 aa, Glycine max
  Coding DNA Sequence Number=SeqID_15857
  Gene Ontology: Mol. function=RNA-directed DNA polymerase activity; Biological process=RNA-dependent DNA replication
  Subcellular localization annotation: CTP_CleavageSite=48; ConfidenceScore=5.39e-01
LALNVPKEMNTPLTGSTSTPKKSRNPNRPETPWTTTTPLTHIDTKVFPTSLKGVALTWYEGLPPRSIDSFDTLDDRIVNLNPEVVLHSMLLALRPRKFAYSLCKKPPSSIDELRTDTHKLDKQHRLDKHQPLQRGPRYGCYTPLTESRVTVLEVPIQLPPGKIEKLIQAGYLTQFVKRPSSNQAEGRLGGHNEDHRRGSDRGQDRRGNKTEDRGRPRHHQQRREHQPQQEQENEPAQ

SEQ ID NO: 132636 - protein, 299 aa, Glycine max
  Coding DNA Sequence Number=SeqID_15858
  Gene Ontology: Mol. function=chorismate mutase activity; Cellular component=chloroplast; Biological process=aromatic amino acid family biosynthetic process
  Homolog annotation: Hit_ID=Q1SZ86; Match level="QueryCoverage=88%, HitCoverage=84%, E-value=1e-107, Identity=72%"; Hit description =Chorismate mutase
  Pfam annotation: Domain name=CM_2; Domain location=42-109; Score=6.5; E_value=0.02; Accession=PF01817.11; Description=Chorismate mutase type II
MMMIRFPLVVLVLMICAMRCRMAKAAEQSPDSGNVYTLASVREDLVRQEDTIIYGLIERAKFPSNSHTYDEKYAQIQGFCGSLVEFVVKNTEAIQAKAGRYKNPEENAFFPENLPPSIVPSYSFKQFLHPGAASININKSIWKMYFKELLPLLATSGDDGNYAQTAANDLSLLQKLQRVASASIAALDVKTSISRRIHYGKFVAEVKFRDAPQDYEPLIRAKDKEGLMKLLTFTSVEETVRKRVEKKAVVFGQEVNLNSDDNDNENRKFDPSVASSLYKNWVIPLTKEVQVEYLLRRLD

SEQ ID NO: 132637 - protein, 521 aa, Glycine max
  Coding DNA Sequence Number=SeqID_15859
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=56%, HitCoverage=45%, E-value=1e-76, Identity=59%"; Hit description =ATPase, E1-E2 type
  Pfam annotation: Domain name=6PGD; Domain location=125-256; Score= -157.4; E_value=1.7e-06; Accession=PF00393.9; Description=6 -phosphogluconate dehydrogenase, C-terminal domain
MADFSCSTSTMGRIEAAIAEHIVAQDATIIKLDGIKPTISEAPQSNTKDGDAEFKSSSVCLDKKVQSFMEESLNSVYSQGRVTENQTMEAEVHSEDCSKFTLGSDEKPDANVVSFKVIRKNPFWVHNREALRLFNKFNKGLRHFLGIDTFYPGGYLRDAGKWTVQQAAELSIVAPTIEVSLDGRFLSGLKEERVEVAKVLHATKICSYAHGMNLIRAKSIEKGWDLKLGMSTSLAYFDIILLASNYNDAIFYVETMNLDGETNLKQKQALEATSKLQDSNFQNFRAVIKCEDPNAGVAYGRGVTEVKRALSRKHESHPGQELKKISELKSSIKGFNFMEERVVNGNWIKEPNVNVIQNFLPLLVVCHTAMPKVDEETSKVSYETESPDEAAFVIVAKEFGFEFYERTHTTISLRELDTISDQKINKSYKLLNILDFTSARKQMSVIVKDVEGKLLLLSKGADSVMALILAYRELNDEEYDKFNKEFTEAKNLVSEDQEQIVEGIIQNIEKDLTLLGAPLAD

SEQ ID NO: 132638 - protein, 117 aa, Glycine max
  Coding DNA Sequence Number=SeqID_15860
MGQICVAPRQCTTDYMKWFYMISHPFMSPTQPRDPPTHPPVVHDDTFIEPDPPQQPVTAAAMPEPPTPAIEASHAITERLERLINMRVVTAGTEACTVTEECLRIVAVVTAQGNAYV

SEQ ID NO: 132639 - protein, 973 aa, Glycine max
  Coding DNA Sequence Number=SeqID_15861
  Gene Ontology: Cellular component=cytosol
  Homolog annotation: Hit_ID=Q10JI7; Match level="QueryCoverage=98%, HitCoverage=97%, E-value=8e-56, Identity=25%"; Hit description =Expressed protein
MSGKALKSLKDENPDLQKQIGCITGFFQLFDRHRFLTGQRSATYVQHRPTSGGSSNEIKELNGTKQEAKAKNLKTAREKQQFSTESSITSFSSSSCSSSMSSHEFNKTIQIQSPSRNRIRIPENTNSKAAKKQPDTPHQQSLHFHHIVNDSMHKETQGLSVKIGAKEEKKGQTNALKHIDSPRPLQSHKYVNAGVTVASEPLHTIAKSKKKPWDSPRLSYDETFKSATKHKELPRLSLDSREGSNRGFNEGNKSHNQLKGSPRGYGRNSSTMINHLQEQETSKRSSSVVAKLMGLEALPECTQTCGSPMGTSSCSSKKNELLARSSTSDEKQHQRFSLPQSRRADSIANVTPCSRFALEPTPWRQPDESQSSPLQASKGSESDIKASKSSLTVYGEIEKRVAELEFKKSGKDLRALKQILEAMQRHKDSVDISRDHASNSPSDNRNCTNLNESSKSQSPRVRQKDPASVTVEMSNSTRVSKLPIVIMKPSKVTRKPNNPSSTEISIHAKSGPSKCSPSNPTNGRLVDRQTTIGISSTTKNIKDPFGQQVLSSDKNNMRTSKLMQSLKVSQDNTGECTTNSGYTTVTGSPRLQKKFGLERCSQPTSPSSDSRINRRGHDRQPVELSSPSTTPRHKFSTLQQRNERFTEISCHLRDFKHHVNIISDFDNKSSSASHSDIEVIRIDQSRKIISSSIQLSGMNQNNAFEELRKAETMITAEQPSPVSVLDAAFYRDDPPSPVKKKSDISKNLGEALSTDEDSEESSVDLLQEIEWIDEKLINFNNTRDPDHKYIAEILLASGLLSGHSYSQIFHSPGHLVDPKLFFALEQMKTKMHFNIKDSAKKIRRIINPEKMQRKLIFDVVNDILVQKLILDNSSALWCQPNELAGTTLKGKQLLDELCTEIDQLQPQNRNFSLVHEDENLKHHHAIWTNCCNEMPNIVLDIERLIFKDLITEVVRGEVANHSGRHCRQLVFYN

SEQ ID NO: 132640 - protein, 50 aa, Glycine max
  Coding DNA Sequence Number=SeqID_15862
KVIAKIEDNQTSGGQNGLLVQQQLFPFPLNLHAAMEFWMTPLPKREDKSG

SEQ ID NO: 132641 - protein, 66 aa, Glycine max
  Coding DNA Sequence Number=SeqID_15863
MEHDTFLATWLAEFDFSPNGLRFSNLQPQPRLINHEKPMLCRWHKLNPFKIEGRRFALDSARDYFP

SEQ ID NO: 132642 - protein, 279 aa, Glycine max
  Coding DNA Sequence Number=SeqID_15864
  Gene Ontology: Mol. function=protein serine/threonine kinase activity; Cellular component=integral to membrane; Biological process=protein amino acid phosphorylation
  Homolog annotation: Hit_ID=Q9LJF3; Match level="QueryCoverage=92%, HitCoverage=55%, E-value=7e-17, Identity=29%"; Hit description =Serine/threonine-protein kinase BRI1-like 3 precursor
  Pfam annotation: Domain name=LRR_1; Domain location=110-136; Score =6.6; E_value=16; Accession=PF00560.23; Description=Leucine Rich Repeat
  Pfam annotation: Domain name=LRR_1; Domain location=139-162; Score =7.1; E_value=13; Accession=PF00560.23; Description=Leucine Rich Repeat
  Pfam annotation: Domain name=LRR_1; Domain location=165-187; Score =16.1; E_value=0.13; Accession=PF00560.23; Description=Leucine Rich Repeat
  Pfam annotation: Domain name=LRR_1; Domain location=190-212; Score =19.8; E_value=0.0099; Accession=PF00560.23; Description=Leucine Rich Repeat
  Pfam annotation: Domain name=LRR_1; Domain location=214-236; Score =12.5; E_value=1.3; Accession=PF00560.23; Description=Leucine Rich Repeat
  Pfam annotation: Domain name=LRR_1; Domain location=243-265; Score =7.1; E_value=13; Accession=PF00560.23; Description=Leucine Rich Repeat
  Pfam annotation: Domain name=LRR_1; Domain location=37-59; Score =10.0; E_value=3.8; Accession=PF00560.23; Description=Leucine Rich Repeat
  Pfam annotation: Domain name=LRR_1; Domain location=62-83; Score =10.6; E_value=2.9; Accession=PF00560.23; Description=Leucine Rich Repeat
  Pfam annotation: Domain name=LRR_1; Domain location=8-31; Score=9.4; E_value=5; Accession=PF00560.23; Description=Leucine Rich Repeat
  Pfam annotation: Domain name=LRR_1; Domain location=85-108; Score =8.0; E_value=9.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=110 -136::139-162::165-187::190-212::214-236::243-265::37-59::62-83::8 -31::85-108
  Subcellular localization annotation: CTP_CleavageSite=44; ConfidenceScore=5.17e-01
MISKLIPNLRELRLVGCSLSDTNIQSLFYSPSNFSTALTILDLSSNKLTSSTFQLLSNFSLNLQELYLGHNNIVLSSPLCPNFPSLVILDLSYNNMTSSVFQGGFNFSSKLQNLDLQNCSLTDGSFLMSSSFIMRSSSSLVSLDLSSNLLKSSTIFYWLFNSTTNLHNLDLGYNMLEGPIPDGFGKVMNSLEVLYLSDNKLQGEIPSFFGNMCALQSLDLSNNKLNGEFSSFFRNSSWCNRDIFKSLYLSCNRLTGMLPKSIGLLSELEYLNLAGNSLE

SEQ ID NO: 132643 - protein, 85 aa, Glycine max
  Coding DNA Sequence Number=SeqID_15865
MGCSPLRRLILYANRGSFSPSSSSCRLLLRGSAKLIFSLCAYALLCNDRLMTAKWKWKNDDWRCHFKEKMIKEEAHHHRKPWIRA

SEQ ID NO: 132644 - protein, 54 aa, Glycine max
  Coding DNA Sequence Number=SeqID_15866
MVSPPPKYCKADAIIGRKAMFKRPFYLEFLNFCFEKFEVAVWSSRTFQGYGVLG

SEQ ID NO: 132645 - protein, 190 aa, Glycine max
  Coding DNA Sequence Number=SeqID_15867
  Gene Ontology: Mol. function=nucleic acid binding; Cellular component= oxygen evolving complex; Biological process=DNA integration
  Homolog annotation: Hit_ID=Q1RWN2; Match level="QueryCoverage=70%, HitCoverage=26%, E-value=4e-19, Identity=55%"; Hit description =Peptidase S8 and S53, subtilisin, kexin, sedolisin; Integrase, catalytic region; Zinc finger, CCHC-type
MDVKSAFLDGSLDEHVFVDQPPDYIKLGNEHKVYKLKKAIYGLKQAPRAWDGLFFKKGEKSELIGFTDSDFAGDQDDRKSTSAYVFMFGTGVVSWSSRKQPIVTLSTIEAEFAAGSACAYLNNDGAIVLKYCKSEKAAWCLHLGHVGEAQLVFDCHFLWIDRESSQAQGQEHTWSCVAAGDEAKQVKRKV

SEQ ID NO: 132646 - protein, 1180 aa, Glycine max
  Coding DNA Sequence Number=SeqID_15868
  Gene Ontology: Mol. function=actin binding; Biological process=actin cytoskeleton organization and biogenesis
  Homolog annotation: Hit_ID=Q1SZ88; Match level="QueryCoverage=81%, HitCoverage=49%, E-value=0.0, Identity=53%"; Hit description=IMP dehydrogenase/GMP reductase
  Pfam annotation: Domain name=Extensin_2; Domain location=897-1180; Score=-142.6; E_value=0.1; Accession=PF04554.4; Description=Extensin- like region
MALFRKFFYKKPPDGLLEITERVYGTLSAGSFSVNTLVLVELKSVGFLLSANISSSLCILSWWGVVVFFDYCFTTDVMEEDEYRVYIGGIIGQLRGHFPDASFMVFNMREGDSQSQISNILCDYDMTVIDYPQQYEGCPLLTMEMIHHFLRSGEQKTLDMIYKQAPWELLQLMSPLNPLPSQLRYLQYISRRNVGSEWPPLDRALTLDCVIIRLIPNMGGEGGCRPIFRMYGQDPFIPADRTPKVLFSTPKRSKLVRYYKQVADCELVKIDIHCHVQAFIRSNILMLNRDELDILWNAKDYFPKNFRVEVLFSDMEASSSVISIDLPHVEEKEGLPVEAFAKVKEIFSNVDWLDSKAEVASVLQQITASNILLERLDSGVSASTSGLRKESSGKFKLDSEKHSDSKNLTSTVQEKLSMSSMGSSVDVPMDNKTEPLQSKALPGNNIESLECLGQGNQPIASFGLSTDSDSTEKAHNDSKNLTSTVQEKVSTSPLGSSVDVPTENKTEPLQSKALSGNNFESFECLGQGNQPIPSFGPSTDSDSFKKEVESLETKQSLENDTKFTACMAHENQSIPLIETSMDANLIKKESGSLESKEKDIESLASKNLLENDTMCPTSVAQGKQSVPLIEPSTDSDSLEKKTGLLGSKEKAIESLNSEALLENGSRLKFEPKPLPEIDTRSPTSEVEGKRSMSSSESSSNAPMEKYKDPLELKASPEDNIKTLASMSQGKQLIPSFGLSTDCSFTEIPIVSLESKALVENNAKVPTSMAHGEQSMPLIEPSKDENSMKQKMGSLESKEKDTESLESKSLLEDDTNCPPSIAQGKQSFPLIQPSTDENSTKKMGQLEQMVLPENDVKSVKSTVQRKQYDPLLEPPIDANLIRKKIEPQELQVALQLPTQSKIISPWVRPAVRSASASYFNSLQGSPVAISRYHSAPSALGITSVLQDHAPMDIKEVTHAVTVSPLPSTLPPSDSKVQNSLEPSSTIVPPTSSPPLLPSLPLKTSVDALTAMEKTFGSFAPAAVTALPPPPPPPPPPQSEHTSKLMQSNVTQYPENTMLDEGKKSLVSPPPSLSMPAPPTTSLSSPSSATKSSSLSHPPPPSLPGTSLSTAKDAFKGPPPPPPPPTPPPSTNQASSSLIPPPPPPLPGFPYSASHPLSSSSSMSKSVATPGPPPPPPPPSHS

SEQ ID NO: 132647 - protein, 62 aa, Glycine max
  Coding DNA Sequence Number=SeqID_15869
  Homolog annotation: Hit_ID=Q1SZ88; Match level="QueryCoverage=88%, HitCoverage=3%, E-value=3e-14, Identity=73%"; Hit description=IMP dehydrogenase/GMP reductase
MQGSLWAETQKLDEFCRAPEFDMSELESLFSAAAPNSNDGKGGKLNRRSSQKVDKLIPVQPN

SEQ ID NO: 132648 - protein, 164 aa, Glycine max
  Coding DNA Sequence Number=SeqID_15870
MPPITEKHANLYMYSLVPIVVFQCAVLALDDSVLDVDQVENLIKFSPTKEEMETLKPYFVCRTIMGIRTTWESVNSSATPETGTAITMLIQWWHKERQGGVETRGTPQMVDDVKKLERQLDSLIIGGLKLHANLPKHVREWKSTEYTNNDHQHRKGLLKENLAN

SEQ ID NO: 132649 - protein, 340 aa, Glycine max
  Coding DNA Sequence Number=SeqID_15871
  Gene Ontology: Mol. function=RNA-directed DNA polymerase activity; Cellular component=nucleus; Biological process=RNA-dependent DNA replication
  Homolog annotation: Hit_ID=Q1T5K4; Match level="QueryCoverage=94%, HitCoverage=32%, E-value=3e-77, Identity=46%"; Hit description=RNA -directed DNA polymerase
HQKALLVARFEEEEVRAAVWEYGSAKCLGLDGLNFKFIKEFRDVIKPDLLCFLDEFYVNGIFLKGSNASFMALIPKVPDPQNLNEYRPISLIGCMYKIVAKLLSGRLKKVRLAIIDEHQIAFIESRHLLHSMVIANKVVEEEKRCNTTCLVFKVNYEKAYDLVSWDFLLYLMRGMGFCNKWISWVDGCLKSAFISILVNGSPLAEFIPQRGLRQGDPLAPFLFNIVAKGLTGLMREAQEKNLFEGFKVGTNNVDISTLQYADDTVFFGSTSMANVRAIKVMLRSFELVLGLKINFDKSSFGAIGMSEQGMHSASTYLNCPFPIWVSPLGQIQGVVSYGNL

SEQ ID NO: 132650 - protein, 105 aa, Glycine max
  Coding DNA Sequence Number=SeqID_15872
  Pfam annotation: Domain name=BmKK2_toxic; Domain location=29-62; Score=16.6; E_value=0.051; Accession=PF09146.1; Description=BmKK2 toxic
MTLVRIVFIAVVLTLITSNAVGFTSTPKTSGPNQCHDNADCSIKLPYCKGIAFCRNGVCACYEEKASITQQCQNDKDCIHLICAPPCEVSYCDTKTSKCKCKCKN

SEQ ID NO: 132651 - protein, 326 aa, Glycine max
  Coding DNA Sequence Number=SeqID_15873
  Gene Ontology: Mol. function=catalytic activity; Biological process =alkaloid metabolic process
  Homolog annotation: Hit_ID=UPI000034F3E8; Match level="QueryCoverage =78%, HitCoverage=57%, E-value=1e-100, Identity=67%"; Hit description= catalytic/ hydrolase
  Pfam annotation: Domain name=Abhydrolase_1; Domain location=102-321; Score=51.2; E_value=3.5e-12; Accession=PF00561.10; Description =alphabeta hydrolase fold
MYDLHPILLLVQEAIVQTCVKALLEAIVQTCAIVLNDGKACKGVEQKIGMLIILPCYLCRLWGENGVNVDDLETNHVVLVHGGGFGAWCWYKSIALLEESGYKVTAIDLTGSGVSSFDANSITSLSQYVKPLTNFLEKLLEGEKVILVGHDFGGVCISYAMEMFPLKISKAVFIAAAMLTNGQSTLDIISQQAGSNDLMRQAQTFVYANGNDHPPTSFDLDKSLSRDLLFNQSPTKDIALACVSMRSVPFAPVLEKVSLSDLKYGSVRRFYIETLEDNAIPISLQENMINASPPEKVFRLKGADHSPFFSKPQALHKLLVEVSKIL

SEQ ID NO: 132652 - protein, 433 aa, Glycine max
  Coding DNA Sequence Number=SeqID_15874
  Gene Ontology: Mol. function=protein kinase activity; Cellular component=integral to membrane; Biological process=protein amino acid phosphorylation
  Homolog annotation: Hit_ID=Q69F86; Match level="QueryCoverage=76%, HitCoverage=94%, E-value=5e-84, Identity=50%"; Hit description =Serine-threonine kinase
  Pfam annotation: Domain name=Pkinase; Domain location=138-405; Score =106.9; E_value=5.9e-29; Accession=PF00069.15; Description=Protein kinase domain
  Pfam annotation: Domain name=Pkinase_Tyr; Domain location=138-405; Score=79.3; E_value=1.2e-20; Accession=PF07714.7; Description =Protein tyrosine kinase
  Pfam module annotation: Pfam domain module=Pkinase::Pkinase_Tyr; Domain location=138-405::138-405
METRKESINKPVSSNSMSIDENEDKSSHEEMLSQFVEPSGSSKRPRSLRSKKCEKSKGPDIGQMMLDMQGKLKAKKIDEAVVRELIVDLMVKHDLPLRFVEFKEMWHTSSSQRQYPTVIEELCYQFSLADIKKSTKNFDEDQLIGTGDMCIVYKGSLQHNGVTEDTVVIGRIHGSAEKELKQFKNEIELLCQLRHPNLITLLGFCDHKDEKILVYEYIPNGSLHDRLYCSDVKKEPLTWKQRLKICIGAARGLHFLHTGVKRTIFHRDVTPYKILLGSNMVAKLADFRLSLTGPHYASKPKPKTISKDGFIGTYGYVAPEISENNTITEKCDVYSFGVVLLELVCKDKLKDVEKRQKHPVEENIDPNIKGKIAPECWEVFMDITERCLKFDPNERPAIGEVEVQLELALSLQEEADIINTGDDYTLLSMIIMN

SEQ ID NO: 132653 - protein, 135 aa, Glycine max
  Coding DNA Sequence Number=SeqID_15875
MATPKTRPENTTGNTFDEKSSTNTGRDNNKIACATTCFVGRGGTFDNNSGADIGRNDIGVSGVVNCFSGDINDMVSVRYCTIGVVIVAESIELSIDGNFSEGKDEEGWLVTEICSFKRMTSSLETMEARVTAEWS

SEQ ID NO: 132654 - protein, 120 aa, Glycine max
  Coding DNA Sequence Number=SeqID_15876
VAPDYMDWFFWILHPFVTPIEETAEPRHPPPSHDEEFVEPPIPEVSVASDLPTHSMVDCEGCQGMVEDLGVIAEDLERVINLRMVTEGTDLYDIMTRCLRRARGDAADGSLRPRQRRRID

SEQ ID NO: 132655 - protein, 119 aa, Glycine max
  Coding DNA Sequence Number=SeqID_15877
MEKSDKMNFKEKKEKKGYITWEDNVLNYSSDSEKKIISLGIMMKDYENGEEQSRYIDSNFSKHMACIKVYSYFSPRKVNMRFMETTNKGHLINNLNNWKLEVEVIGSWKWKLVEVGNWK

SEQ ID NO: 132656 - protein, 39 aa, Glycine max
  Coding DNA Sequence Number=SeqID_15878
MATLCKSRRKVSKGNNCQFCEIKTFSKGLPKIDSLQSKP

SEQ ID NO: 132657 - protein, 669 aa, Glycine max
  Coding DNA Sequence Number=SeqID_15879
  Gene Ontology: Mol. function=nucleotide binding; Cellular component =membrane; Biological process=defense response
  Homolog annotation: Hit_ID=Q8W3K3; Match level="QueryCoverage=100%, HitCoverage=99%, E-value=8e-44, Identity=25%"; Hit description =Putative disease resistance protein At1g58400
  Pfam annotation: Domain name=LRR_1; Domain location=367-388; Score =4.1; E_value=48; Accession=PF00560.23; Description=Leucine Rich Repeat
  Pfam annotation: Domain name=LRR_1; Domain location=390-413; Score =1.5; E_value=1.5e+02; Accession=PF00560.23; Description=Leucine Rich Repeat
  Pfam annotation: Domain name=LRR_1; Domain location=540-562; Score =5.1; E_value=32; Accession=PF00560.23; Description=Leucine Rich Repeat
  Pfam annotation: Domain name=LRR_1; Domain location=612-634; Score =11.4; E_value=2.1; Accession=PF00560.23; Description=Leucine Rich Repeat
  Pfam annotation: Domain name=NB-ARC; Domain location=41-278; Score= -63.2; E_value=3e-06; Accession=PF00931.13; Description=NB-ARC domain
  Pfam module annotation: Pfam domain module=LRR_1::LRR_1::LRR_1::LRR _1::NB-ARC; Domain location=367-388::390-413::540-562::612-634::41-278
MVEAVVSFAVERLHNLPTEEARLLTGVSDKAKSMQNELKRMQCFLRDAERKKDKNDTIKNYISEVGKLAYDAEDVIEIYAIKVALGISVGTKNPLAKTKHLHKASEVQRQLRRSYSHIVEEFIVGLDKDTDKVLISPTKEERDGITKMKDDELARKLFKVQQDKKCLIILDDIWSNEAWDILSPAFPSQNTSWALFKKKAFPRQDNPESTVSDEFIRLGREMVAKCAGLPLTIIVLGGLLATKERVSDWDTIGGETEIPRTKLIQLWVAEGVVSLQYETKWDEAMEDVAECYLGNLISRCMVQVGQMGSTDARRIDEVRRLAVFLDQHADQLIPQDKQFKLFQVLDLEGIKGVKGQSLPKEVGNLLWLKFLSLKRTRIQILPSSLGNLDNLQFLNLQTVNKVTVEIPNVICKLKRLRHLYLPNWCGNATNNLQLENLANLQTIVNFLACKCDVKDLLKLKKLRKLVLKDPRHFQKFSESFSPPNKRLDCLLSLSLRTDMLSFPENVVDVEKLVLGCPSLRKLQVEGWMERLPAASLFPPQLSKLTLWGCRLVQDPLLTLEKLLNLKFLNGWDMFVGKKMACSPNGFPQLKVLVLRGLPNLDQWTIEDQAMPNLYRLSISDCNNLKTVPDGLKFITSLRELEIRWMPKSFKTRLGTAGEDYHKVQHVPSI

SEQ ID NO: 132658 - protein, 181 aa, Glycine max
  Coding DNA Sequence Number=SeqID_15880
  Gene Ontology: Mol. function=nucleic acid binding; Biological process= DNA integration
MERDQVQHQPMQKEIGGNLPPCQHCTKKGHPPFKCWKRPDAMYNECNQIRHEVVICKNKNQPHNEATKAADLEEKYLFVVTCFSSIESSQNWLIDNDCTSHMTNNKDLFKELRNISTLKVRVGDDKFIIVNGKRTVAISTNRDTKLISNVLRLDFPASKTRKSVVERALDAVKTVLIFNLN

SEQ ID NO: 132659 - protein, 223 aa, Glycine max
  Coding DNA Sequence Number=SeqID_15881
MDGLLSSPLGSIMGHVTTGVAIITYRWKINLVLKVEEGLQTMASHRGTKNGSLQEKKGLQTMNPTTGIKNENVLLSIANGLLVEPLNNGSRVTTTFLMVDPRYTSMIFFNFMRMVECVAAWFIATPIGCSMSGKGTSGPSSLSAIGVWGLLLVGRWTEEEVPMFWCSSVAIGTTKSMEGIKLDVHKEKVCAETKRMGPTKVVADGWLCGKDATERGGLTGAVV

SEQ ID NO: 132660 - protein, 637 aa, Glycine max
  Coding DNA Sequence Number=SeqID_15882
  Gene Ontology: Mol. function=nucleic acid binding; Cellular component= intracellular; Biological process=regulation of transcription, DNA -dependent
  Homolog annotation: Hit_ID=Q8LJS2; Match level="QueryCoverage=51%, HitCoverage=98%, E-value=6e-92, Identity=58%"; Hit description =Histone deacetylase 2a
  Pfam annotation: Domain name=zf-C2H2; Domain location=611-634; Score =21.5; E_value=0.0029; Accession=PF00096.16; Description=Zinc finger, C2H2 type
MPNSKNNRNGQGEPHRRGKLTKKSSSFYGHSSPAAMSGDPILRPKTVPDLLSERHRAAATPLVEVVPKQPPKLLLKVTSMGSLGPVQVVMTPESTVGDLVAAAVRQYVKEGRRPILPSNDPSHFDLHYSQFSLESLDREEKLRDIGSRNFFMCPRKCGGGGGDGRGTTPFASCSREADKTTKGGAFGKGSLLGIYSIWKELEYLHNGFEVKLGNWMLDFWNDIWVNRTPIALEVAWIDIHDVGIQVKDMWFERGGKADCGDYHVGKCADALAMEGALSDFQDQVLHVPPDDLIALLHADAIRMIFLESVEVKVGQTVTVDPMDPVDSYIHISQVALGEAKKDKPNEPVVLYLKVGEQKIVLGTLSRDGIPHLSLDLVLDSDSELSHTSKSANSSEEDEELALEGQDNGKPELKAEGAKVTKPSKSIPKIGAPAKAADPKKDEDDDSDDESDDDLAGEDESGSSDEMDDDSNSEEESDGDDEETPAKKVDQGKKRPNESAAKTPISAKKAKTATPEKTGFGLKCGAHWCKSSRCLLPSNTPTTGIRVDGSTVFLAALLPLEGETIMWKRLTLEGEMVGLQKSVHVATPHPSKKGGKTPNSTKGQTPNSAGQLSCASCKKSFTNEAGLQQHKKAKHGGQ

SEQ ID NO: 132661 - protein, 131 aa, Glycine max
  Coding DNA Sequence Number=SeqID_15883
MLNHFFFPFSFLVFLLSFSLTFFFSLTHVHAIVVVELTHRLGGDVEDVVVQVIKKGPTERRIIRLRWWLWWRRDVGRKIIDVDDDAGVRDEVMFEAEIIDVKEEADVTEVGAADREFMEGEREVGLAAMER

SEQ ID NO: 132662 - protein, 234 aa, Glycine max
  Coding DNA Sequence Number=SeqID_15884
  Gene Ontology: Mol. function=RNA-directed DNA polymerase activity; Cellular component=intracellular; Biological process=RNA-dependent DNA replication
  Homolog annotation: Hit_ID=Q1T251; Match level="QueryCoverage=67%, HitCoverage=55%, E-value=6e-18, Identity=32%"; Hit description =Multicopper oxidase, copper-binding site
MVDGPKECISTSTTGAAVEWSDIMEGWDVSKEAPDEEFKELWKLKVPSKVVVFAWRLLKDRLPTRDNLRRKKIELQDYLCPFCRIMEESASHLFFHCSKILPLWWESLSWVNLVGVFPHHPRQHSIQHMHQTHEGLMVTRWKWWWLALTWSIWKHKNSIVFSNNTLNANKMMDEAVFLLWTWLRHLEKGFASHYNSDLQILEKDFSVVEDRNLCHILVLFSLCGLLSGYDQPIA

SEQ ID NO: 132663 - protein, 227 aa, Glycine max
  Coding DNA Sequence Number=SeqID_15885
  Gene Ontology: Mol. function=phospholipase C activity; Cellular component=membrane; Biological process=intracellular signaling cascade
  Homolog annotation: Hit_ID=Q10JM3; Match level="QueryCoverage=75%, HitCoverage=57%, E-value=3e-44, Identity=45%"; Hit description=MAP3K- like protein kinase, putative, expressed
MSMCQNNSLPFNKYAFLTTHNAYAISGDTLKEIEAFLSANPTEIVTIILEDYVHAPNGLTKVFTDAGLMKYWFPLIRVPRNGQDWPSNGDGGRKAGSCPNRAESSPLNDKSKSLVLVNYFRSTPIKPITCEDSSGELINMIHTCYGDAGNRGVKEKDRSVDTLNGKLLCGCDDVHRSWDQHHQLALNHRKNRSNKTDHLEIIQALDCCQFSAVKITFAWHELVGKDC

SEQ ID NO: 132664 - protein, 71 aa, Glycine max
  Coding DNA Sequence Number=SeqID_15886
MGPPKEISTIIYHNGHIADNLVRGSVYIFANPIFIYVTHTPRRCTSDILGIFVRISQVQMNAWLLKSRFNS

SEQ ID NO: 132665 - protein, 393 aa, Glycine max
  Coding DNA Sequence Number=SeqID_15887
  Gene Ontology: Mol. function=RNA-directed DNA polymerase activity; Cellular component=chromatin; Biological process=chromatin assembly or disassembly
  Pfam annotation: Domain name=Chromo; Domain location=334-382; Score =21.3; E_value=0.003; Accession=PF00385.14; Description='chromo' (CHRromatin Organisation MOdifier
  Pfam annotation: Domain name=rve; Domain location=104-226; Score =12.9; E_value=0.0005; Accession=PF00665.16; Description=Integrase core domain
  Pfam module annotation: Pfam domain module=Chromo::rve; Domain location=334-382::104-226
DLKAELQNHPAYQELWRTIETNSSTHSAFVLTPDFILQQNRIWLPQGCSFIPLIMAEFHSMLTGGHMGISKTSAEFHFVTTCLQCQQIKYDHRKSPGLLCPLPVPSRPWEDLSLDFIGGLPAIRGHTVILVVVDRFSKGVHLGKLWPNYTAQELFKLSSTKLRMTSTYHPQSDEQTEVLNLVIEKYLRSFVHQQPASWGKFLIWVEWSYNTSIYSATGLTPFEITFGKKPPTIPHYLTGTSTIDVVDDFMMHHDVAFVSFKKKLLKAQQTMKKFADNNRRKRIGLVAYRLKLPPDSKIHLVFHCALLKPFHHSSDTDTGAVDLPPQSKDNDLLITPLVILNTKWATTDIGPELQVLVQWQGLPLEDTSWEPWTELKETYHLEDKVLLDVQGML

SEQ ID NO: 132666 - protein, 227 aa, Glycine max
  Coding DNA Sequence Number=SeqID_15888
  Gene Ontology: Mol. function=transcription regulator activity; Cellular component=nucleus; Biological process=regulation of transcription
  Homolog annotation: Hit_ID=Q1SGR4; Match level="QueryCoverage=92%, HitCoverage=97%, E-value=1e-67, Identity=66%"; Hit description =Prefoldin; Helix-loop-helix DNA-binding
  Pfam annotation: Domain name=HLH; Domain location=44-118; Score=8.8; E_value=0.017; Accession=PF00010.16; Description=Helix-loop-helix DNA-binding domain
MEGVAPIVEEKAELVVEIDGSLGDSDSLKESGSKKRVRSESCAASGSKACREKLRRDRLNDKYTFYSKFQLSPLRHVPNMIDVIRFVELGAILEPGRPAKTDKAAILIDAVRMVTQLRGEAQKLKDTNQGLQEKIKELKAEKNELRDEKQRLKAEKEKLEQQLKSLNAQPSFMPPPAAMPAAFAAQGQAHGNKLVPFISYPGVAMWQFMPPAAVDTSQDHVLRPPVA

SEQ ID NO: 132667 - protein, 533 aa, Glycine max
  Coding DNA Sequence Number=SeqID_15889
  Gene Ontology: Mol. function=transferase activity, transferring hexosyl groups; Cellular component=integral to membrane; Biological process=cell wall organization and biogenesis
  Homolog annotation: Hit_ID=Q2QN55; Match level="QueryCoverage=99%, HitCoverage=99%, E-value=1e-160, Identity=50%"; Hit description =Glycosyl transferase family 8 protein, expressed
  Pfam annotation: Domain name=Glyco_transf_8; Domain location=173-506; Score=368.8; E_value=8.7e-108; Accession=PF01501.10; Description =Glycosyl transferase family 8
  Subcellular localization annotation: CTP_CleavageSite=28; ConfidenceScore=5.05e-01
MLLQISPSLRHVTVLPGKGLKEFIKVKVASRKLSYRMLFYSLLFFTFLLRFVFVLTAVDNIDGANKCSSIGCLGKKLRPKILGRSLESNVPEVIYGILDQPLGKEELEGRSDIPQTLEEFMTQLKEGGYDAKTFAIKLREMVTLMEQRTREAIVQEYLYRHVASSGIPKQLHCLALRLANEHTNNAAARLQLPSAELVPALVDNNYFHFVLASDNVLAASVVATSLVRSSLRPQRVVLHIITDRKTYYPMQAWFSLHPLSPAIIEVKALHHFDWFTKGKVPVLEAMEKDQNVRSQFRGGSSAIVANTTEKPKVIAAKLQALSPKYNSVMNHIRIHLPELFSSLNKVVFLDDDIVVQTDLSPLWDIDLNGKVNGAVKTCSGEDKFVMSKRLKSYLNFSHPLISQNFDPNECAWAYGMNIFDLDAWRKTNISSTYHYWVEQNIKSDLSLWQLGTLPPGLIAFHGHVHTIDPFWHMLGLGYQENTSFADAETAGVIHFNGRAKPWLEIAFPHLRPLWTKYIDFSDYFIKSCHIRAL

SEQ ID NO: 132668 - protein, 905 aa, Glycine max
  Coding DNA Sequence Number=SeqID_15890
  Homolog annotation: Hit_ID=Q0IEN4; Match level="QueryCoverage=49%, HitCoverage=48%, E-value=3e-38, Identity=27%"; Hit description =Breast carcinoma amplified sequence
  Subcellular localization annotation: CTP_CleavageSite=52; ConfidenceScore=5.15e-01
MGKNDGKKQQHLLLGGVAAGGSGGRTNINGFIPSFHTLSGYLKIVSSGASTVARSAAASFASSILDKDDDADRDRVIWAGFDTLEGGHGEVMRQVLLLGYWSGFQVWDVDDSNNVRDLVSRQDGPVSFMQMVPTPIVSKKPEDKFADKRPLLVVCTDGLLAGGDKTQDGLGATCNGGTLNRHAQVNGNYLPTTVQFYSMRSRTNVHVLKFRSVVYSVRCSSRIVTVSQATQIHCLSATTLEREYTLLTNPIVTHCLGSGGIGFGPLAVGPRWLAYSGSPDATATSGHVSPQHLTPSASFPGFSSNGSLVAHYAKESSKHLAAGIVTLGDMGYKKLARYCSELRSDSSGSIHLVNSSPKGNGIVNGHSTDADNIGMVIVRDIVSKNVISQFRAHKSPISALCFDPSGTILLTASVQGHNINVFKIIPGYERVSASDADPSYVHLYRLQRGLTNAVIQDISFSADSRWIMISSSRGTSHLFAINPQGGPVSILSCDNSLTEKNGGLDIINNQAVRWPHSSALEICKPQSLCAAGPPITLSVVSRIRNGSNGWRSTVTGAAAAATNRMSSLSGAIASSFRNFKDSSTLYVNGNYSKEKHHLLVFSPTSSMIQYALQTINSQDSGVVSGVTPAYESAPLTDARVVVEPIKKWNISLAYSWREGEDTIDIYGENGVSDSNKLYSEEVKKDNIISPKMKNVTVKWNPCSEKEHQFYISEAELQMHQAKTPLWGKTGIYFHSVGKEATLMMDEEAALEGEFEIEKIPTRVIQARSKDLVPIFDYIQTSKFQQIRTLVNNKLNEQLLHQSSFEKGRISPRGILGFPDCINNSGETIAEFKSGIEGNERGDSLIPAETKAFVNNNNTLKPNTWPEIVNNRRENLNMDVHQMFVNSDRKGLKLENHCKEKGDEFE

SEQ ID NO: 132669 - protein, 117 aa, Glycine max
  Coding DNA Sequence Number=SeqID_15891
  Homolog annotation: Hit_ID=Q9C9V9; Match level="QueryCoverage=87%, HitCoverage=12%, E-value=1e-19, Identity=48%"; Hit description =Putative golgi transport complex protein; 67058-70172
MGIPHFFLIPYPTLGHRISCFLDPIELFVDGVDANEVILVTEAEDLKVELGGLGKIEFFGVSGGHEIAKLLGEVEGADGVLEELDGAVEVEELGVFGGNRVVKVGELGAEVTNGGLE

SEQ ID NO: 132670 - protein, 111 aa, Glycine max
  Coding DNA Sequence Number=SeqID_15892
MVDLVTILNGRGAHIKKGDWIGIRKLHGQRGNHQGGWRATPDTISAGHDNTRPPHGRQQRDGDGGFCGCANKKREKRNKKNEGDRVLNATSEGPKGAKLPPDNGKWWQQHG

SEQ ID NO: 132671 - protein, 300 aa, Glycine max
  Coding DNA Sequence Number=SeqID_15893
  Homolog annotation: Hit_ID=Q1T254; Match level="QueryCoverage=53%, HitCoverage=48%, E-value=5e-16, Identity=30%"; Hit description =Peptidase aspartic, catalytic
MAEDRPQRMMLEDYSSSATPWYFTNIARPDGNSLRAWEEVVENFLKKYFPEFKTVEGKHLIASMGYFRKLPHMGSASQSSSTSSLMTCDHIPRSSSMPPPMDQLAKQMAERPTGTFVANTKKNPKEECKEIVTRSQKKKDAEVGRVLQDKSIKEGDDTKREEEDDGKEKDAEVLIPKTKSQFAWEARKEITPALLKEALYLLVPSKKDKERYFKRFLDIFQKLEILIPFGEALQQMPLYIKFLKDLLTKKGKYISNETVATCPSRASEGEAHGCAFQRRKDARSRHQRLFVGNVGKTEGN

SEQ ID NO: 132672 - protein, 58 aa, Glycine max
  Coding DNA Sequence Number=SeqID_15894
MEILSGSIPWVTMMILHKKSTLLQKMDWVQMDHCRAATSLPSFKEKQPESHNNCVRRD

SEQ ID NO: 132673 - protein, 89 aa, Glycine max
  Coding DNA Sequence Number=SeqID_15895
MMTSVSRRMPFFAAAKGDETRVDGGVGYVSELLVQHVAAEWRRKRERRCHFKEKMSLEEAYHYRRPWIRAWRKKEMNEERGREELKYKG

SEQ ID NO: 132674 - protein, 230 aa, Glycine max
  Coding DNA Sequence Number=SeqID_15896
  Homolog annotation: Hit_ID=Q9FGP9; Match level="QueryCoverage=16%, HitCoverage=9%, E-value=2e-07, Identity=61%"; Hit description =Arabidopsis thaliana genomic DNA, chromosome 5, TAC clone:K8E10
MWVSRKRFPADFRREEKEKSDFRQEEKEKSKCKILFDEEELKMILGFNRVEDYLGSLWQYDLYGDYVGKLKINNEDEYFITREYCPSNIAIEEAQIRNGGVMVELLKHRFRESLDLLERGDDGPFSTHKNLSTEELCTVGRAGVRIDNVVLVAATEHRGAHYTINTTLFSYVNIFLILIALSLELGTYFYKGIMYEVVGFGCGIIGQGIANLIMTANKYGFLSRVRFALI

SEQ ID NO: 132675 - protein, 133 aa, Glycine max
  Coding DNA Sequence Number=SeqID_15897
MPLFCLRHRFLYNHRKTCVVEDHFCSSESCTINSKNKMKYKSKDEVMLKSQNRRRSRVKRVEARAGGRENNIIPRRPALFTSGGTGMSSSDIFMLLVFSKDKIIILLDDPGALTVSYKGRGQGGMKRERYLCL

SEQ ID NO: 132676 - protein, 116 aa, Glycine max
  Coding DNA Sequence Number=SeqID_15898
  Homolog annotation: Hit_ID=Q8H6Q7; Match level="QueryCoverage=76%, HitCoverage=6%, E-value=2e-34, Identity=79%"; Hit description=CTV.22
MSASPLDSTAQTGQSSGGGGDWQEQVYQHIKSMKESYLPELNEMYQKIATQLQQHNSLPTQPKLDQLEKMNVFKMLERIIAFLQVSKSNISPNFKEKLGSYENHIINFINRETRFI

SEQ ID NO: 132677 - protein, 240 aa, Glycine max
  Coding DNA Sequence Number=SeqID_15899
MRMSEDVKQRNRWPPRLFTFRGLQAVSQGLRDANGSLSKQNVERIILPQLNAKTKFPKTYSHYLSRMKWFRNQYNMMSTLMRNNSGFGWDPIGKTFTAHEDSHLSHSKLRGKSMVDYEYLKIVVGGGVSSGNNSISVDPDDTDATTFEPENRTVGIEEFSYNPNSDTFITPNNYEPAYQPPSPNQPSPPSHPPLDSEVPIEKQNCHKRRRSEYGGSSSAVGINNQGNVLEIFLLALGLLL

SEQ ID NO: 132678 - protein, 65 aa, Glycine max
  Coding DNA Sequence Number=SeqID_15900
MQGSLGSCGGDRRRMMWRRLGIISGSDGVKKDDGGVEEDNDGVCGDDEGFAGVGSVVGYDKDDDM

SEQ ID NO: 132679 - protein, 545 aa, Glycine max
  Coding DNA Sequence Number=SeqID_15901
  Gene Ontology: Mol. function=pyridoxal phosphate binding; Biological process=amino acid metabolic process
  Homolog annotation: Hit_ID=Q5N1T2; Match level="QueryCoverage=78%, HitCoverage=95%, E-value=1e-123, Identity=55%"; Hit description =Aluminum resistance protein homolog
  Pfam annotation: Domain name=Alum_res; Domain location=116-545; Score= 662.0; E_value=4.7e-196; Accession=PF06838.2; Description=Aluminium resistance protein
  Pfam annotation: Domain name=Beta_elim_lyase; Domain location=136 -427; Score=-117.8; E_value=0.009; Accession=PF01212.11; Description =Beta-eliminating lyase
  Pfam annotation: Domain name=Cys_Met_Meta_PP; Domain location=148 -476; Score=-267.3; E_value=0.0013; Accession=PF01053.10; Description= CysMet metabolism PLP-dependent enzyme
  Pfam module annotation: Pfam domain module=Alum_res::Beta_elim _lyase::Cys_Met_Meta_PP; Domain location=116-545::136-427::148-476
MAAREVDKVGEDEASHDNVWSAGSDVVGQRRSCDKDGFAMVKIWRGECYTLKEERSMCIVRSAISAYPIRASTPMATSPLPIPLNVTNTHHAIANPFVPEDCDFHWFVRVQKNCSVELLVVKAVDSLHSEFRAVDNLVVCNTNRVLKAFQNARVGSHHFGGCTGYGHDEAGGRGALDQAFAKIFGAESAIVRHRSYNILICQQFFSGTHAITCALFALLRTGDELLAVAGAPYDTLEEVLGKRESGGLGSLQDFGVKYREVPLAEDGGLDWNALMSAVKPKTKCALIQRSCGYSWRRSLSVNEIGRAIKIIKKQKPSCSVMVDNCYGEFVESIEPPMVGADLIAGSLIKNPGGTIAPCGGYIAGKKKCVEAAAARLSAPGLGVDCGSTPGDIMRAFFQGLFLSSQMVGEAIKVQVCKIIHFYRRDCAFVASILHFGLIAEVLASKGYKVQPLPRIPRSDTVQAIQLGSHERLLAFCEAVQRSSPVGSYTKPVAGATPGYASEVIFADGTFIDGSTSELSCDGPLREPFTVFCQGGTHWTQWGLVL

SEQ ID NO: 132680 - protein, 69 aa, Glycine max
  Coding DNA Sequence Number=SeqID_15902
  Homolog annotation: Hit_ID=Q9SVA6; Match level="QueryCoverage=62%, HitCoverage=10%, E-value=1e-07, Identity=65%"; Hit description=GTP -binding-like protein
MSWQEELERNQKASGSKSDGCARQVASYEFTTLTCIPGVITYRGAKIQIFCLWVDKPGMPKAEFSCTFF

SEQ ID NO: 132681 - protein, 228 aa, Glycine max
  Coding DNA Sequence Number=SeqID_15903
  Homolog annotation: Hit_ID=Q83SZ3; Match level="QueryCoverage=43%, HitCoverage=2%, E-value=2e-07, Identity=34%"; Hit description=Large repetitive protein
DKKSAINFDVDTTKPEPVEGGDKANFEGVFADKTGTEIPVRPDTNDDTLIFKGKGSEDGTIVMIWGDEARTQLIGSTVVENGEWRYESDKLAEGEYAFNVTVRDAAGNELVIDHTVKTNVDVTPPPPPEINSIFAAGATDVEGLMSMSLNDIMTQGQDSLFIDNGKSQLVVNAKQGEALTLEDILPAGEDASSWQQATGTVTVGGNEYNVYSNGDAELLVQNLHNEQH

SEQ ID NO: 132682 - protein, 56 aa, Glycine max
  Coding DNA Sequence Number=SeqID_15904
MIVKFHDNPTVNVFEIVVFLRQMKSIAVTAKASYTPLVYDHSAGDTICSECGFILE

SEQ ID NO: 132683 - protein, 140 aa, Glycine max
  Coding DNA Sequence Number=SeqID_15905
MISDHGWQVLSKSDDVANWANFWAFLTTASSVAQIFLESSNVDAIKDQLLKAGESLNSILQANTKLAGDNKNLEDRMHALTIEAKGLKMRVVNVEALGVMLIDDILEDIVPTPEKPTTPAKDFHAEGVRAKDEDQVWPTD

SEQ ID NO: 132684 - protein, 201 aa, Glycine max
  Coding DNA Sequence Number=SeqID_15906
  Gene Ontology: Mol. function=transcription regulator activity; Cellular component=transcription factor complex; Biological process =regulation of transcription, DNA-dependent
  Homolog annotation: Hit_ID=Q8W0W3; Match level="QueryCoverage=76%, HitCoverage=50%, E-value=2e-10, Identity=31%"; Hit description =Transcription initiation factor IIB
  Pfam annotation: Domain name=TFIIB; Domain location=83-155; Score =38.9; E_value=1.8e-08; Accession=PF00382.10; Description =Transcription factor TFIIB repeat
MDQVAKACKVWKETLKKVYKDLHSLALVQIPGCTLVTHPSSYDNNNSDMVKTCKNQQGIKNANRDAKRKLKRDCDLVAVLLTMEQMANNLGLVWSIKNHAKELYKKAEGSRVFRGRRRHSRASMVACLYLACQEEEFPRIVKEMQSVSGGAKEKNKHINKVIGVFKKHFQVGRNYGKTQALDLGERLCTNLLALTTMSSKL

SEQ ID NO: 132685 - protein, 78 aa, Glycine max
  Coding DNA Sequence Number=SeqID_15907
  Subcellular localization annotation: CTP_CleavageSite=22; ConfidenceScore=5.09e-01
MTQLGIHKNYSHFIKTPPSKSEAQHGVHRTFGTESGRPNSIRNLAIGLENPRFLTPKMARQKGEPPRRVVPASPTPLV

SEQ ID NO: 132686 - protein, 230 aa, Glycine max
  Coding DNA Sequence Number=SeqID_15908
MVSGEGLSGESVGNGSKVRGYDDEVLELHLGLRRTLEKYLLMPIMLPKYTWADGEIGTYFFRYNHEPDLLNLELVVDKNNKGTKVLSGPSRYCPIGCYSSYGVCVYKLRMNEQGFLLHVDYREELFSDSVGNPMFPFYWQQCPRQYDKYPKELLSVVEQLVMFLFGCVPTPCSQPNIEPHDSLVDAVPPPSKDPKRKHKHKMKSHRKHQSGLGEPSGHQDDNSRDKRFKQ

SEQ ID NO: 132687 - protein, 815 aa, Glycine max
  Coding DNA Sequence Number=SeqID_15909
  Gene Ontology: Mol. function=alpha-amylase activity; Biological process=carbohydrate metabolic process
  Homolog annotation: Hit_ID=Q5BLY3; Match level="QueryCoverage=31%, HitCoverage=27%, E-value=1e-99, Identity=65%"; Hit description =Plastid alpha-amylase
  Pfam annotation: Domain name=Alpha-amylase; Domain location=563-814; Score=10.4; E_value=5.8e-07; Accession=PF00128.14; Description=Alpha amylase, catalytic domain
  Subcellular localization annotation: CTP_CleavageSite=31; ConfidenceScore=5.35e-01
MGAALLPDAAFGIFPRFFNVPRHPLICRTTSATSVRKRNFFFGDKRISKSSLIVLSHLNDSDDKLTDVVVDQDDVIGIEDELVVTKKALSEAQHRQEIIEKERDQLLEELARSEAKKQEYITTILHDKEVAISELEAAKTLFQKKLEDSVEEKFNLESKLVLAKQDAVDLAVQVEKLAEVAFQQATSHILEDAQLRISSAETTAAEAAHLIENQIKDAIEGTISSIVEKSNHAIERALVVAEKAEELAKKSTETFIDGTSPFTEIAAVEAENIKLQGIIIDIESELMMARSQADKLKLELENTRQQLQAFEQRANDAEKALLDFQESSRENILQREEEMKSMLEKVKKDVADRTKAISKAFKADLKNIKATVEAAKEVVHCKDYAYLRRCEALQRSLKSSEDAVKMWRQRAEMAESLLLKERLQDEGDADSIYVVNGGRIDLLTDVDSQKWKLLSDGPRREIPQWMARRINAVSPKFPPKKIDVAEALTSKFRSLELPTVDEVWSIAREKPKEGDALIEHVYERETIEKKRKALERALHRKTIQWQRAPEQTKLEPGTGTGREIVFQGFNWESWRRRWYLELAAKTADLSNCGVTAVWLPPPTESVAPQGYMPSDLYNLNSSYGSVEELKYCIEEMHSQDLLALGDVVLNHRCAQKQSLRAEFQSPNGVWNIFGGKLAWGPEAIVCDDPNFQGRGNPSSGDIFHAAPNVDHSQDFVRKDIKEWLNWLRNDIGFDGWRLDFVRGFSGTYVKEYIEASTPVFAIGEYWDSLGYEHGSLCYNQDAHRQRIINWINATGGTSSAFDMTTKIQKLAIVKI

SEQ ID NO: 132688 - protein, 57 aa, Glycine max
  Coding DNA Sequence Number=SeqID_15910
MTVTSHIYSLYGNTIVIVVDCCYCLLRGGLTRLRHGGPTTGQWVGGGDDGPRDRGII

SEQ ID NO: 132689 - protein, 83 aa, Glycine max
  Coding DNA Sequence Number=SeqID_15911
  Gene Ontology: Mol. function=serine carboxypeptidase activity; Biological process=proteolysis
  Homolog annotation: Hit_ID=Q1EP77; Match level="QueryCoverage=80%, HitCoverage=13%, E-value=1e-14, Identity=65%"; Hit description =Serine carboxypeptidase (Carboxypeptidase D), putative
MALCSVFLNLHLLLFVSSYLSQEILAEQEADRVHGLPAQPPVKFNNMVVISLPMKLKEQHCSIGFSRPLTNQNKNSFSYGSME

SEQ ID NO: 132690 - protein, 100 aa, Glycine max
  Coding DNA Sequence Number=SeqID_15912
MAKEEDTSTNQIHEPSSTLVPDDATPSAPAPERASSIEDGFKENLSQIWLTQRLSFEVQKVAVGLSEHPPLSAASTCLARQKNLAGHQYQGHALSARSVC

SEQ ID NO: 132691 - protein, 151 aa, Glycine max
  Coding DNA Sequence Number=SeqID_15913
MPRAQNSTAHHSAYFGKRALEATRGATFAEIPRFCKLIIVRNLIEAGSKLSLTRGICGLSFGSEDELTPLEPSSVVADTSMAQEEVSSPDSMIEPSPAPISEDIMPSVPAMEPEQPIKMKISHRMSRMFKFCFVLISTNHGQFSLHYVSVI

SEQ ID NO: 132692 - protein, 58 aa, Glycine max
  Coding DNA Sequence Number=SeqID_15914
MCEMIPGYVIKIVPTSKVHPMKELNISRLRFQVILTTVMASWYGARVGMSTTTQLNDG

SEQ ID NO: 132693 - protein, 191 aa, Glycine max
  Coding DNA Sequence Number=SeqID_15915
MYGVGGIIHNVAYADDVARCPVSHCRDSVCRDASSTFIAWPRHLVKPITDDSNHNARLPVGRLGEAEVAAEPDPLGELMKTLFYVYKSPVEVPWEATQFGLPDVGAKFFITHADLAEIISGDKCLNISILQLCTIFMNNCGRSKVDQSLYGLLEPQSIHNAKDRREQCQEYIQTWVKESQRQLYLGAYLHQ

SEQ ID NO: 132694 - protein, 55 aa, Glycine max
  Coding DNA Sequence Number=SeqID_15916
  Subcellular localization annotation: CTP_CleavageSite=16; ConfidenceScore=5.06e-01
MSNASKIKKLDPTSKRVSTIAGTGKAGSKDGTTVKAQDGLSTKSNTRAQLSLFIL

SEQ ID NO: 132695 - protein, 130 aa, Glycine max
  Coding DNA Sequence Number=SeqID_15917
  Gene Ontology: Mol. function=electron carrier activity; Cellular component=membrane; Biological process=electron transport
MVAKREADSALFAEINPWQKENLAITSSPLWWLLTLMGILSYKLGAMGRKGLAYNEKKNILYVANTENNVLREIDFVNEKVRTLAGNRTKGSDYVGGGKGDSQIWEHNLLDATTRVFSGDGYERNLNGSR

SEQ ID NO: 132696 - protein, 78 aa, Glycine max
  Coding DNA Sequence Number=SeqID_15918
  Homolog annotation: Hit_ID=Q6EPN8; Match level="QueryCoverage=48%, HitCoverage=8%, E-value=7e-09, Identity=73%"; Hit description =Putative Ste24p
MVTPGTATTLNLQALAEEIKARYDKAAVKVVDLILTLLQFGGYTLVQNSVDLYRSFGFDTQPVLIGLIIFQASRALDI

SEQ ID NO: 132697 - protein, 49 aa, Glycine max
  Coding DNA Sequence Number=SeqID_15919
MRTRHGKKICTRGYPSEFVSILTGNTQIDWIWVRDCVEDTRYPTGTEMG

SEQ ID NO: 132698 - protein, 123 aa, Glycine max
  Coding DNA Sequence Number=SeqID_15920
MQLKAIEEGRSWCLIKGTRFGSILGRIYFLLRESQNLAPEVLALFRSWRGSTTMLIGVANSIDEASTNLRTNPLQEEGDDAILPRRGRITRVMARRLQEDWARDAGEDFRVLMSLRVDFGPMG

SEQ ID NO: 132699 - protein, 175 aa, Glycine max
  Coding DNA Sequence Number=SeqID_15921
  Homolog annotation: Hit_ID=Q337F4; Match level="QueryCoverage=63%, HitCoverage=34%, E-value=6e-15, Identity=33%"; Hit description=F-box domain containing protein, expressed
  Pfam annotation: Domain name=F-box; Domain location=13-60; Score =29.4; E_value=1.2e-05; Accession=PF00646.23; Description=F-box domain
MHNSKLAVKKGVWRNDLLSIGILSIIFMCLNIADLAVASLVCKMWNKACHDPSLWCKIDLSKLNSSFFLNILNNQPGAYKRTSGKITQLLKYVLSLSNGNTYCLVFNYNVYLTDEQFIIAIERTPNLKQLVLPRTCDFSREAEHMAMKSRWALSPLPLHLTYFLQFANSAGTSFG

SEQ ID NO: 132700 - protein, 87 aa, Glycine max
  Coding DNA Sequence Number=SeqID_15922
MEKKKGGAARKRGGESRNQKRRRRREGRKWARDESNGPKRGEPDRWWSEGGCVGGLWWLGYSGTLTDWYCTDSLTRTVINALFKGQN

SEQ ID NO: 132701 - protein, 132 aa, Glycine max
  Coding DNA Sequence Number=SeqID_15923
  Gene Ontology: Mol. function=protein binding; Cellular component =nucleus; Biological process=multicellular organismal development
  Homolog annotation: Hit_ID=Q9M3N3; Match level="QueryCoverage=65%, HitCoverage=70%, E-value=1e-24, Identity=63%"; Hit description =Putative kinetochore protein
  Pfam annotation: Domain name=Skp1_POZ; Domain location=5-65; Score =83.0; E_value=9.3e-22; Accession=PF03931.5; Description=Skp1 family, tetramerisation domain
MALTKNITLKSLDGEAFEVEEAVAVKSQMIKHMIEDNCADNRVPLPNATNKILAEVIKYCKKHVDANCIDEKPSEDELKAWEADFVKGYMLLRLGGLGLYSIIVIDDPPLQLLFVHLCLKEISMGSFHQKAH

SEQ ID NO: 132702 - protein, 97 aa, Glycine max
  Coding DNA Sequence Number=SeqID_15924
  Gene Ontology: Mol. function=structural constituent of ribosome; Cellular component=ribonucleoprotein complex; Biological process =translation
  Homolog annotation: Hit_ID=Q9M5M7; Match level="QueryCoverage=77%, HitCoverage=47%, E-value=3e-14, Identity=47%"; Hit description=60S ribosomal protein L10
  Pfam annotation: Domain name=Ribosomal_L10e; Domain location=1-74; Score=-66.4; E_value=0.0058; Accession=PF00826.8; Description =Ribosomal L10
MAKFVGKEAFHSRVGASGKSQGTCARVTIVQVLFLVCCKENNNHHAQKDLCRAKFKFPSHQKIIVSWCQTLISFGDNHLQTFGFLLAELSCLTLLVS

SEQ ID NO: 132703 - protein, 170 aa, Glycine max
  Coding DNA Sequence Number=SeqID_15925
  Gene Ontology: Mol. function=nucleic acid binding; Cellular component= intracellular
  Homolog annotation: Hit_ID=Q1RZD5; Match level="QueryCoverage=88%, HitCoverage=30%, E-value=2e-18, Identity=41%"; Hit description=Zinc finger, C2H2-type
MAFAQRRELEDEVRKELELERTFRISMQRSDGITFREPISVSFNHSMGPLNNITMSGGLPFHLLSQASKQINKDKVIILNKPDDHCGEKRKAMTLAIDDNESLQKKSKKEWSCELCQISATSLKGLNDIQGKKHKANKESTRTQKIGLDSRPESETLHPCLTPPHMQTGI

SEQ ID NO: 132704 - protein, 68 aa, Glycine max
  Coding DNA Sequence Number=SeqID_15926
MSIYYAIRKDELPVITNESSPADVALYERWERSNRLSMMFIKIKILVEICGFVDQHEKVRDLLKAIDD

SEQ ID NO: 132705 - protein, 194 aa, Glycine max
  Coding DNA Sequence Number=SeqID_15927
  Homolog annotation: Hit_ID=Q9M3N3; Match level="QueryCoverage=44%, HitCoverage=70%, E-value=4e-22, Identity=59%"; Hit description =Putative kinetochore protein
  Pfam annotation: Domain name=Ribosomal_L10e; Domain location=50-194; Score=-47.4; E_value=0.00015; Accession=PF00826.8; Description =Ribosomal L10
  Pfam annotation: Domain name=Skp1_POZ; Domain location=5-65; Score =67.7; E_value=3.8e-17; Accession=PF03931.5; Description=Skp1 family, tetramerisation domain
  Pfam module annotation: Pfam domain module=Ribosomal_L10e::Skp1_POZ; Domain location=50-194::5-65
MALTKNITLKSLDVEAFEVEEAVAVKSQMIKHMIEDNYVDNKVPLPNATNKILAEVIKYCKKHVDANCTDEKPSEDELKAWEADFVKEYEQDFYCACGTARILAWLPCLKVTSRRLLLLHEELHYWNKSIVAYGFMLQEHSGIRGASRKSQGTCARVTIGQVLFLMCCKENNNHHAQKALCGAKFKFPSRQKII

SEQ ID NO: 132706 - protein, 70 aa, Glycine max
  Coding DNA Sequence Number=SeqID_15928
MCEMIPGYVIKIVPTSKVHPMKVLNISRLRFQVILTTVKAAWYGARVGMSTTTQLNQLRYFQPLCPMEKC

SEQ ID NO: 132707 - protein, 74 aa, Glycine max
  Coding DNA Sequence Number=SeqID_15929
MEEKLLNWKSYLDIANLFVYLNEYVLEERNKGPASSSVVSFDPRGVLVLPLAPQTEGTLLHFFLEMAHHFFLEL

SEQ ID NO: 132708 - protein, 76 aa, Glycine max
  Coding DNA Sequence Number=SeqID_15930
MQEQVDFLHILRVGNVVADWLACFGTCNPGTKVDTIRDMQEQVNFLHILRVGNVVTDWWACFGTCNSGTEVFFEDF

SEQ ID NO: 132709 - protein, 76 aa, Glycine max
  Coding DNA Sequence Number=SeqID_15931
MTPLPVKEDKSGQTPLSVKEDKSGFLKEWKAPKDLSIDNIIVDIAEGASIELIRMYKEDYAKLRSALSLSQKAWML

SEQ ID NO: 132710 - protein, 188 aa, Glycine max
  Coding DNA Sequence Number=SeqID_15932
MTHVELFRKFGEYEMDFTRMTEDEAIGKKNRGLSLKTSITSSDESADDNADGSDTESLNLLVRRFNKFLKKKNNYENRTFHPRRISRKMNYLPPTDSLASSAERQNILSENSEEEQTILCLMANNEAESEVCLATDKQLWYLDSNCSRRCEPYGAECLIQATEIWMPLPVKEDKSGQTPLPVKEDKSG

SEQ ID NO: 132711 - protein, 98 aa, Glycine max
  Coding DNA Sequence Number=SeqID_15933
MQHLMKLLEDSWSVVRNHLLKELAKFSEDYIKLFGGMERFEELRMSLLVDGLTKVTTDKWIDITNMGYVIASRLSRGQIHILAECSIQELRDVQERLC

SEQ ID NO: 132712 - protein, 224 aa, Glycine max
  Coding DNA Sequence Number=SeqID_15934
  Homolog annotation: Hit_ID=Q1SWX1; Match level="QueryCoverage=38%, HitCoverage=17%, E-value=8e-09, Identity=34%"; Hit description=IMP dehydrogenase/GMP reductase
MYKDNWTQPWPMGSEIYPKVHENPRAFFSSSSLILLEPLAHGSSEWSLPREDRITSVVISRYVHSCILPPCNYLCLAFFFFTVKVIMKRESLHRFLSCMHWVPWELKYWSSKFPFLRTWGQTKHHLLRKRFYHVKVKNLEVASLRKLGQRMGQVQRQAFGKVYGKIWDLAMIEVSIEAIASLTQYYDQSLKCFTFRNFQLAPTIEEFEGILGCPIGGRKPYLFF

SEQ ID NO: 132713 - protein, 310 aa, Glycine max
  Coding DNA Sequence Number=SeqID_15935
  Gene Ontology: Mol. function=DNA binding
  Homolog annotation: Hit_ID=Q1RUD8; Match level="QueryCoverage=69%, HitCoverage=42%, E-value=1e-24, Identity=35%"; Hit description=IMP dehydrogenase/GMP reductase
MANQEEWVPLMDVLALLILGVVLCPNMDGMVDLAAIDTFLAYHHSKESPVVAVLADLFDTFDRRCEKSSARIICCLPALCVWLVSHLFLQDTRHPCPLQSHRSCAEKRRIDWDQLLAGVGGRTINWFPRWKEGKEGVLFSCKGYPNIPLIGTRGCINYNPALAIRQLGYPMRGAPMEESMSPFLVRDFGTQNFKAIQRIHKAWETPLRKDQELRGIRNGIIGGYHEWLKVHIRGLDWLAKLKVVSEDSFEAPEEDEEVQALKNELGKAKLAKEKFKLAATHIQKECAGLREENATTAKALEQETKRAHKE

SEQ ID NO: 132714 - protein, 75 aa, Glycine max
  Coding DNA Sequence Number=SeqID_15936
MVEEFVNGFVHQNGIAVITHNPPKGDSGSMYRNTFTSVFSAMAEEFVNDFVHQNGIAVINHNPPKGNFGSMPASC

SEQ ID NO: 132715 - protein, 140 aa, Glycine max
  Coding DNA Sequence Number=SeqID_15937
  Gene Ontology: Cellular component=integral to membrane; Biological process=autophagy
  Homolog annotation: Hit_ID=Q1RSF3; Match level="QueryCoverage=92%, HitCoverage=50%, E-value=5e-26, Identity=47%"; Hit description =CD9/CD37/CD63 antigen
MCKFEFFRDIVHGEAVTHALLHQATLGHVPVSLVGDVVLQPGREIPYSIPHRRPRPIRRVVSGDEERYNGERREGEDDEERGEEVEVEGGVDAAQHADEAEGGDDEYEEAAEEERVLEHLLAVAVDADVGGVAHGGDTQE

SEQ ID NO: 132716 - protein, 77 aa, Glycine max
  Coding DNA Sequence Number=SeqID_15938
MGFEGGNGNVVTEGLGWEYTWGDTHHATQHETSQSVRSEVEHMTSSIKSLYHIYFQIDANVIELDVIISEEGKIKLL

SEQ ID NO: 132717 - protein, 54 aa, Glycine max
  Coding DNA Sequence Number=SeqID_15939
MVWNCSYVAYVEGRDEVDKGTSNTQVFWSRMSNLSLNPLHLDGIDALKRSRTSS

SEQ ID NO: 132718 - protein, 89 aa, Glycine max
  Coding DNA Sequence Number=SeqID_15940
MEKTKLFQAPTEPEAPFVSKDVPTTRTDPQEMYPLLFSVKPKEKGDTKEFRRLVLCSFGKGRRETQKEFRRLVLGEFFLAKGEGNEKDE

SEQ ID NO: 132719 - protein, 84 aa, Glycine max
  Coding DNA Sequence Number=SeqID_15941
  Gene Ontology: Cellular component=integral to membrane; Biological process=autophagy
  Homolog annotation: Hit_ID=Q1RSF3; Match level="QueryCoverage=77%, HitCoverage=24%, E-value=8e-26, Identity=74%"; Hit description =CD9/CD37/CD63 antigen
MRKRMYGFNGQITVEVGVLQPIVPDGVAAQDIDDGDEHEHACIEYGEMSPLASDVGQHSSFARIAVETQFVLSVAPCPAISVVR

SEQ ID NO: 132720 - protein, 788 aa, Glycine max
  Coding DNA Sequence Number=SeqID_15942
  Gene Ontology: Mol. function=catalytic activity; Cellular component =cytoplasm; Biological process=metabolic process
  Homolog annotation: Hit_ID=Q10BT3; Match level="QueryCoverage=94%, HitCoverage=96%, E-value=0.0, Identity=47%"; Hit description=Acyl -activating enzyme 18, putative, expressed
  Pfam annotation: Domain name=AMP-binding; Domain location=290-722; Score=147.9; E_value=2.7e-41; Accession=PF00501.18; Description=AMP -binding enzyme
LQITEAKGYYPYQPAIETGLMLLGEVSGATLDPTITHMAYYKSLSSITVSDIESHGIAREDAATLHQGLAEIIETHSNGTPATWQHVSNSILNPELPFSFHQMLYYGCYKDYGPDPPAWIPNRESAALTNVWQLLERKGEEFLGSAYKDPITSFDDFQKFSVSNPEIYWKCVWDEMSISFSKPPECILRDSPSGESPLSHPSGQWLPGASINPAQNCLNVNGKRSLNDTVIIWRDEQHDDLPRQRMTLEELREEVWSMRAGIRMQQMVQKDKSYIKLWRILFGGWVEQNEHLETAYWRGLVAYALQSLGLEKGSAIAIDMPMNVKSVVIYLAIVLASYVVVSIADSFAASEISTRLKISKAKVIFTQDLIMRGDKSIPLYSRVVDAQSPMAVVIPAKGSEFSMKLRNGDLSWHDFLEKVNNLKGKEFIATEQPIETFTNILFSSGTTGDPKAIPWTNITPLKAAADAWCHMDVRKGDVVCWPTNLGWMMGPWLVYASLLNGASMALYIGSPLGSGFAKFVQDAKVTMLGVIPSIVRSWRSTNSTSGYDWSSIRCFGSTGEASNVDEYLWLMGRALYKPIIEYCGGTEIGGGFVCGSLLQAQSLAAFSTPAMCCSLFILDDEGLPIPQNVPGIGELALGPLMLGASNTLLNADHYGVYFKGMPLLNGKVLRRHGDVFERTAKGYYHAHGRSDDTMNLGGIKVSSVEIERICNGVDSSILETAAIGVPPSGGGPELLTIAVVFKDSNSTNQDLHQLRMSFNSALQKKLNPLFRVSQVVTLPSLPRTASNK

SEQ ID NO: 132721 - protein, 165 aa, Glycine max
  Coding DNA Sequence Number=SeqID_15943
MAQHDSSTLDFLAQITALCKAQGVHSDSLTHERLSPAINLAYIKKNCWNLDDLSVTFRGPRKAKGKRSEAPPSSEVPPSSAPAPIPSIPSTPTYGAVYYHAEPSGLGLAIHHELGGEVAWLGDQPSSSRGGEASTTQEPILEETTAAAAATEEENDAILPRKGIG

SEQ ID NO: 132722 - protein, 113 aa, Glycine max
  Coding DNA Sequence Number=SeqID_15944
MIIETRLKKNEQRCRKQMPLILANRVQPEIETKGVRRMEKSHKTEIAIKEVTESKSKNRIQTGSKSRSKRRNDRRNTVFQIGNPNRIEKSWIHLNHTNNQTKHKKDVLAEAKK

SEQ ID NO: 132723 - protein, 193 aa, Glycine max
  Coding DNA Sequence Number=SeqID_15945
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=99%, HitCoverage=53%, E-value=1e-103, Identity=82%"; Hit description=PSI P700 apoprotein A2
  Pfam annotation: Domain name=PsaA_PsaB; Domain location=1-193; Score=- 239.2; E_value=0.009; Accession=PF00223.9; Description=Photosystem I psaApsaB protein
PAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNIHWGGDYLWLNSSQLINGYNPFGMNSLSVWAGMFWFGHLVWDTGFMFLISWRGYWQELIETLAWAHERTPLANLIRRRDKPVALSIVQARL

SEQ ID NO: 132724 - protein, 202 aa, Glycine max
  Coding DNA Sequence Number=SeqID_15946
  Homolog annotation: Hit_ID=Q1STZ2; Match level="QueryCoverage=49%, HitCoverage=21%, E-value=2e-11, Identity=37%"; Hit description=IMP dehydrogenase/GMP reductase
HKSSAVYPPLCMVGFAPIPTRHKASMSAPKPSLEGKEGVLFSCGNYPNIPLIGTRGCINYNPALAIRQFGYPMRGAPAEESLSPFLARDFGAQSFKIIQRVHKAWESPLRKDKELRGIRNGIIGSYHEWLKVHTRGLDWLSKLKIINEENFEALEEDEEVRALKTELGKARLAKEKFKLVATDVWKECAELRERKCSYRKSP

SEQ ID NO: 132725 - protein, 111 aa, Glycine max
  Coding DNA Sequence Number=SeqID_15947
MLGYHQGGSQNTQVPKLTKQLFNPGLGTKLVQPPCFYSNITDLYVQYFRARCPGHRIRHRGSYNFNAFSNSSIFGQDVLDIVSDIVDPAASMLLAIPLFSGRMSWTLYPTS

SEQ ID NO: 132726 - protein, 96 aa, Glycine max
  Coding DNA Sequence Number=SeqID_15948
MPHNQIDPRTCLFIYPFGREGMTTAPRAPGLLVLATNTNPGASCAKELKSVKCDSRGPGDGNPVNHRVFERKLRPKPLGRGHACLGVTHRFPNANM

SEQ ID NO: 132727 - protein, 218 aa, Glycine max
  Coding DNA Sequence Number=SeqID_15949
  Homolog annotation: Hit_ID=Q668P4; Match level="QueryCoverage=96%, HitCoverage=95%, E-value=4e-47, Identity=49%"; Hit description =Putative lipoprotein precursor
  Pfam annotation: Domain name=DUF799; Domain location=1-218; Score =245.1; E_value=1.5e-70; Accession=PF05643.2; Description=Putative bacterial lipoprotein (DUF799)
MKKLIAVCGVFAALLLTGCAQNKKPYDYSAFRASKPASILVLPADNRAPDINASHSFTSLVTQPLAEAGYYVFPVAVVEETFQQNGLSNGHEIQAVSTKRLHDIFNADSALYISITDYGSSYLVVDSVTTVSATARLVDLRSGKELWQGMATANDSENSNNSNGGIIGMRVSAAIKQIDNNAGDKAHTNAGVISPRLLAQNEQGGLLAGPRYKAPVTR

SEQ ID NO: 132728 - protein, 455 aa, Glycine max
  Coding DNA Sequence Number=SeqID_15950
  Gene Ontology: Mol. function=exonuclease activity; Cellular component= chromosome; Biological process=DNA metabolic process
  Homolog annotation: Hit_ID=UPI00005F80EF; Match level="QueryCoverage =69%, HitCoverage=25%, E-value=6e-66, Identity=47%"; Hit description =COG0419: ATPase involved in DNA repair
  Pfam annotation: Domain name=ABC_tran; Domain location=284-442; Score= -63.9; E_value=0.078; Accession=PF00005.17; Description=ABC transporter
ALQQQQQQLEQQLAAHQLSLPAAPERAGWLQTLQQRWQQWQESERLLAELQPQLAKSETEGSSLQHALAREQQQVASLQQALNHLQQQQQAQQQQRQQLFGDRRVADARQQQHATLQQHDQALAQQLQRWQQAQSELHGLKGQYEQIVSQQQTLAQRAADAESAFRQALLLSDFADESALRAALLAEDEVQTLRQRLQTLEQQHQQHTALHARLAQRLSDHLQQRPAALSDADAGSIAIRLEQLRVALRDNARQQGEAQQQLHSDTRQRQQQQTLLVQIAADEAELAQLSRLNDLIGSAKGDKFRRFAQGLTLDHLVWLANRQLDRLHGRYLLQRRVSDELELEVVDTWQADATRDTRTLSGGESFLVSLALALALSDLVSHKTRIESLFLDEGFGTLDAETLDTALDALDALNASGKTIGVISHVEAMKERIPVQIRVRKMNGLGYSKLELPGE

SEQ ID NO: 132729 - protein, 380 aa, Glycine max
  Coding DNA Sequence Number=SeqID_15951
  Homolog annotation: Hit_ID=Q8D0W1; Match level="QueryCoverage=52%, HitCoverage=81%, E-value=1e-78, Identity=72%"; Hit description =Putative periplasmic protein
  Pfam annotation: Domain name=CsgG; Domain location=1-201; Score =259.5; E_value=6.8e-75; Accession=PF03783.4; Description=Curli production assemblytransport component CsgG
  Pfam annotation: Domain name=DUF799; Domain location=273-380; Score= -32.0; E_value=0.00029; Accession=PF05643.2; Description=Putative bacterial lipoprotein (DUF799)
  Pfam module annotation: Pfam domain module=CsgG::DUF799; Domain location=1-201::273-380
SSRAIDAPQVRAASQPAYQGVRSPIAVGQFDNRSSYMNGIFSDGVDRLGNQSKTILITHLQQTNRFNVLDRSNLKELQQEADFKHSQQNIKGANYIITGDITEFGRKEVGDQQLWGILGRGKSQIAYAKVNLNVVDVTTSEVVYSVQGAGEYQLSAREVIGFGGTASYDSTLNGKVMDLAIREAVDHLVDGINNGAWRPPIYYWGDYQQQVYSYYQKDSDPQKQIDALNLDIEKAKAVNKPVAPGLHAQLGLLYAKNGNTDKAFSQFALEKQLFPESAPVFAALLLTGCAQNKKPYDYSAFRASKPASILVLPADNRAPDINASHSFTSLVTQPLAEAGYYVFPVAVVEETFQQNGLSNGHEIQAVSTKRLHDIFNADSA

SEQ ID NO: 132730 - protein, 425 aa, Glycine max
  Coding DNA Sequence Number=SeqID_15952
  Gene Ontology: Mol. function=sequence-specific DNA binding; Cellular component=intracellular; Biological process=regulation of transcription, DNA-dependent
  Homolog annotation: Hit_ID=Q6CYY0; Match level="QueryCoverage=52%, HitCoverage=77%, E-value=1e-81, Identity=65%"; Hit description=AraC family transcriptional regulator
DAPHLDPADHGIIAAAVERAGQALAEFGKERDRYGLIHADLRLTNLLLHKGETRVIDFDDCGMGWYLHDLAAAISFVEHHPRAAEWVDNWILGYERVAHISDAEMALVPTLLIQRRIQMTAWMGTHADTEMALSLKPHWASHSVRLCRRYLESSQLPRASRHRRADRHADRHRERASGGQAVHCLAPRAVGGRCAFATPASNRGVLAAAATGLSAFITDKGGDVDRIFGIGGIDSELLASPTLSLGLVNYCRVMEEAARHSGFDNFVIRVNWLHRTVLADAGAGAAQCGERVSLAPARYADAAGGQGRLLAARLSGAPRGDPGTPSGCGADARHVPQPDSPRGGQKLGTARARHAGAGCDAADGDAGCHSPPQQQRQRAERGRTGAFAGQPDAHSGRTGTGGDRRQNGVVELVAAATLARRGHQL

SEQ ID NO: 132731 - protein, 336 aa, Glycine max
  Coding DNA Sequence Number=SeqID_15953
  Gene Ontology: Mol. function=glutamyl-tRNA reductase activity; Biological process=tetrapyrrole biosynthetic process
  Homolog annotation: Hit_ID=Q6AVG1; Match level="QueryCoverage=67%, HitCoverage=58%, E-value=3e-73, Identity=55%"; Hit description =Expressed protein
  Pfam annotation: Domain name=DUF266; Domain location=157-268; Score =204.3; E_value=2.9e-58; Accession=PF03267.4; Description=Arabidopsis protein of unknown function, DUF266
  Subcellular localization annotation: CTP_CleavageSite=11; ConfidenceScore=5.35e-01
MKNNNHQQQERSLAAQSQMFSFFFSHVLVFASGLLIGITLITFSFKNLSLNFQFHQLFLPSLSPHSDPILISALNNQTKVTIHSILRPTKAAMHDMTEEELLWRASMVPMIKELPYNHTPKVAFMFLTKGSVLLAPLWERFFKGNEAFYSIYVHSLPSFNDTVPQTSVFHGRRIPSKEVRWGDFNIVGAERRLLANALLDFSNQHFVLLSESCIPLFNFSTIYNYLMNSTKTFVEAYDMPGAVGRGRYSPRMRPLVNLSQWKKGSQWFQIDRALAIDIVSDQQYFPLFNKYCKNRCYGDEHYLPTFAKAWQNMSLQWEDHQYLPPVCKKIHAAGFR

SEQ ID NO: 132732 - protein, 652 aa, Glycine max
  Coding DNA Sequence Number=SeqID_15954
  Gene Ontology: Mol. function=protein kinase activity; Cellular component=cell surface; Biological process=protein amino acid phosphorylation
  Homolog annotation: Hit_ID=Q1RZG3; Match level="QueryCoverage=96%, HitCoverage=99%, E-value=0.0, Identity=69%"; Hit description=Protein kinase
  Pfam annotation: Domain name=Pkinase; Domain location=337-616; Score =138.4; E_value=1.9e-38; Accession=PF00069.15; Description=Protein kinase domain
  Pfam annotation: Domain name=Pkinase_Tyr; Domain location=338-616; Score=118.3; E_value=2.3e-32; Accession=PF07714.7; Description =Protein tyrosine kinase
  Pfam module annotation: Pfam domain module=Pkinase::Pkinase_Tyr; Domain location=337-616::338-616
  Subcellular localization annotation: CTP_CleavageSite=59; ConfidenceScore=5.69e-01
MAADFAIKIPTSFPSTMNTRSSLFASILTLAFFFLTSLPQSYSQLQNHTYSICSQISFSCGTLRNISYPFWGGNRPQFCGRNGFKLTCMHNENTSVQVGSQRFNVLNINQTASTLRMVRTDLVYDRCSSNFTNTSLSVSPFTFLPSVQNVIVFYECPSGINSVVGNTFTCQNDTSKHVFYVVNGTQLNQFPDLHKYCGVSLQVQVSQGVVWESGLGVLEKGFDVRYDAELSSQCTACRDSGGTCGTNENDSPQFSCYCSAGAHASVCSTHKSFVATGFALPLIAVIICRNKARIWKFMLIQVGKIKRNDRVIEAFLESQGSMGLKRYSFSDVKKMTDSLKIKLGEGGYGSVYKGKLLNGCSVAVKILNESKENGEEFINEVASISKTSHVNIVSLLGFCLDGSRKALIYEFMFNGSLEKYIHKKASAESKTTTPSLSLERLHQIAIGIAQGLEYLHKGCNTRILHFDIKPHNILLDEVYRPKISDFGLAKLSTRDESIISMSNARGTVGYVAPEVFSKSFGGVSHKSDVYSYGMMLLEMVGGQKNMDIEASRSSEIYFPQLVIYKKLEQGNDLGLDGGILSGEENEIAKRMTMVGLWCIQTIPSHRPTISRVIDMLEGSVDSLEMPPKPFLSSPPRSSTDFSTAISKSLDGV

SEQ ID NO: 132733 - protein, 632 aa, Glycine max
  Coding DNA Sequence Number=SeqID_15955
  Gene Ontology: Mol. function=protein kinase activity; Cellular component=membrane; Biological process=protein amino acid phosphorylation
  Homolog annotation: Hit_ID=Q1RZG3; Match level="QueryCoverage=94%, HitCoverage=93%, E-value=1e-134, Identity=44%"; Hit description =Protein kinase
  Pfam annotation: Domain name=Pkinase; Domain location=326-599; Score =138.2; E_value=2.2e-38; Accession=PF00069.15; Description=Protein kinase domain
  Pfam annotation: Domain name=Pkinase_Tyr; Domain location=327-599; Score=106.4; E_value=8.2e-29; Accession=PF07714.7; Description =Protein tyrosine kinase
  Pfam module annotation: Pfam domain module=Pkinase::Pkinase_Tyr; Domain location=326-599::327-599
  Subcellular localization annotation: CTP_CleavageSite=20; ConfidenceScore=5.48e-01
MFKFAFFFAFFLFFTTNTTSGSHNNTSSCPTNSCKNGPKISYPFWFSQGSLPDQYCGYQELGLFCDDNGNAIFSPPPGKYYYVKDIDYANHILKLVDFDTANITCPRALHSFPLGNLPLSHSPLNSNLNFYYNCTHYPSSGVPPIECLSSGANRSFVFLMGNETEGFDCQEKVVVAVLKDQITSHDDGGLINEFAGAMNEGFLLDWQTTTNCAECEASNGTCGYSNTRKETLCFCKDGTTKSNTCQGGGGSRTGLSRLIIGLIIGGGIGALLICILVYSFRRKLSPIVSEIRKVKKIHQDIEALIRSNGPLPIKRYSYSEIKKMTNSFQSKLGQGGYGQVYKGNLSNNSPVAVKVLNASKGNGEEFMNEVISISRTSHVNIVNLLGFCLEGQKKALVYDYMPNGSLEKFIHNKNLETNPPLSWERLHHIAEGIAKGLEYLHRGCNTRILHFDIKPSNILLDKKFCPKISDFGMAKLCSNTQSIISMYGARGTVGYIAPEVWNRNFGGVSYKSDVYSYGMMILEMVGGRQSISIEASHSSETYFPDWIYKHVELGSNLAWDEGMTTDENEICKKMIIVGLWCIQTIPSDRPAMSKVVEMLEGSIDQLQIPPKPFIFSPTKTQVDICTTTSSSD

SEQ ID NO: 132734 - protein, 266 aa, Glycine max
  Coding DNA Sequence Number=SeqID_15956
  Homolog annotation: Hit_ID=Q9SKI2; Match level="QueryCoverage=40%, HitCoverage=52%, E-value=8e-15, Identity=50%"; Hit description =Expressed protein
MGEATKGITKAMGQMNRWTADEFAFCTEDDARVMGDAIDDALEGGEEEEETEELVNQFLDEIGIDINSELVNAPATTSVSAPAAKNRVAQAESTANEDSGIYDDLQASAAQWTARMRAKPLINARGVEDVPASVKLPYTFLFFKTCQADNTFSLGSRVIGINAPSEHGESEKCERNYQCSSYEKPRIEFHSSYGMDFSEALAEMPCLDMVDDNNEQAQQQPFRSQQCWSTQKDNLNLWALKGLLYKLVASNECLEGKIAYYMPMNS

SEQ ID NO: 132735 - protein, 931 aa, Glycine max
  Coding DNA Sequence Number=SeqID_15957
  Gene Ontology: Mol. function=transmembrane receptor activity; Cellular component=membrane; Biological process=defense response
  Homolog annotation: Hit_ID=Q1SI46; Match level="QueryCoverage=94%, HitCoverage=95%, E-value=0.0, Identity=41%"; Hit description=Leucine Rich Repeat, putative
  Pfam annotation: Domain name=LRR_1; Domain location=517-538; Score =3.1; E_value=76; Accession=PF00560.23; Description=Leucine Rich Repeat
  Pfam annotation: Domain name=LRR_1; Domain location=540-562; Score =8.8; E_value=6.5; Accession=PF00560.23; Description=Leucine Rich Repeat
  Pfam annotation: Domain name=LRR_1; Domain location=564-583; Score =4.8; E_value=36; Accession=PF00560.23; Description=Leucine Rich Repeat
  Pfam annotation: Domain name=LRR_1; Domain location=587-609; Score =6.1; E_value=20; Accession=PF00560.23; Description=Leucine Rich Repeat
  Pfam annotation: Domain name=LRR_1; Domain location=631-652; Score =11.2; E_value=2.3; Accession=PF00560.23; Description=Leucine Rich Repeat
  Pfam annotation: Domain name=LRR_1; Domain location=654-679; Score =13.5; E_value=0.75; Accession=PF00560.23; Description=Leucine Rich Repeat
  Pfam annotation: Domain name=NB-ARC; Domain location=183-424; Score =28.3; E_value=4.3e-12; Accession=PF00931.13; Description=NB-ARC domain
  Pfam annotation: Domain name=TIR; Domain location=28-158; Score =158.6; E_value=1.6e-44; Accession=PF01582.10; Description=TIR domain
  Pfam module annotation: Pfam domain module=LRR_1::LRR_1::LRR_1::LRR _1::LRR_1::LRR_1::NB-ARC::TIR; Domain location=517-538::540-562::564 -583::587-609::631-652::654-679::183-424::28-158
KIDNNNSSNPVTCFTCRPNDTPQIKYDVFVSFSGADIRQDFLSHLVEGFYRRQIHAFVDYKILKGDQLSEALLDAIEGSLISLIIFSENYASSHWCLFELVKIVECRKKDGQILLPIFYKVDPSNVRYQKGTYGDAFAKHEVRHNLTTMQTWRSALNESANLSGFHSSTFRDEAELVKEIVKCVSLRLNHVHQVNSKGLVGVGKRIAHVESLLQLEATDVRVIGIWGMGGIGEEDLKIDTPNGLPQYVERRLRRIKVLIILDDVNDSEQLEILAGTRDWFGLGSRIIITTRDKQVLAKESANIYEVETLNFDESLRLFNLNAFKEVHLEREYHELSKKVVNYAQGIPLVLKVLGHLLHGKEKEIWESQLERLKKVQSKKVHDIIKLSYNDLDQDEKKIFLDIACFFDGLNLKVNKIKILLKDHDYSVAAGLERLKDKALISVSQENIVTMHNIIQETAWQIARQESIEDPRSQSRLLDPDDVYLVLKYNKGNEAIRSIVINLSGIKQLQLNPQDLVNMRILILHSSTQLKELPDLSKATNLKVMDLRFCVGLTSVHPSVFSLKKLEKLYLGGCFSLRSLRSNIHLDSLRYLSLYGCMSLKYFSVTSKNMVRLNLELTSIKQLPSSIGLQSKLEKLRLAYTYIENLPTSIKHLTKLRHLDVRHCRELRTLPELPPSLETLDARGCVSLETVMFPSTAGEQLKENKKRVAFWNCLKLDEHSLKAIELNAQINMMKFAHQHLSTFGDAHQGTYVYPGSKVPEWLVHKTIQRDYVTIDLSFVLAPHSSDHLGFIFGFVVPEVPNEGLVLEFKISTGGEGEGSNINVYLDRPRHGIKSDHVYLMYDQACSRYLNSRAKHHPRLKIKVTVASRTHTSKYVPLQLRGFGVSTINTTQYLSFVRKVELGDELLPGIREDAEAGTLPANVVAGMEGFYNI

SEQ ID NO: 132736 - protein, 648 aa, Glycine max
  Coding DNA Sequence Number=SeqID_15958
  Gene Ontology: Mol. function=DNA binding; Cellular component=nucleus; Biological process=regulation of transcription
  Homolog annotation: Hit_ID=Q6YZ61; Match level="QueryCoverage=98%, HitCoverage=99%, E-value=4e-73, Identity=32%"; Hit description=MYB transcription factor-like
  Pfam annotation: Domain name=Myb_DNA-binding; Domain location=531 -581; Score=26.3; E_value=0.00011; Accession=PF00249.21; Description =Myb-like DNA-binding domain
METVVGIEDNDDGKFEDSGVDRSSSALSSPKQIANPIVYKLVRVEGDGRLVPATDDEVMEVGDFLEYENSEMHVVANTGQSLECISIERSSSGKLRLECKEGTAEADLGELNAKLQILQKVKEEKQRISCGSPAHSHVNIDSQCSADKFPVIDGKVQSETPCQEIPSIASSLNYTHSNQSGSIDQCSRPSEGVIESGSSASAVYSNLKPDLSMSDGEICLDKLSIRELHELFKVTFGRETTVKDKQWLKRRIAMSLTNSCDVSATTFIIKNNKIVRKFEEESSGNMNAGSLISSGNMTEEEDVNFKDSSAVNACGIEDNQVVSETRPEIGLEDENYQTGQRAAKRIRRPTKRYIEELSENESREHNPRLSISNKPMGLGHVSPTLNVRPARNAFSEVRTYGTRLDSLGGSDVQIPCVSRVRRSRPRKDIASLMKFHPTSMGEAEKLSNKLLEHSSDAGSEFPDKVLKSRMPSKFHQPSSSEPVKEQCPVIGPVELRQELRPKRADPSSHTSDDNNIVTVPTAKGGMRRKHHRAWTLVEVIKLVEGVSRCGAGRWSEIKRLSFASYSYRTSVDLKDKWRNLLKASFALTPAPADEGINLRKHGTAPIPEKILLRVRELAEMNSQVPPNYSSSQLASGGGSVHGDRSGYL

SEQ ID NO: 132737 - protein, 817 aa, Glycine max
  Coding DNA Sequence Number=SeqID_15959
  Gene Ontology: Mol. function=zinc ion binding
  Homolog annotation: Hit_ID=Q1SUW3; Match level="QueryCoverage=98%, HitCoverage=81%, E-value=0.0, Identity=65%"; Hit description=Zinc finger, RING-type; Zinc finger, CHY-type; RINGv
  Pfam annotation: Domain name=Hemerythrin; Domain location=215-276; Score=35.3; E_value=2.2e-07; Accession=PF01814.13; Description =Hemerythrin
  Pfam annotation: Domain name=Hemerythrin; Domain location=286-378; Score=15.4; E_value=0.21; Accession=PF01814.13; Description =Hemerythrin
  Pfam annotation: Domain name=Rubredoxin; Domain location=627-664; Score=-3.5; E_value=0.087; Accession=PF00301.10; Description =Rubredoxin
  Pfam annotation: Domain name=zf-C3HC4; Domain location=691-732; Score= 19.6; E_value=0.0015; Accession=PF00097.15; Description=Zinc finger, C3HC4 type (RING finger)
  Pfam annotation: Domain name=zf-CHY; Domain location=562-639; Score =141.8; E_value=1.8e-39; Accession=PF05495.3; Description=CHY zinc finger
  Pfam annotation: Domain name=zf-MIZ; Domain location=687-735; Score= -4.8; E_value=0.0051; Accession=PF02891.10; Description=MIZ zinc finger
  Pfam annotation: Domain name=zf-RING-like; Domain location=604-650; Score=3.9; E_value=0.052; Accession=PF08746.1; Description=RING-like domain
  Pfam module annotation: Pfam domain module=Hemerythrin::Hemerythrin::R ubredoxin::zf-C3HC4::zf-CHY::zf-MIZ::zf-RING-like; Domain location =215-276::286-378::627-664::691-732::562-639::687-735::604-650
MSELASHSHERPYKRRKYKVVEEEMVLPLARKHFSFRRQCELLYQSLCMMPLKLIERVLPWLVGSLTQDEAKMFQRNMQLAGASGCCPAQRLSDIEENIGWPSCACASALSNSHVLAESGGNNRPVKRNISELHKNEDLPETSEAEDIQKQCCSARPCCVPGLGVSSNNLGLSSLSTAKSLRSLSFSSSAPSLNSSLFIWETESSSCNVGSTQRPIDTIFKFHKAIRKDLEYLDVESGKLSDGDETILRQFNGRFRLLWGLYRAHSNAEDEIVFPALESKEALHNVSHSYMLDHKQEEQLFEDISCVLSEFSVLHEALQMTHMSDNLTESNFGTSDANNSDDIKKYNELATKLQGMCKSIRVTLDQHLFREECELWPLFGRHFTVEEQDKIVGRIIGTTGAEVLQSMLPWVTSALTQDEQNKMMDTWKQATKNTMFNEWLSECWKESPVSTAQTETSDHITSQRGAEYQESLDHNDQMFKPGWKDIFRMNQNELESEIRKVYRDSTLDPRRKAYLVQNLMTSRWIAAQQKSPKALSEGSSNSVEIEGLSPSFRDPGKHVFGCEHYKRNCKLRAACCGKLFTCRFCHDNVRDHSMDRKATSEMMCMRCLNIQPIGPLCITPSCNGFSMAKYYCNICKFFDDERNVYHCPFCNLCRVGQGLGIDYFHCMKCNCCLGIKSSSHKCLEKGLEMNCPICCDDLFTSSATVRALPCGHYMHSACFQAYTCSHYTCPICSKSLGDMAVYFGMLDALLAAEELPEEYKDRTYSAMTVIGRALHASTGCTTNVDFVALTIPGLSNVRRQIPAALSVLLLSGGRQSW

SEQ ID NO: 132738 - protein, 215 aa, Glycine max
  Coding DNA Sequence Number=SeqID_15960
PPRFSFSHDVVSELQKQQDVPRKDTMLLESNHDFEFSTSRRSLEFESSSADELFSNGVIVPIQMQKKRNTTRKHTLYGEAPYMRLPPLPSSVDKIKKESTREVLHDKKTYSTSFWGFSRSKSLSCDTKKSLMCYSPPLSRSNSAGSVPQPKRVSSTGHQAKPLSSSSSSTLNLYPIQRSHSSKSYGGSYANGLWISPVLNLPTPCISKGSGTSLF

SEQ ID NO: 132739 - protein, 121 aa, Glycine max
  Coding DNA Sequence Number=SeqID_15961
  Subcellular localization annotation: CTP_CleavageSite=68; ConfidenceScore=5.20e-01
HPVDPEEPNKALGFPALVTGLCQSYRVPVPPSKGSRPQDTQWTLRSPTSKVIRPLTNRAFIKKYCAPRQAQGETPQQPGDGRQRATDAPPTPPKAPQLIYKSWSIAYEPWSTSRRPSPKPK

SEQ ID NO: 132740 - protein, 142 aa, Glycine max
  Coding DNA Sequence Number=SeqID_15962
MNFAARKPVEFTPIPVSYADLLPYLLDNSMVAITLVKVHQPPFLPEYDSNATCACHGEAPGHSIEHCRALKRKVQVTMLNEMDKVDIFVPHPLINASLLIQLSPECGCKPLVCLLKRPVLLSLDFQDRSIRDYSSCALVGLP

SEQ ID NO: 132741 - protein, 61 aa, Glycine max
  Coding DNA Sequence Number=SeqID_15963
MTGLVIILSGRDNLTQPVICNRVGNPNCLTQEMARSRRNHHGGWRAAPSTTSAGPNNTTLL

SEQ ID NO: 132742 - protein, 76 aa, Glycine max
  Coding DNA Sequence Number=SeqID_15964
MEADDDGSTAIIMHRWRWKKLRCGRSIYGMREGDEREKLADVFLASSPQSIISNFFFLGLRPLSKKCIKCSFDLEL

SEQ ID NO: 132743 - protein, 85 aa, Glycine max
  Coding DNA Sequence Number=SeqID_15965
MSEVSDYVCEFDWPESGDACRFWALFVHGDALDFQVSMLIFNISRGNLEEKQEREGGKENGNERDKNIRKKEESRPYSGRWLMKL

SEQ ID NO: 132744 - protein, 198 aa, Glycine max
  Coding DNA Sequence Number=SeqID_15966
  Gene Ontology: Mol. function=transcription factor activity; Cellular component=nucleus; Biological process=regulation of transcription, DNA-dependent
  Homolog annotation: Hit_ID=Q3L8J2; Match level="QueryCoverage=96%, HitCoverage=87%, E-value=6e-47, Identity=48%"; Hit description=CBF -like transcription factor
  Pfam annotation: Domain name=AP2; Domain location=21-85; Score=122.1; E_value=1.6e-33; Accession=PF00847.10; Description=AP2 domain
AGVLISHKRKAGRKKFRETRHPVYRGVRQRNGNRWVCEVREPNKKSRIWLGTYPTPEMAARAHDVAVLALKGTSALFNFPDSVSLLPVAKSSSAADVRVAASKVSTIFCPSYSSVTLSSSSPSNSRVKAKPCLIDDFVKTENNVDEAKSVFFDEEAFYNMPLLLDSMAEGLLITPPSMKRVFDWDQVDCEIDLTLWTD

SEQ ID NO: 132745 - protein, 184 aa, Glycine max
  Coding DNA Sequence Number=SeqID_15967
  Homolog annotation: Hit_ID=Q53PY3; Match level="QueryCoverage=52%, HitCoverage=85%, E-value=4e-24, Identity=52%"; Hit description =Expressed protein
  Pfam annotation: Domain name=Dabb; Domain location=83-177; Score =74.8; E_value=2.7e-19; Accession=PF07876.3; Description=Stress responsive AB Barrel Domain
MRPIITQTCLWMVTPMTPFMCHTTMARDNFHYGMERSCTILVGLKAAMQGVSWGSDNEQKIKTSRLVVTSFGSRVSWLAMGEFKHFVIVKFKEGVAVDELTKGMEKLVTEIGAVKSFEWGQDIESLDVLRQGFTHAFLMTFNKKEDFVAFQSHPNHVEFSTKFSAAIENIVLLDFPSTLVKAPA

SEQ ID NO: 132746 - protein, 75 aa, Glycine max
  Coding DNA Sequence Number=SeqID_15968
MAGHDWPLDFLFPTYRYIGTDASGDRVTTDRSLPLPGAKQAENVAARQPSSSGQTLTHKEGGDMVNVPLKEKSTG

SEQ ID NO: 132747 - protein, 89 aa, Glycine max
  Coding DNA Sequence Number=SeqID_15969
  Subcellular localization annotation: CTP_CleavageSite=18; ConfidenceScore=5.39e-01
MWFASRRPTTTDRCSCMSASTDSASASRVRVPPLLYALPQSSSELRSHGLETAPMLRQGQDLQGPPEPRMKPKKMKTWLTYSTSREEAD

SEQ ID NO: 132748 - protein, 105 aa, Glycine max
  Coding DNA Sequence Number=SeqID_15970
MLTSPERVQTTTLVFACQSDFGSPNDEVQITVRRLRMLPDSRVTIAGWVSDSSLLGDPIVPSSEGKDGNSHPGSRFMVSWDFGSRLVEWSDMIYVRALVWLAVHG

SEQ ID NO: 132749 - protein, 136 aa, Glycine max
  Coding DNA Sequence Number=SeqID_15971
  Gene Ontology: Mol. function=nucleic acid binding
MDYLTPTLGETNTILLLALLEGVTFDFKHGFLHMLENNLFSGVAYEDPMQHLSKFIKLTNMVRKNYVAVKYIRLYAFPFSLNEKAWDWLCSLPKNGITTWNQCKSAFLRKYFSPIKIDQYIKDNGNFVQRKQKSLP

SEQ ID NO: 132750 - protein, 95 aa, Glycine max
  Coding DNA Sequence Number=SeqID_15972
  Homolog annotation: Hit_ID=Q1SKD7; Match level="QueryCoverage=98%, HitCoverage=25%, E-value=1e-08, Identity=31%"; Hit description =Ankyrin
MAPKKLSTKRSRKDTSGEGSSAAQDFDSHRFWSAEHQQHFEAIKGWSFLRERRVQLRNDEHTDFQEEVARRRWTQLVSPVAKFDPKIVMEFYANA

SEQ ID NO: 132751 - protein, 336 aa, Glycine max
  Coding DNA Sequence Number=SeqID_15973
  Gene Ontology: Mol. function=DNA binding
  Homolog annotation: Hit_ID=Q1S0F5; Match level="QueryCoverage=56%, HitCoverage=56%, E-value=3e-19, Identity=27%"; Hit description=IMP dehydrogenase/GMP reductase
QQAFRKAYGKIWDLAMIEVSTKAIASLIQYYDQPLRCFTFEDFQLVPTVEEFEGILGCPLEGRKPYLFSGFYPSIKCLEERARDLASQNKWPPFIDILALLIFGVVLFPNVDGLVDLVAIDAFLAFHHNKESPVVAVLADIYNTFNQREANWDQLLPSIEGVSVNWFPRWGCINYNPILAIRQLGYLTRGEPLVESLTPFVTRGFSDPTQGCFKESTRRGRAYTRGLDWLPNLRAAKEEGVEAPEESEEQLSETEANMLAIIGKYKEELDLATAHEHKVADEYAQVYAEKEARGRSRSSPITSKGQGDGRRVLSPRGNPWAPQLLPTYDRLDGPYN

SEQ ID NO: 132752 - protein, 551 aa, Glycine max
  Coding DNA Sequence Number=SeqID_15974
  Gene Ontology: Mol. function=helicase activity; Cellular component =nucleus; Biological process=transcription termination from RNA polymerase II promoter
  Homolog annotation: Hit_ID=Q1SF68; Match level="QueryCoverage=99%, HitCoverage=38%, E-value=0.0, Identity=88%"; Hit description=AAA ATPase; DEAD/DEAH box helicase, N-terminal
MKVYRPDVARVGVDSQTRAAQAVSVERRTEQLLVKSREEIMGWMHQLKNREAQLVQQLHGLHRELNATAAAVRSQGSVGVDPDLLMARDQNRDALLQHLAAVVENRDKVLVEMSRLALLESRFRPGSGFNLEEARASLEASFANEAEVVFTTVSSSGRKLFSRLSHGFDMVVIDEAAQASEVAILPPLSLGAARCVLVGDPQQLPATVISKAAGTLMYSRSLFERFQQAGCPTMLLSVQYRMHPQIRDFPSRYFYQGRLTDSESVAKLPDEPYYKDPLLRPYIFYDIRHGRESHRGGSVSYQNIHEAQFCLRLYEHVQKTVKSLGVGKITVGIITPYKLQLKCLQREFDEVLNSEEGKDLYINTVDAFQGQERDVIIMSCVRASSHGVGFVADIRRMNVALTRARRALWVMGNANALLQSEDWAALINDAKSRNCYMDMDSLPKDFLVSKAPSYTSLPGKPSSNMRGMRSGGPRYRSMDMHMESRLGPPSEEDENMGAPVSSRNGNLRQSRYSMENSLDDFEHGGDKSRDAWQYGIQKKQNSSGSMGKRDV

SEQ ID NO: 132753 - protein, 32 aa, Glycine max
  Coding DNA Sequence Number=SeqID_15975
MVAGVNSCGGGGVARTIWWLRVREENDDNKEK

SEQ ID NO: 132754 - protein, 87 aa, Glycine max
  Coding DNA Sequence Number=SeqID_15976
  Subcellular localization annotation: CTP_CleavageSite=56; ConfidenceScore=5.18e-01
MGKDSGPASRLEHQKQPETKTNTENSQSQYSSNHPMLVHTNPPSKRTPPFNNQMTRRPMKQSTTQSHKTVLNFHNSKAQIRTLKPNQ

SEQ ID NO: 132755 - protein, 761 aa, Glycine max
  Coding DNA Sequence Number=SeqID_15977
  Gene Ontology: Mol. function=helicase activity
  Homolog annotation: Hit_ID=Q1SF68; Match level="QueryCoverage=100%, HitCoverage=55%, E-value=1e-164, Identity=72%"; Hit description=AAA ATPase; DEAD/DEAH box helicase, N-terminal
MGSRGRPLFDLNEPPAEDNDEREGIVCFQPQKAHPSTNPHASDLFATSSAAQGIVNNNAFSHASSVSGFQPFVRPKSTGVPELDAESKRAGDQDAKVSSKDEDVNVMDSRILSSANAQFTEREEGEWSDEEGGFANANGGNNANANGGNNAIANGGSSLPRQSQASEEPATSGMVDGCVAVASDSKSRNIKSSDSINDEKSSHASIGLESNSSEQKSNSIPNSESNIKSEASVDAQEEPPLIPKPKEVKGIEASHALRCANNPVKRKIDQRKEEMLGKKRNRQTMFLNLEDVKQAGPIKTSTPRRQTFSSPVISRIKEVRTVPAQVERVGIAKDQRLTDTSSGEGGNYAEAQEPKSDCNGDTSGPPVRSRRLNSETEPPTEANLPPPIPRQGSWKQLSDSRQQKNVLHSNRKSGLSGQSSNDVKLGNKKHLSIKKQAPVSSQPQDTSVERLIREVTSEKFWHHPEETELQCVPGRFESVEEYVRVFEPLLFEECRAQLYSTWEESTETVSRDTHIMVRVKANESRERGWYDVKVLPVHEFKWSFKEGDVAILSSPRPGSVRSKQNSSSLAQDDGESEVTGRVVGTVRRHIPIDTRDPPGAILHYYVGDSYDPSRQVFVQTFPLKGSFNDCVEMVDDDHIIRKLQAGSIWYLTVLGSLATTQREYIALHAFRRLNLQMQTAILQPSPEHFPKYEQQTPAMPECFTQNFVEYLHRTFNEPQLAAIQWAAMHTAAGTSSGTTKRQEPWPFTLVQGPPGTGKTHT

SEQ ID NO: 132756 - protein, 137 aa, Glycine max
  Coding DNA Sequence Number=SeqID_15978
MVEEQRRKKSEERNATQREEWEVGGGSRSCYDSSQRSSNSFMDELNVVPESREAIGGGLYKLHHTLPLNVSEYILQALKPRLKHNSCMYTPPRQLRSKEGREESFVPRIRRRHLYSLELKLMIMILQPPIDLIGTDL

SEQ ID NO: 132757 - protein, 302 aa, Glycine max
  Coding DNA Sequence Number=SeqID_15979
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=88%, HitCoverage=59%, E-value=1e-116, Identity=73%"; Hit description =Protein kinase like protein
  Pfam annotation: Domain name=Pkinase; Domain location=1-260; Score =59.7; E_value=9.4e-15; Accession=PF00069.15; Description=Protein kinase domain
  Pfam annotation: Domain name=Pkinase_Tyr; Domain location=1-249; Score=-160.1; E_value=0.012; Accession=PF07714.7; Description =Protein tyrosine kinase
  Pfam module annotation: Pfam domain module=Pkinase::Pkinase_Tyr; Domain location=1-260::1-249
MKHESDGNFIQVPSLSSPVTDPDPDPIVIVIDLRTFYASEVLVALEYLHMMGIVYRDLKPENVLVRSDGHIMLTDFDLSLKCDDSTSTPQIILDQKNTPHKDPRVDPSQSQFTSSSCILPSCIVPAVSCFHPKRKRKKKQAQHNGPEFVAEPIDVRSMSFVGTHEYLAPEIVSGEGHGSAVDWWTLGIFIFELFYGVTPFRGMDNELTLANIVARALEFPKEPSVPPTAKDLISQLLVKDPSRRLGSTMGASSIKHHPFFQGVNWALLRCTPPPFVPPHYIKEAVSSHHEIETCPQTPIDYY

SEQ ID NO: 132758 - protein, 179 aa, Glycine max
  Coding DNA Sequence Number=SeqID_15980
  Homolog annotation: Hit_ID=Q9SZ53; Match level="QueryCoverage=16%, HitCoverage=8%, E-value=5e-07, Identity=86%"; Hit description =Protein phosphatase 2C-like protein
MGLGNRPCIQCNLFKKPKRRIQYSSALLLGFSQFQIFLPLQPSITGACERIPVVVARVESQGGCEGQVVLVGVVAVLVEPRLCFACAFVFLCSERRRCWIQNDIGHAFVFLNSGAHKVLRDLNFSTTDPVALMLGMSLKNVVFEFLFIVKAYNLSRDHKPDLEIKKERILKGGGFIHAS

SEQ ID NO: 132759 - protein, 216 aa, Glycine max
  Coding DNA Sequence Number=SeqID_15981
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=82%, HitCoverage=38%, E-value=5e-43, Identity=56%"; Hit description =Protein kinase like protein
MMIPDGGFREAFVGLALAEDVEVAAGAELGEEAEPFGGVDGGVEGGEEGVVEGFEDFPLGLGSSFLAAAGQLLLVHHLGGEHHGEGPVVEFGEVDGADVAGAETAGEAEVGGEDAAAGGLRSDPVDGGPAWVGGGSVGLAVGGEVGGGGGGESGGFGAEAGAPLDVRGGGGGEAKTLEVGLEMRKVKQTGFPLSLIPLIPIGPNGTATFAFALLDI

SEQ ID NO: 132760 - protein, 259 aa, Glycine max
  Coding DNA Sequence Number=SeqID_15982
  Gene Ontology: Mol. function=catalytic activity; Biological process =protein amino acid phosphorylation
  Homolog annotation: Hit_ID=Q75HB0; Match level="QueryCoverage=93%, HitCoverage=65%, E-value=4e-77, Identity=58%"; Hit description =Expressed protein
  Pfam annotation: Domain name=DUF860; Domain location=1-251; Score =181.3; E_value=2.4e-51; Accession=PF05898.4; Description=Plant specific of unknown function (DUF860)
MEPLLVTNLRKLLMLCVDCRVPLETVELLGPELGLPSDFKDCLVPKYPQFFAVRRFRGRDSLALEDWDSTLALTARESRLAQEGVVNLKADGNRRKVKISRDGNYLGPFAFKMNFPAGFRPNVGYLEQLERWQKLEFPSPYLNARRFDAADPKARKRAVAVIHELLSLTMEKRMTSLQLDAFHAECLLPSNLLLCLIKHQGIFYLTNKGVRSTVFLKDAYLGSNLIDKCPLLQFYDKFMALCGRGNIDLCDNNSLTMVV

SEQ ID NO: 132761 - protein, 588 aa, Glycine max
  Coding DNA Sequence Number=SeqID_15983
  Gene Ontology: Mol. function=oxidoreductase activity; Cellular component=integral to membrane; Biological process=potassium ion transport
  Homolog annotation: Hit_ID=Q9ZUX0; Match level="QueryCoverage=70%, HitCoverage=88%, E-value=1e-160, Identity=76%"; Hit description =Expressed protein
  Pfam annotation: Domain name=Aldo_ket_red; Domain location=103-416; Score=211.6; E_value=1.8e-60; Accession=PF00248.11; Description =Aldoketo reductase family
PPPPSPILRLHALQLYFERLAAAKERLKLCSTSGGWGRIDRDDAVEAMLRYADAGLTTFDMADHCTFSSYSQLLLLTWSFPIGLLFLLPPLLPDNRSIAVKNGNDSLVICRVVNGMWQTSGGWGRIDRDDAVDAMLKYADAGLTTFDLADIYGPAEDLYGIFIDRVRRERPPELLEQVRGLTKWVPPPVKMTSSYVRDSINVSRKRMDVESLDMLQFHWWDYSNPGYLDALKHLTDLKEEGKIKTVALTNFDTERLQIILENEIPVVSNQVQHSLVDMRPQQRMAELCQHTGVKLITYGTVMGGLLSEKFLDTNISIPFAGPAINTPSLQKYKRMVDAWGGWSLFQGLLRTLKQVASKHGVSIATVGVKYILDQPAVAGSMVGVRLGLAEHIQDTNAIFSLVLDEDDMNSIREATAKGKDLLKVIGDCGDEYRRDKGKVFEPNFVSVEEFYWNNEDIIVVDSSASHGINIHQISESGEVPSSNDNEGINGANNIREVNRGERVIGAVEIGARERNDEVLAHIRVGNGVSLAELVGGDEADVDGVGDGGGRQRAASCRRASRGECGAPRRVRDIDDVHSEKRNGIDLEE

SEQ ID NO: 132762 - protein, 152 aa, Glycine max
  Coding DNA Sequence Number=SeqID_15984
  Gene Ontology: Mol. function=structural constituent of ribosome; Cellular component=intracellular; Biological process=translational elongation
  Homolog annotation: Hit_ID=Q8H2B9; Match level="QueryCoverage=71%, HitCoverage=99%, E-value=3e-12, Identity=41%"; Hit description=60s acidic ribosomal protein
  Pfam annotation: Domain name=Ribosomal_60s; Domain location=58-151; Score=114.8; E_value=2.4e-31; Accession=PF00428.9; Description=60s Acidic ribosomal protein
MDETPRAENPSYILCLSTPAPLVSLCTNPNTKTRSEIAIAIQRVVAAYLLAVLGGNPSPSADDIKHILGAVGAEAENELIELLLTEVKGKDFNELIASGSEKMSAVSGGGAAVAVAAAPAGGAAAPAAEAKEEKKVEEKEESDDDMGFSLFD

SEQ ID NO: 132763 - protein, 643 aa, Glycine max
  Coding DNA Sequence Number=SeqID_15985
  Gene Ontology: Mol. function=peptidyl-prolyl cis-trans isomerase activity; Cellular component=spliceosome; Biological process=protein folding
  Homolog annotation: Hit_ID=Q9LXM7; Match level="QueryCoverage=96%, HitCoverage=95%, E-value=0.0, Identity=78%"; Hit description =Peptidyl-prolyl cis-trans isomerase
  Pfam annotation: Domain name=Pro_isomerase; Domain location=489-641; Score=259.8; E_value=5.7e-75; Accession=PF00160.11; Description =Cyclophilin type peptidyl-prolyl cis-
  Pfam annotation: Domain name=WD40; Domain location=189-227; Score =3.2; E_value=15; Accession=PF00400.22; Description=WD domain, G-beta repeat
  Pfam annotation: Domain name=WD40; Domain location=245-283; Score =0.4; E_value=32; Accession=PF00400.22; Description=WD domain, G-beta repeat
  Pfam annotation: Domain name=WD40; Domain location=56-93; Score=23.1; E_value=0.001; Accession=PF00400.22; Description=WD domain, G-beta repeat
  Pfam annotation: Domain name=WD40; Domain location=99-137; Score =22.6; E_value=0.0014; Accession=PF00400.22; Description=WD domain, G- beta repeat
  Pfam module annotation: Pfam domain module=Pro_isomerase::WD40::WD40:: WD40::WD40; Domain location=489-641::189-227::245-283::56-93::99-137
LIQFKVLLRLKMTEEHENGANASEEEQVIGPGPAPRARPKRPLQFEHAYLDALPSANMYEKSYMHRDVVTHVAVSAAEFFITGSADGHLKFWKKRPIGIEFAKHFRSHLGPIEGLAVSIDGLLCCTISNDRSVKIYDVVNFDMMVMIRLPYVPGAVEWVYKQGDVKARLAISDRNSSFVHIYDARAGTNDPIISKEIHMGPIKVMKYNPVCDSVLSADAKGIIEYWSPATLQFPENVVDFKLKSDTNLFEIAKCKTSVSAIEVSPDGKQFSITSPDRRIRVFWFSTGKLRRVYDESLEVAQDLQRSDAPLYRLEAIDFGRRMAVEKEIEKTESALLPNAVFDESSNFLIYATLLGIKVENNDRFLRIALYQGDRNSKKVRKIPSAAANANESKEPLTDPTLLCCAFKKHRIYLFSRREPEEPEDATKGRDVFNEKPPADELLAVSDIGKSVTTSLPDNVAISNYVLWSGPGLDLDLPQPSHDDPGLLEQDILHTTMGDIHMKLYPEECPKTVENFTTHCRNGYYDNLIFHRVIKGFMIQTGDPLGDGTGGQSIWGREFEDEFHKSLRHDRPFTVSMANAGQNTNGSQFFITTVATPWLDNKHTVFGRVAKGMDVVQAIEKVKTDRTDKPHQDVKILNVTVPKS

SEQ ID NO: 132764 - protein, 576 aa, Glycine max
  Coding DNA Sequence Number=SeqID_15986
  Gene Ontology: Mol. function=transcription factor activity; Cellular component=nucleus; Biological process=regulation of transcription, DNA-dependent
  Homolog annotation: Hit_ID=Q1SF87; Match level="QueryCoverage=99%, HitCoverage=100%, E-value=0.0, Identity=71%"; Hit description =Pathogenesis-related transcriptional factor and ERF
  Pfam annotation: Domain name=AP2; Domain location=245-315; Score =111.6; E_value=2.3e-30; Accession=PF00847.10; Description=AP2 domain
  Pfam annotation: Domain name=AP2; Domain location=344-409; Score =128.3; E_value=2.1e-35; Accession=PF00847.10; Description=AP2 domain
  Pfam module annotation: Pfam domain module=AP2::AP2; Domain location =245-315::344-409
MSNWLGFSLTPHLRIDEEFERENQERGAGGGGGYHHPSPSSHPHLSVMPLRSDGSLCVADSFSHSAASQEWRYDSAIGGGNSNEKGPKLEDFLGGYSNSPTKVFCQDTQHDQNQSQNNVSKINVNVAPSFCTNAEIETGESLANPYPHQSFHAYNDNSHALIPTNGMYKSWLAQTQFSSDGKPSTEANGCNFQSLSLSMSPGMQNGVGAISSVQVSEDSRKRVMAKSHAREPVPRKSIDTFGQRTSQYRGVTRHRWTGRYEAHLWDNSCRKEGQTRKGRQGGYDKEEKAAKAYDLAAIKYWGPTTHINFPLSTYEKELEEMKHMTRQEFVANLRRKSSGFSRGASVYRGVTRHHQHGRWQARIGRVAGNKDLYLGTFSTQEEAAEAYDIAAIKFRGTSAVTNFDISRYDVKRICSSSTLIAGDLAKRSPKESPALVPAEDFNSCGSSMPPASQPPPLAITDGEHSDELSNMMWNANSDVHAQNENGANINNNVTESSSQQVSPSSNKDALNPQSPKCSVGLPNEFGVSGADYGHGYFTLDGPKYDDGNNENDHMSTNRLGNLGLVNQVPMFALWNE

SEQ ID NO: 132765 - protein, 62 aa, Glycine max
  Coding DNA Sequence Number=SeqID_15987
  Gene Ontology: Cellular component=cytoplasm; Biological process =autophagic vacuole formation
  Homolog annotation: Hit_ID=Q1SF86; Match level="QueryCoverage=82%, HitCoverage=51%, E-value=1e-17, Identity=86%"; Hit description =Autophagy protein Apg12
  Pfam annotation: Domain name=APG12; Domain location=1-61; Score=11.8; E_value=7.7e-06; Accession=PF04110.4; Description=Autophagy protein Apg12
MQIAGTDKFAKVIDFLRRQLHRETLFVYVNSAFSPNPDELVIDLFNLRKNFSFMPDCMCLGQ

SEQ ID NO: 132766 - protein, 100 aa, Glycine max
  Coding DNA Sequence Number=SeqID_15988
  Subcellular localization annotation: CTP_CleavageSite=30; ConfidenceScore=5.18e-01
MRISVTSSDSDAPIPLSGRRGRAMTMKDTRAESTTGSSLASEASRTKMATTKYAGGMRGRHFATRLERRVAAVAMQWHDVVGVAVYESWPSGAVALRNWR

SEQ ID NO: 132767 - protein, 286 aa, Glycine max
  Coding DNA Sequence Number=SeqID_15989
  Gene Ontology: Mol. function=DNA binding; Cellular component=nucleus; Biological process=regulation of transcription
  Homolog annotation: Hit_ID=Q2LME9; Match level="QueryCoverage=77%, HitCoverage=82%, E-value=3e-60, Identity=54%"; Hit description=MYB11
  Pfam annotation: Domain name=Myb_DNA-binding; Domain location=14-61; Score=45.3; E_value=2.1e-10; Accession=PF00249.21; Description=Myb -like DNA-binding domain
  Pfam annotation: Domain name=Myb_DNA-binding; Domain location=67-112; Score=45.7; E_value=1.6e-10; Accession=PF00249.21; Description=Myb -like DNA-binding domain
  Pfam module annotation: Pfam domain module=Myb_DNA-binding::Myb_DNA -binding; Domain location=14-61::67-112
MRRSPCCSKEGLNKGAWTALEDKILTEYINIHGEGKWRHLPKRAGLKRCGKSCRLRWLNYLRPDIKRGNITNDEEALIIRLHSLLGNRWSLIAGRLPGRTDNEIKNYWNTNIGRKLQNGGAGSTLNTNIQQDQNVKDQEWHYDKGSCLVQTKATTWTNKVTVTNEISRHNEGIIIKSNVIGDNKMKGFLLSPSKESNNDPVLDFMADLEMDGNFFSELIEMDLPESSCQENKILEDNGNPIMVDKVYLSPKSSSDTIHYPWGDSWYDTNFDFLPVTIFMESGFDWL

SEQ ID NO: 132768 - protein, 400 aa, Glycine max
  Coding DNA Sequence Number=SeqID_15990
  Gene Ontology: Mol. function=drug transporter activity; Cellular component=membrane; Biological process=multidrug transport
  Homolog annotation: Hit_ID=Q680B9; Match level="QueryCoverage=96%, HitCoverage=75%, E-value=1e-114, Identity=52%"; Hit description=MRNA, complete cds, clone: RAFL22-63-F13
MEHSKKKKKKKGSQNPEAKFQFELNTCSKAKDLRGAISLYDDAVSNNTRLNQHHFNALLYLCSNSVADPSLKPTALDYGFRAFCHMSALAVLPNEATVTAVARLAAAKGDADYAFDLVKSMGKNYNNALPRLRTYDPALFCFCEMLDADKAYEVEEHMSGVGVSLEEAEVAALLKVSARCGRADKVYEYLHKLRSSVRCVSESSAVVIEEWFRGSKSSEVGEVEFEAGQVKEGVLRNGGGWHGQGWVGKGDWVVSRTSVGADGHCCCCGEQLVCVDIDDAEREKFAGSVAALAFEREVKANFSEFQAWLEKHASYEAIVDGANIGLYQQNFADGGFSISQVLDDVVKELYNRSGKKWPLVVLHNKRLRGLMENPSSRRLVEEWMNNGALYTTPNGSNDDW

SEQ ID NO: 132769 - protein, 510 aa, Glycine max
  Coding DNA Sequence Number=SeqID_15991
  Gene Ontology: Mol. function=phosphoric monoester hydrolase activity; Cellular component=endoplasmic reticulum; Biological process =metabolic process
  Homolog annotation: Hit_ID=Q9XGY7; Match level="QueryCoverage=99%, HitCoverage=98%, E-value=1e-151, Identity=52%"; Hit description=Acyl CoA reductase
  Pfam annotation: Domain name=Epimerase; Domain location=15-357; Score= -40.5; E_value=0.0016; Accession=PF01370.11; Description=NAD dependent epimerasedehydratase family
  Pfam annotation: Domain name=NAD_binding_4; Domain location=17-338; Score=338.1; E_value=1.5e-98; Accession=PF07993.2; Description=Male sterility protein
  Pfam annotation: Domain name=Sterile; Domain location=410-510; Score =74.5; E_value=3.3e-19; Accession=PF03015.9; Description=Male sterility protein
  Pfam module annotation: Pfam domain module=Epimerase::NAD_binding _4::Sterile; Domain location=15-357::17-338::410-510
MELGSIMHFLQDKTILVTGATGFLAKIFVEKILRVQPNVKKLYLLLRARDTESATQRLHTEIIGKDLFRLLKEKLGTRFNSFVSEKLAVVPGDISQEDLNLEDPILGEEIFNQTDVIVNLAATTNFDERYDIALSINTLGVLHVLSFAKKCVKLKVLIHVSTDANFASRLLQQVIILGSRVSSYVCGEREGLILEAPHHFGVSLNGVPGPDIDMEKKKVEDKLNQLREEGAIEHDIELAMKDLGTQRATMYGWPNTYVFTKAMGEMLVGTTKGNMNVVIVRPTMVTSTYKEPFPGWIEGLRTIDSIVVAYGKGKLVCFLANLEAVFDVIPADMVVNAMLVAMVAHANQPSDIIYHVGSSVVNPVMYLNLRDYSVRYFTEKPWINRDGKPVKVGKFTILRNMDSFRKYMYIRYLLPLKGLELVNAASCQYFQKMYLDFNRKIRTVLRLVELYKPYLFFNGVFDNTNTEKLLSSARQGGVETELFYFDTKMIDWEDYFINIHFPGIIKYAFK

SEQ ID NO: 132770 - protein, 142 aa, Glycine max
  Coding DNA Sequence Number=SeqID_15992
VHYTFVKGNLKLQMPPSYSLVIQIIEEGMKNRNAKEATILFPSKAPTDNTPMPVCPQLYSLKRESEKGYWHVPLAPGTSCESTRCWLCITRPCGHDVVATVSNGVSSLDSQVDENNATSVTEVVWGVSVMVPKRVVVIVADT

SEQ ID NO: 132771 - protein, 174 aa, Glycine max
  Coding DNA Sequence Number=SeqID_15993
  Homolog annotation: Hit_ID=Q1SF89; Match level="QueryCoverage=25%, HitCoverage=27%, E-value=3e-13, Identity=86%"; Hit description =Extensin protein-like-related
  Subcellular localization annotation: CTP_CleavageSite=36; ConfidenceScore=5.06e-01
MTGPKIPLFQPHHSPKLGQPLKPAYTFSLSIAFPLPISEKTQNGNNGAELAPPAYWVSSPPLPPPPPPPPPPLSLSPPPPPSKSMTLSFVPPPGAPPPYPNNMPNVRRPPHRRRRHRRPPPPPPPPPPHKMNAGKKVGLLFVGIAAIMQVGVVGFLVIKRRQLLKSDDRYESCS

SEQ ID NO: 132772 - protein, 77 aa, Glycine max
  Coding DNA Sequence Number=SeqID_15994
MTLLFSNFLPKDLNANFPLKKYQWFCFIPTGGSHPQDTQGTGKSPTGPGGFQFGLGAFIIHTGCPSPPPPRQGHVII

SEQ ID NO: 132773 - protein, 89 aa, Glycine max
  Coding DNA Sequence Number=SeqID_15995
  Gene Ontology: Mol. function=protein serine/threonine kinase activity; Cellular component=membrane; Biological process=protein amino acid phosphorylation
  Homolog annotation: Hit_ID=Q94KG4; Match level="QueryCoverage=76%, HitCoverage=40%, E-value=9e-23, Identity=75%"; Hit description=Pto -like kinase SG2
MELQQRIIIIIITIAMLSAKYPLIIQQDVGGFQVMVDDCVLRTCVEIMQPACDADANLQALLPQEMCVIGVLEMLAEGATRHEIIVKDH

SEQ ID NO: 132774 - protein, 107 aa, Glycine max
  Coding DNA Sequence Number=SeqID_15996
MTHMKKTGQMMSEAAKEIVEKIDSLEEQASQGSFVAHGRQDVLTATIGRLEHPGRVRAVGVGVTIKQYFRPAPRTSRTSSSIAPKDLEQLTQQIRDQLEESITDKVT

SEQ ID NO: 132775 - protein, 45 aa, Glycine max
  Coding DNA Sequence Number=SeqID_15997
PFAKRKPCAKRISVHVLSRESQALSAQPLHLRLIWSTKLAKVELS

SEQ ID NO: 132776 - protein, 175 aa, Glycine max
  Coding DNA Sequence Number=SeqID_15998
MVLQGRTISIDHHIDSSTVDVSDIPPFTKDMSLINDEEPQDNMITKGDDKGDDKKLKGQSKNEFKIFKIESRTFQDSRRKLNSRIKNQDSRDQDSRIKRRPNQDKYEQMITKDDDKGDDKKLKGQSKNEFKIFKIESRTLQDSRGKLNSRIKNQDSRIKRRPNQDKYEKVFSKLE

SEQ ID NO: 132777 - protein, 49 aa, Glycine max
  Coding DNA Sequence Number=SeqID_15999
MAQAVSVGVESGRGKGLGMFWDDLEAMKGNSIEILKFCRTRVHYPCRVQ

SEQ ID NO: 132778 - protein, 107 aa, Glycine max
  Coding DNA Sequence Number=SeqID_16000
MDYLTTTLGDTNTILKHVFLQILENNLFSGASHEDPAQHLRKFIKFINTVRQNRVSIEYPMGPKSTLRLMRIIELSSASLAQSSWSLLAMALVMGPFFGRIASSPHS

SEQ ID NO: 132779 - protein, 173 aa, Glycine max
  Coding DNA Sequence Number=SeqID_16001
MGKLDHLKERLRAIEGGEDYAFANLEELFLVPNIITLPKFKVPDFDKYKGTTCPKNHLKMCCRKMGAYAKDEKLLKHFSQESLIGTTVTWYTNLGTFLSPFLEGPNGFLRRQCQYNSDMAPDKMQLQNMCKKGARIFQRIRPKMENLGNLSGTSNDGERDDLNNSRHITSVLL

SEQ ID NO: 132780 - protein, 102 aa, Glycine max
  Coding DNA Sequence Number=SeqID_16002
MKADMKAMKEQMATMMEAMMSLNPIYGGQRFGKYGRPHNVKIQNKHAFPPYGSPPKEDVNNYTPILIESQQPQSDHAHVSQPMGETHGMPHHNLVDFEPCLG

SEQ ID NO: 132781 - protein, 140 aa, Glycine max
  Coding DNA Sequence Number=SeqID_16003
MDTLRLFPWLMVRTTLHLRVEEKEDSSPKATNVILTEKDQASKKVEVSTDGNSMQNKEGHKKKKDIGISSGIIDLKPTNISLHLVDCSVIYPSGAIEDVLVKVDKFIFPTDFVILDIMVDEDVPIILGRHFLSTCDLNVE

SEQ ID NO: 132782 - protein, 165 aa, Glycine max
  Coding DNA Sequence Number=SeqID_16004
MIPVKRKGKGIKSNALYRCCMGSSWAAPPNMLFSNICRCGRNDFQDYFDDAKESRVKQVPKNLESKSFKNQVSRFKIQDSRTIKFQESRFKNNQDQDSRLKIQESREDSIKISTKFVFSKTLSSTRIFHKIFHQRVLLSCNRLPEGSNRLPVVSIVFKTDLQSCN

SEQ ID NO: 132783 - protein, 76 aa, Glycine max
  Coding DNA Sequence Number=SeqID_16005
MKKKNLLKIEVYLGKSGPEVIARSPSGLQSSLSSVDGCSGQWAWLKHCSWVMKNVGLGDIRLKGCRPDDLPEIVEG

SEQ ID NO: 132784 - protein, 111 aa, Glycine max
  Coding DNA Sequence Number=SeqID_16006
MIRSCPHNGITEQRLVHGGVSSHNKMSLDVACGGNLMLNLFAYAIKIIKDMCSNPYNNSWDEMIMKRGINQLEPNPKREDTLIKEDQAPEKIEVPTDGNPVPKNEGDIDIS

SEQ ID NO: 132785 - protein, 64 aa, Glycine max
  Coding DNA Sequence Number=SeqID_16007
MKRALCYANDGNQQGRSPSVIVIGGGMAGIAAARSLHDASLQGSVLGDASQFRIQLVLYSHLGE

SEQ ID NO: 132786 - protein, 175 aa, Glycine max
  Coding DNA Sequence Number=SeqID_16008
MTPRRFETTMTMRITRTIFNRGDSSKCGGKFNALELIPINVEMLKLFPAKMEVKADYIGLLLIASASYDPRVEGAAVVVSLSEDHVLSEYHPLSETLARLVSKVNLEENLSRKHMLNVSPARLESHLFLMALSTPGSLSQSSLTCTKRENGAKRAFEDRKPFLKLEVKEKRELGG

SEQ ID NO: 132787 - protein, 359 aa, Glycine max
  Coding DNA Sequence Number=SeqID_16009
  Homolog annotation: Hit_ID=Q1SF91; Match level="QueryCoverage=62%, HitCoverage=100%, E-value=8e-86, Identity=70%"; Hit description =Transcription activator-related
  Pfam annotation: Domain name=QLQ; Domain location=10-46; Score=71.1; E_value=3.6e-18; Accession=PF08880.1; Description=QLQ
  Pfam annotation: Domain name=WRC; Domain location=76-121; Score =101.5; E_value=2.5e-27; Accession=PF08879.1; Description=WRC
  Pfam module annotation: Pfam domain module=QLQ::WRC; Domain location =10-46::76-121
MMSASARNRSPFTQTQWQELEHQALVFKYMVTGTPIPPDLIYSIKRSLDTSISSRLFPHHPIGWGCFEMGFGRKVDPEPGRCRRTDGKKWRCSKEAYPDSKYCERHMHRGRNRSRKPVEVSSAISTATNTSQTIPSSYTRNLSLTNPNMTPPSSFPFSPLPSSMPIESQPFSQSYQNSSLNPFFYSQSTSSRPPDADFPPQDATTHQLFMDSGSYSHDEKNYRHVHGIREDVDERAFFPEASGSARSYTESYQQLSMSSYKSYSNSNFQNINDATTNPRQQEQQQQQHCFVLGTDFKSTRPTKEKEAETATGQRPLHRFFGEWPPKNTTDSWLDLASNSRIQTGDDPASSSLLSLSHPF

SEQ ID NO: 132788 - protein, 436 aa, Glycine max
  Coding DNA Sequence Number=SeqID_16010
  Gene Ontology: Mol. function=oxidoreductase activity; Cellular component=nucleus; Biological process=electron transport
  Homolog annotation: Hit_ID=Q8LE44; Match level="QueryCoverage=99%, HitCoverage=84%, E-value=1e-178, Identity=71%"; Hit description =Putative amine oxidase
  Pfam annotation: Domain name=Amino_oxidase; Domain location=1-404; Score=173.2; E_value=6.5e-49; Accession=PF01593.14; Description =Flavin containing amine oxidoreductase
MGASWLHGVSNENPLASVIGRLGLPLYRTSGDNSILYDHDLESYGLFDMDGKQVPQELVAKVGEIFEAILQETDKIRQESSEDMSVLRGLSIVFDRKPELRLEGIAYKVLQWYLCRLEGWFAADTDAISLKGWDQVDVVGCIGILSSEYTIILHDCEKEVLLPGGHGLMVRGYLPVVNSLAKGLDIRLGHRVTKVVRRYNGVKVTVENGKTFFADAAVIAVPLGVLKAKKILFEPKLPDWKEAAIADLGIGLENKIILHFENVFWPNVEFLGVVADTPYECSYFLNLHKATGRAVLVYMPSGQLAKDVEKMPDEAAVNFAFMQLKKIFPDASSPIQYLVSRWGSDINSLGSYSYDAVGKPHELYERLRVPVDNLFFAGEATSMSYPGSVHGAYSTGTMAAEDCRMRVLERYGEVDLFQPVMGEEGSMSIPLQISRL

SEQ ID NO: 132789 - protein, 940 aa, Glycine max
  Coding DNA Sequence Number=SeqID_16011
  Gene Ontology: Mol. function=transmembrane receptor activity; Cellular component=membrane; Biological process=defense response
  Homolog annotation: Hit_ID=Q2HUN2; Match level="QueryCoverage=97%, HitCoverage=72%, E-value=1e-159, Identity=43%"; Hit description=TIR; Disease resistance protein
  Pfam annotation: Domain name=LRR_1; Domain location=667-688; Score =1.6; E_value=1.4e+02; Accession=PF00560.23; Description=Leucine Rich Repeat
  Pfam annotation: Domain name=LRR_1; Domain location=690-711; Score =6.6; E_value=16; Accession=PF00560.23; Description=Leucine Rich Repeat
  Pfam annotation: Domain name=LRR_1; Domain location=713-735; Score =8.9; E_value=6.1; Accession=PF00560.23; Description=Leucine Rich Repeat
  Pfam annotation: Domain name=LRR_1; Domain location=755-776; Score =11.1; E_value=2.3; Accession=PF00560.23; Description=Leucine Rich Repeat
  Pfam annotation: Domain name=LRR_1; Domain location=778-799; Score =15.0; E_value=0.26; Accession=PF00560.23; Description=Leucine Rich Repeat
  Pfam annotation: Domain name=LRR_1; Domain location=801-826; Score =7.9; E_value=9.3; Accession=PF00560.23; Description=Leucine Rich Repeat
  Pfam annotation: Domain name=LRR_3; Domain location=667-686; Score =33.2; E_value=8.8e-07; Accession=PF07725.3; Description=Leucine Rich Repeat
  Pfam annotation: Domain name=NACHT; Domain location=217-358; Score= -18.6; E_value=0.0016; Accession=PF05729.3; Description=NACHT domain
  Pfam annotation: Domain name=NB-ARC; Domain location=183-461; Score =110.4; E_value=5.2e-30; Accession=PF00931.13; Description=NB-ARC domain
  Pfam annotation: Domain name=TIR; Domain location=27-154; Score =182.8; E_value=8.3e-52; Accession=PF01582.10; Description=TIR domain
  Pfam annotation: Domain name=TIR; Domain location=804-927; Score =67.4; E_value=4.6e-17; Accession=PF01582.10; Description=TIR domain
  Pfam module annotation: Pfam domain module=LRR_1::LRR_1::LRR_1::LRR _1::LRR_1::LRR_1::LRR_3::NACHT::NB-ARC::TIR::TIR; Domain location=667- 688::690-711::713-735::755-776::778-799::801-826::667-686::217 -358::183-461::27-154::804-927
  Subcellular localization annotation: CTP_CleavageSite=52; ConfidenceScore=5.26e-01
MNEQQRITDVASSSNSSSMSSSKQYDVFLSFRGEDTRRSFTSHLYESLNEVKVQTYIDDRLEKGEEISPTLTKAIENSRVSIVIFSENYASSKWCLGELIKIMESKKEKGQIVIPVFYNIDPSHVRKQTGSYEQAFEKHEGEPRCNKWKTALTEAAGLAGFDSRNYRTDPELLKDIVGAVLRKLPPRYQNQRKGLIGIEDHCKQIESLLKIGSSEVKTLGIWGMGGIGKTTLATTLYDKLSHKFEDACFLANLSEQSDKPKNRSFGNFDMANLEQLDKNHSRLQDKKVLIILDDVTTSEQLDKIIPDFDCDFLGPGSRVIVTTRDKQILSRVDEIYPVGEWSFDKSLQLFCLTAFGEKQPNDGYADLSRMVVSYCKGIPLALKVLGASLRSRSKEIWECELRKLQKIPNKEIHKVLKLSYDGLDRSEQDIFLDIACFFKGRDRCWVTRVLEAFEFFPAPGINILLDKALITISDSNLILMHDLIQEMGREIVHQESKDPGRRTRLWRHEEVHDVLKYNKGTDVVEGISLDLSRLNEDLNLSSNSLAKMTNLRFLRIDGESWLSDRIFNGYLPNGLESLYLSNDVEPLYFPGLESLVLYFPNGHVSSYLPNGLESFYFLDGPVSLYLPNGLESLYFPSGLESLSNQLRYLHWDLCYLESLPPNFCAEQLVVLHMKFSKLKKLWDGVQNLVNLKEIDLSYSEDLIEIPNLSEAENLESISLSGCKSLHKLHVHSKSLRAMELDGCSSLKEFSVTSEKMTKLNLSYTNISELSSSIGHLVSLEKLYLRGTNVESLPANIKNLSMLTSLRLDGCRKLMSLPELPPSLRLLDINGYDQLEKGDEISPALTKAIEDSHVYILIFSENDASSKWCLGELIKIMECKNEKGQMVIPVFYNVDSSHVRKQTGSCEQAFEKHEGEPRCKKWKAVLTEAFNLAGWNSRTYR

SEQ ID NO: 132790 - protein, 160 aa, Glycine max
  Coding DNA Sequence Number=SeqID_16012
  Gene Ontology: Mol. function=nutrient reservoir activity; Cellular component=apoplast; Biological process=auxin mediated signaling pathway
  Homolog annotation: Hit_ID=Q9AR81; Match level="QueryCoverage=90%, HitCoverage=91%, E-value=3e-44, Identity=52%"; Hit description =Germin-like protein precursor
  Pfam annotation: Domain name=Cupin_1; Domain location=9-150; Score =114.0; E_value=4.5e-31; Accession=PF00190.13; Description=Cupin
  Pfam annotation: Domain name=Cupin_2; Domain location=39-114; Score =26.9; E_value=6.9e-05; Accession=PF07883.2; Description=Cupin domain
  Pfam module annotation: Pfam domain module=Cupin_1::Cupin_2; Domain location=9-150::39-114
MFLHIVFLLFLLSSTSHATVQDFCVADLKGLNGLELSAARLDLGPSGVIPLHTHPGANELLIVLQGHILAGFISSGNIVYQKVLKKGELMVFPQGLLHFQIAVGKRKALAFPVFSSANPGLQILDFALFASNFSTPLVTQTTFLDPDLVKKLKGVLGGSG

SEQ ID NO: 132791 - protein, 225 aa, Glycine max
  Coding DNA Sequence Number=SeqID_16013
MSIRTNRFKAVDRVLKDLERVEKEGKLNDLKSELNKIKEVFLKKIWNSTLKLLPAAASSGQSSHHAQAAASSHHHVTPLPSSTPQLHQEEDLQSIKDCYNNLDDEFKRIFSSLLQFPENAVFKRREIALWFSQYGDHRWNSVWVDSILKSKVIVPHGNCNSPIKSKIKINQKIRNNFQSPLPTAQADHASRHFQWRHQCSPSNSASFSLCAMAEHLCHQFFGRHP

SEQ ID NO: 132792 - protein, 129 aa, Glycine max
  Coding DNA Sequence Number=SeqID_16014
MSLPRLPPSLEELGLDDSITIPHLPTSDLCGFVYCIILSVGSALIGNVWCSTYEDGIEVSWDRSNIIFIFGWNGDEERIKECGVFPVYATTSGLKLVSNSGKEIFECESIEWEQLLHTSKRRKISCQQK

SEQ ID NO: 132793 - protein, 159 aa, Glycine max
  Coding DNA Sequence Number=SeqID_16015
MKLERFSFKKKVSTIDIINWDPNLERLFVYFVRFSSFDSVMVKMGASSYNGKFPPKGSFYKVILKMGFFLNNFWDGSVFDVNFQRKRQQQWRFEHAATRGGKIANISGDFVSPGLASLTGELHPVSPDTVATCLQASASAGLASLTGEKLEKKFVHFLL

SEQ ID NO: 132794 - protein, 77 aa, Glycine max
  Coding DNA Sequence Number=SeqID_16016
MMLHAVMCIKKEGDLARNSVRRKGHVAHDPQSEGGRHSTRLRRENPRVKQSEEKLEESQEIARDVTITTGTYMSPLR

SEQ ID NO: 132795 - protein, 83 aa, Glycine max
  Coding DNA Sequence Number=SeqID_16017
MGCYTFTLGFSLLNLVLCLPPSLCGSISCQISFLLYAHYSMQHHFEERLEKEGYMSIPFDENEESDTALSQLQSSHPQSVVSF

SEQ ID NO: 132796 - protein, 283 aa, Glycine max
  Coding DNA Sequence Number=SeqID_16018
  Gene Ontology: Mol. function=ATP binding; Biological process=apoptosis
  Homolog annotation: Hit_ID=Q8LJ95; Match level="QueryCoverage=94%, HitCoverage=44%, E-value=1e-44, Identity=41%"; Hit description=NBS -LRR resistance protein RGH1-like
  Pfam annotation: Domain name=LRR_1; Domain location=215-235; Score =2.7; E_value=90; Accession=PF00560.23; Description=Leucine Rich Repeat
  Pfam annotation: Domain name=LRR_1; Domain location=61-83; Score=7.7; E_value=10; Accession=PF00560.23; Description=Leucine Rich Repeat
  Pfam annotation: Domain name=LRR_1; Domain location=85-107; Score =9.6; E_value=4.6; Accession=PF00560.23; Description=Leucine Rich Repeat
  Pfam module annotation: Pfam domain module=LRR_1::LRR_1::LRR_1; Domain location=215-235::61-83::85-107
MKDLWVLQLGRFMQDSPKHHIEVDSEEFLKELSGHEDLLCLSLRGISRIFELPPSIVKIESLGILDLKACHNLETLPSDISSLQSLWYLNLSECYLLDRMPKGIQNLTRLKVLKGFVLGSSSKTPCRISDIAANLKRLVRLSIRIGSGAVIQEGEFESLKKLSELEHLKISWGVFDTRYIDIQISVPSSLKKLHLEGFPGQNIPEWLKPSKLSCSLRELHITGGKLKSLDHGENNDWGVEMVYLKYLKDLDVDLEHLRKLFPSLRYVEIKQILNQPYLEWSIN

SEQ ID NO: 132797 - protein, 430 aa, Glycine max
  Coding DNA Sequence Number=SeqID_16019
  Gene Ontology: Mol. function=hydrolase activity, acting on glycosyl bonds; Biological process=carbohydrate metabolic process
  Homolog annotation: Hit_ID=Q9SUP5; Match level="QueryCoverage=91%, HitCoverage=91%, E-value=1e-159, Identity=64%"; Hit description =Putative polygalacturonase
  Pfam annotation: Domain name=Glyco_hydro_28; Domain location=75-417; Score=-45.0; E_value=6.4e-07; Accession=PF00295.8; Description =Glycosyl hydrolases family 28
  Subcellular localization annotation: CTP_CleavageSite=28; ConfidenceScore=5.17e-01
MLLPPFLTLTFLLLFFNASVAAIYSTTTCSNIVSLRYRSDRISVTDFGGVGDGRTLNTKAFRAAVYRIQHLRRRGGTVLYVPPGVYLTESFNLTSHMTLYLAAGAVIKATQELGNWPLIAPLPSYGRGRELPGGRYMSFIHGDGLSDVVITGENGTIDGQGDVWWNINVVVRYVTILAPRDSPNTDGIDPENCISSFIGAKLFKGSIEITIADSTSAIMLYSSSNVCIEDSYISTGDDLVAVKSGWDEYGIAYGRPSYGITIRRLTGSSPFAGIAIGSETSGGVENVLAEHINLFNMGVGIHIKTNSGRGGLIKNITVAHVYVENARQGIKIAGDVGGHPDEKFNPNALPVVKGITIKNVWGVRVNQAGLIHGLRNSPFTDVCLSNINFHGMRGPRSPSWKCSDVFGFAHQVSPWPCSQLSSQEPGSCAI

SEQ ID NO: 132798 - protein, 722 aa, Glycine max
  Coding DNA Sequence Number=SeqID_16020
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=50%, E-value=0.0, Identity=48%"; Hit description=Chromo
  Pfam annotation: Domain name=zf-H2C2; Domain location=648-689; Score =26.1; E_value=0.00012; Accession=PF09337.1; Description=His(2) -Cys(2) zinc finger
  Pfam module annotation: Pfam domain module=RVT_1::zf-H2C2; Domain location=231-400::648-689
MEDDKEDPMSTIVPQGTQEDEIEEYEDHHLSFNALKGGRGVGTIRFIAFIENLPVTVLIDGGSSDNVLQPRVAKFLKLPVEPATQIRVMVGKVFLLPIFGADLILRASWLKTINSHNADYDALQLKFLWKGKFTTLQGDCQLVPKQAQLHCIRRIVATNSIAEVYSLQLMEPDVVPKSMLDLPVTMEPELALLLHTYSVVKPYRYPHSQKEEIERLVSGMLDEDIIQPSKTPFSSPIILVKKKDGSWRVCTDYRALNAITIKDNFPIPTVDELIDELFGASFFSKLDLRSGYHQILLNPDDKHKTAFRTHHGHYEWLVMPFGLTNAPTTFQSLMNDIFVGILRKFVLVFFDDMLVYSANWKHHLYHLEVVLSILKQHQLCARFSKYCFGVQHIDYLGHTLFGSGVAMKGTKLEAIQKWLEPSNLKQLRAFLGLTDFYRRLVKSYGIAAPLTDLLKKDSFKRSVAASEAFQQLKIAMTSAPGLTIPNFNEIFVLETDASGSGIGVVLSQNKHPIAYFSKKLSLRMQKQSEKPQRIVRQKLHTPEQQQWLPKFLGFDFTIQYKPGKENIHTDALSRSFMVAVSTPIHSWINKVMDLTQTDSQLSKIYQSCLQGQNPSSEYSIQNGLLFFKGKIVLPHDVGLLNQIMEEFHSSKIGGHSEVNRTTTRIGAQFYWNGMRSDISKFVRECVICQQAKVDHVFPAGLLQTLLIPQHCYLVRIIFAPTE

SEQ ID NO: 132799 - protein, 330 aa, Glycine max
  Coding DNA Sequence Number=SeqID_16021
  Homolog annotation: Hit_ID=Q6H4U9; Match level="QueryCoverage=20%, HitCoverage=17%, E-value=4e-13, Identity=57%"; Hit description =Dentin sialophosphoprotein-like
MSWSLEIGRENSAVRDDGKSFEVGSQKGDYETATHHGNLASLGVTLCISTTRLYSKAKFLKAGDTLARNPLEKAHPDGQPFNPSTPVKCCEEGGKRIDSLEQTPSSCISNVLSTQCDTLDSTEGIRTGSLHSLDKNDKTTASVSPWPSTTHTRRNKSVCFACDSDLSSCDSSDYGGRHMKKTDSANNESTYKPSPNPTPMKLSDEMQTPGTAYPSAKDLPNAVILEERNKRMQTSYNQVRKTPADRPIIGMVAAHWIEDEDSQAPPPKWWDGNGIPNSTNKYKKDQKVNWHATSFEERLEKALSEETVISQRVMVMGTNDNYHWSRNTHS

SEQ ID NO: 132800 - protein, 102 aa, Glycine max
  Coding DNA Sequence Number=SeqID_16022
  Homolog annotation: Hit_ID=Q1T2D5; Match level="QueryCoverage=54%, HitCoverage=3%, E-value=6e-10, Identity=51%"; Hit description=Chromo
  Subcellular localization annotation: CTP_CleavageSite=41; ConfidenceScore=5.47e-01
MTSLFLLPVIPFSHLIPFSQNASQPPGSSPNNGSPMVQPINASLPVKEISLGFPHFDGTTPVMEWIFKLEKFFTYHNTPYASRVDIATMHFDKDVVAWFQMS

SEQ ID NO: 132801 - protein, 155 aa, Glycine max
  Coding DNA Sequence Number=SeqID_16023
  Gene Ontology: Mol. function=3-oxoacyl-[acyl-carrier-protein] synthase activity; Biological process=fatty acid biosynthetic process
  Homolog annotation: Hit_ID=Q8L3X9; Match level="QueryCoverage=39%, HitCoverage=13%, E-value=1e-21, Identity=75%"; Hit description=3 -oxoacyl-[acyl-carrier-protein] synthase, mitochondrial precursor
  Pfam annotation: Domain name=Ketoacyl-synt_C; Domain location=24-87; Score=-47.7; E_value=0.1; Accession=PF02801.12; Description=Beta -ketoacyl synthase, C-terminal do
IGDGSGVLVLEEFEHAKNRGSKIYAEVRGYGMSGDAYHLTQPPSEGRGAILAMTRALRQGQLTWAYPISKTKSKLHEKHVRAPLDYDDTNYFRDDVFFYVGGMHDAIRNGKSSTDGPRGSGLARTSGDFKPTGLASQTGELVPACLARRSDDKAM

SEQ ID NO: 132802 - protein, 165 aa, Glycine max
  Coding DNA Sequence Number=SeqID_16024
VYEENDGVIFECSKKAIQIKRRISFNALKKKLEIRFLVSGKYVALQICDDEDVETILESFQQQDQMSDMELYIEKDVAGGSMFHSANSLTSCGNNLSNNEAQPPRNVSNLHGDEDDDDDYLVSNSYVEESLDEDDSVDGISDTDDEVTDMIQPVRIVHPAEGIIY

SEQ ID NO: 132803 - protein, 77 aa, Glycine max
  Coding DNA Sequence Number=SeqID_16025
MAARRRGSRGRRRSKRRKETKQNEWCKFGRKKFSSGEDITAAEEKNFFRGVSWKTSSVESHRRRLPQDSTEEAVFRS

SEQ ID NO: 132804 - protein, 232 aa, Glycine max
  Coding DNA Sequence Number=SeqID_16026
  Homolog annotation: Hit_ID=Q1T493; Match level="QueryCoverage=89%, HitCoverage=45%, E-value=2e-30, Identity=31%"; Hit description =Nucleic acid-binding, OB-fold, subgroup
  Pfam annotation: Domain name=DUF223; Domain location=40-132; Score= -10.2; E_value=0.026; Accession=PF02721.5; Description=Domain of unknown function DUF223
MARIPDKIRSIDGSKETLKLDVRITDLWFVGTPNKSEQAEMVFVDFEGDQIHAICKSDHLKSWKADLKENCTYVMHNFKVVKNDGQFRVCEHEYKLFFIGVTVVREADLHELPFKEFRFVEFANVVAGNFVSGLGEILSCTLWENYCAQFLSYLNERGDDGPMVIILTHARIKDAQGSYPASVSNSFKASKLLINDPILEIQEFKERLLDLGVEVSRVLLPGDQASSQVSGG

SEQ ID NO: 132805 - protein, 70 aa, Glycine max
  Coding DNA Sequence Number=SeqID_16027
MMVDTLPVFYYEKLEGYMPSSFTDLVFAKERIEVGLKRGKFDYVSSTIRATSPELLNSRRGLSQFSTRTS

SEQ ID NO: 132806 - protein, 407 aa, Glycine max
  Coding DNA Sequence Number=SeqID_16028
  Gene Ontology: Mol. function=chitin binding; Cellular component =extracellular region; Biological process=chitin metabolic process
  Homolog annotation: Hit_ID=UPI00006A17C9; Match level="QueryCoverage =75%, HitCoverage=100%, E-value=4e-49, Identity=33%"; Hit description= UPI00006A17C9 related cluster
LHNLIFRGLHALAFRGLHALAIRELQVLAFRGLHVLPFRGLHVLPFRGLHVLAFRGLHALAFRGLHVLPFRGLHALTFRGLHIFAFRGLHALTFRGLHVLAFRGLHVLALRGLHALTFRGLHILVLRGLHALAFRGLHILAFRGLHPLAFRGLHVLNFIRLHAFTFRGLHVLTFIMLHALTFRGLHVLTFKGLHALAFRGLHFLTVIGLHALTFRGLHVLALRGLYALAFRGLHVPTFRGLQVFAFRGLHLLTFRGLHVLPFRGLHVLAFKGLHALAFIGLDALAFIGLHICAFKEFKPLCILGQDFTRAATKRRVRIMDHARKTPSGPGEVQQGPGVSSSDYGPLSVLWSARRLQQGRDTTAARGWPTAGNKRTTATSQAPQLIYKGLSVAYDPWPTSRRPSPKPK

SEQ ID NO: 132807 - protein, 176 aa, Glycine max
  Coding DNA Sequence Number=SeqID_16029
MSVFACYQAFRLTDSKEKVYTDNHSGISARQRDSNVSMTDLVSAEDDVNLRVSTGLSAAIDEGRRRQHSKKNVYTDNHSGISARQRDSNVSMTDLVSAEDDVNLRGSTGLSAAIDEGRRRRHSKKNVYTDNHSGISARQRDSNVSMTDLVSAEDDVNLRVSTGLSAAIDEGRRRRR

SEQ ID NO: 132808 - protein, 213 aa, Glycine max
  Coding DNA Sequence Number=SeqID_16030
  Homolog annotation: Hit_ID=Q016Y0; Match level="QueryCoverage=37%, HitCoverage=52%, E-value=1e-10, Identity=47%"; Hit description =Homology to unknown gene
MGFANSNSKRNPTNYVHAGALFKELETYCKSRLRPDPCFALKGSSLQDMKLLFVEMGVGYDLHGQDMTTAAMRPCRDAISANSIPAFRKGNIPRVTSDHMKLHVKLGVPHPLQQNLDKDKIRYVFPYQDITAAAMRLSQCALCGRARARLTGALSKGGKMRGVATNVYLWKNQRKPVKMKILSSGVVFTLEEGRQKRGFCSYVPSFGEEIRLT

SEQ ID NO: 132809 - protein, 109 aa, Glycine max
  Coding DNA Sequence Number=SeqID_16031
  Subcellular localization annotation: CTP_CleavageSite=78; ConfidenceScore=5.07e-01
MWTTTGEELATQLAQASKVASSRSNSLLEEGFGRPNFRRSYGNSRITQKHLFSIFATLRNFTDRKQSETKQRSHSQSRGSALDDEKLWRMEDCTQQSLHMAPNSWVEDA

SEQ ID NO: 132810 - protein, 151 aa, Glycine max
  Coding DNA Sequence Number=SeqID_16032
LFGVPVTPSKVIRPPITRAIIEKYCTHRQAQGDAPQAADAPPPPHQADPAGSFGMERYLQYLVRQQAANHRGQVRTHKCLYQLSISLQSQGFAPFVCPTPDQFRVEVAWPGDWPEAQVGEPPSEAPGDANEARMDEEMTDLLDFLGGSGAT

SEQ ID NO: 132811 - protein, 105 aa, Glycine max
  Coding DNA Sequence Number=SeqID_16033
MERCFMTSQKNQLSTTDDMSLPVRRKFSSIYHSTTELSGAREWIKMMLDLKECGDELVGRGGGRGGRTRKATGGGRGIGDGENGEGGAVREIHDKGCGEGKEGDE

SEQ ID NO: 132812 - protein, 207 aa, Glycine max
  Coding DNA Sequence Number=SeqID_16034
MEHKFHPSKVAARAITLSIRQQFGQPWPRWGAIPKDHQELFFLRFKLSQARSDAASSAGESQLTPLDPDEEQRLRSWCWVATTRPKRKERLYDTGDLVHTYKCGNGSLMQHTQGSSSSVEDAAEINCPREKLRQSKRGDTHFLVSSPSVPTFRGTKHYSSTTITSVTVPRPATTTPGPVATPPAPARTTTGPGWECGGKAPAECGLT

SEQ ID NO: 132813 - protein, 130 aa, Glycine max
  Coding DNA Sequence Number=SeqID_16035
  Gene Ontology: Mol. function=calcium ion binding; Cellular component =flagellin-based flagellum; Biological process=ciliary or flagellar motility
  Homolog annotation: Hit_ID=Q1T0A3; Match level="QueryCoverage=100%, HitCoverage=92%, E-value=1e-32, Identity=55%"; Hit description =Calcium-binding EF-hand
  Pfam annotation: Domain name=efhand; Domain location=42-70; Score =24.2; E_value=0.00048; Accession=PF00036.22; Description=EF hand
  Pfam annotation: Domain name=efhand; Domain location=6-34; Score =19.2; E_value=0.015; Accession=PF00036.22; Description=EF hand
  Pfam module annotation: Pfam domain module=efhand::efhand; Domain location=42-70::6-34
MRVNTEFERVLKYFNEDGDGKISPSELRNRLGMMGGELLFKDAEKLIEELDSDGDGLLSLENFVKIMEDAGEEKLKDLAEAFEMYRNTEMYGFITTKSLQRMLRRLGESKSMEQCTTMIDHFDLNGDGLL

SEQ ID NO: 132814 - protein, 77 aa, Glycine max
  Coding DNA Sequence Number=SeqID_16036
MNGEKGTVKKQRSEEGEDSVKQALSGAVPTGIPKLRGELPCIRPSLPSSGESGGGWHDTLEEESERESENQRVRERH

SEQ ID NO: 132815 - protein, 141 aa, Glycine max
  Coding DNA Sequence Number=SeqID_16037
  Gene Ontology: Mol. function=calcium ion binding; Cellular component =flagellin-based flagellum; Biological process=ciliary or flagellar motility
  Homolog annotation: Hit_ID=Q1T0A3; Match level="QueryCoverage=99%, HitCoverage=100%, E-value=2e-48, Identity=67%"; Hit description =Calcium-binding EF-hand
  Pfam annotation: Domain name=efhand; Domain location=115-141; Score =24.0; E_value=0.00052; Accession=PF00036.22; Description=EF hand
  Pfam annotation: Domain name=efhand; Domain location=42-70; Score =29.8; E_value=9.7e-06; Accession=PF00036.22; Description=EF hand
  Pfam annotation: Domain name=efhand; Domain location=6-34; Score =28.0; E_value=3.4e-05; Accession=PF00036.22; Description=EF hand
  Pfam module annotation: Pfam domain module=efhand::efhand::efhand; Domain location=115-141::42-70::6-34
MRVNTEFERVLKYFDEDGDGKISPSELRNRLGMMGGVLLFKDAEKLIEELDSDGDGFLSLEDFVKIMEAAGEEEKLKDLAEAFEMYHDSEMFGFITPKSLQKMLGRLGESKSMEQCTAMIGHFDLNGDGLLSFDEFRVMMQ

SEQ ID NO: 132816 - protein, 105 aa, Glycine max
  Coding DNA Sequence Number=SeqID_16038
  Homolog annotation: Hit_ID=Q9XGF2; Match level="QueryCoverage=50%, HitCoverage=19%, E-value=3e-08, Identity=57%"; Hit description =Putative glyoxalase I
MQTVEALKVFVDGADDVIVEGEGVSGGFAFWCFGLMHACYNSRKLRRILGLMAQMMCTKLHKQLDLLEERLLEKLDQYLVQRQITSCVDPDGWKTVFVDNVDFRR

SEQ ID NO: 132817 - protein, 130 aa, Glycine max
  Coding DNA Sequence Number=SeqID_16039
  Homolog annotation: Hit_ID=Q9FI20; Match level="QueryCoverage=41%, HitCoverage=21%, E-value=1e-12, Identity=56%"; Hit description =Arabidopsis thaliana genomic DNA, chromosome 5, P1 clone:MFC16
  Pfam annotation: Domain name=DUF858; Domain location=1-100; Score= -128.9; E_value=0.011; Accession=PF05891.2; Description=Eukaryotic protein of unknown function (DUF858)
MEKRKDFTPNTARYDVIWIQWCIGHLTDEDFVSFFKRAKERFHTIKYLLEASALSTNNSLECKDMECMLDKIFRGLAYIHIGTKVCHRDLKPQNILGVSVERAFFMWPLFPGENAIDQLEHIIKVLGTPT

SEQ ID NO: 132818 - protein, 80 aa, Glycine max
  Coding DNA Sequence Number=SeqID_16040
MKKKESKRMKQNEEETKATKKKESKTQQKRKKGNTVGAEWTGNATTHDTCKQFKKKKTHAIIRGATNKLGSVMQKCPKNQ

SEQ ID NO: 132819 - protein, 92 aa, Glycine max
  Coding DNA Sequence Number=SeqID_16041
LVFFNGIVPAMGRPLKKEHITTTYENSVKEMGTVEDNNILLWRRSIIENNAANDGGVDKWIDDFRPTDPGHSPGAGHSSPTPKDATNGAPRP

SEQ ID NO: 132820 - protein, 258 aa, Glycine max
  Coding DNA Sequence Number=SeqID_16042
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=2e-26, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSLTSEGYMPSPSGDYTSSPSEDYTSLPLEGCTPSPSENYTSSPLEDYTSLPSEGCTPSPSENYMPSPSKDYTSSPSMDYTSLPSVDYTSSPSEGCMPSPSKVYTFSPSEYYTSSPSEGYTPSSLEDYMSSLSKTTRPRLQRATRPCLQRTTRPHLQRITHPSLKRATGPHLQRTSCPRHQRAPCPRLQRTTHPRHQRTTRPHLHVGSSGHVIIKKGGLKKKTAENKECREEEDKHKSFILVRQQPVPTSSPQATCLP

SEQ ID NO: 132821 - protein, 297 aa, Glycine max
  Coding DNA Sequence Number=SeqID_16043
MDIDLTLQLRDQILVQVKGYAFFVNITDERLFNVYGCCKVIWHLEINCKTSLIPLKEGEGGEKKSEIIGQQGDNNVVVLEPSPHKEQLVAATPVESIFDHRAQNVQPEHPPESSPVFHNQMDVVVPEGVSKDLCIVSKFWANEEGSNEENVIPLGEGWVFLVDFNAILGAYEKIGGCPLLGASCDDFSNWNILSNLTHLHSRGVKFTWTNGRLHVELVGLGSSSSMDSFATWKMNGSGMEKEERERRCHFKEKMSLEEAHHHRRPWIIAWRKKEMNEGRGREEHEILCSKRALKSEV

SEQ ID NO: 132822 - protein, 117 aa, Glycine max
  Coding DNA Sequence Number=SeqID_16044
  Homolog annotation: Hit_ID=Q1S0A6; Match level="QueryCoverage=66%, HitCoverage=6%, E-value=4e-10, Identity=41%"; Hit description=Zinc finger, CCHC-type; Peptidase aspartic, catalytic; Polynucleotidyl transferase, Ribonuclease H fold
MDDRWGEPDAGFDEHGVTLPNMDTQDTLFPFISPTKPLLGRGHRTKQPSTRSQDYVTNTTKRLSPSNCSPSPKADSGAPYPITDYEKESVTYTNTVKDSQWRDAMKSEIYALETNGT

SEQ ID NO: 132823 - protein, 74 aa, Glycine max
  Coding DNA Sequence Number=SeqID_16045
MVAVGGGGLDDEGMSSALALFLEAIYPAKPKTCHDDVRLALPEPRLAVLHSKIFTNSTNLWELSEMGRLAQSLL

SEQ ID NO: 132824 - protein, 363 aa, Glycine max
  Coding DNA Sequence Number=SeqID_16046
  Gene Ontology: Mol. function=RNA-directed DNA polymerase activity; Biological process=RNA-dependent DNA replication
MVDLKHQQIGNIKTVEAQAILSTVRELGMTWELDQQNIIDKIKEMEERDLKEADKLGESKKESIDRNMCQALWGDKEIGWEMQPVDNTAGGAQGDSSIEEFNQWIDDLEVEEAPWEQFGDTFKKVKLIQDELNRFEEMTMDTQLSSQETRVRRQLQADLWVAAHSYESLLRQKARSRWIKKGDCNSRYFHLMMNASCRHNLLKGIMSEGGWVDEPQKVKEVREAVWECGSDKSPGSNGLNFKFIKKFWEIIKSDVLRFLHEFHVNGIFPKGGCIYKIVSKFLAKRIKKVMSSIIDGRQSTFIEGRHLLHGVLIANKVVEEGCLASASISILVNGSPTKEFTPTRGLRQRDPFAPFLFNIVAEG

SEQ ID NO: 132825 - protein, 224 aa, Glycine max
  Coding DNA Sequence Number=SeqID_16047
  Homolog annotation: Hit_ID=Q2HVJ8; Match level="QueryCoverage=26%, HitCoverage=12%, E-value=1e-16, Identity=73%"; Hit description =Nuclear protein SET
MGQTLYGPAMTVTFFSLNARLQGKLEKLIFLHDYGPQSSHAYLREHQFVYIRWHLCLTTPTIVANFVNFALVIFSTVLGAYWKNSYEAWIPLLFKVLPCWANSSEETPVLSPLVPVSLLGSSKGEDQKQKVVTKQSPKKVNLVAALVRGMLVKDALMQLELTIKRAAKTVYQENYSNFLIGNSELPNSEENYVLKEECRASILSYPIPIQGLRMLQESGILADQ

SEQ ID NO: 132826 - protein, 109 aa, Glycine max
  Coding DNA Sequence Number=SeqID_16048
MDLVDTVVELHYPKTGFINTVFESELVAVVKHTSTVVVVVDDYTGQIVDDYTLLVLNIYTLGKSKRKIGFEASTSRQGKSGSQFPSLILKDKVVAPRKGHVRTFGSVME

SEQ ID NO: 132827 - protein, 49 aa, Glycine max
  Coding DNA Sequence Number=SeqID_16049
MGDKKAKKAYITWDENDLESSDNSEKEVVNLCLMGKDYESDEEQICRRN

SEQ ID NO: 132828 - protein, 114 aa, Glycine max
  Coding DNA Sequence Number=SeqID_16050
MELIENMAASDQAILRDGAHIPTKRNLLELSSQDALLAKNKLLSVKKRLSFEFSKSSSWAKRISTAKCSFNALSARENLAEHQHQSCALSGTMPRAQNHTAATVPILGKKPCKQ

SEQ ID NO: 132829 - protein, 216 aa, Glycine max
  Coding DNA Sequence Number=SeqID_16051
MAYRKRKAPSTPTQARFDRSRFTSQEAWERYTDIVVPRKLLPERNVVVYYTEFDEFKEELERCHWDEEFTEFMDGNIDVAITPVVVEEGETLCAYSRFALLRPNPQDLAAKLCIPGRGFELNADGQPLKILRKNMTTLAQTWSVLSFSNLIHTSHTYYVTLDRAKLIYGIIMKMDMNVGYLISHQISLIAQHDTSRLGFPALNTALCKARGVQSDS

SEQ ID NO: 132830 - protein, 148 aa, Glycine max
  Coding DNA Sequence Number=SeqID_16052
GDQSGSQCFARIFQPYEINIGLKEHSNRVTPKAYTPKSPSGPLPPDSVIPPTVPIEFPNAKETEKRLKPPLVLSSCDSFFSHHEYYLKNPNGGTKNKRLQREGFSSKLRHNIKIPNGDNARNWVANVVFKFHNDLTVNEPEIVIFLRQ

SEQ ID NO: 132831 - protein, 117 aa, Glycine max
  Coding DNA Sequence Number=SeqID_16053
MYNSDDPSPKQAWVRGHLVKIDADNLNIFPETSVVLAEVSIRGARRARARPAVLPSTSVAPTPSSTSAAPSVPAQSDSQHFEAMLQSIHQGQIILLQSLQVVAPLGSIPSVEQFLDR

SEQ ID NO: 132832 - protein, 108 aa, Glycine max
  Coding DNA Sequence Number=SeqID_16054
MDEIDPTLEYFIFVLVAQKMMHYVSLKNYYFAQSVAHQHTPVEAMSSKGILMMPKNQESSKVSRKDLRIKFQVSRFKKNQDQDSRLKIQESREDSIKISTKKVFQNIE

SEQ ID NO: 132833 - protein, 47 aa, Glycine max
  Coding DNA Sequence Number=SeqID_16055
MWFNNIRENEKKANRCCTVLLEIYASLCLNCFIGEEAYVKAGECFNN

SEQ ID NO: 132834 - protein, 104 aa, Glycine max
  Coding DNA Sequence Number=SeqID_16056
  Subcellular localization annotation: CTP_CleavageSite=40; ConfidenceScore=5.03e-01
LPEIVSGSTSSGIGLRNFRKTFFRKLRSPISEEGLPEIVSGSTSSGIGLRNFRKNFFRNMDEDQWRYDFAMSQEVDMDYDYDNQEECGVNERHVDCSNAFNTSQ

SEQ ID NO: 132835 - protein, 208 aa, Glycine max
  Coding DNA Sequence Number=SeqID_16057
  Gene Ontology: Mol. function=protein disulfide oxidoreductase activity; Biological process=cell redox homeostasis
  Homolog annotation: Hit_ID=Q941V7; Match level="QueryCoverage=49%, HitCoverage=43%, E-value=2e-25, Identity=52%"; Hit description =Glutaredoxin-like
MNHERERKRKEGTGAHGQQVQEMHLIRPLSLQAAHVGIHCGQALEKLLELATLVQPPQLLGPTNVPSVNEDTWQGQPGFATRDPTELREKTRVHGQVALVQRDAEPAQDGTHLFAVLERGADHAQAREVEHHALLRAGNGRRRERVGECDSVEDGGFGFGGGGGGRWRSGGCCILREVKGGLVYFAFRGGLRGKRDGLGEIEMALLNE

SEQ ID NO: 132836 - protein, 75 aa, Glycine max
  Coding DNA Sequence Number=SeqID_16058
MRKLIKERIENKVVNFVGLNKVKWWLDRNIEMEITEATGLQMRARVKMKGRKESLFPARATHKGCESPLIQPGCS

SEQ ID NO: 132837 - protein, 119 aa, Glycine max
  Coding DNA Sequence Number=SeqID_16059
  Gene Ontology: Mol. function=2-C-methyl-D-erythritol 2,4 -cyclodiphosphate synthase activity; Biological process=terpenoid biosynthetic process
WTFILVTIYFALGTIVSAYGCWRFFNKPVIHNGAKAEFLRRDVEETISTNLITSNKLESRYVEEDFQQRAGFWGFVMQTIYQETRRIRKTVKRTVACLYYGIIQGMVCGGLRGLVEILE

SEQ ID NO: 132838 - protein, 264 aa, Glycine max
  Coding DNA Sequence Number=SeqID_16060
  Gene Ontology: Mol. function=oxidoreductase activity; Cellular component=membrane; Biological process=metabolic process
  Homolog annotation: Hit_ID=Q94K41; Match level="QueryCoverage=96%, HitCoverage=99%, E-value=5e-78, Identity=58%"; Hit description =Putative alcohol dehydrogenase
  Pfam annotation: Domain name=KR; Domain location=10-184; Score=-78.5; E_value=0.0083; Accession=PF08659.1; Description=KR domain
  Pfam annotation: Domain name=adh_short; Domain location=9-176; Score =73.4; E_value=7.1e-19; Accession=PF00106.15; Description=short chain dehydrogenase
  Pfam module annotation: Pfam domain module=KR::adh_short; Domain location=10-184::9-176
MSKQRLQGKVAIVTGGATGIGAEAVRIFVENGASVVIADIKDELGHNLATSLGLDKVDYRHCDVRDEKQVEETVSFTLEKYGSLEILFSNAGIAGPLSSILDFDLNEFDNTMAVNLRGAMAAIKHAARVMVARETRGSIICTTSVAGSFAGCAGHDYTASKHGLIGLVRSACSELGAKGIRVNSISPYAVATPLTCETFDMEPGEVEAAGHALANLHGITLKPTHIAQVALFLASDESAYISGHNLVVDGGFSVVNRGLPSIKN

SEQ ID NO: 132839 - protein, 59 aa, Glycine max
  Coding DNA Sequence Number=SeqID_16061
MVFRRGWAFSPWVKVYGELGFWLNAYRTAGHDICQSVGLASDSGIKGMSHIISMTHMQQ

SEQ ID NO: 132840 - protein, 70 aa, Glycine max
  Coding DNA Sequence Number=SeqID_16062
  Homolog annotation: Hit_ID=Q1RVQ6; Match level="QueryCoverage=81%, HitCoverage=53%, E-value=4e-07, Identity=44%"; Hit description =Ribonuclease H
MAGSTSGWKQILLCWSQLFIGLTSSLGLYKIIGLTIQFRFFLTKLGSLTFTVKVMAMQTAEQLICPYGHK

SEQ ID NO: 132841 - protein, 106 aa, Glycine max
  Coding DNA Sequence Number=SeqID_16063
MYVSGNSDIYGFLEPQSIQRFGQSQFESESYIKSWMQSSQRDVYLGAYLNGFHYSGHWQMVPKSKAPGRWIVVKCNRQKGTTECGYYVMHWMSTIILGTFRNNWEA

SEQ ID NO: 132842 - protein, 88 aa, Glycine max
  Coding DNA Sequence Number=SeqID_16064
MAFGGLAARPGELLLHPEMENISFDLPHTIYINILRNLKGLGDLDNIYYVALINKALWYQGVYHVFDKMDDNSKHTTIAKGSVVAKQK

SEQ ID NO: 132843 - protein, 113 aa, Glycine max
  Coding DNA Sequence Number=SeqID_16065
  Subcellular localization annotation: CTP_CleavageSite=55; ConfidenceScore=5.11e-01
MEHATRGTARRTRQQQDSAPDAGASGSALLLGATGSAQRVGATGSAPDAGTTQTRAWVVPASGALPVAPSGRALPVAPSGRALPDASVSGALPCCCLVRRAVPRGIIMDGVGI

SEQ ID NO: 132844 - protein, 728 aa, Glycine max
  Coding DNA Sequence Number=SeqID_16066
  Gene Ontology: Mol. function=inorganic anion exchanger activity; Cellular component=integral to membrane; Biological process=anion transport
  Homolog annotation: Hit_ID=Q8VYR7; Match level="QueryCoverage=99%, HitCoverage=99%, E-value=0.0, Identity=76%"; Hit description=Boron transporter 1
  Pfam annotation: Domain name=HCO3_cotransp; Domain location=1-558; Score=-100.4; E_value=1e-12; Accession=PF00955.11; Description=HCO3- transporter family
MEETFVPFEGIKNDLRGRLMCYKQDWTGGIKAGLRIWAPTTYIFFASAIPVISFGEQLERDTDGVLTAVQTLASTSICGIIHSILGGQPLLILGVAEPTVIMYTFMFNFAKERPELGRDLFLAWTGWVCVWTALLLFLFAVLGACSIINRFTRIAGELFGMLIAMLFMQQAIKGLVDEFRIPERQNPKSIEFISSWRFANGMFALVLSFGLLLTALRSRKARSWRYGTGWLRSLIADYGVPLMVLVWTGVSYMPAGSVPHGIPRRLFSPNPWSPGAYENWTVIKACKLQDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVAARKSMGKNASLGQLYGNMQEAYNQMQTPLVYQDSSARAQGLRDLKESTIQAATSMGNVDAPVDETIFDVEKEIDDLLPVEVKEQRLSNFLQSIMVGGCVAAMPLLKKIPTSVLWGYFAFMAIESLPGNQFWERILLLFTAPSRRYKVLEDYHATFVETVPFKTIVTFTIFQTIYLLICFGLTWVPIAGVMFPMMIMLLVPVRQYFLPKFFKGIHLQDLDAAAYEEQTALPFNLATHSEFGAGASQVGEGEILDEVITRSRGEFRHTSSPKITSSTPTPRTDTNSHLSPRLSFSSRMGEFKTEQSPRSGARGPLSPKAGEVRLSHLGRSPLNPDSKQHDHN

SEQ ID NO: 132845 - protein, 123 aa, Glycine max
  Coding DNA Sequence Number=SeqID_16067
MENKKRKGKDYEVEDEEMKMDKFYALLRRYRDARDRRRKELEELDKSEKEKRMKAGTEQHRVWVPSFEWEDFTDQVQFRGQQYMQFPTSSTSPSPLAGGTDNKQLTNLFHGFNYHKAVQMATN

SEQ ID NO: 132846 - protein, 191 aa, Glycine max
  Coding DNA Sequence Number=SeqID_16068
  Gene Ontology: Mol. function=enzyme regulator activity; Cellular component=chloroplast; Biological process=regulation of nitrogen utilization
  Homolog annotation: Hit_ID=Q1SUV7; Match level="QueryCoverage=97%, HitCoverage=83%, E-value=1e-58, Identity=64%"; Hit description =Nitrogen regulatory protein P-II
  Pfam annotation: Domain name=P-II; Domain location=74-188; Score =78.3; E_value=2.4e-20; Accession=PF00543.12; Description=Nitrogen regulatory protein P-II
MAAIAGAHVFGVVSFQLKQAEMPFACSSLIRKHIGDSPQRNVALRRRANGTILPQIRAQNVLPDYVPKSEFYKVEAILRPWRVPQVSSVGHVPLDLPSFMVNAGTDFSFLDSKAMLKMGIRGVTVSDVKGFGSQGGSKERQGGSEFSEDNFVAKVKMEIVVRKDQVEAVIDKIIEEARTGEIGDGKIFCKT

SEQ ID NO: 132847 - protein, 180 aa, Glycine max
  Coding DNA Sequence Number=SeqID_16069
MKGFMEFKETIFHMQPDKAPGSDGMLVVDFEGQYLCKQWEEKGSEGKAMKDNNIVQQIIIASSALLLHFQTKSLRYEGLVIVLFAFAIRTPGFAIVVPASFSGVVFVVLSSSCGPREGPCPQGSDLDATDSRPPRRCHLGTSPTIGPILPKEHPSLGMSVATKWFEHGAMEHRLNVYSLW

SEQ ID NO: 132848 - protein, 434 aa, Glycine max
  Coding DNA Sequence Number=SeqID_16070
MVSGVRWTTKEFKEIWAGYKYVESGGSGGGVSGGSRMDILERAGLSSSAMGRKSLKAQRCPLWNFSLQLKHRPRSRWEAISSGIVASRVVVKHVGVAVRGVVKAGRGEVEEDDDCRESSLARSRPDRRSVPRSLVDGPTPPTVSPTDDSVGKILKLEKVLDHDAFLSELEQSSGRIVILGRRKVSTQSLEEHRPRGELAIGVHPLKPCEGVAFHIQSSGSVPSNRGMSNFIMCVTAGTGEGGGKGGGVVEEGDRAGLRRWISSSIFKVMEFTDSPRRSEEPRFLSESGMKAMRAPIDKGVSGWLRGPVPPQAMGREREYFYNRIWLGMSPSSRQHHSANHHCQVSSAFAFSNEIFEFLLPFLVLSLLCYHNVIYKIISKVLANRLKGVMGKCVFEEQSAFVPGRSIIDNALVDCEDVMAIASSTKDEKLNMKIM

SEQ ID NO: 132849 - protein, 94 aa, Glycine max
  Coding DNA Sequence Number=SeqID_16071
MDEHNVVLDLGLVKGVLWPWVNTAKFERKRQHPPSTGLGSLVLISEWVKSLLSMVEQSPNKSMQNAFLASLKASTVDTLLRHVMLMSKLPLLLA

SEQ ID NO: 132850 - protein, 475 aa, Glycine max
  Coding DNA Sequence Number=SeqID_16072
  Gene Ontology: Mol. function=hydrolase activity; Cellular component =membrane; Biological process=proteoglycan metabolic process
  Homolog annotation: Hit_ID=Q1RX76; Match level="QueryCoverage=99%, HitCoverage=84%, E-value=1e-179, Identity=65%"; Hit description =Glycoside hydrolase family 79, N-terminal
  Pfam annotation: Domain name=Glyco_hydro_79n; Domain location=1-288; Score=378.1; E_value=1.3e-110; Accession=PF03662.4; Description =Glycosyl hydrolase family 79, N-terminal domain
MDLNNKIFLNAVKAFSPLKLRLGGSLQDKVIYGTEDNHQPCTPFVKNPSEMFGFTQGCLPMDRWDELNYFFEKAGAKIIFGLNALAGKSIHSGSAKGPWNYTNAESFIRYTVGNGYSIYGWELGNELSGSGVGTSITADQYALDVAALHDVVYNAYEKTEPKPLVIAPGGFFDANWFNIFISKSGKSIDVVTHHIYNLGPGVDEHLVERILDPSYLDKEASTFSGLKNILASTGTSATAWVGESGGAYNSGHHLVSDAFVYSFWLVATPHDSDFINDSLQLGYLDQLGMSAAYDTKTYCRQSLIGGNYGLLNTTNFLPNPDYYSALLWHRLMGRHVLSTTFSGTNKIRAYAHCAKQSKGITVLLINLDSNTTVEAEVTFNNNAESLRHRKMSSHSKRMELPLASETAREEYHLTPQDGDIHSQTMVLNGKALSVNSDGDIPPLEPIYVNSSEPIRVAAFSIVFAHLPDAVVSACC

SEQ ID NO: 132851 - protein, 254 aa, Glycine max
  Coding DNA Sequence Number=SeqID_16073
  Gene Ontology: Mol. function=DNA binding; Cellular component=nucleus; Biological process=regulation of transcription
  Homolog annotation: Hit_ID=Q1RUM7; Match level="QueryCoverage=99%, HitCoverage=98%, E-value=2e-70, Identity=55%"; Hit description =Homeodomain-related
  Pfam annotation: Domain name=Myb_DNA-binding; Domain location=24-59; Score=24.9; E_value=0.00029; Accession=PF00249.21; Description=Myb -like DNA-binding domain
  Pfam annotation: Domain name=Myb_DNA-binding; Domain location=65-110; Score=46.9; E_value=7e-11; Accession=PF00249.21; Description=Myb-like DNA-binding domain
  Pfam module annotation: Pfam domain module=Myb_DNA-binding::Myb_DNA -binding; Domain location=24-59::65-110
MDVKVKKSQSIELQVQDCEEDIRKGPWSVEEDTILQNYVATHGLKRSGKSCRLRWLNYLRPDVRRGNITLQEQITILELHSRWGNRWSKIARHLPGRTDNEIKNYWRTRVIKQARNLKCDVDSKQFQDALRYVWMPRLIERTHPSLPIPSETHGPAHVDPNPTAPAQHELHGSGSGSGPSALEDVSSGAELNAPLDSDSEHLVYDVWGTCDSFNGNSTLPLGGGDLMESLWEDENMWLMRQLCHDLEIKDNFLA

SEQ ID NO: 132852 - protein, 203 aa, Glycine max
  Coding DNA Sequence Number=SeqID_16074
  Gene Ontology: Mol. function=DNA binding; Cellular component=nucleus; Biological process=regulation of transcription
  Homolog annotation: Hit_ID=Q0PJK7; Match level="QueryCoverage=96%, HitCoverage=90%, E-value=4e-54, Identity=57%"; Hit description=MYB transcription factor MYB76
  Pfam annotation: Domain name=Myb_DNA-binding; Domain location=32-77; Score=49.1; E_value=1.5e-11; Accession=PF00249.21; Description=Myb -like DNA-binding domain
MDRARGFSSLQLHHCPRRRLRWLNYLRPNVRRGNITLQEQLLILDLHSRWGNRWSKIAEHLPGRTDNEIKNYWRTRVVKQAKQLKCDVNSKQFRDTLRFVWMPRMLERIRAQASSSAQAHQSSLISNSNTQAHSGLLSSALHAHAPSLSDSSASYNLMGADAGSCSSHSYYSDIAGNGFGGADLWTDQNICFLQHQLAHHDLF

SEQ ID NO: 132853 - protein, 332 aa, Glycine max
  Coding DNA Sequence Number=SeqID_16075
  Gene Ontology: Mol. function=oxidoreductase activity; Cellular component=cytoplasm; Biological process=response to red or far red light
  Homolog annotation: Hit_ID=Q4W8C2; Match level="QueryCoverage=91%, HitCoverage=89%, E-value=1e-148, Identity=82%"; Hit description =Gibberellin 2-oxidase
  Pfam annotation: Domain name=2OG-FeII_Oxy; Domain location=173-277; Score=124.8; E_value=2.4e-34; Accession=PF03171.10; Description=2OG -Fe(II) oxygenase superfamily
MVVLSPSPTSIKTSYKKKKTMKIPTIDLSMERTELSETVVKACEEYGFFKVINHNVPKEVIARMEEEGAKFFAKPTHEKRRAGPASPFGYGFTNIGPNGDKGDLEYLLLHANPLSVSQRSKTIASDSTKFSCVVNDYVEAVKEVTCEILDLVLEGLGVPEKFALSKLIRDVNSDCVLRINHYPPLNQKLKGNKNSIGFGAHSDPQILTIMRSNDVGGLQIYTREGLWIPIPPDPNQFFVMVGDVFQVLTNGKFMSVRHRALTNTLGARMSMMYFAAPPLDWWITPLAKMVSPPQNPSLYKPFTWDHYKKATYSLRLGDSRLDLFKAQLDTHH

SEQ ID NO: 132854 - protein, 214 aa, Glycine max
  Coding DNA Sequence Number=SeqID_16076
  Gene Ontology: Mol. function=acyltransferase activity; Cellular component=integral to membrane; Biological process=metabolic process
  Homolog annotation: Hit_ID=Q1RU17; Match level="QueryCoverage=98%, HitCoverage=38%, E-value=3e-70, Identity=63%"; Hit description =Phospholipid/glycerol acyltransferase
MARSINNMITYFATRQFKYQRYHSLLRRSDLNDHTLIFDLEGALLKSSSVFPFFMLVAFEAGGLLRAIVLLLVYPFVCLVGDETGLKIMVMICFFGIKEESFRVGRTVLPKFLLEDVGSEMYEVVKRGGKKVGLSKLPRVMVGSFLKEYLEIDFVVGRELKVFNGFYVGLMEERKTMHANLELVPDGKRNYSHIIGISGFRQDLDDDYFSLCKK

SEQ ID NO: 132855 - protein, 464 aa, Glycine max
  Coding DNA Sequence Number=SeqID_16077
  Gene Ontology: Mol. function=DNA binding; Cellular component=nucleus; Biological process=regulation of transcription, DNA-dependent
  Homolog annotation: Hit_ID=Q1SUU5; Match level="QueryCoverage=89%, HitCoverage=95%, E-value=1e-167, Identity=71%"; Hit description =Homeodomain-related
MDAKDILGLPKNSFPSLEKKSRPPKESQRKPDGISREVYALTGGLASLMPAIEASQLKKKPLPLEKITWQWLPFTSSARKDNLHLYHWVRVINGVPPTGDYSFAKYNKSVDVIKYTDEEYDQVFVRSSDRFPSSRTVEELKDRYYSVSRAILIARAPSSGDVVAHSIVKEPYNVAQEMERKRALSMVLSQTRQQERRDEEVLVEAKKIAEKRLPPKVAGQSQFVASNAGAEAIERAVPGETVSPSNVQLPMVSSDASGAFSSLTLLFLTPPNSQTSMSALPTGKFDREIFQLRVYLRTYALEQMVQAGNASAGLRTIKRVEQTLQDLGVNLKPRVPTKAVCAEHLELRKEILTWLNLQKQVQYKEAEGSSFRDGSYGETPGTPKHLHRGGDQDRTFIPDSMNFGVERVGKKDQKRKVATGKGVSIHRILSIKIMNVVEGVAVNSTPENSDCGISSPTEIRFTSV

SEQ ID NO: 132856 - protein, 257 aa, Glycine max
  Coding DNA Sequence Number=SeqID_16078
  Gene Ontology: Mol. function=acyltransferase activity; Cellular component=integral to membrane; Biological process=metabolic process
  Homolog annotation: Hit_ID=Q1RU17; Match level="QueryCoverage=95%, HitCoverage=45%, E-value=3e-90, Identity=67%"; Hit description =Phospholipid/glycerol acyltransferase
  Pfam annotation: Domain name=Acyltransferase; Domain location=34-156; Score=31.1; E_value=3.9e-06; Accession=PF01553.11; Description =Acyltransferase
MTLAMLMWLPCGFILALIRITTAFSLPYNISTPLLEFTGLHLTTSRPKEDKLLLKGRLYACNHRTLLDPLYVSFTLSRDLVAVTYSLSRMSEIISPIKTVRLTRNRGQDAKTIKRLLKHGDLVVCPEGTTCREPYLLRFSPLFSELCVEIIPVAIDCHVTMFHGTTAGGLKCLDPFFFLMNPTPSYSVQLLEKVSPSITASNVINDDYARFEVANHVQTHIGKALGFECTQLNRKDKYLILAGNEGIVSTTKSGRSI

SEQ ID NO: 132857 - protein, 610 aa, Glycine max
  Coding DNA Sequence Number=SeqID_16079
  Gene Ontology: Mol. function=nucleoside-triphosphatase activity; Cellular component=nucleus; Biological process=ribosome biogenesis and assembly
  Homolog annotation: Hit_ID=Q1RU18; Match level="QueryCoverage=87%, HitCoverage=71%, E-value=0.0, Identity=90%"; Hit description =Helicase, C-terminal
  Pfam annotation: Domain name=DUF1605; Domain location=439-540; Score =92.2; E_value=1.5e-24; Accession=PF07717.6; Description=Domain of unknown function (DUF1605)
  Pfam annotation: Domain name=HA2; Domain location=293-405; Score =80.9; E_value=3.9e-21; Accession=PF04408.13; Description=Helicase associated domain (HA2)
  Pfam annotation: Domain name=Helicase_C; Domain location=132-232; Score=50.2; E_value=6.8e-12; Accession=PF00271.21; Description =Helicase conserved C-terminal domain
  Pfam module annotation: Pfam domain module=DUF1605::HA2::Helicase_C; Domain location=439-540::293-405::132-232
MTDPLLERYKVIILDEAHERTLATDVLFGLLKEVLKNRPDMKLVVMSATLEAEKFQGYFFGAPLMKVPGRLHPVEIFYTQEPERDYLEAGIRTVVQIHMCEPPGDILVFLTGEEEIEDACRKITKEISNLGDQVGPVKVVPLYSTLPPAMQQKIFEPAPPPLKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSGCHQQLSSLGSMSPVGMHHWILIPNCFVRPREAQKAADEAKARFGHIDGDHLTLLNVYHAYKQNNEDPSWCYDNFVNHRALKSADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLSSFPIPDMQFSFSSHTGKACPRETLQEARKGKGGSQEPQMKSAIHTIFAFGFGFGLDILPSAAETSTSERNTECR

SEQ ID NO: 132858 - protein, 34 aa, Glycine max
  Coding DNA Sequence Number=SeqID_16080
MVLKRFFKGSIRHAMAVPKAEKMQRQDETNKKQA

SEQ ID NO: 132859 - protein, 536 aa, Glycine max
  Coding DNA Sequence Number=SeqID_16081
  Gene Ontology: Mol. function=acyltransferase activity; Cellular component=integral to membrane; Biological process=metabolic process
  Homolog annotation: Hit_ID=Q1RU17; Match level="QueryCoverage=93%, HitCoverage=91%, E-value=0.0, Identity=66%"; Hit description =Phospholipid/glycerol acyltransferase
  Pfam annotation: Domain name=Acyltransferase; Domain location=323 -437; Score=34.8; E_value=3.1e-07; Accession=PF01553.11; Description =Acyltransferase
  Subcellular localization annotation: CTP_CleavageSite=36; ConfidenceScore=5.02e-01
MVMMSTFFFKFIFIFWYRFFFKPLKSLRRSVSNITYATHQFKYQRYHSLLHRNSDLNDHTLIFDVEGALLKSSSVFPFFMLVAFEAGGLLRAIVLLLVYPFVCLVGDEMGLKMMVMICFFGIKEESFRVGRTVLPKFLLEDVGSEMYEVVKRGGKKVGLSKLPRVMVESFLKEYLEINFVVGRELKVFNGFYVGLMEERKTVHANLELVREGKGNSSDMIGISGFHKDLDHSFFSTCKEVYMVTEAEKKNWKNLARDKYPKPLIFHDGRLALKPTPLMTLAMLIWLPCGFILALIRITTALSLPYNISTPLLEFTGLRLTISRPKTTNKEDKFLLKGRLYACNHRTLLDPLYLSFTLSRDLVAVTYSLSRMSEILAPIKTVRLTRNRDEDAKTMKSLLKHGDLVVCPEGTTCREPYLLRFSPLFSELCVEIIPVAIDCHVTMFHGTTAGGLKCLDPFFFLMNPTPSYSVQLLEKVSPSITASNVINGDYAGFAVANHVQTQIGKALEFECTQLNRKDKYLILAGNEGIVSTTKSGK

SEQ ID NO: 132860 - protein, 386 aa, Glycine max
  Coding DNA Sequence Number=SeqID_16082
  Gene Ontology: Mol. function=nucleic acid binding
  Homolog annotation: Hit_ID=Q1SUT8; Match level="QueryCoverage=38%, HitCoverage=54%, E-value=9e-63, Identity=74%"; Hit description=Zinc finger, CCHC-type
GCPSTLGANRKSQDFFERIPARDKNVRALFTEKVLSKIEKDVGCKIKMDEKFIIVSGKDRLILAKGVDSVHKIREEGDQRGTSSSQMTRSRSPERSPVSARFQRSEPQRSHSGPRNTSQFQQRFGRQERAVEDRIRDDVQKFSRGSPQGRDSIGYVYSILRKLQECLTYSSFPEAYGNSGARGRSSQSRSPRHAPYTGNSYNSFEGRNQNMGAYRNDGWDSHRRESGIRPGHQFDYSASPQTLEELELEYKNEAAELMKIRDREEDEENFKHREAIRDLREKYMSKVSLVRDTHAKQWEGFLQLDAQRRQQQAVQQMPSGYRGFKQQSFPEYDGSTANPPPYAGSNLPLESRNRFSDNMETYPNRPHDNFGEFHRRGDFAKAYNRY

SEQ ID NO: 132861 - protein, 129 aa, Glycine max
  Coding DNA Sequence Number=SeqID_16083
  Homolog annotation: Hit_ID=Q9FVD4; Match level="QueryCoverage=49%, HitCoverage=12%, E-value=3e-24, Identity=85%"; Hit description =Ser/Thr specific protein phosphatase 2A B regulatory subunit beta isoform
  Subcellular localization annotation: CTP_CleavageSite=15; ConfidenceScore=5.33e-01
MFHFIGGTLLIKDCLSSKVSTPSIPPTPRTEGEILKSSNMKSFNFSELKTATRNFRPDSVVGVKRRQVPTPSRPSRSLGNNITRVVRHGAESVGVDANGNSFDITTKLLHLACHPAENSIACAGADSLK

SEQ ID NO: 132862 - protein, 114 aa, Glycine max
  Coding DNA Sequence Number=SeqID_16084
MVKESVVVVEGFPPKGDTIEDIISPNSTIIVEDEEALNGIVVTLKIEEPVVSNAGAREEEESKEKKGIEEEEVKEKYRGHGEEDDKCRVCGEESMHGFQLVPVRFIPCFRHPEY

SEQ ID NO: 132863 - protein, 347 aa, Glycine max
  Coding DNA Sequence Number=SeqID_16085
  Homolog annotation: Hit_ID=Q8LKR2; Match level="QueryCoverage=28%, HitCoverage=23%, E-value=1e-22, Identity=50%"; Hit description=Actin- related protein 4
MELVSNLLTPVFARFVSYDTPEDAQSAISTMNGCQLGDQGEVLAGALKIMLCDDKQHDMRKTAAYIKRLATLSLCVGSADSMAALVIVKHLLQKNVKCINLLENDIGWGISIDIILIMVSSVSHSIALSPFPFSLTVQPQSFPSLKEAVNSNPKKKRTYARQDARATAAAVSTKALRATRYSYNYDSDNSKGCNSNCDMKPAINGKSKRSPCSFYSSLLPNLVLLEIGIPTHTYSVPESESYEVSTIVIDLGSHTCKASYVGEDAPKRCVEHTLSHTYVVGTIDKTNIDGTADINNENSDKTKGKCKLYVGSQSLGCHRDHMEVLSPLKDGVVIDWNIVDNIWDRAL

SEQ ID NO: 132864 - protein, 97 aa, Glycine max
  Coding DNA Sequence Number=SeqID_16086
MARVGYGYCLSNPLPDSSTYLHTCVRYSTDFKWRGGFGFGVGTGLVIPYPYPYPTFGYRGKPEPEPIPGQFGYYPSIRTDSGGYPRIRVFLPCLIIL

SEQ ID NO: 132865 - protein, 128 aa, Glycine max
  Coding DNA Sequence Number=SeqID_16087
  Gene Ontology: Mol. function=nucleic acid binding; Cellular component= ribonucleoprotein complex; Biological process=multicellular organismal development
  Homolog annotation: Hit_ID=Q1SUT7; Match level="QueryCoverage=87%, HitCoverage=21%, E-value=9e-36, Identity=64%"; Hit description=RNA -binding region RNP-1 (RNA recognition motif); WW/Rsp5/WWP
  Pfam annotation: Domain name=RRM_1; Domain location=8-80; Score=65.6; E_value=1.6e-16; Accession=PF00076.12; Description=RNA recognition motif. (a.k.a. RRM, R
QVDVSCKVYVAPVPRTATEDEIRPVFEEHGTIVEIVLLKHKKTGTRQGSCFVKYATFDEADRAIKVLNNKYTFAGESYPVVVKFADRELERLGVRGLCRNMEKKDPLEGKLLIFFWDSRGLLFDYMIV

SEQ ID NO: 132866 - protein, 271 aa, Glycine max
  Coding DNA Sequence Number=SeqID_16088
  Gene Ontology: Mol. function=nucleic acid binding; Biological process= multicellular organismal development
  Homolog annotation: Hit_ID=Q1SUT7; Match level="QueryCoverage=99%, HitCoverage=49%, E-value=2e-90, Identity=61%"; Hit description=RNA -binding region RNP-1 (RNA recognition motif); WW/Rsp5/WWP
  Pfam annotation: Domain name=WW; Domain location=187-216; Score=33.3; E_value=8.3e-07; Accession=PF00397.16; Description=WW domain
MALAAIKGLNKTFTMRGCDHPLIVRFADPKKPKTGESRGNYLSVNANFGPCSQEPAVWPLPNFGDSNTGGIILPHAPYHSTIAHPQVTSHMQNWEPGATVLQHPFPPHQVHPQVASMSLGSIQAPKLSSQLFITEVQRESHPADSSVQNIEQQLSSQLPSQTESNPSTVTGITPPDMPTSSQDEDFPECDWSEHYCPDGDKYYYNCVTCESRWDKPEEYALYEKESQKQQEQEDNSCSLSQLSLSSSQLVGQKQQETDHDHKQSETSPVVG

SEQ ID NO: 132867 - protein, 79 aa, Glycine max
  Coding DNA Sequence Number=SeqID_16089
MENNDGLWWLMVAVDDGENLRKDPNGQIMDKCHLKLQTKFREDPTVNEGWAAFLPRQLHVAFSRGFFEKLDPYLSTPLY

SEQ ID NO: 132868 - protein, 189 aa, Glycine max
  Coding DNA Sequence Number=SeqID_16090
MVEKFLQNAQVVSIGEINNLRQDCYCLTVGTIDEIIIDAPWSYDSCPNCTTTFDPSKGGSACRSCHTSVVDTIPRMEHNRDKGNFLLWDATCIKLFGKTAGECRDELIAARDDIKEQSSKGKGIAVEPKSSPPIFVPTPSLSQSSDYDPGNSTCLTPTKRISCQQTSFDFDFDEHAQYQLLTNKHIRAE

SEQ ID NO: 132869 - protein, 82 aa, Glycine max
  Coding DNA Sequence Number=SeqID_16091
MASKKRKAPSTPTQARYDRSRKLLPEKNVVVYYTEFDEFKEELKRRHWDEKLIDFANSSINITIVKEFYANLYDPEDKSPKQ

SEQ ID NO: 132870 - protein, 135 aa, Glycine max
  Coding DNA Sequence Number=SeqID_16092
  Gene Ontology: Mol. function=nucleic acid binding; Cellular component= integral to membrane; Biological process=protein amino acid autophosphorylation
  Homolog annotation: Hit_ID=Q9FNZ1; Match level="QueryCoverage=100%, HitCoverage=30%, E-value=4e-39, Identity=58%"; Hit description=Zfwd2 protein
  Pfam annotation: Domain name=WD40; Domain location=51-87; Score=36.7; E_value=8.1e-08; Accession=PF00400.22; Description=WD domain, G-beta repeat
  Pfam annotation: Domain name=WD40; Domain location=6-42; Score=8.9; E_ value=3.3; Accession=PF00400.22; Description=WD domain, G-beta repeat
  Pfam annotation: Domain name=WD40; Domain location=91-127; Score =33.4; E_value=8.1e-07; Accession=PF00400.22; Description=WD domain, G-beta repeat
  Pfam module annotation: Pfam domain module=WD40::WD40::WD40; Domain location=51-87::6-42::91-127
AWNIQTMSEFTLDGPKGRVRAMTVGNNTLFAGAEDGVIFAWRGSSKADSPFELVASLTGHTKAVVCLAVGCKMLYSGSMDQSIKVWDMDTLQCTMTLNDHTDAVTSLICWDQYLLSSSSDRTIKVWACIEAGSLE

SEQ ID NO: 132871 - protein, 64 aa, Glycine max
  Coding DNA Sequence Number=SeqID_16093
MHLCLTKIENLLQANRKSLRDFPSMPYPLGYAAKTHQNNLIYNELAYDREILAAEFDKCYQSLT

SEQ ID NO: 132872 - protein, 96 aa, Glycine max
  Coding DNA Sequence Number=SeqID_16094
  Gene Ontology: Mol. function=nucleic acid binding; Cellular component= nucleus; Biological process=regulation of transcription
  Homolog annotation: Hit_ID=Q1SFN1; Match level="QueryCoverage=86%, HitCoverage=24%, E-value=1e-34, Identity=88%"; Hit description=CENP -B protein
MPLRITLQRTLGLNSIVGTIIENNAEDDSEDDTVSLEPVARKEALMASNTLHNFMIQYKNTTPELLYAIRKVRDELQIDLNFKGKQTTIESYFDRV

SEQ ID NO: 132873 - protein, 172 aa, Glycine max
  Coding DNA Sequence Number=SeqID_16095
  Gene Ontology: Mol. function=peptidase activity; Cellular component =integral to membrane
  Homolog annotation: Hit_ID=UPI00006BE73E; Match level="QueryCoverage =92%, HitCoverage=36%, E-value=4e-47, Identity=57%"; Hit description =probable peptidase
  Pfam annotation: Domain name=Peptidase_M16_C; Domain location=4-103; Score=-4.2; E_value=0.1; Accession=PF05193.11; Description=Peptidase M16 inactive domain
MFLPTEHLLIKRKDAYVLDMLSTYLSNGKSSVLYKKLVDQDKKALQVAAFNQGLEDYSIFAFFAIPMGQTTKQTLQSDIDAEIKKLQTTLISQEDYQKIQNQFENQFVNQNSSIQGIAASLATNHVLMGNTNLINKEIDIYRSITREDLQNAAKKYLNPNQRIIINYVPEKK

SEQ ID NO: 132874 - protein, 36 aa, Glycine max
  Coding DNA Sequence Number=SeqID_16096
MARSMFASCPYVVTSFLMVSRGIIPFEEHIAAVGVN

SEQ ID NO: 132875 - protein, 208 aa, Glycine max
  Coding DNA Sequence Number=SeqID_16097
  Gene Ontology: Mol. function=glutamate-5-semialdehyde dehydrogenase activity; Cellular component=membrane; Biological process=electron transport
  Homolog annotation: Hit_ID=Q8ZRG3; Match level="QueryCoverage=87%, HitCoverage=46%, E-value=8e-85, Identity=81%"; Hit description =Cytochrome BD2 subunit I
MAWMGATISVIHSAIENIARMAGGAAQECGYRHMQQAVREGGVKHHGEPVHRHDLTVDDLIALRGLHPAVRREDPEGRNNSAQRHHAGGEEVQTRPDFVPAEQHHAEEPGFEEEGGQHFIGQQRAGHHQPGDHAHAKVDGKNLRPEMVQRAPDRIFGFQPQPFEYGKVACETDGDGRENNVKGYGAEIGRADAEKRILTITVGVNFTL

SEQ ID NO: 132876 - protein, 88 aa, Glycine max
  Coding DNA Sequence Number=SeqID_16098
  Gene Ontology: Mol. function=RNA-directed DNA polymerase activity; Biological process=RNA-dependent DNA replication
MPGLSSNIVQHRLPLNPECSPVKQKLRRMRPETSLKIKEEVKKQFDAGFLAVTRYLEWVAKKDGKIKMAPEDMEKTTFVTLWGMSAIK

SEQ ID NO: 132877 - protein, 183 aa, Glycine max
  Coding DNA Sequence Number=SeqID_16099
  Gene Ontology: Mol. function=nucleic acid binding; Cellular component= nucleus; Biological process=DNA integration
MSAMDMIKSLSSKPEKFTGENFFCWQQQMKFWLTELDLYSVISKREIKTSTSSTDIVQTDATIKHDVSDKDILCHGRILSALADNIYKIFCHTKTSVELWEALELKYGSAEKGLSRYSCEKMIEFQMIDGKSISDQIHEFENIVYDMKLKGIVLPDIMLVAFMISKLPPSWTDFARSLKHKHE

SEQ ID NO: 132878 - protein, 107 aa, Glycine max
  Coding DNA Sequence Number=SeqID_16100
MFLQKAVASGGSNLARLGELGGKLLPYFPINRGRSEGERENPSRGASVTCPWVILRRFSTVLRRSSFVLRRSSVFNHDSARIPFLEDAHVSPRVALPPKGRLRKEAT

SEQ ID NO: 132879 - protein, 117 aa, Glycine max
  Coding DNA Sequence Number=SeqID_16101
  Gene Ontology: Mol. function=transition metal ion binding; Cellular component=chloroplast thylakoid membrane
  Homolog annotation: Hit_ID=Q9FVZ7; Match level="QueryCoverage=57%, HitCoverage=29%, E-value=1e-13, Identity=51%"; Hit description =Putative steroid membrane binding protein
MTAGTKLIINVYSILRAYVETENKNFYGPGGPYAMFAGKECSRALALLSFKPDDINGNLEGLGEEELTILEDWEFKFIEKYPKVGQLIAEQRTRQNEFKEQTQDNLDNPNECKEEEK

SEQ ID NO: 132880 - protein, 80 aa, Glycine max
  Coding DNA Sequence Number=SeqID_16102
  Homolog annotation: Hit_ID=Q5W7C9; Match level="QueryCoverage=67%, HitCoverage=20%, E-value=2e-19, Identity=80%"; Hit description =Unknow protein
MEENSESALSTNKEAISNATRNLMESSILAQDERWRHALHMQVGREVVFPVADGWKRLLIPRRLRSKGGIRPRRGSRLIS

SEQ ID NO: 132881 - protein, 188 aa, Glycine max
  Coding DNA Sequence Number=SeqID_16103
MASKKRKSIGTRPTYQYDTRRFHSFEAWTRYTNNVLGRHILPKRKVEIYHTELDEFKAELETCNFHKCLTNLVDISIDLVLVKEFYANLYSPKGPSPKQVRVRGHVVKIDVDNLNTFLETPVVLAEGETLPAYSRYCRLPADIREIEAALCIPGRGFVLNAEGHPGKILKCGVFSHTPTWLLLPTPRT

SEQ ID NO: 132882 - protein, 206 aa, Glycine max
  Coding DNA Sequence Number=SeqID_16104
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=8e-26, Identity=32%"; Hit description= UPI00006A17C9 related cluster
RATRPRLQRLHFLTFRGLHVVTVNGLHALTFKGLYALAFRGLHAFTFRGLHVLPFRGLYALAFRGLHALTFIGLHALTFRGLHVPSFRGLHTFALRGLHALIIGGLHVLAITGLHILALRGLHILTFRGLHILTLRGLHALTFRGLHVLTFRGLHVLAFIGLHALTYRGLHVLSFRGLHTLALEGSTPSPLEGYTSSLLVGSTSAP

SEQ ID NO: 132883 - protein, 165 aa, Glycine max
  Coding DNA Sequence Number=SeqID_16105
  Subcellular localization annotation: CTP_CleavageSite=45; ConfidenceScore=5.57e-01
MNSLPSAVHVSSTFESGAPRIDCLALFANSPFSTFIRSPMNSLPSAVHVSSTFESGAPRIDCLALFANSPFSTFIRSPMNSLPSAVHVSSTFESGAPRIDCLALFANSPFSTFIRSPMNSLPSAGHVSSNFESGALRIDCLALFGNSPFSTFIRSPLNSLPSAVP

SEQ ID NO: 132884 - protein, 97 aa, Glycine max
  Coding DNA Sequence Number=SeqID_16106
MPKDYMFLKVLFKTKKSKIFKMDDQDSLLSLRKITLNRKGIPIEVAKGLAKKFKLKKSFSRDLLSGNRLPEDVIDYQWPKLIYNSVIDYTYMVIDYQ

SEQ ID NO: 132885 - protein, 243 aa, Glycine max
  Coding DNA Sequence Number=SeqID_16107
  Gene Ontology: Mol. function=L-lactate dehydrogenase (cytochrome) activity; Cellular component=peroxisome; Biological process=electron transport
  Homolog annotation: Hit_ID=Q7VSE6; Match level="QueryCoverage=99%, HitCoverage=62%, E-value=1e-123, Identity=88%"; Hit description=L -lactate dehydrogenase
  Pfam annotation: Domain name=FMN_dh; Domain location=1-243; Score =300.7; E_value=2.7e-87; Accession=PF01070.8; Description=FMN -dependent dehydrogenase
MSICSLEDVAAATGKPFWFQLYVMRDREFVGDLIDRAKAAGCSALVMTLDLQILGQRHKDIKNGLSTPPKPTIRNLINLATKPRWCLGMLGTKRRTFGNIVGHAKGVSDLSSLSSWTAEQFDPRLSWDDVEWIKQRWGGKLIIKGILDVEDAQLAANSGADALIVSNHGGRQLDGAMSSIAALPSIADAVGSKIEVWMDGGVRSGQDILKAVALGARGAMIGRAFLYGLGAYGQAGVKRVLEI

SEQ ID NO: 132886 - protein, 139 aa, Glycine max
  Coding DNA Sequence Number=SeqID_16108
  Pfam annotation: Domain name=zf-CCHC; Domain location=67-84; Score =28.4; E_value=2e-05; Accession=PF00098.13; Description=Zinc knuckle
MELMRLNQHEENDKKKKGIALTASSSTQEGSAKEDSIEIDEDDDLSLFVKRFNKFLRKRTEDSSSTPRCYECNQPGHLRVDCPMFKKRIEKSKKKVFNEKKAKKAYITWDENDMDSSEDSENKVVNLSLMAKSYESGEE

SEQ ID NO: 132887 - protein, 106 aa, Glycine max
  Coding DNA Sequence Number=SeqID_16109
  Gene Ontology: Mol. function=DNA binding; Cellular component=nucleus; Biological process=regulation of transcription
  Homolog annotation: Hit_ID=Q0PJD5; Match level="QueryCoverage=88%, HitCoverage=47%, E-value=3e-31, Identity=72%"; Hit description=MYB transcription factor MYB60
MCIKQRLGLDTCIKTLSSKEGYRNKKESRQHIILVSYIQEHGPGNWRAVPAKTGLSRCIKSCRLRSTNYLRPGIKQGNFTEQEEKMIIHLQDLLGNRYESIFQAPT

SEQ ID NO: 132888 - protein, 120 aa, Glycine max
  Coding DNA Sequence Number=SeqID_16110
MTKLGLCLSSALDDKRVRITVRMTKLGLCLSSALDDKRVRITVRMTKLGLCLSSALDDKRVRITVRMTKLGLCLSSALDDKRVRITVRVSMTKIYGAADKSKALAPTYPPMRNSDLRSSG

SEQ ID NO: 132889 - protein, 73 aa, Glycine max
  Coding DNA Sequence Number=SeqID_16111
MSLSLQSQGFTSFPCPTPDQFRAKVTWLGDWPEARAGEAPAEAPAEAPDEADEAREDEEMADLLDFLGGSGST

SEQ ID NO: 132890 - protein, 258 aa, Glycine max
  Coding DNA Sequence Number=SeqID_16112
  Gene Ontology: Mol. function=DNA binding
  Homolog annotation: Hit_ID=Q1STZ2; Match level="QueryCoverage=93%, HitCoverage=55%, E-value=1e-32, Identity=31%"; Hit description=IMP dehydrogenase/GMP reductase
MAEVSTKAIASLTQYYDQPLRCFTFGDFQLTPTIEEFEEILGCPLGGRKPYLFSGFYPSLARIFKARTLASQDEWAPFIDVLALLIFRVVLFPNMDELVDLTVIDAFLAFYDCKESPVVAILADLYDIFDRRCEKNHARIFCCTPALYVWLVSHLFRKGERHIFQLEGHRSCAKKKEANWDQLLASKERSSVNWFPRWKEGITDVLISCGEFPNVPLMGTRGCINYNPVLTIRQLGYPMRGAPVGSSGLRIIKKGGLN

SEQ ID NO: 132891 - protein, 299 aa, Glycine max
  Coding DNA Sequence Number=SeqID_16113
  Gene Ontology: Mol. function=hydrolase activity; Cellular component =membrane; Biological process=phosphonate transport
  Homolog annotation: Hit_ID=P16689; Match level="QueryCoverage=65%, HitCoverage=52%, E-value=4e-76, Identity=74%"; Hit description =Protein phnM
MDHSPGQRQYASLEMYRTYYQGKYQLNDEQMDQFEREQLALAAEFSTPNRNAIAGLCQARGIPVASHDDATAAHVAESHAVGSAIAEFPTTLEAARASRDCGMRVLMGAPNIVRGGSHSGNVAAWQLASHGLLDILSSDYYPASLLDAVFRLVADERNALTLPQAAALVTRNPAQAIGLHDRGTIAEGLRADLVLAHTDHGQAGVLMARLIWLTGPSGSGKDSLLNALREAPPDKLVIAHRYITRPADAGGENHVALSEAEFRRREALGLFAISWRAHGLSYALGKEIDHWLARGLNVL

SEQ ID NO: 132892 - protein, 104 aa, Glycine max
  Coding DNA Sequence Number=SeqID_16114
MHRRPQTHRCHLIRLIQLGHLACVATYPSAGGRRVTRGMRVPRKEYARSRHQRLFEENVGKTGKDAIYELLSERFGSCIYARGRGETLRRWTINDLLFLKGEKR

SEQ ID NO: 132893 - protein, 37 aa, Glycine max
  Coding DNA Sequence Number=SeqID_16115
MAKAFNRFGMKGALIVHSGLDEMNPLVPIPRNYLIIP

SEQ ID NO: 132894 - protein, 61 aa, Glycine max
  Coding DNA Sequence Number=SeqID_16116
MEEKVKLKISGGLRSTYLKLLCSDTTCWKLAYEASMEAGSLSFNKRKIKEKRLEETSSTRE

SEQ ID NO: 132895 - protein, 68 aa, Glycine max
  Coding DNA Sequence Number=SeqID_16117
MQSQGLSLPPEPLVSPSGPRVGVEEVTNADAPVPVPTDEVSLVGQALHTFLAWSTHLVKSLSQQRASN

SEQ ID NO: 132896 - protein, 86 aa, Glycine max
  Coding DNA Sequence Number=SeqID_16118
  Subcellular localization annotation: CTP_CleavageSite=46; ConfidenceScore=5.23e-01
MEAKAQKWWSRGENQQNPWVQGCSPKRANPASFFFQKNNERCVPVSSSMRFFIVIHLFICSPEHKFKIITGSKHNNTQGVSYHIPS

SEQ ID NO: 132897 - protein, 46 aa, Glycine max
  Coding DNA Sequence Number=SeqID_16119
MSGATSDSVPQSIDPNSQHVCNPISSILTVGNCKNMSELREIPFAP

SEQ ID NO: 132898 - protein, 76 aa, Glycine max
  Coding DNA Sequence Number=SeqID_16120
MDNHSWCYPTCIQCHKKTDIEAAPFKCGCGKENDQPVLSECAELIGQSTDEVNRACSKVDSLNLDCNDAPQVESIS

SEQ ID NO: 132899 - protein, 72 aa, Glycine max
  Coding DNA Sequence Number=SeqID_16121
MGRALQGAPNPGFVRRKGRGGSRRRRQTVAEDDGDAGDSQNEIENKNEGNAANLLLGHSHSSIFTSIYPFLG

SEQ ID NO: 132900 - protein, 233 aa, Glycine max
  Coding DNA Sequence Number=SeqID_16122
  Gene Ontology: Mol. function=cysteine-type endopeptidase activity; Cellular component=GPI-anchor transamidase complex; Biological process=proteolysis
  Homolog annotation: Hit_ID=Q6Z6K3; Match level="QueryCoverage=65%, HitCoverage=38%, E-value=5e-74, Identity=89%"; Hit description =Putative GPI-anchor transamidase
MAQDVMKLLFHDCFHVMAQDVMKLLFHDCLPARAQVDYRGYEVTVENFLRVLTGRHETSVPRSKSLLSDEGSHILLYMTGHGGDEFLKFQDSEELQSHDLADVVKQMKEKHRFKELLIMVDTCQASTLFCQLHSPGVLAIGSSMKGENSYSPHLDSDVGVSVVDRFTFYTLAFFERLNMNDNASLSGLSSRCWGFKPWLPKTVPRSQIKVGVGMSECRLVWQRQSHLAASRVA

SEQ ID NO: 132901 - protein, 90 aa, Glycine max
  Coding DNA Sequence Number=SeqID_16123
MRAVDFQGENRDIQLLVHVHALGMQKSSNMPHRATHTCPQNLSQKNDDLGLIPRWIVMKFEHHLHNPIPRILTDGNCKNMSELGGIPFTQ

SEQ ID NO: 132902 - protein, 1146 aa, Glycine max
  Coding DNA Sequence Number=SeqID_16124
  Homolog annotation: Hit_ID=Q83IM7; Match level="QueryCoverage=41%, HitCoverage=91%, E-value=0.0, Identity=75%"; Hit description =Hypothetical protein yjgR
  Pfam annotation: Domain name=DUF853; Domain location=529-1024; Score =1160.9; E_value=0; Accession=PF05872.2; Description=Bacterial protein of unknown function (DUF853)
  Pfam annotation: Domain name=FtsK_SpoIIIE; Domain location=516-689; Score=-43.1; E_value=0.045; Accession=PF01580.9; Description =FtsKSpoIIIE family
  Pfam annotation: Domain name=SBP_bac_5; Domain location=62-433; Score= 208.6; E_value=1.5e-59; Accession=PF00496.12; Description=Bacterial extracellular solute-binding proteins, family 5
  Pfam module annotation: Pfam domain module=DUF853::FtsK_SpoIIIE::SBP _bac_5; Domain location=529-1024::516-689::62-433
QNKPAFSQQRDSDKVVASITQDNHDASTLIVLHLIQQRLCPAGRHAKRHAGGGQADRDAPQKLAPLLATSWQPGSTPHSLVFNLKPDAHFVSGNPVTAQDVVFSLTRAVQLNKAPSFILAEFGWTADNIASQLRVVNDHQLEIQWPAQIGQDLALRLLTAPVASVVDSKTVQQHITANDSGNGWLHTHSAGSGAFSIQQYVPQQALVLSANPHASPQPQLKRILLKGVADAGARRLLIQQGDVDVAYQLGPDQIDALKNDKQLRIEAFPSSLVYYLAFNTQNKAQPALGNPALWQAARWLVDYNAISRDLLKGQYRIHQSFLPQGFDGALENKPFHYDVAKAKAILAQGGIRPGSKFSLTVINQPPYIDVAQALQASFAKADVQIELQPVAESELWGKMRGRDFQSIFIYWGADYVDPNTNASAFAYNVPGGSKTLAWRVGWEIPELSAQTRAAAGESDASQRRALYTALQQRVQQDSPFVVMLQGAQQVAVRNNVSHVQQGIGVSLLFFDAVEKSHYAMPESANIMTTPLLIAQTPDLQLHLLPAMANRHGLITGATGTGKTVTLQKLAESFSAIGVPVFMADVKGDLSGIAAAGDGSEKLLARLAKIGVTDWQAQKNPVMLWDIFGQQGHPVRATVSDLGPLLLARLLSLNEVQSGVLQIIFRIADDQGLLLLDFKDLRAMTQYIGDNAKAFQTQYGNISSASVGAIQRGLLALEQQGAEHFFGEPMLDIRDWMRCDADGKGFINILAAEKLYQQPKLYATSLLWLLAELYEQLPEAGDLEKPKMVFFFDEAHLLFNDAPPVLLEKVEQVIRLIRSKGVGVYFVTQNPADIPDNVLGQLGNRVQHALRAFTPKDQKAVKSAAETMRANPAFNTVEAIQALGTGEALISFLDEKGSPSMVQRAMVIAPGSRMGPATPDERNSLINHSPLYGKYDSAVDRESAFEMLQQGVQAAPQQADAPPGKGNSVAVDDGILGGLKEILFGSTGPRGGKRDGVSARWTPPLIALCYDRGMDKYQQLKRSKRLALSLLLIAAATFVVTLFLPPTFWVLGLKAIAEAAMVGALADWFAVVALFRRVPVPFISRHTAIIPRNKDRIGENLGRFVQEKFLDTDSLLALIRRHDPSQLLAQWLNTPGNADRIGRHLLQ

SEQ ID NO: 132903 - protein, 68 aa, Glycine max
  Coding DNA Sequence Number=SeqID_16125
MRLPGKESLPMGSPITINEILDASISFLNDHLEETPGSTKIEENHSKCINLAQCGARKKVASARDFGW

SEQ ID NO: 132904 - protein, 217 aa, Glycine max
  Coding DNA Sequence Number=SeqID_16126
  Gene Ontology: Cellular component=membrane
  Homolog annotation: Hit_ID=Q8PNZ6; Match level="QueryCoverage=94%, HitCoverage=82%, E-value=2e-47, Identity=43%"; Hit description =Integral membrane protein
  Pfam annotation: Domain name=DUF6; Domain location=75-204; Score= -2.0; E_value=0.086; Accession=PF00892.11; Description=Integral membrane protein DUF6
MLLPRWKRQAPRLGRAEWIGLLWLSLAGNLVYFLLLVTAVQWAGGAAASLIVGLIPVVVTLVGVREQGAVPLRQLLPALGLRWLARRPDLSSHDWSLLTGVTTGGLALLLVPMAFIGHTGSHSAAQWSGFWAISAGVAVVASILGNAFWNRASRLLPLTLTGQMIVFETLFALLYAFAWQQRWPTLLEALAIVFLVAGVMLCAHAHRTPRAIAEHAG

SEQ ID NO: 132905 - protein, 219 aa, Glycine max
  Coding DNA Sequence Number=SeqID_16127
  Gene Ontology: Mol. function=helicase activity; Biological process =viral genome replication
  Homolog annotation: Hit_ID=Q1SM26; Match level="QueryCoverage=87%, HitCoverage=46%, E-value=7e-50, Identity=54%"; Hit description =Nucleic acid-binding, OB-fold
  Pfam annotation: Domain name=DUF889; Domain location=1-207; Score =241.9; E_value=1.4e-69; Accession=PF05970.5; Description=Eukaryotic protein of unknown function (DUF889)
MHLQTNPASHTNHHDLKQFSDWLLDIGDGKLGEPNDEYDKITIPDEFLIKDFNDPIQSIVEATYPDLLQNYSNGDFLQKKIVLASTKDVVDSINDYVLALIPTEEKEYCSVDKSDELLNPAFGILTPEFLNSLKTSGIPNHKLKIKVGTPIILLRNLDQADGLCNGTRLIVTRLGSNMVEAKIITGPNIGHRTYIPRMNMSPSNSPWSFKLIRRQFHLQ

SEQ ID NO: 132906 - protein, 172 aa, Glycine max
  Coding DNA Sequence Number=SeqID_16128
  Gene Ontology: Mol. function=zinc ion binding
  Homolog annotation: Hit_ID=Q1S818; Match level="QueryCoverage=52%, HitCoverage=85%, E-value=1e-13, Identity=46%"; Hit description=Zinc finger, GRF-type
  Pfam annotation: Domain name=zf-GRF; Domain location=60-103; Score =30.7; E_value=5.2e-06; Accession=PF06839.3; Description=GRF zinc finger
MAERKGPPSPTRDHRMLLDALSQRMNQVLREHTKGMYERLESLENQNLNWENEKHGDMDRHEFEAPLVTSWTEENPGRRFYGCCLYKDTGRRGCNFFQWHDPVGNNRQKKIIVGLMKEVDELKLREKDLQTMISEMKMKEKCLWIVLVVCWLKHFMNYFRHVQLKLSIWHNT

SEQ ID NO: 132907 - protein, 486 aa, Glycine max
  Coding DNA Sequence Number=SeqID_16129
  Gene Ontology: Mol. function=DNA binding; Cellular component=nucleus; Biological process=regulation of transcription
  Homolog annotation: Hit_ID=Q1SLX7; Match level="QueryCoverage=91%, HitCoverage=100%, E-value=1e-105, Identity=51%"; Hit description =Homeodomain-related
  Pfam annotation: Domain name=Myb_DNA-binding; Domain location=138 -184; Score=53.4; E_value=7.8e-13; Accession=PF00249.21; Description =Myb-like DNA-binding domain
  Pfam annotation: Domain name=Myb_DNA-binding; Domain location=190 -235; Score=52.5; E_value=1.4e-12; Accession=PF00249.21; Description =Myb-like DNA-binding domain
  Pfam module annotation: Pfam domain module=Myb_DNA-binding::Myb_DNA -binding; Domain location=138-184::190-235
  Subcellular localization annotation: CTP_CleavageSite=56; ConfidenceScore=5.45e-01
MKAWPARVIYPSSQENTNSLTRYPSSSSHSSSPPSMGMVYADMDSLSLCSHYGTVVSSHHQDCYVSNGGTNWGFPFMRECPNNSDDVAEEEEGKGSDSSTGEDSDKVNHHANNSNDENNPNENNSNSGGSGHSKLCARGHWRPAEDSKLKELVALYGPQNWNLIAEKLEGRSGKSCRLRWFNQLDPRINRRAFSEEEEERLMQAHRIYGNKWAMIARLFPGRTDNAVKNHWHVIMARKYREQSSAYRRRRLSQSSSVYRRVDEINTTITTTNSIVVSRDTEQQAPPPPPYCVNLSNNGGLANNIINNNNNINMMSSFPYAAASFHGGVVPSSGGIEFGLNSSPHMTTAKEPFSTTKLAPPHIALYPQQTSLDFFSGVRSSSDMVGEYFGQNLHHQQQQPSSGFYPQYPQYVMLMNHHHQQNNHNNFYGFSNSTSQILLGHSEASLSSSVAAEEHRDHQNLSSDQCPPDATTTIPPPFIDFLGVGAT

SEQ ID NO: 132908 - protein, 229 aa, Glycine max
  Coding DNA Sequence Number=SeqID_16130
  Gene Ontology: Mol. function=tetrahydrofolylpolyglutamate synthase activity; Cellular component=mitochondrion; Biological process=folic acid and derivative biosynthetic process
  Homolog annotation: Hit_ID=Q8W041; Match level="QueryCoverage=97%, HitCoverage=39%, E-value=6e-76, Identity=66%"; Hit description =Dihydrofolate synthetase /folylpolyglutamate synthetase
MKDFLDYLDSLKNYEKSGVPKGAGTDSSDGFDLGRMRCLMERFGNPHSKFKAVHIAGTKGKASTAAFVSNILRNEGYSVGCYTSFAHHGQQALFFSSSPHILTIRERILLGKSGHLVSAKLLNDLFRRIKPDIDQAMKEENGCISHFEVFTTMAFLLFADENVDFAVIEAGLGGARDATNIISSSGLVASVITTIGEEHLAALGGSLETIAMAKAGIIKQDRPVKCFSL

SEQ ID NO: 132909 - protein, 86 aa, Glycine max
  Coding DNA Sequence Number=SeqID_16131
MSLLEPLHYTNTSREFGTQSRTMMHSFPWEYDANKEVANATRRLLGLCSRGLRIIGNVKVRDLGVMTMFAFTGSREEVYWTMHMGE

SEQ ID NO: 132910 - protein, 53 aa, Glycine max
  Coding DNA Sequence Number=SeqID_16132
MTSNGGSWWPPMVVGGGGGVSRVRARLAKWESTFGAKHDFSCLVQFFSGWDLR

SEQ ID NO: 132911 - protein, 102 aa, Glycine max
  Coding DNA Sequence Number=SeqID_16133
MDGDDENEDVLPWDPITCSGQRTKKRKEPFGVEDVAPNTKIGQVKGSSSLRGKEQMIEVEDNAILEEFEKEFQGIDFGNSKEKVEGHAPLLDHEEYDYIGKV

SEQ ID NO: 132912 - protein, 108 aa, Glycine max
  Coding DNA Sequence Number=SeqID_16134
  Pfam annotation: Domain name=zf-C2HC_plant; Domain location=13-62; Score=23.4; E_value=6.9e-05; Accession=PF07567.3; Description =Protein of unknown function, DUF1544
MRDHQILLAPILGGNIILEDKEIVVCAICSKVTKGGITKAKEHLMAKPWIVAACAKCPKKVRVELWGYLKDKKKQENEKFQGMRQHFLEDYSDNEEERAVDEGFANIE

SEQ ID NO: 132913 - protein, 127 aa, Glycine max
  Coding DNA Sequence Number=SeqID_16135
  Homolog annotation: Hit_ID=Q0PJI9; Match level="QueryCoverage=42%, HitCoverage=24%, E-value=2e-20, Identity=83%"; Hit description=MYB transcription factor MYB124
MGRVFVVDHIVNEHPLNVISGPKWLCYSGPSVTILGMGRDDGAVLLGREGAVLHSGAKLFAPSEPTRVAGPSLNVAVLSAAYLAVMLGTKLRLKVGYEIATKSTILFPNRLTQYKASYMSKKFKFLL

SEQ ID NO: 132914 - protein, 225 aa, Glycine max
  Coding DNA Sequence Number=SeqID_16136
MLAWESQRFLIVKKLAESTLLIFAGQDKGKVDNEGNQRVRENRRYFFSLYARYICEENLIPLNLEIEATCRRNNTTRRRREQQEVQINQGERGSSSELSSPSPVTSPHPFSKERVMAEYHPQRMTLEDYSSSTTPQYFTNIARPDVQAANIIYPHFFIQLIQGNLFHGLLSEEPYTHLATYIKICNMVKIVRVLEDAIRLNLFFFSLADEAKRWLPSFKGNSLHT

SEQ ID NO: 132915 - protein, 35 aa, Glycine max
  Coding DNA Sequence Number=SeqID_16137
MSSERGAIQLGFHATFALSAIATLGEYDGNLVLST

SEQ ID NO: 132916 - protein, 209 aa, Glycine max
  Coding DNA Sequence Number=SeqID_16138
  Gene Ontology: Mol. function=RNA binding; Biological process =hemolysis by symbiont of host red blood cells
  Homolog annotation: Hit_ID=Q53M53; Match level="QueryCoverage=76%, HitCoverage=45%, E-value=4e-46, Identity=56%"; Hit description =Hemolysin A, putative
MALQFLKHPVTISRGLHNETTLTFISRLRNPKLLFSVRCEDNAQIATSFRSYATAKSEKVLQVRKKKRLDEICVEKYQQYSRSVIQSWILQACGRNGLICCEVCTEVFVTFSSALREGKVYVDGKVINKAGTPVPGKAVVEIKADVPKYVCRAGHKLEAAVELLGVDVAGKVALDSGLSTGGFTDCLLQYGASHVYGVDVGYGQVTLEV

SEQ ID NO: 132917 - protein, 125 aa, Glycine max
  Coding DNA Sequence Number=SeqID_16139
MAPKHMEQLTQKIRDQLEESITEKVTRQVLTLPPEPVDGRSATHVSTKENVVIWFCSLHNRLDFLKGIIIRSDIFFNTFTLALFGNINILIVQFTSMFVLNNALKGFDDTPQSKSKATARWIVVK

SEQ ID NO: 132918 - protein, 132 aa, Glycine max
  Coding DNA Sequence Number=SeqID_16140
  Gene Ontology: Mol. function=RNA binding; Biological process =hemolysis by symbiont of host red blood cells
  Homolog annotation: Hit_ID=Q9LSV5; Match level="QueryCoverage=90%, HitCoverage=27%, E-value=2e-24, Identity=52%"; Hit description =Hemolysin-like
VMPAVVNAMKENAALVTLVKPQFEARRSQVGKGGIVKDPAVHQESSLYSNMASLWVSACAALSKTLKLFYFYKEIGELFELIVLEKIIKGVENFGFCCKGWIESPLKGAEGNTEFLVHFNRTHNIEVPEDLE

SEQ ID NO: 132919 - protein, 171 aa, Glycine max
  Coding DNA Sequence Number=SeqID_16141
  Gene Ontology: Mol. function=iron ion binding; Biological process =iron ion transport
  Homolog annotation: Hit_ID=UPI00005F9CD4; Match level="QueryCoverage =98%, HitCoverage=60%, E-value=2e-47, Identity=55%"; Hit description =COG2375: Siderophore-interacting protein
VNHVSGAVDADESAPGAVRRQVFQQRGQRRQRGRIARQAVEIGRRQHRFGAARVADTDFIADFRLARKVDRWASVIVNRKFDVHFRLFRAHGANGIGAHDRAHGVRGPARAVFGQRRQIRLSLVGERQKDFDVRSGGVGRVVAQIGRGKGDAAQVRRNVLYGADGDQVGGA

SEQ ID NO: 132920 - protein, 129 aa, Glycine max
  Coding DNA Sequence Number=SeqID_16142
MKAQAIQKQNTAPHVLSRGGYDYLEQKLLAEKTKKKMQEAAQLGSVDGVIDPPSPDSFEEQATQGSFVPHGHQDVLVAAIGRPEHPGRVRVVGAGVTIKQYFGSAPRTSRSASSLPPDELQQLTQQIRD

SEQ ID NO: 132921 - protein, 482 aa, Glycine max
  Coding DNA Sequence Number=SeqID_16143
  Gene Ontology: Mol. function=zinc ion binding; Cellular component =nucleus; Biological process=regulation of transcription
  Homolog annotation: Hit_ID=Q1SLX9; Match level="QueryCoverage=99%, HitCoverage=100%, E-value=1e-116, Identity=51%"; Hit description =Zinc finger, Dof-type
  Pfam annotation: Domain name=zf-Dof; Domain location=130-192; Score =137.3; E_value=4.3e-38; Accession=PF02701.6; Description=Dof domain, zinc finger
  Subcellular localization annotation: CTP_CleavageSite=49; ConfidenceScore=5.28e-01
MSEVKDPAIKLFGRTISLPHTHINDSFSSASASGPACAPSSSSSPREVTSSATQQQHEPEEPSRKVLTSSQDDDDASHQTTEDLKSSTTSSGIFENPKTPSAETETSIPKSSTNGEKSEKSASEEKTLKKPDKVLPCPRCNSMETKFCYYNNYNVNQPRHFCKNCQRYWTAGGTMRNVPAGAGRRKNKNSSATVSHYRHIMFSEGLQGATLNAPNGLHNAVMTFGPDSPLCDTMASMLNIAERAQSCVPNGFHVTEPNSFVSYRKEEEEEDGTSGHSTGVNSVATTSTLSHSGSHESLDKKVVEGFTPQFPYFPSAPWPYPIPPPTFFPQGYPLSLYTTPAYWSYMPPSWNNNISAISPQSSVNNSVSNPTLGKHSRDGNIIASSNSQREMHDMEHNSSEHNALIPKTLRIDDPREAAKSSISMWSKLGIKNDDKASSGGLFKAFPSSKGNDINHQMVEASSPVLQANPAALSRSLTFREQT

SEQ ID NO: 132922 - protein, 67 aa, Glycine max
  Coding DNA Sequence Number=SeqID_16144
MDKWFYCGKGEVGEARDGRFGIWGLGLGAWARVRVWGRRGLGVFDMRKNGIRTPSTYLDHEIPLDNE

SEQ ID NO: 132923 - protein, 378 aa, Glycine max
  Coding DNA Sequence Number=SeqID_16145
  Homolog annotation: Hit_ID=Q1S463; Match level="QueryCoverage=18%, HitCoverage=17%, E-value=7e-19, Identity=67%"; Hit description =Eukaryotic aspartyl protease
MNNFSFMTHILRWLRRFYRTALECTRVKLNNDGFMYRNVIVFTTSVYIINLEIPRQASASMSLVSCASFEPFLRLLRFRLQKDEALLYTIHVVLAKMRSSTQRGLLYTSSQNPHSHAKMMSSSNSQNPAAAAAASSEAQGSSSDTLSVDPALTLSVARNSGGSAILRAAFDRYRGIVFKNIPGVVLKAPSFLSFCFAATTTVLPISGHQQVRCGAVQSVTLSSSSEEALDGIIGFGQSNFSMLSQLSASRKVKKVFSHCLDNIRGGGIFAIGEVVELKVSNSVGTKIFALEKKTAKLRGIEKALVARHEAGHAVVGTAVANILAGQPRVESLHIELASLVCPEKLGIPKYKVGEDDGPLGNGPRRGLLRERQREGAGC

SEQ ID NO: 132924 - protein, 241 aa, Glycine max
  Coding DNA Sequence Number=SeqID_16146
MDLLISFVTYRQQLRLHRSQKAIYCHLHHWEDASINYLHPTTKLSCTTLYPTFRCKLHLTIFSPYLHLQSSSKMSITSSTVSSRMSYPIVRPPSIMQFMEAFHNDCRSKLHDDEPSNFDDAKSPKIPSFFHRQWAPNYPEFVHFRYDGALYQIRVRQQRGKFFLMDGLKDFRTQLQIYESTLINFFACDHNCIFDVHFIPPLDQQTCARPRLSSRQHIWTVEITQCILGVPQLLILKCRMM

SEQ ID NO: 132925 - protein, 121 aa, Glycine max
  Coding DNA Sequence Number=SeqID_16147
  Homolog annotation: Hit_ID=Q1S9B4; Match level="QueryCoverage=31%, HitCoverage=10%, E-value=2e-10, Identity=73%"; Hit description =Cyclin-like F-box; Serine/threonine protein phosphatase, BSU1
MVEGILYCYDYLGKIKGFNVGREVWEELKGLEKGLPRFEGSTQLMDEYFGKRAIDGVVVPRKGMGHASRDTTNARDRNAQEDYPRLSVAVAGDWKFDVYMGIDKFVHGMIDGAQKITALNG

SEQ ID NO: 132926 - protein, 405 aa, Glycine max
  Coding DNA Sequence Number=SeqID_16148
  Gene Ontology: Mol. function=DNA binding; Cellular component =chromatin; Biological process=DNA integration
  Pfam annotation: Domain name=rve; Domain location=119-272; Score =20.3; E_value=0.00012; Accession=PF00665.16; Description=Integrase core domain
MAEAHSISSPMVSNCKLSRHGVDASDVDDRRSTSGAAIFLGPNLISWWSRKQKVTARSSTEVEYCSLAQTSTELTWIHALLTELQVPFTTLVLYGDNQSAVSIAHNTMFHNHTNHMEIDVFFVREKVLAKQLSILHIPALDQWANVLIKPLSSARFEVLRGKLNKSKLMCEKQSGKVIKVIRTDVELNILHMTFKNNCDEGMLHEVPTPYTPQHNGVAERRNRTIMNMVRSMLKGRKLPKYFWGEAVSITCFILTRIPTRRLQEITPDKAWSRRKPNVSHLKIFGSLSYKHVPEQVGKKLDDRSDPMIFIGYHPTGAYKLYDPKGKKIVISIYVIVDESKWWNRDECSPEACVEMRLLEDQITEPELSETIQPRRPQRNRQQPRRLNDCEILPDNLVIEEGVWSI

SEQ ID NO: 132927 - protein, 155 aa, Glycine max
  Coding DNA Sequence Number=SeqID_16149
  Gene Ontology: Mol. function=nucleic acid binding; Cellular component= mitochondrion; Biological process=DNA integration
MSTTLSEPFSESVPAPTYIPVNTHPMQTRSKSGIHNPRLHPSLFLAHSEPKTVTQALKNSDWFAAMQQEYDALLKNRTWDLVPLPSNRQASGCKWVFRVKENDDGSINKFKARFLEESVFMTHPPGFEVEDRSLVCKFNKTLYGLKQPQGNGLIG

SEQ ID NO: 132928 - protein, 206 aa, Glycine max
  Coding DNA Sequence Number=SeqID_16150
  Pfam annotation: Domain name=RRM_1; Domain location=59-129; Score =24.7; E_value=0.00032; Accession=PF00076.12; Description=RNA recognition motif. (a.k.a. RRM, R
MSRERNSGWERVRNRRKAIERDRVSLREDPRRTYVRNRDGQQQCYNRANWRDHTDISSFYFTQFPEDIIEKDLWYHFKRWGDMREIFISKQRNNNSRRYGFARFKGVNDAHSLERQLDKIVIGGSKLYINIPKFGREMARKVAPEDKPMGTDEKHENEATQRRQPHPRMNPVSYAAMVARNKWNSGQRKTPHNEPQSRRLALNGTS

SEQ ID NO: 132929 - protein, 188 aa, Glycine max
  Coding DNA Sequence Number=SeqID_16151
  Gene Ontology: Mol. function=RNA-directed DNA polymerase activity; Biological process=RNA-dependent DNA replication
  Homolog annotation: Hit_ID=Q1SQN7; Match level="QueryCoverage=38%, HitCoverage=11%, E-value=1e-09, Identity=41%"; Hit description=RNA -directed DNA polymerase
MEAKTHLFWGESDPYIYFFSFFRVPNRVVDNMSPKGKRGLRPQRHQDLQPSIAWQMEMELISTSRRIMGQGPKTGSSSIAARKCLSKWNSVEVSKISLSSKWELTRTQDGSGISYGGDHYPTGQYSAQSAYNLLMGESMNENQDGVFEELWKLKIPNKISFFGTTTKMQPIYSSNEVKPSLYGGNLCP

SEQ ID NO: 132930 - protein, 121 aa, Glycine max
  Coding DNA Sequence Number=SeqID_16152
  Subcellular localization annotation: CTP_CleavageSite=29; ConfidenceScore=5.16e-01
MSLPPLRPHNHSQTHLKLSGRLPLQALVSADLNTTKSLKLSRTLIFLSLELSRHAEVVEAKLHGELKNNSRVQDKNQEEFKTQEESLETRIKIQGSRSRESRSRFKTQDSRMKRRLNQDKS

SEQ ID NO: 132931 - protein, 80 aa, Glycine max
  Coding DNA Sequence Number=SeqID_16153
MALHQPQQGNAFQNGILWRQNQIIQQMGAHKDTGWEWNFIWRRPLFDSEIAMAGSFQRDVEGKSIHPHRRDDWVWKADPS

SEQ ID NO: 132932 - protein, 124 aa, Glycine max
  Coding DNA Sequence Number=SeqID_16154
MFAQSGRWDMVITPFDVSLSEKGALSAIPTREGIVLSEQGRAKRAIVQWNVKNTIFHSPLLQNATQTLKPHFLPPKITCGHRELLLLAIEPTHQEEYFNQSGILRILLKDSVEKISQSFISYFI

SEQ ID NO: 132933 - protein, 239 aa, Glycine max
  Coding DNA Sequence Number=SeqID_16155
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=100%, HitCoverage=16%, E-value=1e-71, Identity=49%"; Hit description=Chromo
MADNTRMKELATDVKKNADDIKKLYDEVQIQFERFGAVTDARFQTMEDLQSSTDGKLDKINEALSMLLRNSSQTSSHGVTNSNKAPFQVRNVKLDFPRFDGKNVMEWIFRAEQFFDYYETPDKDRLTITSVHLDQDVVPWFQMIQKTHPFNSWAEFTRALELDFGPSIYDCPRATLFKLSQTGTVSDYYRQFTALANKVYGLSTDALVDCFISGLNPDIRRDVMIHTPINIVKAVSLAK

SEQ ID NO: 132934 - protein, 153 aa, Glycine max
  Coding DNA Sequence Number=SeqID_16156
  Gene Ontology: Mol. function=RNA-directed DNA polymerase activity; Biological process=RNA-dependent DNA replication
MKFYRGSVDGIFFIVKVVSGVMYVKDSWVNGKSLESLFPRLFLMSDQKEEVVRGMMGSWVEDRWRWSLRWRRVPFEWESELIFQVNLLLSNVQVHKDYSDSWLWLESTWSTYSSNSAYQARFAEEDAHELSSTLAEVWKLKIPLLKWLFAFGG

SEQ ID NO: 132935 - protein, 148 aa, Glycine max
  Coding DNA Sequence Number=SeqID_16157
  Homolog annotation: Hit_ID=Q84VJ1; Match level="QueryCoverage=88%, HitCoverage=40%, E-value=8e-45, Identity=64%"; Hit description =Biostress-resistance-related protein
CHMEYGNAFEDKANTMDISEDAPDDLEGLDASAAHVANLLSTEPADIKLGVGGFSMGAATALYSVSCFTAGKYGNGNPYPANPSAAVGLSGWLPCSKTLSNKLQGVDEATRRAQSFPVLLCHGKGQKTKCSEPAQSAADKYDPQGSDN

SEQ ID NO: 132936 - protein, 667 aa, Glycine max
  Coding DNA Sequence Number=SeqID_16158
  Gene Ontology: Mol. function=RNA-directed DNA polymerase activity; Cellular component=chromatin; Biological process=chromatin assembly or disassembly
  Pfam annotation: Domain name=Chromo; Domain location=555-606; Score =35.4; E_value=2e-07; Accession=PF00385.14; Description='chromo' (CHRromatin Organisation MOdifier
  Pfam annotation: Domain name=rve; Domain location=297-457; Score=7.8; E_value=0.0013; Accession=PF00665.16; Description=Integrase core domain
  Pfam module annotation: Pfam domain module=Chromo::rve; Domain location=555-606::297-457
MKDRFPLSAIDKLLNELGRASWFSKLDLHQGFHQILMADEDVAKTVFRTHEGHYKYRAMPFGLCNASSTFQAAMTTMLRPFLSQFAMHRYHLKYSKCSFEQRQLDYLGHVISGRDGYAAIAIPLTSLLCKETFGWSLESQAAFEQLKTAMTSAPVLALPKFDLPFTLETDTFGITMGAVLLQQGHPITFFSKAFCPRVHQASEYVRELYAITTAIPKNNTTWPNYWASTMISSTRPASRMSSPTHCLAFRYLRSKRVREEPSSCPDYHMSRDLLFYKNAIWVNPSNPLISALLMKFHATPIGGHLGMKKILHRYPCSHGYTVLLVVVDCFSKGVHLGALLARFTAYKVAALFLNIVCKHHGFPRSIISDYDPIFISSFWRELFRLNDTSLWMSTAYHPQSDDQTEVIYGKPPPAVPSYIPGAIENKDVDTMLHTRDKIHAKLRSQLLKAQTTMKQYTDRHHRDVHYDMGQLVYVKLRPYRQSSYRGHHHPKLAKRYFGPFRVLERIGSVAYHLQLLLDSKLHPVFHYSLLRAHHGPLDLLTSLLPLDAINHHPILEPLTILSSREDPSTSPPTRMVLVQWEGLAPKDSTWEKWDDVQHCVHLDDKVVFPGGGDVSNNLVISTSNLDHNHTGHAAHAESCNVTCEEAVSSQGRPRRSNARPSYLRDFV

SEQ ID NO: 132937 - protein, 132 aa, Glycine max
  Coding DNA Sequence Number=SeqID_16159
  Gene Ontology: Mol. function=transcription factor activity; Cellular component=nucleus; Biological process=regulation of transcription, DNA-dependent
  Homolog annotation: Hit_ID=Q9LTC5; Match level="QueryCoverage=82%, HitCoverage=86%, E-value=1e-20, Identity=45%"; Hit description =Nicotiana EREBP-3-like protein
  Pfam annotation: Domain name=AP2; Domain location=17-82; Score=133.5; E_value=5.8e-37; Accession=PF00847.10; Description=AP2 domain
MEEAHKGEQDKEKGGEEVKYRGVRRRPWGKFGAEIRDPTKSTGRQWLGTFDTAEEAARAYDRAAIELRGALAILNFPDEYYAHLPFVSSNPSISSNGSSYAAQQKEVIEFECLDNKVLEDLLESEVKRRNED

SEQ ID NO: 132938 - protein, 122 aa, Glycine max
  Coding DNA Sequence Number=SeqID_16160
MDILAWWWEGGGWCKDRGEKEEEVVNGENGVVKQWCDIKGVWIAEISGKGKKWNGCVSYAIVGGPKLGKGRRRRSTVKGWPWSWTSTVGHQDRHSRSEPLPTIMRSGSVFTAWRLSNLATCG

SEQ ID NO: 132939 - protein, 118 aa, Glycine max
  Coding DNA Sequence Number=SeqID_16161
  Gene Ontology: Mol. function=protein-tyrosine kinase activity; Cellular component=integral to membrane; Biological process=protein amino acid phosphorylation
  Homolog annotation: Hit_ID=Q2HVC0; Match level="QueryCoverage=70%, HitCoverage=10%, E-value=3e-19, Identity=61%"; Hit description =Protein kinase
MRQLQASLGADEEGRRSVVDPTFRKAWLDQSLKTMMEIYVRCLVKELADRPSIEYVLWNLQFASQKRFRADLQGKMEGNEIVAEGPRCSLHSRKVYSALSVDYLKMFLLNVPATVVAL

SEQ ID NO: 132940 - protein, 377 aa, Glycine max
  Coding DNA Sequence Number=SeqID_16162
  Homolog annotation: Hit_ID=Q1SEW3; Match level="QueryCoverage=39%, HitCoverage=12%, E-value=8e-34, Identity=48%"; Hit description =Integrase, catalytic region; Zinc finger, CCHC-type; Peptidase aspartic, catalytic
MDVNNAFLHGNIEEDIYMSQPPGFIHPQLLDHVCKFQKALYGLKQAPRDRFQALKQCMISIGFTNSKFDASLFVYKHDLVLAYFLVYVDDLLLTAKFSLIDLGEPSHFLGLELVPTQNGLFLTHYYKNSFLQHPFYNGCMRTALESGTLTLSLSRSHTDSLTRSKSCSRPATSDLAPSPAAAPASSAPAAPSPISSPAMTPGKQNILTLRGEIVVSEGHSFEVEFVEGGVGHEVEVNEAWLALDGHGPDAGESAGGATGGYGVAVSDEELCAARFPGRSPGPGPAEGRELTATYESGELHPGYLKLALAKSLNKILEEEYMLAKPARDAAAKAKMEVEAPSTEEVPLHEEIEWNISILVHCDSYQLALGTICSALLI

SEQ ID NO: 132941 - protein, 295 aa, Glycine max
  Coding DNA Sequence Number=SeqID_16163
  Gene Ontology: Mol. function=nucleic acid binding; Biological process= DNA integration
MVIGYGRLGKLDEEIDGWELRLGEEVDENRGKHFAISNKDTGLGFGLKLVGGYGASHGKQRQPKTRNLEYFGGHMTKMVMVVKHGVGGYWQFQLGDGVCIQMSHYVEGCMVEWLSEMFHVFEGREGFALGLEGKGDQDTDATILLRDDYGHGELLEETKKIATCTPDLQSFLVEEPLPLSGSLPQNAKGKFNRLRTITIGNVKLILTSVVIGNREMTDVIGHMESHVGNNMFWPCVPYDHNTANLMRRNLVVWSLDYCLRRRRNLCNLMRHDEKVRGSGKFHKRGCMGGSHRKRL

SEQ ID NO: 132942 - protein, 329 aa, Glycine max
  Coding DNA Sequence Number=SeqID_16164
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process =flavonoid biosynthetic process
  Homolog annotation: Hit_ID=Q9LHN8; Match level="QueryCoverage=98%, HitCoverage=90%, E-value=1e-130, Identity=67%"; Hit description =Leucoanthocyanidin dioxygenase-like protein
  Pfam annotation: Domain name=2OG-FeII_Oxy; Domain location=176-277; Score=130.5; E_value=4.6e-36; Accession=PF03171.10; Description=2OG -Fe(II) oxygenase superfamily
MGLKSLPSQYVQPLEERVINVVPQESIPIIDMSNWDDPKVQDAICDAAEKWGFFQIINHGVPLEVLDSVKDATYRFYGLPPKEKVKYTKENSSTKHVRYGSSFSPEAEKALEWKDYLSLFYVSEDEAAATWPPACRNEALEYMKRSEILIKQLLNVLMKRLNVSEIDETNESLFMGSKRINLNYYPVCPNHDLTVAIGRHSDVSTLTVLLQDETGGLYVRAPNHHGWIHVPPVSGAIVINIGDALQVMSNGRYKSIEHRVSANGSKTRVSVPIFVNPRPSDVIGPLPQVLASGEKALYKNVLYSDYVKHFFRKAHDGKLTVEYAKICQV

SEQ ID NO: 132943 - protein, 181 aa, Glycine max
  Coding DNA Sequence Number=SeqID_16165
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=72%, HitCoverage=8%, E-value=1e-40, Identity=57%"; Hit description=Chromo
MVDNTRMKELTGDVKRILEMMENRNKEYAARFETLETTLEYITGYEQSPFSGGSDVLQWIFKAEQFFNYHKTPGEQRLIIASIHLDKEVVPCYQMMTRENSFKTWIAFTRALETEFGPSPYECPRSQLFKLAKIGSVQSYYVQFTALANRVQGITQEALLDCFVGGLKPDIRRDVIAQSPT

SEQ ID NO: 132944 - protein, 146 aa, Glycine max
  Coding DNA Sequence Number=SeqID_16166
MMNSLSEHATLSEFINTHCILQELAHNRPIISMEHFLEQVAWPEAQLLLVRPNEAAQPKPTPVQVNPEPANPQSPVVNPPSSPELEAVPPSPPLIVISDASSNEAAAPPDSPITETTDPHVSPIGGIVDLSNSSSREVVALTEIPV

SEQ ID NO: 132945 - protein, 106 aa, Glycine max
  Coding DNA Sequence Number=SeqID_16167
MARHDTCQGLVWFKDKRDAPHYFHDTNAKMMIWKFYAKLVMHAPMWTLKWWRCVYCPLLAIPMLLWCFALRLPGGAVLLDESPVNVGPNDLVGGNGHSVELTEARN

SEQ ID NO: 132946 - protein, 90 aa, Glycine max
  Coding DNA Sequence Number=SeqID_16168
MVKKFGKFLKRSKDKKFSKPSKKIESNNNTFTCFKCWKQDSMDDSSTIEETKVNSEFEEVLETFNEIHEEVKRLVVSNNKLRSGLKLHIT

SEQ ID NO: 132947 - protein, 246 aa, Glycine max
  Coding DNA Sequence Number=SeqID_16169
MRGAPLLIAVIAEPFIAAECRLLESALNKGWLGFARVGVGERMGRRARTVACSRDNGWRACTSQRISRARPEIKQLKRNGVGGDEAVPVHPLEPAKGWAIEIKGSGSDTVFVGGSLVVKKLGDLEDPTQGIVPIEVRDVQLNGVTTLWVEWLVGSGDCTGRQPCLPTQNASRTGKKWLLLIGKWWCVKWYGLPLETAGRSDQCYEQREQEGDAGSLTTNYNSIVNDERSWVIIRSPSGSLVERYFS

SEQ ID NO: 132948 - protein, 123 aa, Glycine max
  Coding DNA Sequence Number=SeqID_16170
  Gene Ontology: Mol. function=fumarate hydratase activity; Cellular component=tricarboxylic acid cycle enzyme complex; Biological process=fumarate metabolic process
  Homolog annotation: Hit_ID=Q1RV37; Match level="QueryCoverage=67%, HitCoverage=16%, E-value=1e-22, Identity=67%"; Hit description =Fumarate lyase
  Subcellular localization annotation: CTP_CleavageSite=73; ConfidenceScore=5.68e-01
MLFMDTNKSHSSAPTWKKTAQSRVLIGLVLFSGGSFLPSPWRSTCSRVVYQLDPTQRRSSPCVLLPLPDPSPLPSGKKEIPLDPFKFPPTNYGEHKLKDRCRTSTSVGPANACPNPSFALLAS

SEQ ID NO: 132949 - protein, 251 aa, Glycine max
  Coding DNA Sequence Number=SeqID_16171
  Gene Ontology: Mol. function=potassium ion transporter activity; Cellular component=integral to membrane; Biological process =potassium ion transport
  Homolog annotation: Hit_ID=O64769; Match level="QueryCoverage=86%, HitCoverage=27%, E-value=3e-65, Identity=58%"; Hit description =Potassium transporter 11
  Pfam annotation: Domain name=K_trans; Domain location=1-247; Score= -171.7; E_value=7.7e-15; Accession=PF02705.7; Description=K+ potassium transporter
MAYWTDVSVNTVELLLKLTTYSRSTIREKSFAAKTKRWLEETPYMKNIILMLALVGTCMVIGDGILTPAISVLSAVGGIKVNHADLSNEVVVLVAVVILVGLFSMQHYGTDKVGWLFAPIVLLWFLLIGGIGIFNICKYGSSVLKAFSPLYIYRYLQREGKDGWLSLGGILLSITGTEALFADLAHFPVSSVQIAFTLLVFPCLLLAYSGQAAYLMHNLDHSEDAFYRSIPGLLYLSHSILELPLVILLCC

SEQ ID NO: 132950 - protein, 161 aa, Glycine max
  Coding DNA Sequence Number=SeqID_16172
MSLDQVLFKLANKWKGTERIKSFLWKLSQMYLLEKVQFFAVKLDLHPHSKSIKTYKPIASSKQLNENKVDIKWKFPDFGDVALNCDGAVNDGGGGFRANLKAILVGVKLAWSRGFTRIRVVLMHPCYNVVQGIHEVHSGSGNIIWNNILKEANQVDLQRKP

SEQ ID NO: 132951 - protein, 106 aa, Glycine max
  Coding DNA Sequence Number=SeqID_16173
MEDISDYKCNINSSEYFPLSGIARKRNSIVDQSEFQIVSIHQSSLDEHTTVRDLFALKANGNGRLLALFFAKESCISFSAPTSKTAEPLNSLRFFRLQRWKSIDTI

SEQ ID NO: 132952 - protein, 58 aa, Glycine max
  Coding DNA Sequence Number=SeqID_16174
TRLTALLPQPQKRTTCDETLVRDDDALLLCDIVDSKRERNGAIFEGYVKEEEEEEEDI

SEQ ID NO: 132953 - protein, 82 aa, Glycine max
  Coding DNA Sequence Number=SeqID_16175
MAILRKHYGCPGSPGIPVVNKTGGYGGHLARPGELVTETYEFRNDTCFLSVMLRNLADYIIILFWTYGMLRNLTYLCNDASI

SEQ ID NO: 132954 - protein, 364 aa, Glycine max
  Coding DNA Sequence Number=SeqID_16176
  Gene Ontology: Mol. function=protein serine/threonine kinase activity; Cellular component=cell surface; Biological process =protein amino acid phosphorylation
  Homolog annotation: Hit_ID=Q1RVK5; Match level="QueryCoverage=99%, HitCoverage=79%, E-value=1e-146, Identity=72%"; Hit description =Protein kinase
  Pfam annotation: Domain name=Pkinase; Domain location=15-300; Score =146.9; E_value=5.4e-41; Accession=PF00069.15; Description=Protein kinase domain
  Pfam annotation: Domain name=Pkinase_Tyr; Domain location=15-300; Score=74.8; E_value=2.8e-19; Accession=PF07714.7; Description =Protein tyrosine kinase
  Pfam module annotation: Pfam domain module=Pkinase::Pkinase_Tyr; Domain location=15-300::15-300
MKFRYKELEEATDGFQALIGKGASASVFKGILNDGTSVAVKRIDAEERGEKEFRSEVAAIASVHHVNLVRLLGYCNAPTAPRYLVYEYVSNGSLDWWIFSKRVSQRRRGGCLSWNLRYNVAIDVAKGLAYLHHDCRSRILHLDVKPENILLDENFRALVSDFGLAKLIGKEESHKEVSAIRGTRGYLAPEWLLEKGISDKTDIYSYGMVLLEIVGGRKNVCSVEIDERANKSKRKWQYFPKIVNEKVREGKLMEIVDPRLLECGGVVDETQVRTLVYVALWCVQEKPRLRPSMPQVVDMLEGRVRVEMPPDTRMVVVDFLCVDEESATDSNSMPRLDFVSNQRTQSNVESSSTYSFATTIMSGR

SEQ ID NO: 132955 - protein, 265 aa, Glycine max
  Coding DNA Sequence Number=SeqID_16177
  Gene Ontology: Mol. function=protein methyltransferase activity; Cellular component=cytoplasm; Biological process=protein amino acid methylation
  Homolog annotation: Hit_ID=Q9SNQ2; Match level="QueryCoverage=79%, HitCoverage=55%, E-value=2e-86, Identity=71%"; Hit description =Protein arginine N-methyltransferase protein-like
  Pfam annotation: Domain name=MTS; Domain location=51-184; Score= -80.0; E_value=0.0084; Accession=PF05175.4; Description =Methyltransferase small domain
  Pfam annotation: Domain name=Methyltransf_11; Domain location=67-166; Score=23.4; E_value=0.00027; Accession=PF08241.2; Description =Methyltransferase domain
  Pfam annotation: Domain name=Methyltransf_12; Domain location=67-164; Score=15.7; E_value=0.019; Accession=PF08242.2; Description =Methyltransferase domain
  Pfam module annotation: Pfam domain module=MTS::Methyltransf _11::Methyltransf_12; Domain location=51-184::67-166::67-164
MGTSANAVAGGRGGAPVPKDVDYANYFCTYAFLYHQKEMLSDRVRMDAYFDAIFQNKRHFAGKKTVLDVGTGSGILAIWSAQAGARKVYAVEATKMSEHARALVKANNLQDVVEVIEGSMEEITLPEKVDVIISEWMGYFLLRESMFDSVINARDRWLKPTGVMYPSHARMWMAPIRTGIVDHKLGDYESTMDDWHHFVDETKTYYGVDMSTLTRPFSEEQRKYYLQLDDGLYKHNSMCFTRLNDPNHYLELIFAGIVRGLHAGV

SEQ ID NO: 132956 - protein, 86 aa, Glycine max
  Coding DNA Sequence Number=SeqID_16178
MKEKKELVLWVLQKVRGSGGQQQRWWRKILCASSMILSFDEVLMNFNWWVNSGGGGGASVAHYCDASPCACLGVQYFSMKALLIGA

SEQ ID NO: 132957 - protein, 73 aa, Glycine max
  Coding DNA Sequence Number=SeqID_16179
  Homolog annotation: Hit_ID=Q2R2A3; Match level="QueryCoverage=76%, HitCoverage=4%, E-value=6e-08, Identity=68%"; Hit description =Ubiquitin carboxyl-terminal hydrolase family protein, expressed
MDSLFFFFFFFLKPTAKFQKKLQVPDVEFSKPCFNYFLGVELSRERIYMVLGSNILDWNTMIVLQKSPMQSTG

SEQ ID NO: 132958 - protein, 397 aa, Glycine max
  Coding DNA Sequence Number=SeqID_16180
  Gene Ontology: Mol. function=transition metal ion binding; Biological process=protein amino acid phosphorylation
MENNGVSVDGQSDHFSSVSDNNLIHASMPYYGVIEDIWELDYGQFRVHVFNYRWVNGNTGVKQDKLGFTLVDLQKGGYNDDPFIMAVQARQVFYVQDPSNWRWSVVVQGRKFSMTDYSDGSSVDVSDMSAVCQQMPIINATDQDDVVHATRNDHYEGLWENNQMKTRQSTRLRRLTARSLDQPRPTVNVNPATGRRSGPHKEKFHSYLGVVARDKIPIVHSSWNDEPETLKNLIWDYILVKFDIPEGDNAKKKGQAKDDPFVKYGIDVATWAEFAKSQQTPNWQGIKKKAREIQKYNDYPHLSHGGYELLENKLMDQKRKTQEQQVEFTENPSLYLDPPSPILRQMKWKMVCTKQYGQMNSTVAKEISDKIDSSEEQTMQGSFVPSGRQDILNTTIG

SEQ ID NO: 132959 - protein, 84 aa, Glycine max
  Coding DNA Sequence Number=SeqID_16181
MKIANITLKMGKGITKRSLHRTLPKSCNENIKHKCTRNGRSTCASMIEAKWFYDGTPISKETMTTLRHKWAGYFLQIKNNLEVK

SEQ ID NO: 132960 - protein, 38 aa, Glycine max
  Coding DNA Sequence Number=SeqID_16182
MKFLCLMFNQDIWTKGERLHSGNGCSGNDALLDVNHCP

SEQ ID NO: 132961 - protein, 98 aa, Glycine max
  Coding DNA Sequence Number=SeqID_16183
MIIRGQDIYNSQDKAITSPSSSESEETKGEESSEEIYPQEEGQPLMVKEECKETYIKETSPIRQPPHLVLCKKTLVSTATPLGLEIIPQVKELLDESL

SEQ ID NO: 132962 - protein, 75 aa, Glycine max
  Coding DNA Sequence Number=SeqID_16184
MATARWVLKHPVYGIVILRLGIYTKHESGDPTVMWFRMPPDSWVTVTKSGVVDKSRAFAPTYPQFVMRNSNLRSS

SEQ ID NO: 132963 - protein, 307 aa, Glycine max
  Coding DNA Sequence Number=SeqID_16185
  Gene Ontology: Mol. function=RNA-directed DNA polymerase activity; Biological process=RNA-dependent DNA replication
  Homolog annotation: Hit_ID=Q8H6Q8; Match level="QueryCoverage=85%, HitCoverage=55%, E-value=3e-32, Identity=35%"; Hit description=CTV.20
LKRKLRNLNLEPTIEEQINNLLIETLEEETKTSSSTFSEENLNIIKQDDQPSSTDDDEREINTLTREQDLLFEANNSIPDPQEKKVFLEKLKKTLETKPRPKDFITNNKFDVSNIFKRLENTSAKSTTIQDLQIEINNFKKEVKERRQQQEIHQIILSQLEENSDSESIEKNVENENLEDKMFMGLINKIKIQKFYINIRIIINDFVLDTMALFDTGTDSNCILEGLVPTKFFEKTSEKLTTTNGLKLKINYKLSSAIIENQGLRINTNFLLTCRMHSGIEENILSISPMRKTLGKKKFPQKLDQFR

SEQ ID NO: 132964 - protein, 366 aa, Glycine max
  Coding DNA Sequence Number=SeqID_16186
MGCFSSKVIARSISFHEERKKRSRRKTNGIPLLEDLIISTGGSDQYLALVCAANTVSNKLHSGSLSSNTSSKLAIEPATATSETIKKLKPSSARLSQGEGKQIESDKNRSKSWHQFPEHIVDSLVQENSSGFEDKHDSCSKGAARSRSFHTVEEYDDIVKKIWLAECHDGQQSEFNDEEDAGSGTNTTHHTEHKDCIIKKMQPPNLNKKYSLEERKVVKEINNLSTEAESHISSSGIKNEEVVPSHKRSTIEKGIKRKAVAKRLESLRIPSGVEYPAIASLREWLPAGGIYSPGSYVTPKFGSYSIMNIRNANESSEDSIFSPELVSAFEQCMQKLEAEEENILKQIVENVEEESEASSPKKGHHA

SEQ ID NO: 132965 - protein, 317 aa, Glycine max
  Coding DNA Sequence Number=SeqID_16187
  Gene Ontology: Mol. function=nucleic acid binding
  Homolog annotation: Hit_ID=Q01D99; Match level="QueryCoverage=44%, HitCoverage=33%, E-value=2e-15, Identity=32%"; Hit description=[O] KOG1816 Ubiquitin fusion-degradation protein
  Pfam annotation: Domain name=PGAM; Domain location=106-228; Score =56.3; E_value=1e-13; Accession=PF00300.12; Description =Phosphoglycerate mutase family
MTVVVIWMLQRCHIFTPLRNNNSKGKARDTTSEETKQQQGLSKPVLTNHKQKKMHSVICNSAVSLSPYHSCRRKPNRLRAKSSLLVQKQDTQLGEPLSDSVSVSRRLILLRHAKSSWDNRSLRDHDRPLSKSGKEDAVRVSRRLQQLGWIPELILSSDAARTKETLKIMQEQVQELVEAEVHFVSSFYSIAAMDGQTAEHLQKIICRYSRDEILTIMCMGHNRGWEEAASMFSGATVELKTCNAALLETAGKSWDECKVFICYYISFEKICKRLDLEASLLIQGTQNASVKATELMTLESIYWRKDECDAKASVRSV

SEQ ID NO: 132966 - protein, 76 aa, Glycine max
  Coding DNA Sequence Number=SeqID_16188
  Gene Ontology: Mol. function=pyruvate kinase activity; Biological process=glycolysis
  Homolog annotation: Hit_ID=Q1SGD3; Match level="QueryCoverage=71%, HitCoverage=16%, E-value=2e-10, Identity=63%"; Hit description =Pyruvate kinase
MGVKYRARIKQRLALYHGIMSIYMQFSNDAEETFSRALKLLLVNVDESSGLENRGQTIAKMQMRLETMLFMLVYCV

SEQ ID NO: 132967 - protein, 68 aa, Glycine max
  Coding DNA Sequence Number=SeqID_16189
MSNTKHQLRKENEKDGRVRRNLVVRWRWRFEGGGDEVMLVVTKSVRAMNRGKVVIWSIHGGNEGHGGG

SEQ ID NO: 132968 - protein, 194 aa, Glycine max
  Coding DNA Sequence Number=SeqID_16190
  Gene Ontology: Mol. function=signal transducer activity; Cellular component=microtubule; Biological process=signal transduction
  Homolog annotation: Hit_ID=Q9FKS9; Match level="QueryCoverage=98%, HitCoverage=42%, E-value=5e-65, Identity=69%"; Hit description=WD -repeat protein-like
  Pfam annotation: Domain name=WD40; Domain location=74-112; Score =37.8; E_value=3.8e-08; Accession=PF00400.22; Description=WD domain, G-beta repeat
MELFISWLQTMTLELEILIWRDFSFRSISAFLGQKMIQENGKKDRMHTSLSPDGKLVVIVGDYPEGLLVDSQTGKTITPFRGHLDFSFASAWHPDGHIFATGNQDKTCRVWDVRNLSKSVAVLKGNLGAIRSIRFTSDGHSSWRWPSQLTLCMCTTQSMDLRRSKRLIFLQNHSLLVFGTAPTEAFYSSIDAEK

SEQ ID NO: 132969 - protein, 84 aa, Glycine max
  Coding DNA Sequence Number=SeqID_16191
  Gene Ontology: Mol. function=catalytic activity; Cellular component =integral to membrane; Biological process=cellular metabolic process
  Homolog annotation: Hit_ID=Q1RUS0; Match level="QueryCoverage=92%, HitCoverage=16%, E-value=2e-25, Identity=86%"; Hit description=NAD -binding site; Nucleotide sugar epimerase
MAHQILIGVRFTYDEGKHTAETLTMDYHRRVGVEVRIARIFNTYGPQMCLDDGCVVSNFVAQSGGINATTKEGAFDHLWGWEAD

SEQ ID NO: 132970 - protein, 149 aa, Glycine max
  Coding DNA Sequence Number=SeqID_16192
  Homolog annotation: Hit_ID=Q10L49; Match level="QueryCoverage=78%, HitCoverage=20%, E-value=2e-47, Identity=77%"; Hit description =Expressed protein
MPIVMDTAITARDSIRGCRADANEAVVILLPSNITVFTLDFSGSGLSDGDHVSLGWHEKDDLKMVVSHLKSNKLVSHIGLWGRSMGAVTSLLYGAEDPSIAGMVLDSAFSNLYDLMMELADVYKIRLPKFTVHILSLLHSLCVCAHVVL

SEQ ID NO: 132971 - protein, 332 aa, Glycine max
  Coding DNA Sequence Number=SeqID_16193
  Homolog annotation: Hit_ID=Q10L49; Match level="QueryCoverage=28%, HitCoverage=16%, E-value=1e-31, Identity=62%"; Hit description =Expressed protein
MAVQYMRRVIEKKAKFDIMDLNCLLVAPKTFIPVLLGHGNDDQFIQPHHSDLISESYAGDKNIIKFDGDHNSSRPQFFYNSISIFFYNVLHPPHTPRVCKLEKYFDFGDLKTGSAVNEVKITSEKLSLQEIYLNLNIVTRMQFVNSNNDTPASFKGHLQSATTDAASSSSAPPSTSNSITASVSELISKVAPVTAAESMIREEPKHGNNEPGHDEPADMKIQQDEQNDPTEDYFSYCSSTRESWGRCSTLVLSDEESYPDFRDDDNGSEVFATPLGSMREMAADPKEEGKDQKKKKKAERSSKKLKSERFDKWESLSQRLRLCILKGRPKPS

SEQ ID NO: 132972 - protein, 328 aa, Glycine max
  Coding DNA Sequence Number=SeqID_16194
  Homolog annotation: Hit_ID=Q1SMI5; Match level="QueryCoverage=28%, HitCoverage=11%, E-value=5e-24, Identity=48%"; Hit description =Prefoldin; tRNA-binding arm; t-snare; Protein kinase PKN/PRK1, effector
  Pfam annotation: Domain name=zf-XS; Domain location=141-181; Score =3.7; E_value=0.074; Accession=PF03470.5; Description=XS zinc finger domain
MEVIPNYWLTSLDVESHESLVSGAEWESESPKAGFSSTASGWPSFDDIKSSSLTYSLSAEEKATVAVLQLQHRALEACQKFLVGDAGSDSDEDDEEAEDDELLDNDSKESEEYKFFEKVFAEDGDLRRYYENNHKEGDFYCLVCGGIGNKVWKRFKDCIGLIQHSTAILRTRRKRAHRAYAQVICKVVEPKNPAVGYTDDTNSNDVLPKFARRGLNFFETQEESNEQNSGSNNTLSESERVTKAETEILALKKAIAKLKDEKEAGLLQYQQSLEKMSNLELEVSTAQENSRKLDEQASKAEAEVQALKEAQIKLQAESEASLLQYQEK

SEQ ID NO: 132973 - protein, 519 aa, Glycine max
  Coding DNA Sequence Number=SeqID_16195
  Gene Ontology: Mol. function=oxidoreductase activity; Cellular component=membrane; Biological process=electron transport
  Homolog annotation: Hit_ID=O48786; Match level="QueryCoverage=93%, HitCoverage=92%, E-value=0.0, Identity=72%"; Hit description =Putative cytochrome P450
  Pfam annotation: Domain name=p450; Domain location=40-508; Score =242.4; E_value=9.3e-70; Accession=PF00067.12; Description=Cytochrome P450
MEEFKILFVFLMTLLLVLKVTISLWWRPRKIEGHFSNQGIRGPPYRFFIGNVKELVGMMMKASEKPMPFSHNILPRVLSFYHHWKKIYGATFLVWFGPTVRVTISDPDLIREIFTSKSELYEKNESPPLVKQLEGDGLLSLKGEKWAHHRKIISPTFHMENLKMLIPIMATSVVEMLEKWKAMAEEKGEVEIEVSECFQTLTEDVITRTAFGSSYEDGKAVFRLQAQQMVLAADAFQKVFIPGYRRNINSWKLDKEIKKSLVKIIERRRKENACGKEETKRPTDLLGLMIWASNNNNNTTSNVNVTVDDIVEECKTFFFAGKHTTSNLLTWTTILLAMHPQWQIRAREELVSVCGARHIPTKEDLAKLKTLSMIVNESLRLYPPTIATIRRTKADVELGPYKIPCGTELLIPILAVHHDQATWGSNATEFNPGRFSNGVSRAARLPFAFIPFGLGARTCIGQNLALLQTKLTLAVMVRGFNFRLAPTYQHAPTVLMLLYPQYGAPIRFQPIPAPTVNCY

SEQ ID NO: 132974 - protein, 128 aa, Glycine max
  Coding DNA Sequence Number=SeqID_16196
  Gene Ontology: Cellular component=nucleus; Biological process=cell division
  Homolog annotation: Hit_ID=Q9LME2; Match level="QueryCoverage=79%, HitCoverage=11%, E-value=1e-18, Identity=39%"; Hit description =Synaptonemal complex protein 1
VTQMKQEHDKRQASLIAEHNEQLKRTQLQAENEFREKTMFMRNDHEAQIKALRCELEDECRKLEEELHLQKSKEDRQRALLQLQWKVMSDKSKEDQEVNSKQSIKGGGHPHPSKGSLNPYAEDPYAFD

SEQ ID NO: 132975 - protein, 228 aa, Glycine max
  Coding DNA Sequence Number=SeqID_16197
MITIWDAAKKKGFKLYYNEEMPSRKMKIEIVNHPWNWSSLFNRKRLVHAPDANDLHDAQQKKKAEEEEVVVVAMKEEVASIQAKASAKVVDDTIVRGVIIDLTNTGVIDKTPEASDAAIADEVEHNIIDPPSKQSTTSNETTSGDKGELNVIILYSTSSGPTLLNYAQPATISKDQTQMSMLGAAVVAALVPQPPPIPQPLEPTPSPILGQTPPPPPSSPPPPPPAQG

SEQ ID NO: 132976 - protein, 36 aa, Glycine max
  Coding DNA Sequence Number=SeqID_16198
MEGTCLKNMYSTSSGVGTAQNSFIVCQKEQMLFPNF

SEQ ID NO: 132977 - protein, 780 aa, Glycine max
  Coding DNA Sequence Number=SeqID_16199
  Gene Ontology: Mol. function=RNA-directed DNA polymerase activity; Cellular component=chromatin; Biological process=RNA-dependent DNA replication
MDRFGRIIVQIRNLNPEVALQSMLLALRLGIFTDSLFKKPPNCMNKLRERAKSYIQMEEMFKFKKEVRQAEQKPDKKEGGTETNSHKLNKRHKPDKRQSHPRGPRYERYTPLTANRTIILEEAFNAKIPIKLPSPLPPKSGHNTEDCWALKAKIEELIQARYLAQFVKRPDKHPTRARSRGHQKDQHINHDADRRRYRAKDRGRQRHHQQSRECQPSQDQENEPAQQTRGVINTIAGRFFYGNLLPITFTNKDFRGINPINQDDPMIVFIVIANFMVSKTRGYVDLMTTFDQGQLSRSFIVSYLIVDADTFYFALIGRKVLNELGAIISMLHLKMKFSTLMGDIVTVKEDQKPHPRAGGSNQVMSMDKGFPIQTLIVYEASLDGTFDVDPRDDTMDIGPNPIEELIKLQLGPKPGQNTQLYRDLTSHQHRRIADVLHRNTNLFVWHPSDMLGIHPRIICHKLAIYPQAKPVLHKMRKMGEERHKTIKEEVDKLLKAQFIKEVKYSTWLANVVMVKKAKGKWRMCTNYIDLNRVCPKDAYLLPNIDRLVNNASGFQVLSFLDAYSGYNQIKMPAPNEEKTTFITEDVNFCYRVYVDDMVVKSQRIFQHLANLEKVFGEIRKYDMWLNPEKCTFGVCGRKFLGFLITHRGIEANLDKCIKIQEMHNPTSVEEVQKLNDRLASLSRFLPKLAEKEKPFYKLLRKTEPFLWDKSREQASLAFKKTIATPSHQVVVKMNYPIKQVLRKPKLEGRMTAWSVELAKFDLQYEPRGPMKIQFMADFLA

SEQ ID NO: 132978 - protein, 969 aa, Glycine max
  Coding DNA Sequence Number=SeqID_16200
MVRAFEVLCPFFNIRPSVSMFLYFFQMKLSGKIGWVSLNNVSKKLFEFDLNMFCRFKDRFFKSDPTRFKSFDEDLLTLVERVDKAILEQLSASLDAWAILSLPLADDPLVALDDIIGDFTWRPLVKQGGPTGGVMPPTIVEPPVREEGQLVAKVGPNNDELVEVSPNVPSSILAKRKRDDGCRVDADSDCPFVLQGSTLAPSAVQATASAPTTIVAFSPPAPPSAPVQEVSASPTIVVTTLVSLVGPIVGPLSTIVAPLLRAVALVLASPLSSSSHLSVSLDHVYTSCDTDSMWSIWYRSEQRTLTGFVSTFNKNLSGNPEENGQPHQEFLSKVASLEDEIAKWRATARSVWRVKHPKVANATVAFAEAVRSNHQFLSKVCGVLARLLCTKLDGDELFKRCGCGPQGPVERVRVKVGGVRAEGVIGERSQQTEFFTKDLDLGLFDPFKDVKNSELLDEEEIVIAEEDAGEKQGNEANVCARKWKNRSEKRKKNEEQLREKEKKEKAYTTSLVNYLVMLHFALWSFSPDACEELAKLGKNKAHQGQTLGLTSFGLGIYSSWVDLGFDEPLEKRDSPRADLGFNEPLEKRDSPMADLRFDDPLEKAFGDVSLTKGKPWGLTSLWRYDQGCICPGTKDLSRKKSTTPGLAIGQLNWVQAFPLGDIFQLHLGLATLSRQVERLEVEPFSTLMFSLLCCSWNNSLLVDGSPTSMGIMASVPYVSREGGPEDNSICYLHLIIGMGMFDRSEFSISLSFELSENGIREAIFAFEELDHSWDFWKWSQYVHPPYDEGPNGAQAMEIVRRGAWNVCEFLTSSSLLCVVKGIDPEYQPIVADTHHFGCMRASPIWRHLNRGIVNPLLNSSPLRMTHLVWFLFFCYHNMLGVYHGSLECLLDDGLEMLDLFGADQLGKQVCFGDALLGYVVQLKAFIDVNESFCGMALKLSLRVYSKMTLLESSRMIPALLPFMLNTLSM

SEQ ID NO: 132979 - protein, 99 aa, Glycine max
  Coding DNA Sequence Number=SeqID_16201
MSFRNVTLKFWHMGTKLLSFGILVVDKDILVSRAPLGLGSNKFITENKDLDERTSWTDVGLITSKFNPQPNLGSKVRVGTKYEALPLILFKSVKKDYTG

SEQ ID NO: 132980 - protein, 73 aa, Glycine max
  Coding DNA Sequence Number=SeqID_16202
MADATRNRILEREIEDRVENRLSSKIDERFMEMAVLMHKCRTFYTTTVRARIILQLGETQFEVRDLLILAEHV

SEQ ID NO: 132981 - protein, 77 aa, Glycine max
  Coding DNA Sequence Number=SeqID_16203
MTVQIEAQAQLKDKADMQAQMLAQMKAQAKMQQLLQQQMQTQMQFFRTKILPAIKIPSPPSVQKRGKNHNEDDVTAV

SEQ ID NO: 132982 - protein, 193 aa, Glycine max
  Coding DNA Sequence Number=SeqID_16204
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=72%, HitCoverage=16%, E-value=2e-40, Identity=60%"; Hit description =Receptor protein kinase-like
  Pfam annotation: Domain name=Pkinase; Domain location=11-183; Score= -102.2; E_value=0.018; Accession=PF00069.15; Description=Protein kinase domain
  Pfam annotation: Domain name=Pkinase_Tyr; Domain location=11-193; Score=-148.3; E_value=0.0023; Accession=PF07714.7; Description =Protein tyrosine kinase
  Pfam module annotation: Pfam domain module=Pkinase::Pkinase_Tyr; Domain location=11-183::11-193
MTSLSATTKPTEVQSPSVTKAVLPTGITVLVKKIEWEERSSKVASEFIIRLGNARHKNLVRLLGFCHNPHLVYLLYDYLPNGNLAEKMEMKWDWAAKFRIVVGIARGLCFLHHECYPAIPHGDKKASNIVFDENMEPHLVEFGFKQVLRWSKGSSPTTNKWGTGTKNSKAFALNNNTQLVNDLTEKGEFECPN

SEQ ID NO: 132983 - protein, 203 aa, Glycine max
  Coding DNA Sequence Number=SeqID_16205
MDDSGSLSPSAMVAPILSSRCINRMEGGHGFLKLDRLTSIHLRGHIVRFCVEIDLMKKLVPSLRGLISEDVTTVPVSSEGVVENHIGMNSITLKGVKISILRCWLGGGNQILDKALELKESSLKDRGVGSGKGVVPTTKYWHAELAGKSSVPGTSSSVQLKDKGGNDEMIIDNSRMTNLNQEEDIVVEVEKPWALIGDFNTIL

SEQ ID NO: 132984 - protein, 81 aa, Glycine max
  Coding DNA Sequence Number=SeqID_16206
  Subcellular localization annotation: CTP_CleavageSite=42; ConfidenceScore=5.43e-01
MGVKHLTRTKERSHVIKQSFSQARRGPRGSWLVVLAASKLLSSSSLTQAASCQASLELVVFVGGTRGFQQNQATTAPHLIE

SEQ ID NO: 132985 - protein, 365 aa, Glycine max
  Coding DNA Sequence Number=SeqID_16207
  Pfam annotation: Domain name=Transposase_23; Domain location=90-157; Score=-5.3; E_value=0.0044; Accession=PF03017.5; Description =TNP1ENSPM transposase
MTADKLVEIIGSIKQELRKEVEDENKRTIDLLQKQLDAIKSELSQIQTQQSAPCRPSIPDVLVARVSTKESCVEAAANVVAKERSTLDASIVGLYIVCGDSTQVVASGKMYGVGGIIHNVAYADDVVRVCVDTIYDGDASVPFPTAEIQYVRDASSTFIAWPRHLVKPITDDSNHNARLPVGRLGEAEVAAEPDSLGELMKTLFYMYKSPVEVPWEATQFGLPDVGAKFFIAHADLAEIISGDKCLNISILQLWTIFMNNCGRSKVDQSLYGLLEPQSIHNAKDRCEQCQEYIQIWVKESQRQLYLGAYLHHAMKTITSSFHGMSNQAAPRWVEPKSHVQTGAYECRYYVMHWMWCIVTGGLKDD

SEQ ID NO: 132986 - protein, 656 aa, Glycine max
  Coding DNA Sequence Number=SeqID_16208
  Gene Ontology: Mol. function=RNA-directed DNA polymerase activity; Cellular component=chromatin; Biological process=chromatin assembly or disassembly
  Subcellular localization annotation: CTP_CleavageSite=32; ConfidenceScore=5.47e-01
TKQSKPEASSKPPLFPTPPKTVSKTQDTLKTKQQASKTLTPTYMSDRRAKGLCYFCDEPFTPEHGLSHKTLQLHVMEVDELQEGAEEEVLLENSMGSSSTDPQIFVHALMGIANFHTMRVTGYYQKKPLHVLIDSGSTHNFLDIEVAKRLGCNSDAFDSLRVVVADGTKLNVSVVVRGFQWTIQQTKFTSNMLLIPLGCCDLVLGVDWLVSLGDIVWNFNKLKMEFYVKGRKHVLRGASTRLKTVKKQQLGKAMSTGVHLSILQVCDGQRGLLNSLSTQAADKEVPPAIVKLLDEFSDLFQKPSGLPPSRPSHDHQIPLVPGVGPISKRPYRDLNKHKVENKFPIPLVDDLLDELAGSSIFSKINLRSGYNQVRMDPADVYKTAFKTHAGHFEYLVMPFGLTNAPAIFQGLMNSIFKEFLWKFLLVFFDDILVYNCSLEDHLLHLHKVLITMKANSLFAKKSKCYFGVSMVEYLGHFISKEGVSTDPAKVHTIDQWPLPQTLKQLRGFLGLIGYYIRFVKGYEEATEAPVLALPDFSKIFVVEVDASVNKFKIKINFKFHEKKSRRFKNQEKFDFKIQEKKSRRLHKGIEGTSTWVVVTENKRGYISCGSIQVEGTSTWLFKENKGGYIPCGSLLVKAFTRLKRNLKDCRSLRDWM

SEQ ID NO: 132987 - protein, 64 aa, Glycine max
  Coding DNA Sequence Number=SeqID_16209
MESDEGEVRVLQDGEADQNTKKVKFRDSVDGDMLYGSNGNTSYKEKLLLPFGGIGEDGKNYIEE

SEQ ID NO: 132988 - protein, 183 aa, Glycine max
  Coding DNA Sequence Number=SeqID_16210
  Subcellular localization annotation: CTP_CleavageSite=35; ConfidenceScore=5.25e-01
MNESLMRHTSKFHFSPSFIPSISCSPLLSFFSSIKASFSESEEAKGEESSEEIYPQEEGQPLMVKGECKEVSVSSKRLAKKESHFEIKTNIKEISPLRQPPHLLLCKNTLVSIATPLRLEVIPQVKELLDESLVRKSLNPCALLVSKIGVEGRSPEYEEPQDLRSNPFQGGGNDAILPRKGIG

SEQ ID NO: 132989 - protein, 39 aa, Glycine max
  Coding DNA Sequence Number=SeqID_16211
MRGYLMVTRPFRQPGVNEHVDTRRLPSSSTPFVVLTREV

SEQ ID NO: 132990 - protein, 58 aa, Glycine max
  Coding DNA Sequence Number=SeqID_16212
MMLVSARQRARLPLVDERGGGGQPKGNPECQLPSRARTTKGEEDDVSLRASMGSFAPG

SEQ ID NO: 132991 - protein, 77 aa, Glycine max
  Coding DNA Sequence Number=SeqID_16213
MNALPTLTLPPPPHSPVAGPMRFDRRHWVAHGQTSSEASKWELENESGDMLRVSDDDNKEWRMTKEFIDCDMASVFS

SEQ ID NO: 132992 - protein, 82 aa, Glycine max
  Coding DNA Sequence Number=SeqID_16214
  Subcellular localization annotation: CTP_CleavageSite=71; ConfidenceScore=5.57e-01
MFQPCRIGTGLKKHSNRVTPKAYTLKSPSRPLPPDSAYNTSNVTSSVNHTLIRRQNSFTISHLIVSQPIITCLHVSHKLTHV

SEQ ID NO: 132993 - protein, 36 aa, Glycine max
  Coding DNA Sequence Number=SeqID_16215
MDFPTPPHPYTGHALVVTPIAKQCTELNGPFGWKEA

SEQ ID NO: 132994 - protein, 284 aa, Glycine max
  Coding DNA Sequence Number=SeqID_16216
  Gene Ontology: Mol. function=protein-tyrosine kinase activity; Cellular component=integral to membrane; Biological process=protein amino acid phosphorylation
  Homolog annotation: Hit_ID=Q9FJ52; Match level="QueryCoverage=66%, HitCoverage=25%, E-value=1e-18, Identity=33%"; Hit description =Receptor protein kinase-like protein
  Pfam annotation: Domain name=LRRNT_2; Domain location=36-79; Score =48.5; E_value=2.3e-11; Accession=PF08263.3; Description=Leucine rich repeat N-terminal domain
RIDKNRKLIRLKDLSIAFCFVVVVFLFNNLGLCCSLNEEGNALLKLRQKIMSDSFGALSNWVDDEAFVDPCNWFGVECSDGRVVVSNLKDLCLGGTLAPKFVKLINIKSMVNMLQYFEENSFSGTIPEGFVELKELVVLDLGYNNFSGHLLVDLGSNISLAIILLDNNEFLVGLSPEINELRMLSECQADENQLTNGAKMSACTERVTTCLEELQVNYNNDRSSLDDVASCGACRPWIFFINEVLCFLKINGSGMEKEESLKEEEDEWREKEARSTKFYASNEV

SEQ ID NO: 132995 - protein, 56 aa, Glycine max
  Coding DNA Sequence Number=SeqID_16217
MGPKSILRLMRTLGSSPTSLAQSSWSLLAMALVMGPFLGRIASLDMVMQETYEKTR

SEQ ID NO: 132996 - protein, 125 aa, Glycine max
  Coding DNA Sequence Number=SeqID_16218
MAHEYQGKTLLILIYYPHLLLSIDILLERQSVFCRYLTLRCFKHYLEKKENHLEDVSKEESYMPTPYKYIRNLGSSNIIIVDLWGLSSMLEVAWENANMAHSWELGLHILRDSPTSKYDFKLVSN

SEQ ID NO: 132997 - protein, 108 aa, Glycine max
  Coding DNA Sequence Number=SeqID_16219
MALSQDYLFSWLSQVGWDVLGIWLGRVLDTTEGYHLDRAPDAIEGYQVSIWHYRKAIEPKGNGVSVRYLTKYDPFRIGKLKRVIRGLLHLKVKSDHNMLLRGSSSSCY

SEQ ID NO: 132998 - protein, 191 aa, Glycine max
  Coding DNA Sequence Number=SeqID_16220
FPNVREKEKGLKPPFILSLCDSVIPHHEYYLANPNGEVGKEKVTMRSVSLLDLTVSRNFQRVSGLQEKDRILGEGGKTKMRRRGGIVSVKTDLTSNDGLKSVVGYKAIKWDIYAIELGKYFVDHQCPANIYVEQVVDDVNWFEGKLPRIVEGAIDSQTTQGGRSDKGTAEVKVTENDDPVRSEFDDSDEAK

SEQ ID NO: 132999 - protein, 85 aa, Glycine max
  Coding DNA Sequence Number=SeqID_16221
MEGGEDANVSVSQKPFELTQFRSKFKIQTYLKNASVGKMVPQLMREMGHVIGTVYGASIMVLQLIHMRSVKCIGIDTALIMKVPH

SEQ ID NO: 133000 - protein, 104 aa, Glycine max
  Coding DNA Sequence Number=SeqID_16222
MILARAPVHHENSVSTGTSSSKVVFCLTLCAFSGISGGRLQRADEGEGFGGEGNVAIVWRWRCNDKVGSTKRGRRKLPRMENGNVEMRSFLAQRRDLIGMEVKR

SEQ ID NO: 133001 - protein, 76 aa, Glycine max
  Coding DNA Sequence Number=SeqID_16223
MSIHATVIYYTVRFQQITFPKLNEKVEEDTKAVIFIYKKLRFLSQTVVAMAGILDRKLADSGDRVADNQEAAKLEC

SEQ ID NO: 133002 - protein, 104 aa, Glycine max
  Coding DNA Sequence Number=SeqID_16224
MEHFLEQVAWPEAQLPLMRPNEVNSEPTDPQSPVVNPPSSPELEAVPPSPPLIVISDASSDEAATPPDSPVVEIADPLVSPIGGVANLSNSSSGEVVALTNSPV

SEQ ID NO: 133003 - protein, 97 aa, Glycine max
  Coding DNA Sequence Number=SeqID_16225
MSDMPFRGLKSARKQAVFSAFSGKRNELAKQESLSEELAKRTYCAKRVHPLRMNIHPFAELPMAKKGRIVKPSYRWNQEKELEQKTSLHHPLQLLRQ

SEQ ID NO: 133004 - protein, 83 aa, Glycine max
  Coding DNA Sequence Number=SeqID_16226
MPKSSPNMHVKQEVSTRVKPRLLCKQSMGQNTSNKIDDDGSNSHQGEKQGFQFTKCQETPISKTITHYLYITYNSKRNMQCCT

SEQ ID NO: 133005 - protein, 298 aa, Glycine max
  Coding DNA Sequence Number=SeqID_16227
  Subcellular localization annotation: CTP_CleavageSite=92; ConfidenceScore=5.35e-01
MLVHPTLNGKRQKYPSSIREAFLLLPQASGSSFFREVLLLLPRAASSFPASGSPSSAHSRSSASFRCSVLHRGKPIVPSVVPCECRFASIVRFSGVVGRNCNADPDYDEVSPCACRWIAIKKNVKKISTTTYRQRLDNLRILDVCWMPYAEHRPCIPAHPVDSWVSFDDVDDRWAHYSDHLAPAGDICVVPGQCAPDYIDWFFVISHSFMTAPQTSYPPRDASTTQPKHIPQEPAPASTHADCDADEPRHAMINEACHAIAETLEHHLSLNEVTPGTSTHELIQKCLRISRGVIEDCN

SEQ ID NO: 133006 - protein, 51 aa, Glycine max
  Coding DNA Sequence Number=SeqID_16228
MYLERPKTPENAAMWPVKRKETQIRGRERKIKKKGGREVSSKERTLRRKRH

SEQ ID NO: 133007 - protein, 111 aa, Glycine max
  Coding DNA Sequence Number=SeqID_16229
MEEKGHARNFKEAQHTHSKRKEKLRNNLGEEKCRKIYVHGAFFYKRKRKEATVTSLLLHFQLQLQPATLTYHCTHQKHCNPSLRNTAWLIPPRQYRQWERRELPPRQYRHC

SEQ ID NO: 133008 - protein, 72 aa, Glycine max
  Coding DNA Sequence Number=SeqID_16230
MDATVAIRTLEATYKSSANVVAIETMILKHTQKPWPPAVVALPTSHSGHPATPAGHVVPLAILATCGTCILV

SEQ ID NO: 133009 - protein, 117 aa, Glycine max
  Coding DNA Sequence Number=SeqID_16231
  Gene Ontology: Mol. function=amino acid transporter activity; Cellular component=integral to membrane; Biological process=auxin mediated signaling pathway
  Homolog annotation: Hit_ID=Q2UZS6; Match level="QueryCoverage=100%, HitCoverage=17%, E-value=1e-35, Identity=65%"; Hit description=Auxin influx carrier-like protein 1
MKDGCNSKVPSRVSGHSKTQKRPDSVIVEGRYENSGGTASSKNISPSPFIQFVIYVVDVTVWIKEARTKKDERKEKQLQVAHSILLQVAFKIEAKMSPCTCYKLYHRSKEEESTVEG

SEQ ID NO: 133010 - protein, 259 aa, Glycine max
  Coding DNA Sequence Number=SeqID_16232
  Gene Ontology: Mol. function=nucleic acid binding; Biological process= DNA integration
  Homolog annotation: Hit_ID=Q1SDG1; Match level="QueryCoverage=80%, HitCoverage=25%, E-value=1e-09, Identity=23%"; Hit description =Integrase, catalytic region; Zinc finger, CCHC-type
MKDDEKRKVQDDQKAENILTSGLSSDEFFCTARCQNAKKIWKMLEVTLEGNADIRRASLEKKFEDDELNIKILNCLTRTWEQRITMIKESMDLASMLMEALFGKLLAYEHELIQQSHAEETKKKRNCTQEDRKRQQHLHMLQMWKQGHIKSKCPIYLRKQLVEKKGKKEEKYRKAYIAWEDNASASFDCSSEEDIANVCLMANSMDDSSTIEETEVNFEFEEVLEAFNEMHGEVQRHVVSNNKLRSDLKLHITKLASTQ

SEQ ID NO: 133011 - protein, 252 aa, Glycine max
  Coding DNA Sequence Number=SeqID_16233
  Gene Ontology: Mol. function=amino acid transporter activity; Cellular component=integral to membrane; Biological process=auxin mediated signaling pathway
  Homolog annotation: Hit_ID=Q9SEL4; Match level="QueryCoverage=99%, HitCoverage=52%, E-value=1e-130, Identity=86%"; Hit description=AUX1- like protein
  Pfam annotation: Domain name=Aa_trans; Domain location=43-252; Score=- 80.4; E_value=0.00013; Accession=PF01490.8; Description=Transmembrane amino acid transporter protein
MLSQKQAEEAIVTNETEHKVGSTREEEKEQGHSIFSLKSILWHGGSVWDAWFSCASNQVAQVLLTLPCSFSQLGMLSGIIFQVFYGIIGSWTAYLISVLYIEYRTRKEKENVNFKNHVIQWFEVLDGLLGPYWKALGLAFNCTFLLFGSVIQLIACASNIYYINDKLDKRTWTYIFGACCATTVFIPSFHNYRIWSFLGLGMTTYTAWYLAVAAILHGQVENVTHTGPTKLVLYFTGATNILYTFGGHAVTV

SEQ ID NO: 133012 - protein, 88 aa, Glycine max
  Coding DNA Sequence Number=SeqID_16234
MQTYMGMLLNLARNLRNRLGVGGLIAEDIMLVYLITYILTSRSSNHAQHSMRLSKDVEAKAPQKPAHQWSSFQSFMIKKMNVMLHLHQ

SEQ ID NO: 133013 - protein, 292 aa, Glycine max
  Coding DNA Sequence Number=SeqID_16235
  Homolog annotation: Hit_ID=UPI00006A17C9; Match level="QueryCoverage =66%, HitCoverage=100%, E-value=1e-16, Identity=28%"; Hit description= UPI00006A17C9 related cluster
DYTSSPSEGCTPSHSEGLHVLAFRGSCTFTFRGLHVLAFRELHALTFRGLHFLAIRGLHTLTFRGLHVLTFRGLHVLAFKGLHALTFRGLPVLAFKGLHTLTFKGLHALTFRGLHALAFRGLHVPLFRRLHALTFRGRHVLTFGGLRSPSSFEGYASSLSGPVISLRPFFFPGHPLISKEGQLCEHNQRKAIAQLLCIPGQGFTRATAKSRVGHAHKTPSGLGEVQQGPGVSNFGYGPLLVLQGARTPLQGIASARHPVDPKKSNRVLGFPALITGLCQFYGVPVIPSKVIK

SEQ ID NO: 133014 - protein, 64 aa, Glycine max
  Coding DNA Sequence Number=SeqID_16236
MKNLAIKDFLKERVRSEFGDNIVTICTFLQVTRAKEEILVYLIENGESFRGGIGPRFRQIDGSS

SEQ ID NO: 133015 - protein, 276 aa, Glycine max
  Coding DNA Sequence Number=SeqID_16237
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=69%, E-value=1e-101, Identity=62%"; Hit description =Integrase, catalytic region
  Pfam annotation: Domain name=rve; Domain location=34-190; Score =106.8; E_value=6.3e-29; Accession=PF00665.16; Description=Integrase core domain
MQNNVKQFVHQCATCQQAKYIPKSPAGLLQPLPVPSSPWTDLSMDFITNLPPSQGYTVIFVVVDHFTKGAHFGALHSHFSAHKVAILFLDMVCKLHDLPHSIVSDRDPIFISRFWQELFTKCGTKLRMSTSYHPQTDGQTEVLNRTLEQYLRCFVHETPTKWFSYLSLVEWCYYTSIHSSTGVTPFEATYGYPPPTIPQYLLGSSCVDVVDYLLSSRQDLWNLIHKRLMKTQSAMNTHADAKRRDVSYQVNDWVYVKLHPYRQTSLTNTKYHKLTK

SEQ ID NO: 133016 - protein, 336 aa, Glycine max
  Coding DNA Sequence Number=SeqID_16238
  Gene Ontology: Mol. function=RNA-directed DNA polymerase activity; Cellular component=chromatin; Biological process=chromatin assembly or disassembly
MEPSDIAKTVFRTHQGHYEYRVMPFGLCNAPSTFQATMNEHLKPFLRKFVTVFFDDILESHLQHLTNVFDSLTAGQFYLKESKCLLAQRQLEYLGHIVSQQGVAPDPSKIQAMVDWPIPTTIQSLGLTGFYHKFIKQYASIAAPLTTLLQKDNFHWNDDASAAFIRLKEAMTQAPVLALPDFTTPFTVETDASGLVMGAVLTQHGHPLAFFSKVFCPRLQRSSTYVQELHAITTVVRKWRQYLLGHSFIILTDHRSLKDLMSQVIQMPEQQIYLSKLLGYDYTIEYKSGKSNVVAKAISYSVGDYSLILCPIDTEFHLPRRPASFLGRQSPLQTTM

SEQ ID NO: 133017 - protein, 97 aa, Glycine max
  Coding DNA Sequence Number=SeqID_16239
MDGVEHHKCLIKSILAKRSWDSEAGINGVAQHFRCKMQKMVDHKYENHQKVNGKQSAFGAKVKERPSGLKVANQLLDALHITENSVAPEMISSAGVP

SEQ ID NO: 133018 - protein, 83 aa, Glycine max
  Coding DNA Sequence Number=SeqID_16240
MDVKVVATPTTCRAPYCSNNNYDEVKMRKKCGTSLDDTSLNPLVGQNPSSVRILHWSEPFIGSFSLSHYQSISRLLASPNSLP

SEQ ID NO: 133019 - protein, 102 aa, Glycine max
  Coding DNA Sequence Number=SeqID_16241
MWVSREQDNCDGGMGTSCEGGVTVVELVQRQHDYDGQRKKIIGNLYFPTEKLSMGKFRQEFKHSTPSINFIGNADISKRIHSVENILSVIMIFLVVYAEQIL

SEQ ID NO: 133020 - protein, 256 aa, Glycine max
  Coding DNA Sequence Number=SeqID_16242
  Homolog annotation: Hit_ID=Q6K5F4; Match level="QueryCoverage=19%, HitCoverage=15%, E-value=1e-09, Identity=65%"; Hit description=2 coiled coil domains of eukaryotic origin (31.3 kD)-like protein
MRRVVTPDVCWMPYGDHQGVRVFDLISCFQGELRWGSIMVTHRPERVVRQFGYIQTIPPPPISATLSFEDMDNRHPPVPQHETYVELDISEVPVAPEAGSSQAADQPKHVVDACEAIVERLKHMLNLRMVTAGTELHDIMEDCQRIARGAHGGGNEAGGGGGVEEVGLGEEGGVERGGGGGDRGDEGGTEGGGGGEGEKEEERERREFVVHVLLLDEKEIGRRVLEKKKKDLLSRYTSEGLVEEQTEAKDMLNIQR

SEQ ID NO: 133021 - protein, 72 aa, Glycine max
  Coding DNA Sequence Number=SeqID_16243
MNEEERKMFTELITKTCWTPSPQPPMPFYRKNGGGACHPAHHGMLSSPKRAGGLSLKQHARLGELLLPPEDS

SEQ ID NO: 133022 - protein, 262 aa, Glycine max
  Coding DNA Sequence Number=SeqID_16244
MIMLVELLEVLDEESRAETAQCHGAYSGSYAWGAATLVNMYDQLNDASQSTGRQLVGYITLLQCWIYEHFPSVHESVTDEGYDEMSPRACRWLTTKAYPKAFTSSTYRTCIDALTIPNVSLVIRGVWVVKTLASHRSLSRKLLKEASRGSFSSKPLEKSFSRKLPEVVSVYRTDFHDWTVAICDISSALENSHFFLLLSSKTISCIPSFFSHPQPPVATTDRRCSPLKPHTERNSSTEAESSKLALRFRLRTKPRSNLRGFP

SEQ ID NO: 133023 - protein, 92 aa, Glycine max
  Coding DNA Sequence Number=SeqID_16245
MQLQKATNREDEDAQRRAEEKTKTKMKDLGFVLVGFSVVVFIDAHGALILRRQIWTCDKGDRMREICAMKAICEVDDNNIYMEKATREIVWE

SEQ ID NO: 133024 - protein, 333 aa, Glycine max
  Coding DNA Sequence Number=SeqID_16246
  Gene Ontology: Mol. function=transferase activity; Cellular component= membrane; Biological process=metabolic process
  Homolog annotation: Hit_ID=Q1SRU7; Match level="QueryCoverage=99%, HitCoverage=55%, E-value=1e-137, Identity=66%"; Hit description =Exostosin-like
  Pfam annotation: Domain name=Exostosin; Domain location=7-296; Score =292.6; E_value=7.5e-85; Accession=PF03016.6; Description=Exostosin family
MEQTLKVYVYREGARPIMHSPFFTGLYASEGWFMKQMEANKRFLTRDPNKAHLFYLPFSSRMLEETLYVQNSHNHKNLVQYLHNYVEMIAGKYTFWNRTGGADHFLVGCHDWAPGETKVDMANCIRSLCNADVKEGFVFGKDASLPETYVRDAKIPTKDLSGNSASKRTTLAFFAGSMHGYVRPILLQHWENKDPDMKIFGRLPKSKGNRNYIQYMKSSKYCICAKGYEVNSPRVVEAIFYECVPVIISDNFVPPFLEVLNWESFAVIVLEKDIPNLKNILLSIPEKQYLRLQMRVKKVQQHFLWHKNPVKYDIFHMILHSVWYNRVFSAPAR

SEQ ID NO: 133025 - protein, 134 aa, Glycine max
  Coding DNA Sequence Number=SeqID_16247
  Homolog annotation: Hit_ID=Q1RU20; Match level="QueryCoverage=74%, HitCoverage=13%, E-value=5e-10, Identity=30%"; Hit description =Ovarian tumour, otubain
MSDQFEPFIQGFIDNIVDVKVDGNFGYWSIATLLGMDEDSWLLVHNQLVKELGKWSDDYINLFDGIDKFDELRRSLLVDGFSKVSMDKWMNIMEMRYVIASIYLNDRCPLPPLALLWSRNSHPQTCGLRNLKKG

SEQ ID NO: 133026 - protein, 94 aa, Glycine max
  Coding DNA Sequence Number=SeqID_16248
SDDESCEGTNTEGPDVDFERVANQVEDEEDEDAGFLPELERMVGTAMTTPVRDELVVFLRNYQDVFTWLYQDMPVARYPEWVANIVSVSNKDRK

SEQ ID NO: 133027 - protein, 57 aa, Glycine max
  Coding DNA Sequence Number=SeqID_16249
MYLLSKAGVTQTPTLTRKNLYWAYGYHCIIEQIREGGVWSWMCSSGFYGRSRGGLYG

SEQ ID NO: 133028 - protein, 49 aa, Glycine max
  Coding DNA Sequence Number=SeqID_16250
MEELINKTQLSPKIIPTSSRRLGDSTKESHFSYSTVVILFPQTKVRDHH

SEQ ID NO: 133029 - protein, 110 aa, Glycine max
  Coding DNA Sequence Number=SeqID_16251
MARRDKYGHLLLCGDLNVFRPRLFLSPFLHPETTMSNVPFATQRQASPMASGDRPWSFIVLKIIEVSPAIPRQSSPMACGDHHSHLFLIAFKVSLIGLAVGWVENSLERN

SEQ ID NO: 133030 - protein, 110 aa, Glycine max
  Coding DNA Sequence Number=SeqID_16252
MTCGGTVWLSAPFVIPSGKSDEMRGYRMVIRTFRQPGANKPVDAQKLVLSSSDDMWGYHMVIRTFCHLETSSPMTCGDGKSDDMRGYRMVIRTFCHPETASPVTCGDTQV

SEQ ID NO: 133031 - protein, 150 aa, Glycine max
  Coding DNA Sequence Number=SeqID_16253
  Gene Ontology: Mol. function=chitin binding; Cellular component =extracellular region; Biological process=chitin metabolic process
  Homolog annotation: Hit_ID=Q1RT77; Match level="QueryCoverage=64%, HitCoverage=14%, E-value=4e-09, Identity=40%"; Hit description=Zinc finger, CCCH-type
MTGPLNESISCFLIRVGPRVLVPSPSEDYKSSPSEGYTPSPSEDYTSSPLEDYTSSPSEDYTSSPSEDYTSSPLEGCTFSPSEGCTPSLLVGWTPSPSKGDTSPTLESYVSLLSVGSIAVATCPFAGERGRQKRGSCSYVPSIEEEIRPT

SEQ ID NO: 133032 - protein, 182 aa, Glycine max
  Coding DNA Sequence Number=SeqID_16254
MRTLDTMKLAIMMETTMRSSWLIGLMPLKSLSVNAMGGKIHGSNNLLYCDRNYDGLLKDSSAIGRQGCVMLTPGFFWKRLALVELASRILRIEAFNKGVEVVYGRREDMTQDCVVVGVEIRLECVDFHDAIDKGVSMSSLPFRMMYMGEIGIIFGVDGLKPSKGVSRLKLDRMLSMSEREAT

SEQ ID NO: 133033 - protein, 383 aa, Glycine max
  Coding DNA Sequence Number=SeqID_16255
  Gene Ontology: Mol. function=helicase activity; Biological process =viral genome replication
  Homolog annotation: Hit_ID=Q2R1R7; Match level="QueryCoverage=83%, HitCoverage=19%, E-value=4e-66, Identity=43%"; Hit description=AT hook motif-containing protein, putative
MDNHQHGNHSDPAQARIKKKGIRQHKVNDQAQNIDSNIPDSSEDKSSESTQVSSPENQNYMSSANEPAINREGYFDLGDQLMQCSHCNANMWYDERISKHERTTNSRFSLCCGGGKVELPLLQNPPKYLYQLLYDHDTSDSKNYQQNIRTYNMMLAFTSAGIKFNKSINHSRGPPTIRIQGQPCHIIGSMLPMPRKEPKFAQLYIFDTENEVQNRINAISSPHNQIQGHIVSQLSEMLDEYNVHAKNFRMARDRLQDGQVDNIKLKLIANHEKDGRTYNVPTVPEVAALIVGDFDANSKRDIIIETQHGQLQRIHELHCSYLALQYPLLFPYGEDGYRPNILHSSAPDERLSHIRNNQKKLRVDKFCSLQQSLDDGSTKGLNK

SEQ ID NO: 133034 - protein, 570 aa, Glycine max
  Coding DNA Sequence Number=SeqID_16256
  Gene Ontology: Mol. function=RNA splicing factor activity, transesterification mechanism; Cellular component=ribonucleoprotein complex; Biological process=RNA splicing
  Homolog annotation: Hit_ID=O22212; Match level="QueryCoverage=80%, HitCoverage=83%, E-value=1e-160, Identity=61%"; Hit description =U4/U6 small nuclear ribonucleoprotein PRP4-like protein
  Pfam annotation: Domain name=PRP4; Domain location=147-176; Score =46.6; E_value=8.5e-11; Accession=PF08799.1; Description=pre-mRNA processing factor 4 (PRP4) l
  Pfam annotation: Domain name=WD40; Domain location=269-307; Score =14.6; E_value=0.36; Accession=PF00400.22; Description=WD domain, G -beta repeat
  Pfam annotation: Domain name=WD40; Domain location=311-349; Score =33.4; E_value=8.1e-07; Accession=PF00400.22; Description=WD domain, G-beta repeat
  Pfam annotation: Domain name=WD40; Domain location=351-389; Score =40.9; E_value=4.3e-09; Accession=PF00400.22; Description=WD domain, G-beta repeat
  Pfam annotation: Domain name=WD40; Domain location=393-431; Score =34.4; E_value=4e-07; Accession=PF00400.22; Description=WD domain, G -beta repeat
  Pfam annotation: Domain name=WD40; Domain location=435-473; Score =52.1; E_value=1.9e-12; Accession=PF00400.22; Description=WD domain, G-beta repeat
  Pfam annotation: Domain name=WD40; Domain location=477-516; Score =34.1; E_value=4.9e-07; Accession=PF00400.22; Description=WD domain, G-beta repeat
  Pfam annotation: Domain name=WD40; Domain location=520-558; Score =42.3; E_value=1.7e-09; Accession=PF00400.22; Description=WD domain, G-beta repeat
  Pfam module annotation: Pfam domain module=PRP4::WD40::WD40::WD40::WD4 0::WD40::WD40::WD40; Domain location=147-176::269-307::311-349::351 -389::393-431::435-473::477-516::520-558
MEVEKENTTSTITAEPSVSASDGQDPVSSVNASLPDPMQPVIPQVIAPFVVPSLAPIPAIPPPRPLAPLPVRSPVIRPPVPQNGEVGSSDSDSDNDDSNARINQGGGEYEISEESRLVRERQEKAMQELMMKRRAAALAVPTNDMAVRARLRHLGEAITLFGEREMERRDRLRMIMAKLDAEGQLEKLMKAHEEEEAVASASKDEAEEELQYPFYTEGSKALLDSRIYIAKYSLARAALRIQRAQRRRDDPDEDMDAEMDWALKQAGNLSLEFSEIGDDRPLSGCSFSRDGKWLATCSLTGASKLWSMPKIKKHSIFKGHTERATDVAYSPVHDHLATASADRTAKYWNQGSLLKTFEGHLDRLARIAFHPSGKYLGTASFDKTWRLWDIETGDELLLQEGHSRSVYGLAFHNDGSLAASCGLDSLARVWDLRTGRSILALEGHVKPVLSISFSPNGYHLATGGEDNTCRIWDLRKKKSFYTIPAHSNLISQVKFEPHEGYFLVTASYDMTAKVWSGRDFKPVKTLSGHEAKVTSVDVLGDGGSIVTVSHDRTIKLWSSNPTDEQAMDVD

SEQ ID NO: 133035 - protein, 65 aa, Glycine max
  Coding DNA Sequence Number=SeqID_16257
MTKNNKVTSRHDCVRQLWKDLYSCKAPSCTMPSKPTSIHGTILMGSVVEELFLKAMDDHRVVFGR

SEQ ID NO: 133036 - protein, 114 aa, Glycine max
  Coding DNA Sequence Number=SeqID_16258
MEIGREGEKLFVVREMKENKKIIQIFLPVAASRFVYGSKKYITLQRGLGKRTQWKVTVHDGVPSIADPWFQYLHEKKFMAEDEVVFYFRFDDHAWELLIRKDIEWDEEDIHLDD

SEQ ID NO: 133037 - protein, 57 aa, Glycine max
  Coding DNA Sequence Number=SeqID_16259
MSEIRRFGGLGMEERRKRKGAAQGSLENVIFIEQDAWPSVLVKNDYSIDVIDYQNKK

SEQ ID NO: 133038 - protein, 95 aa, Glycine max
  Coding DNA Sequence Number=SeqID_16260
MTRSYYCYARHVEIVKLSSNSYIQVLDVGSKDSKETLPIVESPRTKLKASYTFPPGTRCPLVLETSVEEATLSITKLRALESEEDNERTSHDNLP

SEQ ID NO: 133039 - protein, 295 aa, Glycine max
  Coding DNA Sequence Number=SeqID_16261
  Gene Ontology: Mol. function=chitin binding; Cellular component =extracellular region; Biological process=chitin metabolic process
  Homolog annotation: Hit_ID=UPI00006A17C9; Match level="QueryCoverage =100%, HitCoverage=100%, E-value=3e-39, Identity=30%"; Hit description=UPI00006A17C9 related cluster
GLHVLAFTEAHILAFRGLHIIALRGLHVVAFSGLHALAFVGLHALTFKGLFVLIFKGLHVLTFRGLRALAFRGLHALAFRGLHVFHFRGLHVFPFKGPHSPTFRGLHVLPFRGLHALAFRGLHVLTFRRLHALTFTGLHVLAFRGVHILPLRGTSSPYLQRITRPLLQRATRPGLQKTTRPWLRRASRPHLQRTTHARLQRTTRLCLRRATRPHLQRTTHPHFLSDTHPCLQRTTRLSFQGATCPCLQRVTRPRLQTATRPSLQRDTRHCLKRTTCPPLQRTTCPPHQRTTHSPL

SEQ ID NO: 133040 - protein, 84 aa, Glycine max
  Coding DNA Sequence Number=SeqID_16262
MEELDAQVAWPGDQPSSFGGGEASTAQELDIEEPPTPTPAEEETTSDQIQPYTPVTEPEQSIQDLSATPALDLNEDQPQEEQDV

SEQ ID NO: 133041 - protein, 105 aa, Glycine max
  Coding DNA Sequence Number=SeqID_16263
  Gene Ontology: Mol. function=RNA-directed DNA polymerase activity; Cellular component=chromatin; Biological process=chromatin assembly or disassembly
MWEASSTLWHGIKCAILLNLSITTKIESTPLWVLGSPRTKSILMSTQGADGMGNFNRDLPESALGRQPKLLNPRSLVRLNIQASSVDPSFKTAPDLDNPLRFRLT

SEQ ID NO: 133042 - protein, 127 aa, Glycine max
  Coding DNA Sequence Number=SeqID_16264
MVAPPDSIPLIEQFNEWVAWPGTQSSLHREDEGPTAQVPLQMEDEPSETTTPEPLVRRKKADETQEAVATSEKPLEATSEPSELVVDTTSPQQATDPSTPEDLTTPVLSLNTSPTATPVLHLTNEED

SEQ ID NO: 133043 - protein, 421 aa, Glycine max
  Coding DNA Sequence Number=SeqID_16265
MELARTVVEMQSTLDSLKDEQKLMESEFEEQQNELRLMQEKGKSVGQGRSEIEALRDNLKHKEAEMEDLKRRLEIPVNDHPTIFPEIVTANGTIAAQDENGKDEISGESAKHEGDTDNNEGTIKSELTKFKDGEVATEIKDEIRIDRELGKANEDPRDDGGGAAKDLDDVEEADGREKKAIQEYAGQVENNTDGGDQVKQLAGMKRKHGRASRTKGKRWRTTVKNSLMENNGVFENHSGDRKVYKDELKGRRFGKVSNEGNFARKDVGLNNNSHRKGKPLAKLLKPENHESKEDANDMKVNNTKHQETNSGTNIYSQNQILDEMRQLEENEQSQVQQNWSKRHIRKADKNAGKTKSKVLLEGPEELEEILDVKKQEEDPIDSDHDDEDNDNYFFKDLHSEFLDEKDEYKEEIDESEFQTDL

SEQ ID NO: 133044 - protein, 273 aa, Glycine max
  Coding DNA Sequence Number=SeqID_16266
  Gene Ontology: Mol. function=acetylglucosaminyltransferase activity; Cellular component=membrane
  Homolog annotation: Hit_ID=Q9ZQZ7; Match level="QueryCoverage=72%, HitCoverage=44%, E-value=2e-67, Identity=64%"; Hit description =Putative glycosylation enzyme
  Pfam annotation: Domain name=Branch; Domain location=161-273; Score =47.8; E_value=2.7e-11; Accession=PF02485.11; Description=Core-2I -Branching enzyme
MNIKIPDINVKKNENFANQQSIESKVTTLESVATQIEKNGQNNNKNLALGTVKESRKSMFASLQVKSELCHKSMRKNVGSHSGRMFSDKKWILPFFASLIISMSLVLTAILGLLSSDGGGEQSPFEIISFKRSEDSSGYFVESDIEKSLNVSVVKREAPRFAYLISGTKGDSHRMMRTLEAVYHPRNQYILHLDLEAPPRERLELANAVKADPIFRGVENVRVMSQSNLVTYKGPTMIACTLQAIAILLKESSEWDWFINLSASDYPLMTQDG

SEQ ID NO: 133045 - protein, 61 aa, Glycine max
  Coding DNA Sequence Number=SeqID_16267
MAHIKKFNHILTNCASSRKLRSADKEQKKNPRPKVKNDRVSIYAFRTSSVFREHVWCSKRS

SEQ ID NO: 133046 - protein, 56 aa, Glycine max
  Coding DNA Sequence Number=SeqID_16268
MDRKITGEATAVDELKGNAAPRANEAMASAKEREKEGTVLWCCRCYSRTEMPRGSF

SEQ ID NO: 133047 - protein, 58 aa, Glycine max
  Coding DNA Sequence Number=SeqID_16269
LKIEIEILRNQADETAELLSELAEVVTQERFLLEEFDDIFHTIRVLEGAFVFDGTKKK

SEQ ID NO: 133048 - protein, 142 aa, Glycine max
  Coding DNA Sequence Number=SeqID_16270
MATRGGGSDDSWVAKTHKAMKKANNSVIGYVTSKSHWPLPHGHISLRPQHKSVEKIMSMGFDLFRHKKPSNDEVVHELRLLDNRLTQWRFANARAHVVNHRMSLLAKGNLIGALDGLANLRYSVVLLKIEFEREKLELKLDD

SEQ ID NO: 133049 - protein, 103 aa, Glycine max
  Coding DNA Sequence Number=SeqID_16271
MVVTGDGELGFDFRRGSLRNGYHIQGRQQARKLPNPDTGSWTLGWVDRSASGVHRSARPFCRRCAPVLNWPGRASGAVTLKKLECSKQAYALYTLAWDNTTGF

SEQ ID NO: 133050 - protein, 131 aa, Glycine max
  Coding DNA Sequence Number=SeqID_16272
MSPLLFRTSSCLTPVVAQSVRFFVVSIKNAENAQKGGQKGHFEDFSDPWLAQASRWLAWATIRLRGEVTSSPRRARLLQVEATARLGELLFNLLPSFPINRREGDKVMGSDFQTLKDLVKLRRRRRKKKKK

SEQ ID NO: 133051 - protein, 54 aa, Glycine max
  Coding DNA Sequence Number=SeqID_16273
ACHAIKEALEQHLNALGTSTHEEVIQKCLRIARGVTEDRNVYVRSRRRRCTNQQ

SEQ ID NO: 133052 - protein, 232 aa, Glycine max
  Coding DNA Sequence Number=SeqID_16274
  Gene Ontology: Mol. function=protein binding; Cellular component =membrane; Biological process=defense response
  Homolog annotation: Hit_ID=Q1SW22; Match level="QueryCoverage=92%, HitCoverage=24%, E-value=4e-31, Identity=40%"; Hit description =Disease resistance protein; AAA ATPase
MVRDLPKEVRDITNVIDEYNLSCEDKQPGDPRCAALLCEVVAFIKTQILLLQNAYKIQDVKSLVCVERDGFQTHFPLEPRLTSSRGNQNVTWQKLRMDPLFIEEDNVVGLDGLRGTLKNWLTKGREKRTVISVVGIPGVGKTTLAKQVFDQVRNNFECHALITVSQSYSAEGLLRRLLDELCKVKKEDPPKGVSNMESLTEEVRNRLRNKRYVVLFDEGCEGCGILLEIIIC

SEQ ID NO: 133053 - protein, 39 aa, Glycine max
  Coding DNA Sequence Number=SeqID_16275
MQSQGLALPSKPEGMIQTRVTQTNAGCTSKKILPAWLPL

SEQ ID NO: 133054 - protein, 167 aa, Glycine max
  Coding DNA Sequence Number=SeqID_16276
  Subcellular localization annotation: CTP_CleavageSite=33; ConfidenceScore=5.03e-01
MPSVPELSAFRFGNRWAKRASLAKLPYLVYFFNCMMASRKCKSIGSRPTTQYDTRRFHSLDAWNRYTDNVLGRNILPERKVELYHTKLDDFKNEVERRNFYKRLTNLVDGSIDLALVKEFYANLYSFEGPSPKQARVKGHLLKIDVDSLNTFLETPVDAILPRKGIG

SEQ ID NO: 133055 - protein, 65 aa, Glycine max
  Coding DNA Sequence Number=SeqID_16277
MFAYSPVAKHKPRAKCIFGHVLSRESLALSTQPLHLKLIGSAKLAKAKLSQFQFDLNSAKRRHDR

SEQ ID NO: 133056 - protein, 85 aa, Glycine max
  Coding DNA Sequence Number=SeqID_16278
EKDMRIMVAKPRIGSRPPKCEKRCNTCGHCEAVQVPVAPQIQTHRRHYSSARATKAVTYSSRDDHLSNYKPMSWKCKCGDYLFNP

SEQ ID NO: 133057 - protein, 437 aa, Glycine max
  Coding DNA Sequence Number=SeqID_16279
  Gene Ontology: Mol. function=tryptophan-tRNA ligase activity; Cellular component=intracellular; Biological process=tRNA aminoacylation for protein translation
  Homolog annotation: Hit_ID=Q5JKV2; Match level="QueryCoverage=89%, HitCoverage=85%, E-value=8e-95, Identity=77%"; Hit description =Putative tryptophanyl-tRNA synthetase
  Pfam annotation: Domain name=tRNA-synt_1b; Domain location=40-384; Score=330.3; E_value=3.4e-96; Accession=PF00579.15; Description=tRNA synthetases class I (W and Y)
MTLKVACFSPPFSHPVLYYSHFYFFRDSHSYLRELLLLPRKRVVSGVQPTGSIHLGNYFGAIKNWVALQNVYDTLFFIVDLHAITLPYDTQQLSKATRSTAAIYLACGVDPSKASVFVQSHVRAHVELMWLLSSTTPIGWLNKMIQFKEKSRKAIKNKGRNRPKCKGETGENKSYRAMGILGSLRKKRESKEIAETCVCFGMGLSLANVGLLNQAHVFLQCSSCWLGDEEVGVALLTYPVLMASDILLYQSDFVPVGEDQKQHLELTRDLAERVPEPLIPPAGARIMSLTDGLSKMSKSAPSDQSRINILDPKDLIANKIKRCKTDSFPGLEFDNSERPECNNLLSIYQLISGKTKEEVVQECQNMNWGAFKPLLTDALIDHLHPIQVRYEEIMSDSGYLDGVLAQGARNAADIADSTLNNVYQAMGFLKRLIIDAK

SEQ ID NO: 133058 - protein, 626 aa, Glycine max
  Coding DNA Sequence Number=SeqID_16280
  Gene Ontology: Mol. function=ATP-dependent peptidase activity; Cellular component=integral to membrane; Biological process=ATP -dependent proteolysis
  Homolog annotation: Hit_ID=Q5JKW4; Match level="QueryCoverage=73%, HitCoverage=81%, E-value=1e-86, Identity=40%"; Hit description=ATP -dependent protease La (LON) domain-containing protein-like
  Pfam annotation: Domain name=LON; Domain location=162-492; Score= -28.9; E_value=0.00015; Accession=PF02190.7; Description=ATP -dependent protease La (LON) domain
MDDEERERLLERERLQIQVIRQLDLEDLVVEEVDHSDEEDIDGDPDEEYALFLSQYHLDASLPPPSSAEFNFDTYIAPLHTYLGDVEDTRHRTAFLDGGAILNLPLFCLGASAFLDGALFVDETNNEVIVNNFGKLVLLQDGKRGCLCVWTGWDLSFTEPFHPSALSHGVVLFPGATLPLRVIEPHLVAAVERALTQDDIPCTIGVIRIHRDTATRRTKSASIGTTAEIRQFGRLGDGSLNVVTRGQQRFRLRRSWTDVEGVPYGEIQVIEEDLPLRIPRDAFGKSAPLSNMPCSQGVSHNLSPKYSHVNMQRSKNEENDSEPNSEESFESELSLMERKIHLSVVGSSYVHDTMDESANDNDVKFMHNSDQEIRSNLDSRTGKCSTSGKQSSKEELSRCKNICAYPSYKISKAFWPHWAYQMFDSYSLAQRAADMWKRIVGMPDMDSLIKKPDILSFHIASKIPVSESTRQELLDIDGIAYRLRREIELLESIDLIRCKSCETIIAKRSDMLVMSSEGPLSAYVNPGGYVHEIMTLYKANGLALVGSAATDYSWFPGFWSRQCFIAETLDPSTHVLLNRYAWTIATCATCKTQMGWLFTARNKQLKPSYFWGIRSCQLAEEIRQNL

SEQ ID NO: 133059 - protein, 227 aa, Glycine max
  Coding DNA Sequence Number=SeqID_16281
  Gene Ontology: Mol. function=sequence-specific DNA binding; Cellular component=nucleus; Biological process=regulation of transcription, DNA-dependent
  Pfam annotation: Domain name=Chromo; Domain location=91-141; Score =13.6; E_value=0.024; Accession=PF00385.14; Description='chromo' (CHRromatin Organisation MOdifier
MEKLLREPTGGSLGKEFYQKLARSFNYSSGRAGKPIIKWTEIESWFQTRLQDSPQVPSSELMVPKCKEGETMQHPSELEFEARSSKDGAWYDVEAFLAHRFLSTGEAEVHVRFVGFGADEDEWINIKTSVRQRSIPLESTECSNLKMGDPVLCFQERRDQAIYYDAHIVEIQRRMHDIRGCRCLILIRYDHDNSEVSFQTVSKGPGCSRKQLALDIEYRARSCKFHS

SEQ ID NO: 133060 - protein, 395 aa, Glycine max
  Coding DNA Sequence Number=SeqID_16282
  Gene Ontology: Mol. function=protein serine/threonine kinase activity; Cellular component=cytoplasm; Biological process=protein amino acid phosphorylation
  Homolog annotation: Hit_ID=Q1T4M8; Match level="QueryCoverage=76%, HitCoverage=48%, E-value=1e-121, Identity=74%"; Hit description =Protein kinase-like
  Pfam annotation: Domain name=Pkinase; Domain location=142-388; Score=- 52.8; E_value=2e-05; Accession=PF00069.15; Description=Protein kinase domain
  Pfam annotation: Domain name=Pkinase_Tyr; Domain location=142-349; Score=-174.5; E_value=0.091; Accession=PF07714.7; Description =Protein tyrosine kinase
  Pfam module annotation: Pfam domain module=Pkinase::Pkinase_Tyr; Domain location=142-388::142-349
  Subcellular localization annotation: CTP_CleavageSite=40; ConfidenceScore=5.25e-01
MPELRSRPHISRLVDSANANPTTQPASPPAAGACRRKPAVAAAPTGRNRRLNNAIAVAADQILNAEDEGGAVRGTRARKLKQDQGVKENIKNKKVSVRVLEVEGMDEYDSGSRSADKAPGAEDEGTTPPIPEKVQVGGSPLYRVERKLGKGGFGQVYVGRLLGAANSSERTGAGAVEVALKFEHRSSKGCNYGPPYEWQVYNALGGSHGVPQAHYKGQQGDYYIMVMDILGPSLWDVWNNNNPHMMSTEMVACIAIEAISILEKMHSRGYVHGDVKPENFLLGLPGTLDEKKLFLVDLGLVNVQVMSDFINYILATGAQFVMLACMPILVEQVAGEMTWNLLLTLLSFFFVVGYLGKDTREKIKGFLSARKRWPLLQKLCVAFVLNHFDNLLNMW

SEQ ID NO: 133061 - protein, 106 aa, Glycine max
  Coding DNA Sequence Number=SeqID_16283
AEILLVRIVCAYNQEVHVIFVEFRVEEDEWINTKTSVLQPENWRPSPVLPGKSSLEETLPQINLRRIWDQFFLTFKVSFQTVSKRPGCKQLALDIENRARSSTFHS

SEQ ID NO: 133062 - protein, 762 aa, Glycine max
  Coding DNA Sequence Number=SeqID_16284
  Gene Ontology: Mol. function=protein serine/threonine kinase activity; Cellular component=endoplasmic reticulum; Biological process=protein amino acid phosphorylation
  Homolog annotation: Hit_ID=Q1T4M8; Match level="QueryCoverage=92%, HitCoverage=96%, E-value=0.0, Identity=77%"; Hit description=Protein kinase-like
  Pfam annotation: Domain name=Pkinase; Domain location=107-475; Score=- 28.3; E_value=7.1e-07; Accession=PF00069.15; Description=Protein kinase domain
SPSSSWANAALTMPELRSRPRRNRLVDNANADEIVSVRGTRARKLKDDQGVKENINKKKVSGRVLEVEGMNEYDSGGRSADKAPEAEDEGTTPPIPEKVQVGGSPLYRVERKLGKGGFGQVYVGRRLGAANSNERAGAGAVEIALKFEHRSSKGCNYGPPHEWQVYNSNFAMIISCSALGGSHGVPRVHYKGRQGDYYIMVMDILGPSLWDVWNNNNPHMMSTEMVACIAIEAISILEKMHSRGLRQDHHLIATTTTTIIAAITTIIATNMIVIAAIAAAATTSMIAAITTVIATNITVAATTAMIAAMIAIAAAMVVVVVTILTYVHGDVKPENFLLGPPGTPNEKKLFLVDLGLATRWRDSSTGLHVEYDQRPDVFRGTVRYASVHAHLGRTGSRRDDLESLAYTLVFLLRGRLPWQGYQGENKGFLVCKKKMATSPETLCCLCPQPFRQFVEYVVNLKFDEEPNYARYISLFDGIVGPNPDIRPINTEGAQKVGHKRGRLTIEEDDDEQPNKKVRMGMPATQWISVYNARRPMKQRYHYNVADVRLAQHIDKGNEDGLFIGSVASCSNLWALIMDAGTGFTAQVYELSPHFLHKEWIMEQWEKNYYISAIAGANNGSSLVVMSKGTQYLQQSYKVSDSFPFKWINKKWREGFYVTAMATAGSRWAIVMSRGAGFSDQVVELDFLYPSEGIHRRWDSGYRITSTAATWDQAAFVLSVPRRKPADETQETLRTSAFPGTHVKEKWAKNLYIASICYGRTVS

SEQ ID NO: 133063 - protein, 96 aa, Glycine max
  Coding DNA Sequence Number=SeqID_16285
MWTGNDDFEVLNVHLYYSNDFLLPVFEVYMMGFSWSVVLHDWMLIVFIPYTKYCKSLVGPGNYYVAGATHMSWKSEAVQGTGDPRLFNNLKGKSPD

SEQ ID NO: 133064 - protein, 1346 aa, Glycine max
  Coding DNA Sequence Number=SeqID_16286
  Homolog annotation: Hit_ID=Q1SPJ4; Match level="QueryCoverage=98%, HitCoverage=98%, E-value=0.0, Identity=68%"; Hit description=Thiolase
  Pfam annotation: Domain name=GCC2_GCC3; Domain location=778-835; Score=6.5; E_value=0.021; Accession=PF07699.3; Description=GCC2 and GCC3
MARFRFRRLRFLAIFVVVVVFASDELESERELSVTDLDWNLFHQDYSPPAPPPPPPHPPSVSCVDDLGGVGTLDTTCKIVNDVNLTRDVYIAGKGNFNILPGVRFLCEIPGCMVTVNVTGNFSLGSNSSIVTGAFEFESENAVFGNESVVNTTGMAGDPPPQTSGTPQGVEGGGGGHGGRGASCLVDTTKLPEDVWGGDAYSWASLQNPYSFGSRGGSTSKESDYGGLGGGLVRMVVHQIVEMNATVLADGGDGGTKGGGGSGGSIYIKAYRMTGNGIISACGGNGFAGGGGGRVSVDVFSRHDEPKIYVHGGKSLGCPENAGAAGTLYDAVPRSLIVDNFNMTTDTETLLLEFPNQPLWTNVYVRNKARATVPLLWSRVQGGVLSFGLRHYATSEFELLAEELLMSDSVMKVYGALRMSVKMFLMWNSKMLIDGGEDITVATSLLEASNLIVLRGASVIHSNANLGVHGQGLLNLSGPGDWIEAQRLVGPGSVLRGPLENATTDDVYLYCDKEDCPYELLHPPEDCNVNSSLSFTLQICRVEDILVEGLIKGSVVHFHRARTISVESSGTISASGMGCTGGLGHGNTLSNGIGSGGGHGGTGGEAFYNDNHVKGGCSYGSATLPCELGSGSGNGNSTGTTAGGGIIVVGSLEHPLSSLSIQGYVKANGGNFEPQIRNEKFAIFDNFTGGPGGGSGGTILMFLHMLTIGKSAVLSSMGGYSSSNGSGGGGGGRIHFHWSDIPTGDVYLPIASVKGDIQIWGGKGKGQGGSGANGTITGKACPKGLYGTFCEECPAGTYKNVTGSDKSLCHSCPVNELPHRAAYISVRGGITETPCPYQCVSDRYHMPDCYTALEELIYRFGGPWLFGLFLMGLLILLALVLSVARMKFVGVDELPGPAPTQHGSQIDHSFPFLESLNEVLETNRVEESQSHVHRMYFMGPNTFSEPWHLPHTPSEQIKDVVYESEFNTFVDEINAIAAYQWWEGAIHSVLSVLAYPFAWSWQQWRRRLKLQRLREFVRSEYDHACLRSCRSRALYEGIKVNATSDLMLAYMDFFLGGDEKRIDLPPRLHERFPMSLPFGGDGSYMAPFTLHNDNILTSLMSQSVQPTTWYRLVAGLNAQLRLVRRGRLRVTFRPVLRWLETHANPALSVHGVRIDLAWFQATNTGYCHYGLMVYALEEGYPATGGSADGALRTEERSRVLSVIKELPLGFAISRAHLSPGGRVEDNYMRRLMNGAALDVNNLQMLDEKRDIFYLLSFILQNTKPVGHQVVAFLCGYIHYNSQSSSSKRHPSIQPWSIMDESEWWIFPAGLVLCKLFQSQLINWHVANLEIQDRSLYSNDFELFWQS

SEQ ID NO: 133065 - protein, 398 aa, Glycine max
  Coding DNA Sequence Number=SeqID_16287
  Gene Ontology: Mol. function=DNA binding; Cellular component =intracellular; Biological process=base-excision repair
  Homolog annotation: Hit_ID=Q1S746; Match level="QueryCoverage=73%, HitCoverage=91%, E-value=1e-129, Identity=73%"; Hit description =Putative serine esterase (DUF676), putative
  Pfam annotation: Domain name=DUF676; Domain location=71-281; Score =226.3; E_value=6.8e-65; Accession=PF05057.5; Description=Protein of unknown function (DUF676)
MDSEGALPQVQEIEQEGVGGGTNKKMEVKNETKKKKKKRSSYFPRFGCFRIEHDASGGGFDIEVVDESGQRPTPTHLIIMINGLVGSAQNWKFAAKQFLKRYPEDTIVHCSERNSSMLTFDGVDVMGDRLAEEVISVIKRHPSVQKISFVGHSLGGLVARYAIAKLYGRDISMELSQGNGHCESQISDQECHDRKYEGKIAGLEPINFITSATPHLGSRGHKQVPMFCGFYSLEKAVSRVAGVFGKTGKHLFLTDRDNGKPPLLLQMVHDSEDIKFLTSSIRRRKELPKRQHLSRHEKYPHIVNVETTKSTSVADEVPDESKVSSGSSKLDYEEIDGDHRYRVIQSFVLILFLCQEEMIKSLTTMSWDRIDVSFSGSMQKILAHSTIQASFYFLKYIM

SEQ ID NO: 133066 - protein, 109 aa, Glycine max
  Coding DNA Sequence Number=SeqID_16288
  Subcellular localization annotation: CTP_CleavageSite=45; ConfidenceScore=5.07e-01
MEAENGGGAATIMQRRRRNKLCCGGNMPTRNVKNVTLMKQTFMPVSDPRSALCLCVFNLCEATMEKLISKVFVKGYACCCNPKNVPSILKNESTHVHPFNLGVNGSPTL

SEQ ID NO: 133067 - protein, 70 aa, Glycine max
  Coding DNA Sequence Number=SeqID_16289
  Subcellular localization annotation: CTP_CleavageSite=42; ConfidenceScore=5.47e-01
MGKNKGHQSHSAAKQIMVKGTTSGKSQTSATSGLAGCLDVVQANQNAYTSSQDNLGQGARKKGRDKFCKN

SEQ ID NO: 133068 - protein, 685 aa, Glycine max
  Coding DNA Sequence Number=SeqID_16290
  Gene Ontology: Mol. function=protein dimerization activity; Cellular component=chromatin; Biological process=DNA integration
  Homolog annotation: Hit_ID=Q2R1C3; Match level="QueryCoverage=90%, HitCoverage=85%, E-value=1e-154, Identity=46%"; Hit description=HAT family dimerisation domain containing protein
  Pfam annotation: Domain name=DUF659; Domain location=159-289; Score =31.9; E_value=6e-10; Accession=PF04937.6; Description=Protein of unknown function (DUF 659)
  Pfam annotation: Domain name=hATC; Domain location=512-600; Score =48.6; E_value=2e-11; Accession=PF05699.5; Description=hAT family dimerisation domain
  Pfam module annotation: Pfam domain module=DUF659::hATC; Domain location=159-289::512-600
  Subcellular localization annotation: CTP_CleavageSite=59; ConfidenceScore=5.46e-01
MVLQAIFNDAFFSTTGSSSTTLFIGSSASTLVAVDSCHHRFPSLLFLVCGGIATCLKVTDAYLVDLRRVYEEDENKLKSKNVPLPTDKRTPTPLTLPPKRRKTSNIESAFNIEDMNHLRAEIARMFYSTSLSFHLARNPYFVSSYSFAANCNLSGFLPPSYNALRTSLLQQERSHIERLLQPIKSLWSLKGVTLVADGWTDAQRRPLINFMAISEEGPMFLKAIDGSKEYKDKHYMFDLLKDVIKEKLNFLIFWTPCVVHALNLGVKNICAAKNVDGNENVFNKCGLIAEVIGDASFIKVFIMTHSMRLAIFNEFSSLKLLSIAETRFASMIVMLKRLKLLKRCLQNMVISDHWNSYREDDVRKAAHVKELILNDIWWDKVDYILSFMDPIYSMIRICDTDASNLHLVYEMWDSMIEKVKTTIYRHDEVLENEVSSFFKVIHEILNSRWSKSCNPLHCLAHSLNPRYYSDNWLNKVPNRVPPHRDDELSSQRIKCLKRYFPHVNVRTKVYEEFSKFSSCAGDFGSFDSIEDRWALDPKTWWVMHGSSTPILQKLALKLLVQPCSSSCCERNWSTYSIHYLKRNKMDPKRAEDLVFVHSNLRLLSRKKEGYKKGETRLWDINGDVHDPLDDSAGVLEMEDLSLDEPDLEAMLFLDDGNGGEENETIREDVLNGACPTEEKSDCLEA

SEQ ID NO: 133069 - protein, 381 aa, Glycine max
  Coding DNA Sequence Number=SeqID_16291
MTVVEYENNKASRYSRGHPWCFFSILAKRKRDKGVGVSCHKKLRAPLSLSALRQAVGLMPGSGHPSSLQDLPLAPLSVEAFIALIVVIPPSSPPPVVPIQEVSSTAKVSVLAALASMVTMNALVMPPHFSSAPPVPPSVVLASTSTYSHPCVSLDHIYTSSDADSLWNVSYKPEQKTMVGFVSAFDKNLIQATGFQHVMDSTKGYCSQSLENGAPEVVNATVAFTEAMKSNHQLSSKGIVAKKDEFAKVVADLEARLKESEFRLKESELQVGREREASKELEEELLMYKKELDLGIFYSFKDVKDDVLLNKEDIDVEEKDASEEFDFNLIKDLATHLVVHPFALWSFSPNAYEDLVLSTSLAVVCLVKPGPLTVVVVVLKE

SEQ ID NO: 133070 - protein, 234 aa, Glycine max
  Coding DNA Sequence Number=SeqID_16292
  Gene Ontology: Mol. function=RNA-directed DNA polymerase activity; Biological process=RNA-dependent DNA replication
MEIVRRGVWHFCKLLASSAPPGEVEGVGPKCRPMVADSHHFGGKGASSGVKAVNSFMKFSHDITCLLVVQAFKQGVYGGSLERFLDHSLKALKLKLRACSKVTLSGPSRMILVALPCTLDAPLSQNLFDGVVHLNYHLVTLKVWSETSGQGNKVELTTSLATKRYRSRGTPGLGQLRTGGVAMIFLKAKKAWMLVHHLAFGLPGSQELASADPGSTFFQVEAHVVFIEFSEDLF

SEQ ID NO: 133071 - protein, 59 aa, Glycine max
  Coding DNA Sequence Number=SeqID_16293
MEHSKRGAHQGRLTKGDLGFCEALEKRDSPRGPEDNSFGCVCLTVGLRMFDKGDEVLDA

SEQ ID NO: 133072 - protein, 211 aa, Glycine max
  Coding DNA Sequence Number=SeqID_16294
  Gene Ontology: Mol. function=ribonuclease H activity; Cellular component=intracellular; Biological process=DNA integration
MDLFAWQPSDMPGIHPSIIFHKLPVCLQAKLANRKWRICINYTDLNRACPKDAYLLPDINKLVDEVSGFQIRQNVEVYVDDMVVKSQTIAQHMEHLEQVFRELYKYNMRLNLEKCTSGIGGGKFLGFMITHQGIEGNHEKCTTILEMHSPTNIQEVQKLNGGLASLFGFLTKKTQLFYKLLKKTKQFLWDKTYEQAFLAFKKIIATPPVLS

SEQ ID NO: 133073 - protein, 103 aa, Glycine max
  Coding DNA Sequence Number=SeqID_16295
MAKRMDNSRRRMSCIEALSESQLAKHTVFTFRLSEVLCCGKTERELSLMRKPSRGALDEILRDYEEASLLWRAKPSVGSSYGVLDPATLAQASLARLGPQVEF

SEQ ID NO: 133074 - protein, 169 aa, Glycine max
  Coding DNA Sequence Number=SeqID_16296
  Subcellular localization annotation: CTP_CleavageSite=76; ConfidenceScore=5.55e-01
MASSQLHPNSWAIVGAFVVLCPFFNICPSVSVFLYFLRMKLTSKIGRVPLNNVSKKLFEFDLNVFRRFKNCFFKLLATNVVADGLPLMFNRDKEPRFLFYWAILPLPSVNDPLASFNALMGDFPWRPLVKQVIPSGRTVPPSAVAPIVGEGGQLAVEVCLIVGVADVTP

SEQ ID NO: 133075 - protein, 78 aa, Glycine max
  Coding DNA Sequence Number=SeqID_16297
  Subcellular localization annotation: CTP_CleavageSite=37; ConfidenceScore=5.15e-01
MSSFLSDSTIGVGGSNSRENTRHGASDNKSSSSERLRVSRHAGGGTSHLYERAHPFVASPTGEPVTITMISPPFVFEK

SEQ ID NO: 133076 - protein, 53 aa, Glycine max
  Coding DNA Sequence Number=SeqID_16298
MTQQRRSTSTEEARPLMAPSAGPGDTRPPQGRNNGGGVHMALSDAKVPTNEVK

SEQ ID NO: 133077 - protein, 158 aa, Glycine max
  Coding DNA Sequence Number=SeqID_16299
MPNNMIEAARTTLVQARGLDKLDRPVILTPFKVITLDTGQHLSMLWGSTKLSLSYLSRLLPRTSNKLPRRRTISFDTGQPLSPVFNYLQSYTLYVSNNYLLAFIFKIDIISNLIYKSPLSIGYYLQAGNYLQGLLHHCNNPYQHGPATPSSHYKYQVS

SEQ ID NO: 133078 - protein, 1579 aa, Glycine max
  Coding DNA Sequence Number=SeqID_16300
  Gene Ontology: Mol. function=binding
  Homolog annotation: Hit_ID=Q1SPJ5; Match level="QueryCoverage=97%, HitCoverage=79%, E-value=0.0, Identity=77%"; Hit description=TPR repeat
  Pfam annotation: Domain name=TPR_1; Domain location=60-95; Score =19.1; E_value=0.016; Accession=PF00515.18; Description =Tetratricopeptide repeat
  Pfam annotation: Domain name=TPR_1; Domain location=96-129; Score =3.8; E_value=1.9; Accession=PF00515.18; Description=Tetratricopeptide repeat
  Pfam annotation: Domain name=TPR_2; Domain location=1298-1332; Score =3.3; E_value=14; Accession=PF07719.7; Description=Tetratricopeptide repeat
  Pfam annotation: Domain name=TPR_2; Domain location=60-95; Score =16.8; E_value=0.078; Accession=PF07719.7; Description=Tetratricopepti de repeat
  Pfam annotation: Domain name=TPR_2; Domain location=96-129; Score =3.4; E_value=13; Accession=PF07719.7; Description=Tetratricopeptide repeat
  Pfam module annotation: Pfam domain module=TPR_1::TPR_1::TPR_2::TPR _2::TPR_2; Domain location=60-95::96-129::1298-1332::60-95::96-129
MEFHLSQTYHEGLLKLQAKEYEKARELLESVLKDPLIANAQVDSSASDGHLLQLRRFYRFLALKNLAAVFLQQGSTHYENALRCYLQAVEIDSKDSVVWNRLGTLSCLMGSLSISRWAFEQGLSCSPNNWNCMEKLLEVLIAIGDEVACLSVSKLILRHWPSHSRALHVRNTIEESEPLRFAPRGIDKLEPQHVRLKFPDKRKATNENVDEDVAFKKLNQNKELHLTEVSWVALADALLEILSPQSSKMDPEKAFSSPDIRLSIILPSSSEAVMNTVEMKGSNCENSVSGDGNIERSSAFKEKEANIQEEQPHERRSSRLERLRSRKPGKEESDSSCGKDPTKVVIQYLEPFISGGLGGQDTIDRDTTKVSCLGNSEYYNVSAFLRETSNNYGAYHMGHLLLEEVARQGLTYQDAFVKFLELEKLTRHWGKERTAECNIFLAELYYDFGSCSPTGSKQLEFISETSYHLCKIIESVALDYPFHLTHALNENSFSIDSNQETHGKTINTSTESNSNLDSSLLMKNCPLWSRFFWLSGRLSIVDDNRAKACQEYCIALTLLAKREKENSLCSVPRPHCKAVKELNFDRVLDEINILKVNFLMEKSVIKMMEQEKFLECVSLLSPLLFSTQDVYPNSFSLSMTDKRDEKITSTELMAVDVLMEACQKTKPMDVEMYFNCHYRKLKILMTKMGLKTCITSFKSSDQAPILTVSPNFDIDSKESSSKNCSHLVTDEVKALSDCISQVKKIIDQHGDSDGLSVPTSSICQMQSLLLLIMSYVGNILALNKASAQVISDQAESSCFVDAAIVFCKLQHLSPTMPIKTQVDLIVATHDLLAEYGLCCLGEGGKGEEGTFLRFAIKHLLALDTKLKSSFNHKESMQCEEVSKNSLVNVSVEESKLDALDIQMDLTKIDEINSEKKDVSEGIISKGISSCRVHDKDGKEVEFENHGGAGTGSKLIKGENLSNQLIECEDELSEYEREELESKIDCALDQCFFCLYGLHLRSDSSYEDDLVVHKNTSRGDYQTKEQCADVFKYVLPYAKASSRTGLVKLRRVLRAIRKHILQPPEDLLAGNPIDKFLDDPNLCEDKLSEEAGSDGFLESITKRMFPDVGGLAQYNATLLRRSEPYLEVYCNLYYFLALSEEMSATDKWPGFVLTKEGEEFVEQNAKLFKYDLMYNPLRFESWQRLGNIYDEEVDLLLNDGSKHVNVVGWRNNATLSERVETSRRRSRRCLLMSLALANTSAQQCEIHELLALVYYDSLQNVVPFYDQRSALPLKDAAWMMFCENSMKHFKKAFALKQDWLHAFYLGKLSKKLGYSHEIALSYYNKAIALNTSAVDPVYRMHASRLKLLFKCGKQNLEILKVLSANSFNQSVKEAVTSILIGIDSSFLNTKERHIDANFVETKHEELLKLDTVWSMLYNDCLSALETCVEGDLKHFHKARYMLAQGLYKRGESGDIERAKDHLSFCFKSSRSSFTINMWEIDSTVKKGRRKTPGTAGNKKSLEVNLPESSRKFITCIRKYLLFYLKLLEETGDRCILERSYVALRADKRVMKITVRDMDTQFMQAHGKEAPSQPEQNLILN

SEQ ID NO: 133079 - protein, 270 aa, Glycine max
  Coding DNA Sequence Number=SeqID_16301
  Gene Ontology: Cellular component=plastid chromosome; Biological process=positive regulation of transcription, DNA-dependent
  Homolog annotation: Hit_ID=Q2RBI6; Match level="QueryCoverage=53%, HitCoverage=43%, E-value=1e-49, Identity=61%"; Hit description =Expressed protein
  Subcellular localization annotation: CTP_CleavageSite=52; ConfidenceScore=5.52e-01
MMTTAPTTSTFFFLLSSLNPHPPRSFFRHKPLFNNPSLLLRPPLRSPRHLTRADDDDGDGGGPDHYEMDEDEMEELDNKKDFDIEYDPLVPAAAAAAAASAADDNIAFVESKSFVSTQGWDSDTVLDYKINEDEFHKICLVDCDFFIRKPPDPDNDVYDFREMYVTPPDTDVYSIPKVLAPMPQKYIRCAQSDYGSYNVTEPPIDAPRDPLYKTEREILKSCEILLNSEQSSYGIQPDNELYLSYLPQKGCFTLLCNIRLRLEELVLPYA

SEQ ID NO: 133080 - protein, 160 aa, Glycine max
  Coding DNA Sequence Number=SeqID_16302
MPDEALIIFKLSDPSIHPIKLEEKWNHPFVVEVKGGGNRTDTNGKQPFNLDIWFIIQRNIEMMKKKSNKVGIRQRSTLESNPPQRLEQENKVDDRGDEREGGICVVGAPTVPWRRWPVAAVVEEEPFRFLDEMKEIWSFEDWEAWSAVTQGSTYEGAAKA

SEQ ID NO: 133081 - protein, 35 aa, Glycine max
  Coding DNA Sequence Number=SeqID_16303
MDEAPIFLLNTFEVSIAVSAEHDASVDIWSLGVLC

SEQ ID NO: 133082 - protein, 89 aa, Glycine max
  Coding DNA Sequence Number=SeqID_16304
  Gene Ontology: Mol. function=protein serine/threonine kinase activity; Biological process=protein amino acid phosphorylation
  Homolog annotation: Hit_ID=Q1S728; Match level="QueryCoverage=52%, HitCoverage=15%, E-value=5e-12, Identity=70%"; Hit description =Protein tyrosine kinase
MEEEISLQEKNITMKIIYFSTLSSGNQLHFLASSEVSGSTAEQRRWMLNDFDIGKPLRKGKFDQVYLARERSDKSHCITRDMTIVVDLY

SEQ ID NO: 133083 - protein, 1011 aa, Glycine max
  Coding DNA Sequence Number=SeqID_16305
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=96%, HitCoverage=97%, E-value=0.0, Identity=45%"; Hit description=Protein kinase
  Pfam annotation: Domain name=LRRNT_2; Domain location=32-71; Score =28.1; E_value=3e-05; Accession=PF08263.3; Description=Leucine rich repeat N-terminal domain
  Pfam annotation: Domain name=LRR_1; Domain location=101-123; Score =10.2; E_value=3.6; Accession=PF00560.23; Description=Leucine Rich Repeat
  Pfam annotation: Domain name=LRR_1; Domain location=125-147; Score =19.7; E_value=0.011; Accession=PF00560.23; Description=Leucine Rich Repeat
  Pfam annotation: Domain name=LRR_1; Domain location=149-171; Score =14.3; E_value=0.44; Accession=PF00560.23; Description=Leucine Rich Repeat
  Pfam annotation: Domain name=LRR_1; Domain location=173-195; Score =11.6; E_value=2; Accession=PF00560.23; Description=Leucine Rich Repeat
  Pfam annotation: Domain name=LRR_1; Domain location=197-221; Score =9.7; E_value=4.4; Accession=PF00560.23; Description=Leucine Rich Repeat
  Pfam annotation: Domain name=LRR_1; Domain location=223-245; Score =3.9; E_value=54; Accession=PF00560.23; Description=Leucine Rich Repeat
  Pfam annotation: Domain name=LRR_1; Domain location=248-270; Score =20.8; E_value=0.0048; Accession=PF00560.23; Description=Leucine Rich Repeat
  Pfam annotation: Domain name=LRR_1; Domain location=272-295; Score =13.1; E_value=1; Accession=PF00560.23; Description=Leucine Rich Repeat
  Pfam annotation: Domain name=LRR_1; Domain location=296-318; Score =18.3; E_value=0.028; Accession=PF00560.23; Description=Leucine Rich Repeat
  Pfam annotation: Domain name=LRR_1; Domain location=320-342; Score =11.4; E_value=2.1; Accession=PF00560.23; Description=Leucine Rich Repeat
  Pfam annotation: Domain name=LRR_1; Domain location=344-366; Score =9.7; E_value=4.3; Accession=PF00560.23; Description=Leucine Rich Repeat
  Pfam annotation: Domain name=LRR_1; Domain location=368-387; Score =9.5; E_value=4.8; Accession=PF00560.23; Description=Leucine Rich Repeat
  Pfam annotation: Domain name=LRR_1; Domain location=416-438; Score =5.1; E_value=32; Accession=PF00560.23; Description=Leucine Rich Repeat
  Pfam annotation: Domain name=LRR_1; Domain location=440-463; Score =14.5; E_value=0.38; Accession=PF00560.23; Description=Leucine Rich Repeat
  Pfam annotation: Domain name=LRR_1; Domain location=486-508; Score =12.8; E_value=1.2; Accession=PF00560.23; Description=Leucine Rich Repeat
  Pfam annotation: Domain name=LRR_1; Domain location=510-532; Score =9.7; E_value=4.5; Accession=PF00560.23; Description=Leucine Rich Repeat
  Pfam annotation: Domain name=LRR_1; Domain location=534-556; Score =12.1; E_value=1.6; Accession=PF00560.23; Description=Leucine Rich Repeat
  Pfam annotation: Domain name=LRR_1; Domain location=558-580; Score =16.9; E_value=0.072; Accession=PF00560.23; Description=Leucine Rich Repeat
  Pfam annotation: Domain name=LRR_1; Domain location=581-603; Score =15.3; E_value=0.23; Accession=PF00560.23; Description=Leucine Rich Repeat
  Pfam annotation: Domain name=Pkinase; Domain location=701-977; Score =163.9; E_value=4.2e-46; Accession=PF00069.15; Description=Protein kinase domain
  Pfam annotation: Domain name=Pkinase_Tyr; Domain location=701-977; Score=96.3; E_value=9e-26; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=32-71::101 -123::125-147::149-171::173-195::197-221::223-245::248-270::272 -295::296-318::320-342::344-366::368-387::416-438::440-463::486 -508::510-532::534-556::558-580:...
  Pfam module annotation: =:581-603::701-977::701-977
MSKIHLFMLKFPFHLLLLLSVIVPFQVISQSENTEQTILLTLKHELGDPPSLRSWIPSPSAPCDWAEIRCAGGSVTRLLLSGKNITTTTKNLSSTICNLKHLFKLDFSGNFISDEFPTTLYNCTNLRHLDLSDNNLAGPIPADVDRLETLAYLNLGSNYFSGEIPPAIGNLPELQTLLLYKNNFNGTIPREIGNLSNLEILGLAYNPKLKRAKIPLEFSRLRKLRIMWMTQCNLMGEIPEYFGNILTNLERLDLSRNNLTGSIPRSLFSLRKLKFLYLYYNRLSGVIPSPTMQGLNLTELDFGNNILTGSIPREIGNLKSLVTLHLYSNHLYGEIPTSLSLLPSLEYFRVFNNSLSGTLPPELGLHSRLVVIEVSENHLSGELPQHLCVGGALIGVVAFSNNFSGLLPQWIGNCPSLATVQVFNNNFSGEVPLGLWTSRNLSSLVLSNNSFSGPLPSKVFLNTTRIEIANNKFSGPVSVGITSATNLVYFDARNNMLSGEIPRELTCLSRLSTLMLDGNQLSGALPSEIISWKSLSTITLSGNKLSGKIPIAMTVLPSLAYLDLSQNDISGEIPPQFDRMRFVFLNLSSNQLSGKIPDEFNNLAFENSFLNNPHLCAYNPNVNLPNCLTKTMPHFSNSSSKSLALILAAIVVVLLAIASLVFYTLKTQWGKRHCGHNKVATWKVTSFQRLNLTEINFLSSLTDNNLIGSGGFGKVYRIATNRLGEYVAVKKIWNRKDVDDKLEKEFLAEVEILGNIRHSNIVKLLCCYASEDSKLLVYEYMENQSLDKWLHGKKKTSPSGLSWPTRLNIAIGVAQGLYYMHHECSPPVIHRDVKSSNILLDSEFKAKIADFGLAKMLANLGEPHTMSALAGSFGYIPPEYAYSTKINEKVDVYSFGVVLLELVTGRKPNKGGEHACSLVEWAWDHFSEGKSLTDAFDEDIKDECYAVQMTSVFKLALLCTSSLPSTRPSAKDILLVLRQCCHSGSTCRRAGNEFDIAPLLGDTRYIYSYKE

SEQ ID NO: 133084 - protein, 79 aa, Glycine max
  Coding DNA Sequence Number=SeqID_16306
MVSLNRATRGETLENTRNAIITNEERLSDYLEVAAAGVSLSEANALSEYHPLSEALARLASQGNLEENLPRKSFVSSCA

SEQ ID NO: 133085 - protein, 221 aa, Glycine max
  Coding DNA Sequence Number=SeqID_16307
  Gene Ontology: Mol. function=nucleic acid binding; Cellular component= oxygen evolving complex; Biological process=DNA integration
  Homolog annotation: Hit_ID=Q1S4N1; Match level="QueryCoverage=96%, HitCoverage=16%, E-value=3e-74, Identity=63%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAQLTNIKQGDGDRFFVVSLYVDDLLVAGSNIELIQQFKEDMMRVFEMTGLGKMSYFLGIEIKQRQNEIFICQQKYADEILKKFCMDNCKSMSTPMCQKGKLCKDNGTTKVNESEYRSLVGCLMYLTTTRPDIMYAVSVLSRFINCANESHLRAAKRVLRYVKGTVSFGVKFCLAPSFELQGYSDSGWVGSLNDMKSTSGFCFNFIGIFTWSSKKQEIVAQ

SEQ ID NO: 133086 - protein, 72 aa, Glycine max
  Coding DNA Sequence Number=SeqID_16308
MSGMSMKMERTLIASCAPISLVSMRILVLTCHDGSGPSDSVLPGCGGHTKPVGAVLPDTVRSKVLTPPLFWT

SEQ ID NO: 133087 - protein, 109 aa, Glycine max
  Coding DNA Sequence Number=SeqID_16309
MSQVVVFKCKFKEYKYKLQSQRSNRQSRVLHQKNIQLSSSLIFLQQTGIKSYFLKGFVSNPIANLTFLDSIHNMDSETPFTALAPLVFKGKNYKLWAARMKAHLEANDL

SEQ ID NO: 133088 - protein, 391 aa, Glycine max
  Coding DNA Sequence Number=SeqID_16310
  Gene Ontology: Cellular component=integral to membrane; Biological process=peroxisome organization and biogenesis
  Homolog annotation: Hit_ID=O80592; Match level="QueryCoverage=93%, HitCoverage=86%, E-value=1e-104, Identity=46%"; Hit description =Putative amino acid permease
  Pfam annotation: Domain name=Aa_trans; Domain location=25-391; Score =248.5; E_value=1.4e-71; Accession=PF01490.8; Description =Transmembrane amino acid transporter protein
MDIEAGKDIPSRDPAELDDDGRVKRTGNVFIATTHIVTVVVGAGVLALAWAMAQLGWIAGIAVMVLFACISVYTYNLIADCYRYPDPVSGKRNYTYMQAVDAYLGHAAYCKFSNNPYMIGFGIFQILLSQIPNFHKLTWLSTIAAATSFGYAFIGSGLSLAVVVSGKGEATSIFGNKVGPDLSEADKVWKVFSALGNIALACSFATVIYDIMDTLKSYPPENKQMKKANVLGITAMTILFLLCGGLGYAAFGHDTPGNILTGFGFYEPFWLVALGNVFIVIHMVGAYQVMAQPLFRVIEMGANMAWPRSDFINKGYPIKMGSLTFNINLFRLIWRSMYVVVATVIAMAMPFFNEFLALLGAIGFWPLIVFFPVQMHIAQKQLVPFVELARI

SEQ ID NO: 133089 - protein, 123 aa, Glycine max
  Coding DNA Sequence Number=SeqID_16311
  Subcellular localization annotation: CTP_CleavageSite=35; ConfidenceScore=5.37e-01
MLSLIIPSCNFNKQRLAPPRSKSCFGFYPNFRKLCASKNGKNTVEAFHRALGGRTFGYQQQGNRGNVACPIISEHNLGLRPSPTTPQFKETKHKLAPNCLTELVKLCTIQSIKGINGKLETKG

SEQ ID NO: 133090 - protein, 141 aa, Glycine max
  Coding DNA Sequence Number=SeqID_16312
  Gene Ontology: Mol. function=structural constituent of ribosome; Cellular component=ribonucleoprotein complex; Biological process =translation
  Homolog annotation: Hit_ID=Q2QD65; Match level="QueryCoverage=67%, HitCoverage=74%, E-value=7e-38, Identity=85%"; Hit description =Ribosomal protein S12
  Pfam annotation: Domain name=Ribosomal_S12; Domain location=15-140; Score=151.5; E_value=2.3e-42; Accession=PF00164.15; Description =Ribosomal protein S12
MGQILQDQTLWELRNDGRKEIKKKWDKRIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 133091 - protein, 412 aa, Glycine max
  Coding DNA Sequence Number=SeqID_16313
MASRKRKATASRPQPHFDTHRFTYEDAWNRYVDNVVLGRNILPERNVKLFVTESDEFRTNLVRRNWQRTLTNLMEGSIDVALVKEFYANLYVSEDKPPKQVRVRGHLIKFDVDSLNTFLETPVVLEPGETLPAYSKFCRLRPDPQELAARLCISGRGFVLNAEGLPWKLLRKYLTTLAQTWSVLSYFNLAPTSRTFDLNLDKARLVYGLVMKMEMNVRALISGQITLMAHSNSSRLEFPALITALCMARGVTSDSLTFESLSLAINLAYIKKNYWTTPRSTFQGPARPGLEDLRSLHSLAQHQPIMSMEEFSLQVAWPRVQPSSHGGGEASATQEPQPNLETAPAAQEDDTKSFVLETYPEADPVIAEVSPQASPISTPMLNLSTLQGSPAGTPVLHLTDDEVMDQDPPQDQ

SEQ ID NO: 133092 - protein, 119 aa, Glycine max
  Coding DNA Sequence Number=SeqID_16314
MRHQIPMIGGIINMKIKKKVCFIPLLNSDQGFPMDPKRIKVIPEWPTPPSVEERISEFQEPLNLRSNHFQGGGNDAILLMRIIKLAKYRLNAQVEKDEGLSGEGQSPRVEKDEGRSGEG

SEQ ID NO: 133093 - protein, 109 aa, Glycine max
  Coding DNA Sequence Number=SeqID_16315
  Homolog annotation: Hit_ID=Q1M2Z4; Match level="QueryCoverage=50%, HitCoverage=27%, E-value=1e-14, Identity=67%"; Hit description=Ampk protein
MEDTLVKFKSEFAVMELEIQALARLAEEITQCGISEGSRKINGKYIHSHLVARLEGIMCKYVVFSYIAVNEQLKEQIKEVDAAQSKEVSVFWVGMAEVNTFKIRLPNVQ

SEQ ID NO: 133094 - protein, 75 aa, Glycine max
  Coding DNA Sequence Number=SeqID_16316
MLRKGSLNEPDWLSKSHLLSEEANSLSESGILENVKPESNAQSAHPVNLLSLLALSASKPAKRPVTNSRSARHAR

SEQ ID NO: 133095 - protein, 123 aa, Glycine max
  Coding DNA Sequence Number=SeqID_16317
MELHQKLVSDEDSQKCMPKPIGYAEMDNAVAVVDPLGELVKNLFRLLYIIVMFKVSSLNTGNILFKCFKNDRMGKHSETSMKCGFPEFKMGLSQIGLFLPNFYCSVYPRRPFIYRANSMPISL

SEQ ID NO: 133096 - protein, 103 aa, Glycine max
  Coding DNA Sequence Number=SeqID_16318
  Subcellular localization annotation: CTP_CleavageSite=46; ConfidenceScore=5.09e-01
MKCWRRPAASKCIAPYMAAARKRAKRSKTHDATGKTLLFAAVVSPSQNMYAKVAELVDALASGVSVLTDVRVQVPLFAPIITEFISRALREGGGIGRRASFRC

SEQ ID NO: 133097 - protein, 90 aa, Glycine max
  Coding DNA Sequence Number=SeqID_16319
MRIGSQNPTPPDFKREEVHPYLKLKVPRGRGRLLDSENSFSLQFGVEMKRNLELQKRQQWWIRRGRKATWREKEGLLEVSGEGERRFGFL

SEQ ID NO: 133098 - protein, 194 aa, Glycine max
  Coding DNA Sequence Number=SeqID_16320
MRRVHTHLPRLMDQEDSLANPLWKRIWKFPVQEKLRFFLWQFVHAAFLTNERRFGGSSSYYLRLSSRSKGVDAYGPCLNRTTRPWIWWLLFWRLRFNNKIKHVCTRGPIKSCGQGSWVSLLVAVRYPKLVHRIPNSSSWFGATGYPRWVVEVTDTSRLHQRNLNIDVCLRRLCPGHKHGSDLVYARHMPNIENA

SEQ ID NO: 133099 - protein, 85 aa, Glycine max
  Coding DNA Sequence Number=SeqID_16321
MTIEESIHVFFDETNYIRQRKDILDDITDTLEDTHIHEEVHKDKEDGNSIDSQSKENQINMDLQREWRTSRYHPLDNITGDILKG

SEQ ID NO: 133100 - protein, 125 aa, Glycine max
  Coding DNA Sequence Number=SeqID_16322
MHRPVGKTTHRHPFVDQIMEVDISLGWKPLNLESWSHRVTSAALASLRQADDEPLKKFMDRFGCITVQICNLNPEVSLHFMLRTLRLGKFADSLCKKPPSSMDELRERAKGYIQMEKMSKFRNEV

SEQ ID NO: 133101 - protein, 62 aa, Glycine max
  Coding DNA Sequence Number=SeqID_16323
  Subcellular localization annotation: CTP_CleavageSite=32; ConfidenceScore=5.24e-01
MKFSRGKVALNASSTLSPLIKLNYLANQSGVCALSVGPCGLNNLRGIGLECRRSNNQFNNVL

SEQ ID NO: 133102 - protein, 243 aa, Glycine max
  Coding DNA Sequence Number=SeqID_16324
  Homolog annotation: Hit_ID=Q47522; Match level="QueryCoverage=23%, HitCoverage=77%, E-value=4e-19, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPEFDPWRLRLSGGFNLGFLLTITMLVVHGTMQVNGHPDVSPAISGIAGLGHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133103 - protein, 138 aa, Glycine max
  Coding DNA Sequence Number=SeqID_16325
  Homolog annotation: Hit_ID=Q09JM0; Match level="QueryCoverage=36%, HitCoverage=91%, E-value=6e-07, Identity=58%"; Hit description=10 kDa putative secreted protein
NWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVAREVGKWIRNLGKRIGSEGWAR

SEQ ID NO: 133104 - protein, 260 aa, Glycine max
  Coding DNA Sequence Number=SeqID_16326
  Gene Ontology: Mol. function=RNA methyltransferase activity; Cellular component=intracellular; Biological process=RNA processing
  Homolog annotation: Hit_ID=Q6D0A7; Match level="QueryCoverage=59%, HitCoverage=68%, E-value=5e-57, Identity=70%"; Hit description =Putative RNA methyltransferase
  Pfam annotation: Domain name=SpoU_methylase; Domain location=2-153; Score=134.2; E_value=3.6e-37; Accession=PF00588.9; Description=SpoU rRNA Methylase family
MHFPLILVSPARPENIGAAARAMKTMGFSELRIVASDAWQDPAARRVAHGAGEILDHVKTYDTLSAALADVDFSVATTARSRAKFRYYATPAQVETILQEKRQWLNRIALVFGREDSGLTNEELEQVDLLTGIPMAQDYPSLNLGQAVMVYCYQLSALHQVAAAPVEAANAQQLQALRQRFHQLLIIARENRRRTVSDRASVALPERSQSVSASAAQHCAAAPFGCKDKFVDLTCALLYFWKADGQDKDRQKKSQCVTTA

SEQ ID NO: 133105 - protein, 617 aa, Glycine max
  Coding DNA Sequence Number=SeqID_16327
  Gene Ontology: Mol. function=RNA-directed DNA polymerase activity; Cellular component=chromatin; Biological process=chromatin assembly or disassembly
  Pfam annotation: Domain name=Chromo; Domain location=538-588; Score =26.9; E_value=7.3e-05; Accession=PF00385.14; Description='chromo' (CHRromatin Organisation MOdifier
MADADISKTAFRTHEGHYKFKVMPFGLCNAPSTFQAAMNDVLRPFLRKYVAVFFDDILPALTYLGHIILAHDVAPDPDKVQAMFIRNYAAIAAPLTSLLRKDQFCWSSASEQAFRDLKHQMTQAPVLATPDFTSPFILETDASGFAIGAVLSQDGHPIAFYSKVLCPRLQKASTYVCELHAVIQTPEHQQYLSKLLGYDYTIKYKPGAANIAADALSRIPAPATTFFSLTMPHVTFLDKLRQAVLQDPQYVELLQQVQSSPATHEDLLVHKDLLLRRGRIWLPFPTPFTSFLIEEFHSSPLGGHTGAAKTLHRLRQTFDWPHIQTDGYTVILVVVDRYSKGAHFGALPAQHIASKVATLFFDMGPNLYQQFLAGDIPFVRYQASDEYRLPSADRWSNGEWSYSTTMHSSTGVSPFEVVYGKPPPSLLHYEPGTSTIEAADDFLATCTTLHQTLQRRLRKAQDVMKQTADKHRRNVQFAINDCVYVLERIGPVAYKLQLPPYSKIHPVFHVSLLKPHHGPLPSSAAELPANTLHNDPLVEPLMIVDWKYDDTSSPPVKKVLVQWAGLAPEDTSWESWDELARAYDFEGKVDFGDESVDSNKAIAAKHTPTNIQAKRPK

SEQ ID NO: 133106 - protein, 376 aa, Glycine max
  Coding DNA Sequence Number=SeqID_16328
  Gene Ontology: Mol. function=RNA-directed DNA polymerase activity; Cellular component=chromatin; Biological process=chromatin assembly or disassembly
MPEHHTRQVTSDKLEEAINRLSQSHNSLSQNHTTLNSKMDFIHLSLSSQIESILERLATITVTPPSPSSLPQPPPSPVHRPRMKLDVPRFDGTDPLGWIFKISQFFDYQGIPELERLTVAAFYMDGPALSWYQWMSRNGFFPSWPAMLQALESRFASSYYEDPQGALFKLQQTGIVSEYLTQFERLANRIVGLPPSVLLSCFVSGLLLKLRREVQALRPLSLPQAVELARLQEDKLLDRRRGPWPPSLPPPPLVSKPLTPSASLPSKLLLKRLTTEEMALRQDQGLCYHCEEKWSHGHRCKPHLHLLIADEDPDSPADPFSLDPPSVSSQDPLLVPQISMNAMEGTLAPQTFRLRGVIRHHQVIILIDGGNTHNFI

SEQ ID NO: 133107 - protein, 209 aa, Glycine max
  Coding DNA Sequence Number=SeqID_16329
  Gene Ontology: Mol. function=transmembrane receptor activity; Cellular component=membrane; Biological process=defense response
  Homolog annotation: Hit_ID=Q1SI47; Match level="QueryCoverage=98%, HitCoverage=28%, E-value=1e-48, Identity=50%"; Hit description=TIR
MTKVQTWRHALNKSADLSGNESSKFRNDAELLKEIVNLVLTRLDKPLVNSKELVGIDEKIADLESLISKKPQDTPEEVFNKLQSNYEGGCFLANEREQSKNHGIKSLKNLLFYELLGCDVKIDTPNSLPKDIVRRICQMKVLTVLDDVNDSEHIEKLLGSIDNFGPSSRIILTTRDEQVLRANKVNETYQLREFSSNKALELFNLHAFS

SEQ ID NO: 133108 - protein, 581 aa, Glycine max
  Coding DNA Sequence Number=SeqID_16330
  Homolog annotation: Hit_ID=Q9ZUV4; Match level="QueryCoverage=95%, HitCoverage=97%, E-value=1e-169, Identity=53%"; Hit description =Nodulin-like protein
  Pfam annotation: Domain name=MFS_1; Domain location=97-497; Score= -4.3; E_value=0.0005; Accession=PF07690.6; Description=Major Facilitator Superfamily
  Pfam annotation: Domain name=Nodulin-like; Domain location=29-276; Score=344.0; E_value=2.5e-100; Accession=PF06813.4; Description =Nodulin-like
  Pfam module annotation: Pfam domain module=MFS_1::Nodulin-like; Domain location=97-497::29-276
MATILTNSSKINSGRFGVLKFIAQVIQGRWFMLCASFFILAGAGGVYVFGSYSEAIKRSQGYDQSTLNFLGFCKDLGGNLGAPIGFIGEVTPPWLVLLIGSVLNFGGYFMIWLVVTGRISKPHVWQVGLYIAIGASSQNFANTGVITTCVKNFPESRGTILGILKGYLGLSGAIMTQLYLAFYGNDSESLILLIAWLPAAISIAFASVIRIMKIGTRQPNEQKTMNNFLFAPIVLALFIMAMIIAQRQIPFSKAAYAGSATVVCVLLIILPLFIAVRKEFSPWNIMEKVLAHAANEVIIEKPQIVEAKEKAKDDPNGSCFSNIFNKPERGEDHTILQALLSIDMLLLLISSFAGYGTNVTVVDNLGQIGESLGYTGNTVRSFVSLVSIWNFFGRVLSGFVSEILLHKYKVPRPMLLVFSHFVTCIGHLLIVFPAPGSVYFASVIIGFSFGVVWPIFYALVSELFGLKHFATLQNCVLMVIPLASYVLNVRVTGFFYDREAKNQLIKSGKEWVKGTELTCIGTECYKLPLIIMACVSFFAGVTSLIFVMRTREFYKSDIYKKFTEKAETELTTSSVVCDEER

SEQ ID NO: 133109 - protein, 228 aa, Glycine max
  Coding DNA Sequence Number=SeqID_16331
  Homolog annotation: Hit_ID=Q9ZUV4; Match level="QueryCoverage=93%, HitCoverage=36%, E-value=4e-67, Identity=59%"; Hit description =Nodulin-like protein
  Pfam annotation: Domain name=Nodulin-like; Domain location=24-227; Score=208.0; E_value=2.2e-59; Accession=PF06813.4; Description =Nodulin-like
MTTNNTNTRQFGVVKFIAQVIQGRLFMLCASFFIMAGAGGTYVFGSYSEEIKSSQGYDQSTLNFLGFCKDLGSNFGTPVGLLGEVVPPWLVIKLGSAFDFGGYFMIWLAVTGRISKLHVWQVCIYIAIGSSSLSFANTGVITTSVPNFPESRGRILGLLKGYLGHSGAIMTQVYLAIYGNDSESLIHLIAWLPAAISIAFASVIRIMKVGTSTKNPIEPKVMYQLLFA

SEQ ID NO: 133110 - protein, 138 aa, Glycine max
  Coding DNA Sequence Number=SeqID_16332
MEFFSVETFDCIQAFQNLGLIPFMSLQLPVYPELVKAFYCNLEIQDNTLISEVFGIKMVIDQSLFHDLTQLSSDGVPFEGTLNDDWKFDFSAQDARQLVCTNNADMTGRLLAGSLAFESRILHYLIVRILRPRSSNLA

SEQ ID NO: 133111 - protein, 98 aa, Glycine max
  Coding DNA Sequence Number=SeqID_16333
MERDEKRFEYRFCYSSEENSVDEDKEGGIGAVDALLISIGEIKRKVKKKKIASYGSRFDEEMSKIGRFGGLGMEERCKGEGAAQGFLENVIFIEQDAW

SEQ ID NO: 133112 - protein, 260 aa, Glycine max
  Coding DNA Sequence Number=SeqID_16334
  Gene Ontology: Mol. function=nucleic acid binding
  Pfam annotation: Domain name=SWIM; Domain location=44-80; Score=38.8; E_value=1.9e-08; Accession=PF04434.8; Description=SWIM zinc finger
MAARLGPLVPMQHSRLEKEKLESNKWTANWVGDPDGTRFEVCHHETRIDVDLQNQSCTCRMWQLTGLPCRHAIVAIRYNNHRSEDYNDGMLTIGSYNATYENYIHPTRSQQYWETTAFDRPTPPHIKKRPGRPKKCRKKYQNEGQVSNIRLKLSYKKVTCTRCGLNGHNNRGCINGGVPPRPKKWKPTFEECNNSNATTTTPETIFISPLMSIAFRSPPLRPQAPIRIIMRDGVSHNKNQPDYMSFIPTPGMPNRQDSKN

SEQ ID NO: 133113 - protein, 103 aa, Glycine max
  Coding DNA Sequence Number=SeqID_16335
  Gene Ontology: Mol. function=nucleic acid binding; Biological process= DNA integration
MNCIPIPRSSPQFHRIYICLDACKKGFKVGYRPFIGLDGCFLKGYYGGHLLAAVGQDANNGLLPAMQEVMPGVKHRYCVMHLWRNFSKQWKDKELRGLVWKYA

SEQ ID NO: 133114 - protein, 108 aa, Glycine max
  Coding DNA Sequence Number=SeqID_16336
MCTIGQPGASEPVDTQRLTSSSAPFSSEDGESDDIQRYPSGYSYKTIYSNPGPRSQVAGGDTQVVIRTKRFLLILTREVRWQAEIPKWLSHKHFFAIRQTQSPVACRD

SEQ ID NO: 133115 - protein, 149 aa, Glycine max
  Coding DNA Sequence Number=SeqID_16337
  Homolog annotation: Hit_ID=Q5NAR8; Match level="QueryCoverage=100%, HitCoverage=59%, E-value=6e-53, Identity=59%"; Hit description =Purine rich element binding protein B-like
  Pfam annotation: Domain name=PurA; Domain location=1-138; Score= -97.8; E_value=0.0064; Accession=PF04845.4; Description=PurA ssDNA and RNA-binding protein
VSEASVSRNRSTIIVPAGSSRDEGWAAFRNVLAEINEASRLFILPNQQNSESSERLVGLSDDVGAGFISGHSTQPATSSELNVDRADQKRFFFDLGSNNRGHFLRISEVAGSDRSSIILPLSGLKQFHEIVGHFVEITKDRIEGMAVAN

SEQ ID NO: 133116 - protein, 71 aa, Glycine max
  Coding DNA Sequence Number=SeqID_16338
MATMHAQTHSISKLHKFMGARPGELTPPFFHEESTRSLWIGVCLLETPRDTRLPPSSASRLSGAGRGTTIC

SEQ ID NO: 133117 - protein, 134 aa, Glycine max
  Coding DNA Sequence Number=SeqID_16339
  Gene Ontology: Cellular component=integral to membrane
  Homolog annotation: Hit_ID=Q6D6D0; Match level="QueryCoverage=97%, HitCoverage=88%, E-value=1e-53, Identity=75%"; Hit description =Putative membrane protein
  Pfam annotation: Domain name=DUF307; Domain location=6-62; Score =74.4; E_value=3.7e-19; Accession=PF03733.4; Description=Domain of unknown function (DUF307)
  Pfam annotation: Domain name=DUF307; Domain location=79-134; Score =105.2; E_value=1.9e-28; Accession=PF03733.4; Description=Domain of unknown function (DUF307)
  Pfam module annotation: Pfam domain module=DUF307::DUF307; Domain location=6-62::79-134
MTSMRTVLNILNFVLGGFFTTLGWLIATVFSVLLVITLPLTRSCWEITKLSLVPFGNEAIHVDELYPEKSNALLSAGGSLLNVIWLVLFGWWLCLSHIAAGIVQCVSIIGIPVGIANFKIAAIALWPVGRRVVS

SEQ ID NO: 133118 - protein, 160 aa, Glycine max
  Coding DNA Sequence Number=SeqID_16340
  Homolog annotation: Hit_ID=Q6T4Q2; Match level="QueryCoverage=54%, HitCoverage=94%, E-value=2e-44, Identity=97%"; Hit description =Putative senescence-associated protein
VCKGFYPPLDGNCASRRLVGLIRPHEGSPTARAFGGPRPPTAAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDN

SEQ ID NO: 133119 - protein, 123 aa, Glycine max
  Coding DNA Sequence Number=SeqID_16341
  Subcellular localization annotation: CTP_CleavageSite=49; ConfidenceScore=5.29e-01
NSFLAVRLSINRLVVWSQQLSLSLFKVLLKSCLGHVARCRNMPFCGRAKARLTGALSKGGKMRGVATNVDKSGAFAPAYPPSKRKSDLRSSFLRVNQAILFTWKVIILRRWTLKVIHLLGKKN

SEQ ID NO: 133120 - protein, 236 aa, Glycine max
  Coding DNA Sequence Number=SeqID_16342
  Homolog annotation: Hit_ID=Q8ZAR7; Match level="QueryCoverage=34%, HitCoverage=14%, E-value=1e-36, Identity=81%"; Hit description =Isocitrate dehydrogenase kinase/phosphatase
  Pfam annotation: Domain name=Transposase_23; Domain location=131-201; Score=18.4; E_value=1.1e-05; Accession=PF03017.5; Description =TNP1ENSPM transposase
  Subcellular localization annotation: CTP_CleavageSite=30; ConfidenceScore=5.57e-01
RRAIRRTSWPASRGTASRPTTCSRRSSATSCAAIGAFGRCLKNCTAICLPRSIGAGYSSASARGTWKTCSLTARSSGSASAAGRRGLARGVHHRKSDPAAHGILQPDAIPDSVPNAISGTCTASRASGWSLRYSNRCGLYIEVDPARLVALGRVCEGSTIVHNTPLLPGQVKVSVEEVTHVDAPVPVPTDEVSIVGQALHTFLAWPTHLVKSLSQQLSLRQNHLQSPIHRSMIRFI

SEQ ID NO: 133121 - protein, 123 aa, Glycine max
  Coding DNA Sequence Number=SeqID_16343
  Gene Ontology: Mol. function=nucleic acid binding; Biological process= DNA integration
MKKAYITWDDNDMESSEDSENEEINLCLMGKSYENDEEVSLKKKWYIDSGCSKHMMGDASKFTYISPKKSEHVTYGDNNKGRILGVGKIGMNSSNSIENVLLVEGLKHNLLSVSQLCDKGYLV

SEQ ID NO: 133122 - protein, 58 aa, Glycine max
  Coding DNA Sequence Number=SeqID_16344
  Subcellular localization annotation: CTP_CleavageSite=28; ConfidenceScore=5.28e-01
MLVATPRVFLSWNTHPASLASPSRRRVRIAKGGAVDKSEAFASTYHRFVMRNSDLRGS

SEQ ID NO: 133123 - protein, 65 aa, Glycine max
  Coding DNA Sequence Number=SeqID_16345
MTCPRARRGSLQDISLYYSVGSMNIFHLLVPLFLPRILMMGDRVHVDGPMGRHCPFPHIAGVWID

SEQ ID NO: 133124 - protein, 69 aa, Glycine max
  Coding DNA Sequence Number=SeqID_16346
MGTNQNGKRFYQVKVKSLDVTSLKELGRLMGPLQRQAFRKVYGKILDLAAAEVFMEAVVSLAQYYDQPL

SEQ ID NO: 133125 - protein, 201 aa, Glycine max
  Coding DNA Sequence Number=SeqID_16347
NKHAFLPYGLPPNYTPPNVAHAPDENVDNSAPIPVESQQPQADHVHVSQPIGETHEVPHHNLADFEPCLGYATKGQAVGGVSLPNTLGGPQYHPQPQPLHFTMGRLPPAMVDREKLDHIEERLRAIEGGGDYAFADMEELCLVPDVVVPPKFKVSDFDKYKGTTCPKNHLKMYSKKMGTYSKNEKLLMHFFQESLIGTAVT

SEQ ID NO: 133126 - protein, 113 aa, Glycine max
  Coding DNA Sequence Number=SeqID_16348
  Subcellular localization annotation: CTP_CleavageSite=50; ConfidenceScore=5.01e-01
IAPARHPADPEKSNRVLGFPVLITGLFQFYGVPISPARSSGPLLTELSSRSTAPPGRHRARHHDSLGMACNGQQTHRRHLQSPSTHLQKLERCLRPVVNQQATKSKAKGKQKY

SEQ ID NO: 133127 - protein, 102 aa, Glycine max
  Coding DNA Sequence Number=SeqID_16349
MNVILKFHDDPTVNESQIVVFLRQHLSGPHESSLQGLKKNWPRGELAVASHPLEPHQGTTIHIKRSNGQAFMVWGRMGYMFLKALFKTRKSKIFKMDDQDSL

SEQ ID NO: 133128 - protein, 139 aa, Glycine max
  Coding DNA Sequence Number=SeqID_16350
MEKSEKKNFSEKKMKKAYITWEDNDMESSEDSENEEINLCLMAKSYESDEEVISSNNLSISFDELQDAFADLHKESIKLAKIFRTNHIHGQDSKGKGKGSNEDPQEEAKSNDELPKEWKASKDHPLDNIIGDISKRGNN

SEQ ID NO: 133129 - protein, 122 aa, Glycine max
  Coding DNA Sequence Number=SeqID_16351
MPTPFPYKNDKALPWKYAAQGSNKRKDVSFVRVKEDLPFTKVTNISGMSGMTHSGRIFAASELPVWSKDKGKVKADIGERDKVGLTSNDEVPIGNITEERDDFDKKVISVEEATKFLRIIQQ

SEQ ID NO: 133130 - protein, 224 aa, Glycine max
  Coding DNA Sequence Number=SeqID_16352
  Gene Ontology: Mol. function=transporter activity; Cellular component= integral to membrane; Biological process=transport
  Homolog annotation: Hit_ID=Q1LQZ9; Match level="QueryCoverage=99%, HitCoverage=51%, E-value=3e-40, Identity=37%"; Hit description=Major facilitator superfamily MFS_1
RGRALRIEGDLGDDCRAQHECQLRQIAAQRQQQHAQRGVFGQVQRQQDAGPAQQHECTAEPAAGVDRSDAALEHALRQPRPDQHQRNVDAGENHEHPAGFLRGVTQRLAHVGRDPGEHHREDPIRGPVQQHVGQEGAIRQQHPVRHARLRCVGAGAGVADLPVAAEQQPQHHPDNAQDAQQQERRVPAVIEHDVGEHRPGDQQADRHALENHRRRHVALVVREP

SEQ ID NO: 133131 - protein, 71 aa, Glycine max
  Coding DNA Sequence Number=SeqID_16353
MDGAFSQDMVAETGLPMILLSESDLTSPLCGVSCYILLSEPWWFFTDMMNKWITMKNLMLKDTGTPRSDRM

SEQ ID NO: 133132 - protein, 123 aa, Glycine max
  Coding DNA Sequence Number=SeqID_16354
MAPDRMQLQSMCMKEHESFKEYAQRWRDLAAQVVPPMMEKEMITMIVDTLSMFYYEKMVGYMPSSFADLAFADKRIEVGLKRGKFDYPALMNEKTGANREDAKEEGTHVVIVVPTWSNFPPAQ

SEQ ID NO: 133133 - protein, 86 aa, Glycine max
  Coding DNA Sequence Number=SeqID_16355
MVTKRERLKAIEEGGDHAFANMAELYLVSDVIIPLMFKVPNFDKYKGTICPMNHMKIYCRKMGAYLKDEKLLMHFFQESLTGASFT

SEQ ID NO: 133134 - protein, 59 aa, Glycine max
  Coding DNA Sequence Number=SeqID_16356
MDYTTIPFLTSGMLRNFMDYLTMGVKYLEVVKRRLHATKQWSPDEIRSLSSSLKLLQES

SEQ ID NO: 133135 - protein, 113 aa, Glycine max
  Coding DNA Sequence Number=SeqID_16357
  Gene Ontology: Mol. function=transition metal ion binding; Cellular component=cytoplasm; Biological process=cytoskeleton organization and biogenesis
MGDHLEDMIRDLGQESFQQAHVLMYDTFQADSNKLMYPRCNNSLTMLLAVLSLVNLKARYGWSDKSFSSLLQVVHDMLLEENMLPKVYYQTKKILCSMDMEYQKIHACPNDCI

SEQ ID NO: 133136 - protein, 122 aa, Glycine max
  Coding DNA Sequence Number=SeqID_16358
MEESHRENNKDHISQSRGSALDGEEHIGEWKNPIGKITKITFPSHEGPLLTVKNTLEIGGFNRENKKDHNSQSLGSALDGDEHVGEWKNPIGKITKITFPSQEGPLLTVKNTFENGGIPSGK

SEQ ID NO: 133137 - protein, 198 aa, Glycine max
  Coding DNA Sequence Number=SeqID_16359
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-29, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALAFRGLHALAFRRLHVLAFRGLHALAFRGLHVLAFRGLNAITFRGLHVLAFSRLHALAFTGLHALAFIGLHVLAFKGLHVLPFRGLHVLAFRGLHALVFTGMHVLAFRRLHVLAFRGLHVLAFRGLHVLAFRRLHVLAFRGLHVLAFRGLHVLSFGGLHILAFRGLHALAFSGLHVLTFTGLHIRAFRELKVLCL

SEQ ID NO: 133138 - protein, 66 aa, Glycine max
  Coding DNA Sequence Number=SeqID_16360
MDLVLCLPLALDLVAYWWWRCVYCPLPAIPMLLWCLALSPSGGAVLLDESPVNAGPNDLVGAMGTP

SEQ ID NO: 133139 - protein, 128 aa, Glycine max
  Coding DNA Sequence Number=SeqID_16361
MAAQLIHDRVVMECLEGVWETLEGIESTSGGTRTHTSTACGVDTTYTTPYRLVEPVQVIEVSFSEEDLEEDPEELPPEPAVDALDFPEDDEDPLPDVDSPEDIMSASEADSTEESGPGGTANSEDSSS

SEQ ID NO: 133140 - protein, 123 aa, Glycine max
  Coding DNA Sequence Number=SeqID_16362
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=84%, HitCoverage=50%, E-value=6e-31, Identity=69%"; Hit description =Germin-like protein
MLANASFPYAKSFSFKMKMIRILFIFALLSFTSHASNVNDFCVADLKGPDSPTGYHCKPPKTVTSHDFVFHLGPGNTSNVFKSAITSAFVKDFPAVNGLSLSVARIDIAQGWSGSNAHTSWCQ

SEQ ID NO: 133141 - protein, 302 aa, Glycine max
  Coding DNA Sequence Number=SeqID_16363
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=4e-34, Identity=32%"; Hit description= UPI00006A17C9 related cluster
HQRATRPHHQSAERPHLLRTTRPHLQRATRPHLQRVACPHHQRATRPHHQRSARPHLLRTTHPHLQRATRPHLKRAARPHHQSAARPHLQRATRPHLQRATRPHLQRAARPRVQRTTRPHLQRATRPHLQRAARPHLQRTTCPLEGCMPSPSEGYTSSPLEGFMPSPSEDYTSSPSEGFMPSHSKGCTSAPGLLALAFRLLHVLTFRGLHALTFRGLHALTFRGLHAVTFRGLHDLTFSGLHALTFRGLHVLAFRGLHALAFRGLHAPALKGRHVLNFGGLHAPSPLEGYASSLSVGSTSAP

SEQ ID NO: 133142 - protein, 121 aa, Glycine max
  Coding DNA Sequence Number=SeqID_16364
MRKTHEIPHHNLADFEPWLGYATEGQAVGGIPIENTSEGPQYHPQLHLLHSTTSKNPRAMAEMEKLDHLEERLRAIEGGEDYSFANLEELFPIPNIITPPKFNVLDFDKYKGTTCPKNHLK

SEQ ID NO: 133143 - protein, 426 aa, Glycine max
  Coding DNA Sequence Number=SeqID_16365
RKDFTWLGIPFNEGGRERSFSAEEGIDYRTRTRRLAREEAFAQWERERDGAAREAAEVGYFVSERSCGLSKGDDGLKEIETRSLESTESAPFFCMNDGKHDHWLMDKGVNYDTKHTALEKSFGVRFPGLGLRFWSRVISGLRKHKLNRKANGSNIFASGGAIKKIILERSASAAHAYFCDQPQWKFEEPSSPSESYGFMSHDMHLVKSEVDRNTISVIVSDENRSDDNQSGTQFKDLGFQSPLVNENVSSQSDYLKFVCDSTLRTRESEIENLQSSDDVAKPANPNSSTVKNEEFVPYVAENQIDDNDSSSGGQQGLPSEDLGIVKPEPQLATYFQNPFEHLLVKFGLTSFLKNIEELISHFLSGSIEMLKSDVGLKVEDIVSEHVDGVDFVQSEGVTKTLPVTLDSVHFRGATLMLLAYGDKEVR

SEQ ID NO: 133144 - protein, 103 aa, Glycine max
  Coding DNA Sequence Number=SeqID_16366
MECETSVMVSEENSKEEDDLLLQSIRKVKRKANEKEIPLEREVEYKKIGGEENYPYKEKFLSSEGAIPFSAFDGGCYALEGFSHSDSVREEDGFLSSRGKVEM

SEQ ID NO: 133145 - protein, 78 aa, Glycine max
  Coding DNA Sequence Number=SeqID_16367
MKSVSTLVYCDGDMISSYEGIVFECPSDPKVITRSEDMSLDALRKTIFDANGDDGCVEYDCKELKCNNDVSKTFSLRI

SEQ ID NO: 133146 - protein, 219 aa, Glycine max
  Coding DNA Sequence Number=SeqID_16368
MEAMMSMKKIMEANVVIVAATSAVAKVNPMLPSGLKQMNHPTSNMVGKDLGSTDDPMMCKFKTSTPSRHMACLPNYTPPNVAYIPNGDVNNSTPILIKSQQPQSDHAHVSRPMEETHEIPHHNLADFEPCLGYATEEQAVGGIPMKNTLEGPQCHPQPQPSHSTAVKNPHAMAEMGKRKGSGPLKEVLDFDKYKGTTCPKNHPKMYCRKIRAYAKMRNC

SEQ ID NO: 133147 - protein, 246 aa, Glycine max
  Coding DNA Sequence Number=SeqID_16369
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q9I3G8; Match level="QueryCoverage=47%, HitCoverage=14%, E-value=2e-62, Identity=99%"; Hit description =Probable cation-transporting P-type ATPase
RLGHARQLAQVLLDQPAAGGATDAFDHQAGFRQLALMADEAALYVRAVVELQLFAERLGQGFGIGGVFAAVPVVAFQAAGDDGLGHRLAARTAHGPRLAEYAGLEAAAGGDRQAAVLHDHGRRYHLFLEKTPLAAAFLAEQFDEATALDGVGQLPDVALAVGVAAQQLHAAVLLRLGRRDQVEGEPIRTAVAGQAHFDFAGQVVDLDLGVHLQAYGQVLAFQGAVDALAGLVVVVGDQGVLVAHRD

SEQ ID NO: 133148 - protein, 201 aa, Glycine max
  Coding DNA Sequence Number=SeqID_16370
MKIGFMFGDEILKDNQEKAAIALGEGAMQFFQMQKEIRVKRGSLSIPPDWMKVESDNKQEISVASDIEILNQSTIIGLVQVLEEANQFVNLELRRSHEEPWYLTFVDGSHVPSLRTKLWSFMRISSDEMNSPWGLIGDFNVILNEVERSRGVESNNHRGMRAFKEVMDYYHLLYAGFEGLKFTWAKRELSMRLDRMVMNLS

SEQ ID NO: 133149 - protein, 103 aa, Glycine max
  Coding DNA Sequence Number=SeqID_16371
MDDVGMVFKNLFTQEEGLETFCLKGRFPRMVEDEMEMLRKDITEEENRIVVFHMGSYEAPGEDGYQPTFYQSQWEVVEISLCETIRNLFRSPAEVKRDCGKGG

SEQ ID NO: 133150 - protein, 163 aa, Glycine max
  Coding DNA Sequence Number=SeqID_16372
  Gene Ontology: Mol. function=ribonuclease H activity
  Homolog annotation: Hit_ID=Q1RYI2; Match level="QueryCoverage=73%, HitCoverage=18%, E-value=7e-11, Identity=32%"; Hit description =Ribonuclease H
MAWELCTNNDALWVQAIRANIIMGSWGFLLRNIFIFENLLWSDHEVRSRLLNLEHHLRLGDNLYKASNYNHHHMEASMLHWRPPNHGFVRLNVNGALTVHGPKAACGGVIRYQMGNFQGAFTCRLKTCLVAQSELWAILHGINMARERGMGWDGQGMVLTSWV

SEQ ID NO: 133151 - protein, 105 aa, Glycine max
  Coding DNA Sequence Number=SeqID_16373
MDFRRLETGVGNGSCKQGYGVKRGKNIGKWGQKRARCGKKGMSFTIRTNDKGGGGICGSNAFQDYFDDAKDSSQESRVKQVSRIKESFNQSKFQESKIRSIKIQD

SEQ ID NO: 133152 - protein, 119 aa, Glycine max
  Coding DNA Sequence Number=SeqID_16374
MARTKKTRQMTSGAVKEIAENIEQASQGSFDPYGRQDVLTAAVGRCHHQAILWLRSTKLLHFLLHPSRRTRAAHSTNQGPAGGVDHRKSDWAAHGILQPNAAPASVTNVITGTCTVSGA

SEQ ID NO: 133153 - protein, 70 aa, Glycine max
  Coding DNA Sequence Number=SeqID_16375
MSTWQLRQNVRRNKGLCVKPVALFVVLKEMLTSDTLWFSKKDERLDVNNDRSNGKVMTSTKEIVVLVEEE

SEQ ID NO: 133154 - protein, 66 aa, Glycine max
  Coding DNA Sequence Number=SeqID_16376
MARKEINKSQEKVATGYPEELGKQLDQHGRAQSDENSKTGQIQAKGPSGEGRRPKWRRTKPLSGER

SEQ ID NO: 133155 - protein, 72 aa, Glycine max
  Coding DNA Sequence Number=SeqID_16377
MSDNFEADTGVLCLVGIGVKPTTHRERAYYAVSSLLNAIQLFCRIPDHSCNLAQEGKKPGEKIRFSSPKRAS

SEQ ID NO: 133156 - protein, 270 aa, Glycine max
  Coding DNA Sequence Number=SeqID_16378
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-31, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
NLSPLEDYTSSPSEGCTPSPSEGCTPSPSKGCMPSSSEDYHSSPLKGYTPSSSKGYTLSPSEDNTLSPSKGYLGLHALTFVGLHALTFRGLHVLTFRGLHVLAFRGQHVLTLTFRELHVLTFKGLHVLAFAFVGLHALTFRGLHVLTFRGKYVLTFAFVGLHTLTFRGLHVLAFRGLHVLTFAFVGLHALTFRGLHVLTLRGQYVLAFAFVGLHALTFRGLHVLVFRGLHVLTFAFVGLHALTLRGQHVLAFRGLHVLTFSGLHALAFKG

SEQ ID NO: 133157 - protein, 166 aa, Glycine max
  Coding DNA Sequence Number=SeqID_16379
  Gene Ontology: Mol. function=signal transducer activity; Cellular component=integral to membrane; Biological process=signal transduction
  Homolog annotation: Hit_ID=UPI0000E6970E; Match level="QueryCoverage =91%, HitCoverage=32%, E-value=7e-30, Identity=44%"; Hit description =GGDEF family protein
  Pfam annotation: Domain name=GGDEF; Domain location=5-159; Score =108.2; E_value=2.5e-29; Accession=PF00990.12; Description=GGDEF domain
REMAYVRQATHDALTGCKNRRAFDSDVAELLNAQQPFAMALVDIDNFKSINDTLGHLTGDIVLRNVAREGIQIMQPHHVPVYRYGGEEFAVLFQAGQIADAFSLLEAWRTAVEKRVWREENLRVTFSGGLGEWHFEPLEQFVESVDNALYSAKRQGKNRILRTSVG

SEQ ID NO: 133158 - protein, 221 aa, Glycine max
  Coding DNA Sequence Number=SeqID_16380
  Gene Ontology: Mol. function=helicase activity; Biological process =viral genome replication
  Homolog annotation: Hit_ID=Q1SRJ5; Match level="QueryCoverage=92%, HitCoverage=27%, E-value=1e-53, Identity=45%"; Hit description =Probable helicase [imported]-Arabidopsis thaliana-related
NNQTENGGTHNDEIKEYLDCRKPVVERLHFHLPGQHSVLYEDHDDIDDVLSKPSISDSKFISWMNTNQNSIEGRNLTYAEFVSKFVYNQKKRCWHLRKKGYTIGRLLWVPPITGELFYLRMMLTVCKGPTSFEDLRTVDNVQYSTYKEACFAMRFLQDDKEFIEAIKEAKDWGSAHYIRKLFVLLLLAATMSKPEQVWDQTWHWMADDIVYNYKKSSTSTS

SEQ ID NO: 133159 - protein, 118 aa, Glycine max
  Coding DNA Sequence Number=SeqID_16381
EKEVHPNLDFRSPTRSHALHDPENALLSRFGAEMSTKGGSFVGVSMENGGEGKSNDVTEEAHEFLRLIQQSEFKVVEQLNKTPARISLLELLINSEPHRALLIKVLNDAHVAHDISME

SEQ ID NO: 133160 - protein, 66 aa, Glycine max
  Coding DNA Sequence Number=SeqID_16382
MCSDCLMQFSILHFYSEPHELIVVHASSTHESGATRSDCLALFMCPPPSSAEPPKTEEIETRVVID

SEQ ID NO: 133161 - protein, 160 aa, Glycine max
  Coding DNA Sequence Number=SeqID_16383
MRKTFKSIQSIENLSSVRKKPRKEEESLRQELGKQEGEARKGGARGSPSLGRLCPGSGNLSSGRLVVACALLQVVIPPVPLVFSTFLVLNQPFLAELYKALREKSKGDLLFLLRSPQKAAMVRAGKHGNCTGGRGRRSAFYLGSALTYAPPHIEEGEPLP

SEQ ID NO: 133162 - protein, 102 aa, Glycine max
  Coding DNA Sequence Number=SeqID_16384
VRIGFRSLPKPRAKLEDSASVEGFLLVWGCNGEHGSLWWLMVALGDGESAWDVKNGFGRKKEEEMVFFLSYPKAKAENAQVRNGLGHGNFAYTPDIFSKIPM

SEQ ID NO: 133163 - protein, 59 aa, Glycine max
  Coding DNA Sequence Number=SeqID_16385
MVVLSGWVEVRQGGDGWLAAGVYEAKIEVEEVKAQSVIIHFFLVLVSVVHPAKQSRAKS

SEQ ID NO: 133164 - protein, 409 aa, Glycine max
  Coding DNA Sequence Number=SeqID_16386
  Gene Ontology: Cellular component=nucleus; Biological process =abscisic acid mediated signaling
  Homolog annotation: Hit_ID=Q10Q07; Match level="QueryCoverage=18%, HitCoverage=18%, E-value=6e-28, Identity=78%"; Hit description =Expressed protein
  Pfam annotation: Domain name=DUF1675; Domain location=67-404; Score =242.8; E_value=7.3e-70; Accession=PF07897.2; Description=Protein of unknown function (DUF1675)
MAEVEDIDNPHHDHHHYLSSSTTQPPMINFPRDLLRTFVGVNNNNNNNSQHHNLPMPVVKLEDEKEELELSLGLSMNGRFGVDPTAKKIKRTTSIPEFVRDEEMGYAAAMGCTGSLVRTCSLPTETEEEWRKRKELQTLRRVEARRKRSEKQRNMKALREQQQRSEGSNPVEQGAGGYGEVAPPLARTVSLTARVCGLGLNGDSEKEKKEKRSGIALPPPSPSQGSIGSSGISEAESQQGQALFSYKDILWTQLHCFTYLDSSLLATEVMDGCSRTTPMDVRSPTSANLLPDSELKSPAGVAENNTGKNAAAAAAVTMRSQSNKYSPPQSRTKDIVRNLLEDMPCVSTKGDGPNGKRIEGFLYRYGKGEEVRIVCVCHGSFLTPSEFVKHAGGGDVANPLKHIVVSPSF

SEQ ID NO: 133165 - protein, 129 aa, Glycine max
  Coding DNA Sequence Number=SeqID_16387
  Subcellular localization annotation: CTP_CleavageSite=44; ConfidenceScore=5.18e-01
MVNGMECSMIFQPDLCSLFKTVSLLSQASPVPIGGRQAVVEIKRTTTRVGSGINSTGRPRIPPGRGGLRNDSFRGRGNYGGGRGYGRNDYVSRGEFSGRGHGHGHGEGYHQGRGRGGRSSGQKQNAVSN

SEQ ID NO: 133166 - protein, 295 aa, Glycine max
  Coding DNA Sequence Number=SeqID_16388
  Gene Ontology: Mol. function=nucleic acid binding; Cellular component= intracellular; Biological process=transport
  Homolog annotation: Hit_ID=Q9FME2; Match level="QueryCoverage=93%, HitCoverage=53%, E-value=2e-49, Identity=43%"; Hit description =Similarity to RNA-binding protein
  Pfam annotation: Domain name=NTF2; Domain location=17-133; Score =153.2; E_value=6.8e-43; Accession=PF02136.11; Description=Nuclear transport factor 2 (NTF2) domain
MALQTATPPTTPSAQVVGNAFVEQYYHILHHSPDLVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDAAAVTVTPEPGKIIIQKICIFSFKIYSGVGFMLFSFFTEPSHFADSSAPDPTNSHVNKGQTVAENAYEPSNHHERQIPVENVDNVEPHFQSNGNDDSQATELASSAQEKKSYASIVKVQKEGSVATKVYVPTNTLKSGPNKTENK

SEQ ID NO: 133167 - protein, 258 aa, Glycine max
  Coding DNA Sequence Number=SeqID_16389
  Gene Ontology: Mol. function=O-methyltransferase activity; Biological process=lignin biosynthetic process
  Homolog annotation: Hit_ID=Q84KK5; Match level="QueryCoverage=99%, HitCoverage=71%, E-value=4e-99, Identity=70%"; Hit description=S -adenosyl-L-methionine: daidzein 7-0-methyltransferase
  Pfam annotation: Domain name=Dimerisation; Domain location=30-78; Score=66.3; E_value=9.9e-17; Accession=PF08100.2; Description =Dimerisation domain
  Pfam annotation: Domain name=Methyltransf_2; Domain location=94-258; Score=79.0; E_value=1.4e-20; Accession=PF00891.8; Description=O -methyltransferase
  Pfam module annotation: Pfam domain module=Dimerisation::Methyltransf_ 2; Domain location=30-78::94-258
MASNNGRKASEIFQGQLLLYRHMYAHVDSMFLKCIVELGIPNIIHNHGQPITLPKLVSILQVPPNKVSGLQSLMRYLAHNGFFEIVTIHDNLEEKEAYALTAASELLVKGSDLCLAPIVECFLDPTFSSSWHQMKKWICEDDLTLFGISLGSHLWDFLNKSPTHNKSFNEAMASDSQMMNLALRDCNWVFEGLETIVDVGGGTGITAKIICEAFPKLKCIVLERPHVVDQNLSGCNNLKYVVGDMFKSIPKADAVLLK

SEQ ID NO: 133168 - protein, 123 aa, Glycine max
  Coding DNA Sequence Number=SeqID_16390
  Gene Ontology: Mol. function=3'-5'-exoribonuclease activity; Biological process=RNA processing
  Homolog annotation: Hit_ID=Q2PYZ2; Match level="QueryCoverage=74%, HitCoverage=29%, E-value=1e-30, Identity=74%"; Hit description=3'-5'- exoribonuclease/RNA binding protein-like protein
MNDDGKIVLVSDEDGQKRAQEPVNKEKRKLTLRSIPFSLTCILHKNYILADPTAEEESIMETHVTVVLDTSGQLISLYKPGGPVLAYTSAIQGQRYYKTFGVLRPSYAPTDIQSGTTLRPASV

SEQ ID NO: 133169 - protein, 354 aa, Glycine max
  Coding DNA Sequence Number=SeqID_16391
  Gene Ontology: Mol. function=O-methyltransferase activity; Cellular component=integral to membrane; Biological process=lignin biosynthetic process
  Homolog annotation: Hit_ID=Q84KK5; Match level="QueryCoverage=99%, HitCoverage=100%, E-value=1e-147, Identity=70%"; Hit description=S -adenosyl-L-methionine: daidzein 7-0-methyltransferase
  Pfam annotation: Domain name=Dimerisation; Domain location=31-79; Score=72.3; E_value=1.5e-18; Accession=PF08100.2; Description =Dimerisation domain
  Pfam annotation: Domain name=Methyltransf_2; Domain location=91-331; Score=355.0; E_value=1.3e-103; Accession=PF00891.8; Description=O -methyltransferase
  Pfam module annotation: Pfam domain module=Dimerisation::Methyltransf_ 2; Domain location=31-79::91-331
MASSINGRNASEIFQGQTLLYKHLFAHVDSKCLKCIVELGIPDIIHNHGQPITLPELASILQIPPAKVSQVQSLMRYLAHNGFFERVTIHEKEAYALTAASELLVKSSELSLAPMVEYILDTTISGSFHQLKKWVHEEDLTLFEISLGSHLWDFLNRNPAYNKSFNEAMASDSQMLNLALRDCKLVFEGLESIVDVGGGTGATAKIICEAFPDLKCIVFDRPQVVENLSGSNNLTYVGGDMFKSIPKACAVLFKMILHNWSDEDCRKILENCKEAISSKSKTGKVIVIDVVINEKKDEHEITRLKLLMDLNMACLLNGKERREEDWKKLFVEAGFQSYKISPLTGYLSLIEIYP

SEQ ID NO: 133170 - protein, 195 aa, Glycine max
  Coding DNA Sequence Number=SeqID_16392
  Gene Ontology: Mol. function=3'-5'-exoribonuclease activity; Cellular component=exosome (RNase complex); Biological process=RNA processing
  Homolog annotation: Hit_ID=Q2PYZ2; Match level="QueryCoverage=89%, HitCoverage=49%, E-value=2e-53, Identity=63%"; Hit description=3'-5'- exoribonuclease/RNA binding protein-like protein
  Pfam annotation: Domain name=RNase_PH; Domain location=45-195; Score =22.8; E_value=6.1e-05; Accession=PF01138.11; Description=3' exoribonuclease family, domain 1
MGLPNVSEDLSSEVEVDAFKRIFPLRYFERHLAESIRADGRPLGKARETSIFLGAVAFANGSALVKIGSTTMLTAIKMEIMTPSLESPDEGCLDWLLLVGPLMSIDFHMPPICSPIVRPGRPAEASPMVSKQLSNTISRHVLIFAVTLSRMTDLKELSLVSGKAAWMAYLDIYCLDADGALFDAALLSAIAALSH

SEQ ID NO: 133171 - protein, 65 aa, Glycine max
  Coding DNA Sequence Number=SeqID_16393
MVLMCTDRGNTSKERVAWVRHRVTAEVEDEGFVRLDNADATAPNNGDSRVTEEVEERVFESAKEK

SEQ ID NO: 133172 - protein, 79 aa, Glycine max
  Coding DNA Sequence Number=SeqID_16394
NNQHENTEKGTLYCITFPNFLNSDQRVPTDPKRIKVIPEWPTPPSVEGRSPEYEEPRDLRSNPFQGGGDDAILHPKGIG

SEQ ID NO: 133173 - protein, 106 aa, Glycine max
  Coding DNA Sequence Number=SeqID_16395
MPLLSLIFVFSLLLSKTLSFSRNPQNLSQKNDDLGLIHRWIVVKFEYHVWNPILRILTVGNCKTMEKKESHEDSTSGGFNPFSVSLTFGNSIRAVGGKTGGIPGNR

SEQ ID NO: 133174 - protein, 80 aa, Glycine max
  Coding DNA Sequence Number=SeqID_16396
MTGGILLQNTLKGPQFRPQSQPLHFAVGGGPPAMAKKGKLDHIEERLKDVAGGEDYAFANLEELFLVPERGHSQVQGAGL

SEQ ID NO: 133175 - protein, 51 aa, Glycine max
  Coding DNA Sequence Number=SeqID_16397
MVSKVWSFNGGFNGEEEEEKSNVGSLAFLCTHRGPFSKVGNMYIQMLRIKP

SEQ ID NO: 133176 - protein, 124 aa, Glycine max
  Coding DNA Sequence Number=SeqID_16398
MVNDIFTPSRYKEIIMVQPKPSAGLKGKPHQHALTFMPSCIQKSKAWVPRPKSCFGIYPNFRKLSPHPKSGNHTCTNPIYKQHSQTYAQTPLRHFTEHLVGALLGTNSKGIGAMWLAPSFQNTT

SEQ ID NO: 133177 - protein, 315 aa, Glycine max
  Coding DNA Sequence Number=SeqID_16399
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=97%, HitCoverage=25%, E-value=1e-154, Identity=81%"; Hit description=DNA -directed RNA polymerase beta'' chain
  Pfam annotation: Domain name=RNA_pol_Rpb1_4; Domain location=59-129; Score=13.4; E_value=0.0005; Accession=PF05000.7; Description=RNA polymerase Rpb1, domain 4
  Pfam annotation: Domain name=RNA_pol_Rpb1_5; Domain location=131-315; Score=-86.8; E_value=1.8e-05; Accession=PF04998.8; Description=RNA polymerase Rpb1, domain 5
  Pfam module annotation: Pfam domain module=RNA_pol_Rpb1_4::RNA_pol _Rpb1_5; Domain location=59-129::131-315
MEVLMAERANLVFHNKVIGGTAIKRLISRLIDHFGMAYTSHILDQVKTLGFRQATDTSISLGIDDLLTIPSKGWLVQDAEQQSFILDQTSSLWESRGNASQVHQLVGMRGLMSDPQGQMIDLPIQSNLREGLSLTEYIISCYGARKGVVDTAVRTSDAGYLTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQVRGIL

SEQ ID NO: 133178 - protein, 125 aa, Glycine max
  Coding DNA Sequence Number=SeqID_16400
  Gene Ontology: Mol. function=protein transporter activity; Cellular component=outer membrane-bounded periplasmic space; Biological process=protein transport
  Homolog annotation: Hit_ID=Q1QWF4; Match level="QueryCoverage=80%, HitCoverage=26%, E-value=4e-09, Identity=28%"; Hit description=TonB -like protein precursor
MSILTLGSKKGGRKFPVKEWEKAKRKGKKFPVKEWEKAKRKERKFPVKEWVKAKRKERKFPTKEWEKVKKEGKKFPVKEWEKAKRKERKFPVKEWVKAKRKERKFPTKEWEKVKKEGKKVPDQRN

SEQ ID NO: 133179 - protein, 103 aa, Glycine max
  Coding DNA Sequence Number=SeqID_16401
MACTHIPVLQNCPMCGISCQCQDLHAILLKFQPARINLTLHLTLQSPTMLNGTPRGISVTSTRCVSSRILGEMEVDEPWLGLWLPLNYQVDMGASQHRTLELG

SEQ ID NO: 133180 - protein, 190 aa, Glycine max
  Coding DNA Sequence Number=SeqID_16402
  Homolog annotation: Hit_ID=Q8TGM5; Match level="QueryCoverage=21%, HitCoverage=61%, E-value=8e-08, Identity=70%"; Hit description =Uncharacterized protein ART3
MLLRGVYADLPRAPASWLVEIWVHGRLRRDKMVDEPRSRPITCEPVSSGPIDDPLRARTLPTRPQRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 133181 - protein, 167 aa, Glycine max
  Coding DNA Sequence Number=SeqID_16403
  Homolog annotation: Hit_ID=Q8TGM5; Match level="QueryCoverage=21%, HitCoverage=53%, E-value=9e-07, Identity=75%"; Hit description =Uncharacterized protein ART3
MVDEPRSRPITCEPVSSGPIDDPLRARTLPTRPQVRRGYPLSLSISISAGYVHGGLFPVRSPLLRESCVAHPPFYHGEVGHEPRFQPTTRRVLAGGRRALGLMASGATCVQRLDGSRDSAIHTKYRISLRSSSMQEPRYPLPRVIVCKCCVVTTPAGHRLRAPGSRT

SEQ ID NO: 133182 - protein, 151 aa, Glycine max
  Coding DNA Sequence Number=SeqID_16404
  Homolog annotation: Hit_ID=Q1STP5; Match level="QueryCoverage=86%, HitCoverage=21%, E-value=1e-11, Identity=35%"; Hit description=IMP dehydrogenase/GMP reductase
CVTDDAYQETSPCASWWLTSKAHIKGITGAPYRARCDALTVTDGQLRWGPMVVTARPERVLRQFGYIQSIPPSHVSARLSHDDMDDRWMHFADHVLAVGELCLVPGQVSADYMKWFFRISHPFMIPTQAGDQPRDAPAADPKEYMQLPSPQ

SEQ ID NO: 133183 - protein, 125 aa, Glycine max
  Coding DNA Sequence Number=SeqID_16405
  Homolog annotation: Hit_ID=Q1SKD7; Match level="QueryCoverage=99%, HitCoverage=33%, E-value=2e-10, Identity=31%"; Hit description =Ankyrin
MAPKKLSTKRSRRDAAAEGSNATPEFDSHRFQSAEHQQRFEAIKGWSFHRERHVQLREDEYTDFQEEIAHRCWTSLVTPMAKFDPETVLEFYANTWPTEEGVRDMHSWVRGQSIPFDADALSQFL

SEQ ID NO: 133184 - protein, 81 aa, Glycine max
  Coding DNA Sequence Number=SeqID_16406
MTRRMGFAEKTSQRWQRCNRRDDLKKINPDGRLSESGGNFPPSPKNCDDVLCGECAHEIMDASAGKNTNGSHKVFGEQRDC

SEQ ID NO: 133185 - protein, 84 aa, Glycine max
  Coding DNA Sequence Number=SeqID_16407
MIYDCRNLPFGGRVTRGLTGVSSKIRKCAESPPTFIQGKHQKNRKRHGLQNLSVKGSGVVFTHGEGCFPCSYIFLNCDKEIRST

SEQ ID NO: 133186 - protein, 136 aa, Glycine max
  Coding DNA Sequence Number=SeqID_16408
  Gene Ontology: Mol. function=porin activity; Cellular component =integral to membrane; Biological process=transport
  Homolog annotation: Hit_ID=Q66DC4; Match level="QueryCoverage=99%, HitCoverage=28%, E-value=2e-33, Identity=51%"; Hit description =Possible outermembrane porin (OPR family) precursor
MGTHGAQRKTLALAVAGALLGTGFAMAPEAKAAGFIDDSTLTGGIYYWQRERDRKDLNPDSKDYNQYTTNLSHSTANLSLDFASGYAWDMFGLDVGAFTAIELAESSASGHPNEIAFSSKNRTYDEDYSGDKGGVS

SEQ ID NO: 133187 - protein, 54 aa, Glycine max
  Coding DNA Sequence Number=SeqID_16409
MTSKLQMLITFATVIRLRPTIYQNAQNSEENLDKGDLATKVWMTPLPVKEDKSG

SEQ ID NO: 133188 - protein, 177 aa, Glycine max
  Coding DNA Sequence Number=SeqID_16410
  Homolog annotation: Hit_ID=Q1SFC5; Match level="QueryCoverage=81%, HitCoverage=19%, E-value=4e-20, Identity=40%"; Hit description =Asp/Glu racemase
MGLIIPQDYAEEVANPSIEGKRALRLTPKSLNQSSQKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLNENYNLHPFEFNHSHFCTM

SEQ ID NO: 133189 - protein, 326 aa, Glycine max
  Coding DNA Sequence Number=SeqID_16411
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8X5Q3; Match level="QueryCoverage=87%, HitCoverage=37%, E-value=3e-89, Identity=61%"; Hit description =Sensor protein
  Pfam annotation: Domain name=HATPase_c; Domain location=109-225; Score=129.2; E_value=1.2e-35; Accession=PF02518.16; Description =Histidine kinase-, DNA gyrase B-, and HSP90-like ATPase
  Pfam annotation: Domain name=HisKA; Domain location=3-68; Score=40.9; E_value=4.3e-09; Accession=PF00512.15; Description=His Kinase A (phosphoacceptor) domain
  Pfam module annotation: Pfam domain module=HATPase_c::HisKA; Domain location=109-225::3-68
MKAVGQLTGGLAHDFNNLLAVIIGSLALTVDQLPPGTLASRIERARLAADRAAQLTQRLLAFSRKQALYPRAVAVVELVENLQSLLQHSLLPGQHLVVDAQRPGWPAWIDAGQLENALMNLVVNARDAMERQSGEIRLRIWNQRIQEADGKRDRVTIEVIDHGCGMSAEVREQVFEPFFTTKATGSGSGLGLSMVYGFVRQSGGQIELETAPGQGTTVRLLLPRAPEAAQPLVSAPVLTPRASRDRLILVLDDEPAVRQTLCEHLHQLGYLTLECADGESALTLLRQTPDIDLLITDLMLLGALNAGHPADQLSGSALDAGDATAV

SEQ ID NO: 133190 - protein, 79 aa, Glycine max
  Coding DNA Sequence Number=SeqID_16412
MALMMEKQLRKKKMQQRIQNQMMMILMPPHDHQTFIFTLTSYWGIILLSPLQILLGLITLIMKVADPTCMTARTCSGSL

SEQ ID NO: 133191 - protein, 101 aa, Glycine max
  Coding DNA Sequence Number=SeqID_16413
MAKFDPDIVLEFYPNACPTEEGVRDMRSWVRGQWIPFDADAIGQFLGYPLVLEEGQECEYGQRRNRSDGFDEEPSPSCYVYRGRILPGLLPGDGCGSCAPT

SEQ ID NO: 133192 - protein, 46 aa, Glycine max
  Coding DNA Sequence Number=SeqID_16414
MEDTCAAVAADIQGDPPKGENWGMPLRAIMKHRSKLEGGGHMNSAR

SEQ ID NO: 133193 - protein, 217 aa, Glycine max
  Coding DNA Sequence Number=SeqID_16415
FALLRPDPQELAAKLYILGRGFELNADGQPLKILRKNMTTLAQTWNVLYFFNLIPTSHTSDVTLDRAKLIYGIIMKMDMNLGYLISHQISLTAQHDTSRLGFPALITTICKARGVQSDSRSLENLSLAINLAYIKKNCWNLDGPIVTFRGPRKARGVYMAQEEETSTDQIPKPSPAPIPNDAIPSALASELEQPISHDSLAAQVLDLNEHAQEQPQE

SEQ ID NO: 133194 - protein, 81 aa, Glycine max
  Coding DNA Sequence Number=SeqID_16416
MLPDAETCSKIKVTTPFDSNDPIHDESQSISIIANHDPLIGLPLTPTKRQSFHECEDEARSSLISPAQLSSNKLAKHDQIE

SEQ ID NO: 133195 - protein, 77 aa, Glycine max
  Coding DNA Sequence Number=SeqID_16417
MRAEINKDPTLVSKMTKYTKTGLRDSRRSLIYVNYNIATRLHSKTVLCNHLRMCDVKINISPLNYKIATASYSNTVL

SEQ ID NO: 133196 - protein, 245 aa, Glycine max
  Coding DNA Sequence Number=SeqID_16418
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-32, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFIGQQVLAFRKLHAPGFRGLHVLAFRALHVLAIRGLHALTFRGLHVLAIRGLQVLVFRGLHALAFRGLHVLTFRGLHVLPIRGLQVLAFRGLHALAFRGLHVLALRGLHVFAIKGLHAHTFKGLHVLAIRGLPVLAFRRATTRPHLQRTTRLHVLAFRGLNALTFRGLHALTFKGLHALTIRVLHVVAIIRLHVLAFRGLHVLAIRGGLHALTFRGLHALTFEGLHALTIRGLHVLTSE

SEQ ID NO: 133197 - protein, 114 aa, Glycine max
  Coding DNA Sequence Number=SeqID_16419
WGRNKFRGALWDSNSKLKLRRAETDQSRVEGMILEDKLKACQRSKRSLSEQLSRTEENMWAIIDQYKEKLSLAATHEQRLEDEYAKLPSLLAKAKTMADMYLAPEEVHGLLNYC

SEQ ID NO: 133198 - protein, 57 aa, Glycine max
  Coding DNA Sequence Number=SeqID_16420
MTGETKVVGNAPAFVDELRGFGGGGGGASVAYSRPSAGCCGVSPCACLGAQYFLMNA

SEQ ID NO: 133199 - protein, 140 aa, Glycine max
  Coding DNA Sequence Number=SeqID_16421
DITVVPNLVPSQNASPAMVETKILVGKDTSSGELPESTTHKEVQKEWTCALCHVTTSSEKTLIDHLHGRKHKATCESLKAQNQPVPHKVKSDQSKDDLNQKNVIYQINSKTKSGEKVGKEAMDHKGEIVEAHATREVEDE

SEQ ID NO: 133200 - protein, 115 aa, Glycine max
  Coding DNA Sequence Number=SeqID_16422
MQETPAVMVQKKGETKRRVAALEVSILFFSSNKLVLSLMSDPSHTPDKLEDALLRLTQQQSSMTAKIDELLMRLPPLLHHNPSPTSSSPPSPSPASVHKMKLDVPRFVFHSFVLF

SEQ ID NO: 133201 - protein, 692 aa, Glycine max
  Coding DNA Sequence Number=SeqID_16423
  Gene Ontology: Mol. function=protein serine/threonine kinase activity; Cellular component=cell surface; Biological process =protein amino acid phosphorylation
  Homolog annotation: Hit_ID=Q1SFV5; Match level="QueryCoverage=90%, HitCoverage=94%, E-value=0.0, Identity=67%"; Hit description=Protein kinase; Concanavalin A-like lectin/glucanase
  Pfam annotation: Domain name=Lectin_legB; Domain location=35-269; Score=151.3; E_value=2.6e-42; Accession=PF00139.10; Description =Legume lectin domain
  Pfam annotation: Domain name=Pkinase; Domain location=351-621; Score =181.7; E_value=1.8e-51; Accession=PF00069.15; Description=Protein kinase domain
  Pfam annotation: Domain name=Pkinase_Tyr; Domain location=351-621; Score=127.5; E_value=3.8e-35; Accession=PF07714.7; Description =Protein tyrosine kinase
  Pfam module annotation: Pfam domain module=Lectin_legB::Pkinase::Pkina se_Tyr; Domain location=35-269::351-621::351-621
SPDMAASPYCKNSYVHAFLHATLTLLLLVMPLAAASLAFNYQQLGDAGNATLSISGDVYHEQEVLQLTRYETFSYGRVIYHKQLHLWDKNSGKVADFTTHFSFTINARNNTNYADGMTFFLAHPSFPELDPRDGVGIGLLSRTQLLNPNFTKEYPFVAVEFDTYVNPEWDPKYHHVGIQVNSFVTSVSDTTQWFTSMDQRGYDADISYDSASNRLSVSFTGYKDNVKIKQNLSSVVNLKDKLPDWVEFGVSAATGMYYEEHTLSSWSFNSSFVFDKHKGGSKKGLAVGMGIGGFVLIGGTGLISLGLWKKWKKVDEEENHIVEEYMGEDFERGAGPRKYSYAELAHAANGFKDEHKLGQGGFGGVYKGYLKDIKSHVAIKKVSEGSDQGIKEFASEVIIISRLRHRNLVNLIGWCHERKKLLLVYEYMSNGSLDIHLFKKQSILQWAVRYNIARGLASALLYLHEEWEQCVVHRDIKPSNIMLDSEFNAKLGDFGLARFVDHAKSAQTTALAGTMGYMAPECTLGYRPASKESDVYSFGVVALEIACGRIPINHRAQENEISIVQWVWGLYGEGRILEAADQRLEGKFEEEQIKCLMIVGLWCAHPDHNNRPSMRQAIQVLNFEAPLPNLPSSLPVPTYLEGPLHSYIAPFSITASEEGQSQIISFSSNTNSIGFTTKSDDASPSVSLLYSR

SEQ ID NO: 133202 - protein, 379 aa, Glycine max
  Coding DNA Sequence Number=SeqID_16424
  Homolog annotation: Hit_ID=Q1S4N0; Match level="QueryCoverage=38%, HitCoverage=38%, E-value=4e-07, Identity=29%"; Hit description =Cyclin-like F-box
  Pfam annotation: Domain name=DUF295; Domain location=323-371; Score =51.6; E_value=2.7e-12; Accession=PF03478.8; Description=Protein of unknown function (DUF295)
MALKAKNKKKQQPSGNKEVQKSKSWLDLPNQLINTIQVHQNLDKDITSGGIIKSWRTSPKHCNSDSKLPWLQLTNPDGSNTEKYRTHITRRRGSLLTSYAYIPSGFWCRHFFRKLPRYPWENYVGCSNGILIAEAEPLYMYHLWNPTQGVMFRLPLWDPKVPIKLAVLSSPTEDPNCTVMVLTGIAQPAFTFYKLRRGSNYSSWITQEPQWTMQDCTLTESLGRRQKHVMQMQFTNAIGFKGKFYVLSVQGSLVVIENIDSVPKVMDISGTRIFPSVSSNHFREYLLESDGEVLLVFLISRKSSVHSVDDVEVYQLNMGRLSWVKLESVGERAVLVGSNCSMSVLASEVGCRKNCIYFKHPVVDEWCVHDMELGNIRLE

SEQ ID NO: 133203 - protein, 405 aa, Glycine max
  Coding DNA Sequence Number=SeqID_16425
SRRPLLLEVCARRIGLLPLHPHDSSQRHYVEHLVLIATLSLVLYLSLRPIIRNRVASLPGLIGPPPEGRARSWVARFFQRFGLCFGDFFPSDVIEAEAEFGDAAGVAEEANGALGVPAEAQKLEAEASDAREGREWSASEAGGGGERREGTPIRVGAKGSEEKRRMKKESVGSAERRKSGTGDGGSGGGQIEECRRTRELIKLPRYPCKHYVGSSNGILIAEIEPLHMYYPCNPTHGEVLRLLFWDPKDHNCTVMILTGISDPAFALCKVKETCWVTKWRWSKDCVTVEPQNQRAMQDCTLTEQLGKQQVMQFTNAIGFKGKFYVLSVKGSLAVIEEVDSVPKVTNLSDTRIVFLLFHQNHFREYLLESDGEVLLVFLIPRKSSMHIVDNVEVYQLNTGRLSWVN

SEQ ID NO: 133204 - protein, 682 aa, Glycine max
  Coding DNA Sequence Number=SeqID_16426
  Gene Ontology: Mol. function=protein serine/threonine kinase activity; Cellular component=cell surface; Biological process =protein amino acid phosphorylation
  Homolog annotation: Hit_ID=Q1SFV7; Match level="QueryCoverage=99%, HitCoverage=99%, E-value=0.0, Identity=66%"; Hit description=Protein kinase; Concanavalin A-like lectin/glucanase
  Pfam annotation: Domain name=Lectin_legB; Domain location=33-262; Score=173.2; E_value=6.4e-49; Accession=PF00139.10; Description =Legume lectin domain
  Pfam annotation: Domain name=Pkinase; Domain location=347-616; Score =169.4; E_value=9.2e-48; Accession=PF00069.15; Description=Protein kinase domain
  Pfam annotation: Domain name=Pkinase_Tyr; Domain location=347-616; Score=111.5; E_value=2.5e-30; Accession=PF07714.7; Description =Protein tyrosine kinase
  Pfam module annotation: Pfam domain module=Lectin_legB::Pkinase::Pkina se_Tyr; Domain location=33-262::347-616::347-616
MAASRYCKKTYVRAYFLHVTLIFLLLVIPRAAASLAFNYQQLGDTGNALKTSGDVYPDQDVLLLTRYEPDSYGRVTYYENLHLWDKNSGKVTDFTTHFSFTINTPNKTHHGDGITFFLAHPDFPQSGIDGSGIGLASREQLKNLNYAKDYPFVAVEFDTFVNDWDPKYDHVGIDVNSINTTDTTEWFTSMDERGYDADISYDSASNRLSVTLTGYKDSVKIKQHLFSVVNLSDVLPEWVEIGFSSATGFFYEEHTLSSWSFNSSLDKEQQKGGSKIGLVIGLSVGLGAGLSVLIVIWGVTFLVRWMLKNRGLEEVSLFDHAMDNDFERMSLPKKFSYEELARATNNFARENKIGEGGFGAVYRGLIRELNIHVAIKKVSRRSSQGVKEYASEVKIISQLRHKNLVQLLGWCHQNNDLLLVYEFMENGSLDSYLFKGKGLLAWKVRYDIARGLASALLYLHEEWEECVLHRDIKSSNVMLDSNFDAKLGDFGLARLMDHAIGSKTTVLAGTIGYLPPEAVTRGKASRESDVFSFGVAALEIACGRKAIEPNVNEEQLYLVDWVWELHGMVDLLKASDPSLYGHFDEKEMERLMIVGLWCTYTDFHLRPTIRQVVQVLNFEAPLPTLSPQVPSFSYNSSFSSMPSRTSAFANNQCVSSTSSSLGTGSSQSNTTCEVIISPAAAH

SEQ ID NO: 133205 - protein, 677 aa, Glycine max
  Coding DNA Sequence Number=SeqID_16427
  Gene Ontology: Mol. function=protein serine/threonine kinase activity; Cellular component=cell surface; Biological process =protein amino acid phosphorylation
  Homolog annotation: Hit_ID=Q1SFV6; Match level="QueryCoverage=88%, HitCoverage=77%, E-value=0.0, Identity=66%"; Hit description=Protein kinase; Heat shock protein Hsp20; Concanavalin A-like lectin/glucanase
  Pfam annotation: Domain name=Lectin_leg-like; Domain location=37-260; Score=-107.8; E_value=0.036; Accession=PF03388.4; Description=Legume -like lectin family
  Pfam annotation: Domain name=Lectin_legB; Domain location=28-254; Score=168.1; E_value=2.3e-47; Accession=PF00139.10; Description =Legume lectin domain
  Pfam annotation: Domain name=Pkinase; Domain location=334-604; Score =184.1; E_value=3.5e-52; Accession=PF00069.15; Description=Protein kinase domain
  Pfam annotation: Domain name=Pkinase_Tyr; Domain location=334-604; Score=123.3; E_value=7.1e-34; Accession=PF07714.7; Description =Protein tyrosine kinase
  Pfam module annotation: Pfam domain module=Lectin_leg-like::Lectin _legB::Pkinase::Pkinase_Tyr; Domain location=37-260::28-254::334 -604::334-604
MRKDKNYGHHWCDHKTTKHQALGNCVVQGKNFGTVEDLATRSANAVAPNIQLTTNQADKGMNGSIGRATYYQPMHLWDKATGTLTDFSTNFSFVINSRGQSVYGDGIAFFLAPAGSMVPNSTLGGTMGLTLDNQILNSTDNPFVAVEFDIFGNDWDPPGEHVGIDINSLRSVANATWLADIKGGKVNQALISYNSTSLNLSVAFTGFKNGTALLHHLSVIVDLKLYLPEFVTVGFSAATGNLTAIHTLNSWDFNSTSIIAPSQKKKDKKALAVGLGVGGFVLIAGLGLISIRLWKKTSEEEDHDFEEYIDEDFERGAGPQKYSYAELAQAANGFKDEHKLGQGGFGGVYKGYLKDLKSHVAIKKVSEGSDQGIKEFASEVRIISRLRHRNLVNLIGWCHAGKKLLLVYEYMSNGSLDIHLFKKQSILQWAVRYNIARGLASALLYLHEEWEQCVVHRDIKPSNIMLDSEFNAKLGDFGLARFVDHAKSAQTTALAGTMGYMAPECTLGYRPASKESDVYSFGVVALEIACGRKPINHRAQENEISIVQWVWGLYGEGRILEAADQRLEGKFEEEQIKCLMIVGLWCAHPDHSNRPSIRQAIQVLNFEAPLPNLPSSLPVPTYLEHPLHSSILPFSINASEEGQSQITGCSSNTNSSGFTTTSDDASPSVSLMYSRRN

SEQ ID NO: 133206 - protein, 443 aa, Glycine max
  Coding DNA Sequence Number=SeqID_16428
  Gene Ontology: Mol. function=protein serine/threonine kinase activity; Cellular component=membrane; Biological process=protein amino acid phosphorylation
  Homolog annotation: Hit_ID=Q1SFV6; Match level="QueryCoverage=97%, HitCoverage=53%, E-value=1e-137, Identity=60%"; Hit description =Protein kinase; Heat shock protein Hsp20; Concanavalin A-like lectin/glucanase
  Pfam annotation: Domain name=Lectin_legB; Domain location=39-266; Score=199.1; E_value=1.1e-56; Accession=PF00139.10; Description =Legume lectin domain
  Subcellular localization annotation: CTP_CleavageSite=41; ConfidenceScore=5.07e-01
MVSAAPNAMYAQLSNLSFSHHFLVMLLSIFFIFIIPCAFPLSFNITSFDPNGKSIIYEGSANPVTPVIELTGNVRDSTGRATYFQPMHLWDKATGNLTDFTTHFSFVIDSRNRSGYGDGMAFFLAPAGLKFPYVSRGGALGLTLENQRLNSTDPFVAVEFDIYKNFYDPPGEHVGIDINSLRSVANVTWLADIKQGKLNEVWISYNSSSFNLSVVFTGFNNDTILRQHLSAIIDLRLHLPEFVTVGFSAATGSSTAIHSVNSWDFSSTLAAQENITKGADTVARSPATSNIAPSQKKKNKTGLAVGLSIGGFVLIGGLGLISICLWKKWKKGSVEEVHVFEEYMGKDFGRGGGPRKYSYAELTQAANGFKDEHKLGQGGFGGVYKGYLKDIKSHVAIKRVSESSDQGIKEFASEVNIISRLRHRNLVHLIGWCHAGEKALTCV

SEQ ID NO: 133207 - protein, 56 aa, Glycine max
  Coding DNA Sequence Number=SeqID_16429
MGEDGVVVAPRTTMGSRWCDYSLTRWSQMCSKIWISHGSILCDNNENEIGGLAKGA

SEQ ID NO: 133208 - protein, 361 aa, Glycine max
  Coding DNA Sequence Number=SeqID_16430
  Gene Ontology: Mol. function=protein serine/threonine kinase activity; Cellular component=cell surface; Biological process =protein amino acid phosphorylation
  Homolog annotation: Hit_ID=Q1SFV3; Match level="QueryCoverage=58%, HitCoverage=37%, E-value=3e-80, Identity=62%"; Hit description =Protein kinase; Concanavalin A-like lectin/glucanase
  Pfam annotation: Domain name=Pkinase; Domain location=134-361; Score=- 0.1; E_value=1.5e-08; Accession=PF00069.15; Description=Protein kinase domain
  Pfam annotation: Domain name=Pkinase_Tyr; Domain location=140-336; Score=-67.3; E_value=2.4e-08; Accession=PF07714.7; Description =Protein tyrosine kinase
  Pfam module annotation: Pfam domain module=Pkinase::Pkinase_Tyr; Domain location=134-361::140-336
SLWRWFAILPSKPKSATADDEKLRGGALSIGLVDGDRNLLETHYQFVVVDIVYNSRNNILKVSFTENKLGGGDATQIIQHLSYHVNITDQLSKSVTVGISAATGEYTEEHTLFSWSFSTSTSSPTPSKGHSKKGRINTILLEGTGIGTGYFKGLNSYAAMKRISAGSAQSLKEYAEEVTIISQLRHMNLVKLAGWCHKKNDLFLIYEYMPNGSLDSCLFGGEKFLPWKVRYNVALGLASAWLYLQEECEKFVFHREIKSSNIMVDSNFSAKLGDFGLARQVDHEKGSQSSVGVATGRKAIHHKDMEGGVSLVEWAWEHHGLRNLLAAADPNLCAEFDVQQTECLLVVGLWCANPDCASRPL

SEQ ID NO: 133209 - protein, 284 aa, Glycine max
  Coding DNA Sequence Number=SeqID_16431
  Gene Ontology: Mol. function=protein serine/threonine kinase activity; Cellular component=membrane; Biological process=protein amino acid phosphorylation
  Homolog annotation: Hit_ID=Q1SFV6; Match level="QueryCoverage=90%, HitCoverage=31%, E-value=2e-88, Identity=65%"; Hit description =Protein kinase; Heat shock protein Hsp20; Concanavalin A-like lectin/glucanase
  Pfam annotation: Domain name=Lectin_leg-like; Domain location=48-280; Score=-100.7; E_value=0.012; Accession=PF03388.4; Description=Legume -like lectin family
  Pfam annotation: Domain name=Lectin_legB; Domain location=40-276; Score=177.2; E_value=4e-50; Accession=PF00139.10; Description=Legume lectin domain
  Pfam module annotation: Pfam domain module=Lectin_leg-like::Lectin _legB; Domain location=48-280::40-276
MVSAAPKAMVVPLSNLNFPYHHFLVMLLSIFFLLIIPYASALSFNFTSFDPNDKSIIYEGSANPVAPTIQLTRNQMDKNMIGSIGRATYCQPMHLWDKATGNLTDFTIHFSFVIDSRNRSKYGDGMAFFLAPAGLKIPNATKGGSLGLTLDNQRLNSTDNPFVAVEFDIYKNPYDPPGEHVGIDINSLRSVANVTWLADIKEVKLNEAWISYNSSSLNLSVVLNVFNNDTDHTIQQQYLSAKVDRRLYLPELVTFGFSAATGNATAIHSVNSWILAQLWQHKKT

SEQ ID NO: 133210 - protein, 151 aa, Glycine max
  Coding DNA Sequence Number=SeqID_16432
MTSPSQQPLGKTILMALLGFPPGVPPLPHISKINVDGSFLPLQGVSSEIVLDDPCPPHHPNGGLLLSLLEFFHRNWNVSIQFIGREANSVIYNGRVVCAVEEREINHGAGVPVGVDLIAAPSTLPRTKNIFCPFIIFELNCERGQYSYSIR

SEQ ID NO: 133211 - protein, 708 aa, Glycine max
  Coding DNA Sequence Number=SeqID_16433
  Gene Ontology: Mol. function=protein serine/threonine kinase activity; Cellular component=cell surface; Biological process =protein amino acid phosphorylation
  Homolog annotation: Hit_ID=Q1SFV6; Match level="QueryCoverage=94%, HitCoverage=83%, E-value=0.0, Identity=67%"; Hit description=Protein kinase; Heat shock protein Hsp20; Concanavalin A-like lectin/glucanase
  Pfam annotation: Domain name=Lectin_leg-like; Domain location=53-267; Score=-114.4; E_value=0.1; Accession=PF03388.4; Description=Legume -like lectin family
  Pfam annotation: Domain name=Lectin_legB; Domain location=39-266; Score=175.9; E_value=1e-49; Accession=PF00139.10; Description=Legume lectin domain
  Pfam annotation: Domain name=Pkinase; Domain location=369-638; Score =171.4; E_value=2.2e-48; Accession=PF00069.15; Description=Protein kinase domain
  Pfam annotation: Domain name=Pkinase_Tyr; Domain location=369-638; Score=139.8; E_value=7.3e-39; Accession=PF07714.7; Description =Protein tyrosine kinase
  Pfam module annotation: Pfam domain module=Lectin_leg-like::Lectin _legB::Pkinase::Pkinase_Tyr; Domain location=53-267::39-266::369 -638::369-638
  Subcellular localization annotation: CTP_CleavageSite=41; ConfidenceScore=5.10e-01
MVSAAPNAMYSQLSNLSFSHHFLVMLLSIFFIFIIPCAFPLSFNITSFDPNGKSIIYEGSANPVTPVIELTGNVRDITGRATYFQPMHLWDKATGNLTDFTTHFSFVIDSRNQSAYEDGMAFFLAPAGLKFPYVSRGGALGLTLEDQRLNSTDPFVAVEFDIYENPDDPPGEHVGIDINSLRSVANVTWLADIKQGKLNEVWISYNSSSFNLSVVFTGFNNDTILRQHLSAITDLRLHLPEFVTVGFSAATGIDTAIHSVNSWDFSSTLAAQENITKGADTVARYPATSNIAPSQKKKNKTGLAVGLSIGGFVLIGGLGLISIGLWKKWKKGSVEEDLVFEEYMGEDFGRGAGPRKYSYAELTEAANGFKDEHKLGQGGFGGVYKGYLKDIKSHVAIKRVSEGSDQGIKEFASEVNIISRLRHRNLVHLIGWCHAGKKLLLVYEYMPNGSLDIHLFKKQSLLKWTVRYNIARGLASALLYLHEEWEQCVVHRDIKSSNIMLDSEFNAKLGDFGLARFVDHAKSAQTTALAGTMGYMAPECATSGRASKESDVYSFGVVALEIACGRKPINHRAQENEINIVEWVWGLYGEGRILEAADQRLEGEFEEEQIKCLMIVGLWCAHPDHNNRPSMRQAIQVLNFEAPLPNLPSSLPVPTYLEGPLHSFIAPFSITSSEEGQSQITGSSSNTNSTGFTTKSDDASPSVSLLYS

SEQ ID NO: 133212 - protein, 666 aa, Glycine max
  Coding DNA Sequence Number=SeqID_16434
  Gene Ontology: Mol. function=protein serine/threonine kinase activity; Cellular component=cell surface; Biological process =protein amino acid phosphorylation
  Homolog annotation: Hit_ID=Q1SFV2; Match level="QueryCoverage=98%, HitCoverage=99%, E-value=0.0, Identity=74%"; Hit description=Protein kinase; Concanavalin A-like lectin/glucanase
  Pfam annotation: Domain name=Lectin_leg-like; Domain location=28-270; Score=-93.2; E_value=0.0036; Accession=PF03388.4; Description=Legume -like lectin family
  Pfam annotation: Domain name=Lectin_legB; Domain location=32-264; Score=170.7; E_value=3.6e-48; Accession=PF00139.10; Description =Legume lectin domain
  Pfam annotation: Domain name=Pkinase; Domain location=359-628; Score =148.0; E_value=2.6e-41; Accession=PF00069.15; Description=Protein kinase domain
  Pfam annotation: Domain name=Pkinase_Tyr; Domain location=360-628; Score=107.5; E_value=3.9e-29; Accession=PF07714.7; Description =Protein tyrosine kinase
  Pfam module annotation: Pfam domain module=Lectin_leg-like::Lectin _legB::Pkinase::Pkinase_Tyr; Domain location=28-270::32-264::359 -628::360-628
MAWWRNSLQNPTLLFCYATRTIFILQIIPLANSLSFDYPNFKNGDVKWEGDASILKGAIQVTSNTMDQNNNYSVGRVTSYKKMLLWDMNTGKLADFTTKFSFVVFSGKSYYGDGMAFFLADPNLPLLKNIREGGGLGLVDGKQVLNSTQPFVAVEFDTFHNKWDPQGGTHVGLNFNSMRSNITKQWLTDIQIWNVYNCSIEYNSSTLNLSVSFTTYNNVSKPVEEYISYKVDLRDYLPGKVILGFSAATGKLYEVHTLRSWSFNSSLQSDENTNEIKPVAAPPTSNPDSENEHKIGLWVGIGIGVGLVLGLLGLICALLWKRSREKKGELVFDLNMADEFPKGTGPKSFCYNELVSATNKFAEKLGQGGFGGVYKGYLKDLKSYVAIKRISKESRQGMKEYVTEVKVISQLRHRNLVQLIGWCHRKNDFLLIYEFMPNGSLDSHLYGVKSFLTWTVRYNIALGLASALLYLQEEWEQCVIHRDIKSSNIMLDSCFNAKLGDFGLARLVDHEKGSQTTRIAGTRGYIAPEYFTSGKATKESDIYSFGVVLLEIASGRKPVELEAEEGQITVVEWVWKLYGLGRFLEAADPKLCGEFDENQMERLVIVGLWCVHPDYSFRPSIRQVIQVLKFESALPILPEMMPVPTYLPPTIKALFSSVSSSFWGRS

SEQ ID NO: 133213 - protein, 148 aa, Glycine max
  Coding DNA Sequence Number=SeqID_16435
  Gene Ontology: Mol. function=carbon-sulfur lyase activity; Cellular component=vacuole
  Homolog annotation: Hit_ID=Q9S7N2; Match level="QueryCoverage=83%, HitCoverage=30%, E-value=3e-35, Identity=59%"; Hit description =Putative alliinase; 54807-57232
  Pfam annotation: Domain name=Alliinase_C; Domain location=26-148; Score=-124.3; E_value=2.5e-07; Accession=PF04864.4; Description =Allinase, C-terminal domain
MVVATNGFPSSNATIPPTNISPNAILPLDRGDPVVFEEYWKKMCESCTVVIKGWELMSYLSDMSNVCWYMLPEMKEAIKRLHHVVGNAVTEDRYIVVGNGATQLLQGAVFALSPSEANSQPINVVAAVPYYSVIIPFCPLPYSYYIMS

SEQ ID NO: 133214 - protein, 113 aa, Glycine max
  Coding DNA Sequence Number=SeqID_16436
  Gene Ontology: Mol. function=carbon-sulfur lyase activity; Cellular component=vacuole
  Homolog annotation: Hit_ID=Q9S7N2; Match level="QueryCoverage=94%, HitCoverage=27%, E-value=1e-38, Identity=66%"; Hit description =Putative alliinase; 54807-57232
  Pfam annotation: Domain name=Alliinase_C; Domain location=2-113; Score=-100.9; E_value=1.8e-08; Accession=PF04864.4; Description =Allinase, C-terminal domain
MVDLEYQDEVDILRSGLYQWAGDAASYEKNEPYIEVVTSPNNPDGTMRGPVVKSEAEGKLIHDLAYYWPHYTPITHQADHDIMIFTFSKCTGHAGSRLGWAIVKDIEVAKKMT

SEQ ID NO: 133215 - protein, 138 aa, Glycine max
  Coding DNA Sequence Number=SeqID_16437
MERMRKDNEERLRRIHGSSEALSVRIQNIKKGGEDKSSNSSHGEDEAYEEDVGGSRNERYRDSRNHRRYEVEQVFACYNYNEEKKMKFASLEFEGYCRNLPFGERATRDSWLIFQERNTRGVATIVYLRKTSEKPGKT

SEQ ID NO: 133216 - protein, 226 aa, Glycine max
  Coding DNA Sequence Number=SeqID_16438
  Gene Ontology: Mol. function=RNA-directed DNA polymerase activity; Biological process=RNA-dependent DNA replication
  Subcellular localization annotation: CTP_CleavageSite=53; ConfidenceScore=5.12e-01
VVPSVGPYNQQGQWRSHPGNQFNKDQGGPSNRPIKQGPNIFQRTTKLEDTLTQFMQIADKSSNSFVANTEKNPKEECKVMMTRSKRFMEEEDEDNVVMPKKKVAEKKDTDDKKEDVRERSRSEQAREKKKEKVVNEGMEVPYLVVPSKKEKDRHLDILTRKHKYIHWENIVVEGNCSAVIQKILPPKHKDPGSVTIPCSIGEVTVGKDLIDLGASINLMPLSMCRK

SEQ ID NO: 133217 - protein, 107 aa, Glycine max
  Coding DNA Sequence Number=SeqID_16439
MTEGCGEGFCLANLPGDAFSLWGNFFEAKKQMMADAKFAGLLGLGKPLVEILPPGQLRGFCPLLAWLGSAVLGFVGDLEGEGRITATRAESQWIVAARPLCHLQYPV

SEQ ID NO: 133218 - protein, 123 aa, Glycine max
  Coding DNA Sequence Number=SeqID_16440
  Gene Ontology: Mol. function=carbohydrate binding
  Homolog annotation: Hit_ID=Q10NJ9; Match level="QueryCoverage=93%, HitCoverage=28%, E-value=1e-29, Identity=54%"; Hit description =Lipase, putative, expressed
  Pfam annotation: Domain name=DUF620; Domain location=34-123; Score= -54.1; E_value=3.9e-11; Accession=PF04788.3; Description=Protein of unknown function (DUF620)
MGACMQRDSTAKYIVQQYVAATGGVAALNSLESMYAMGQVRICGSEVRRQGDGYEESVQSRGKTEVGGFVLWQKNPDLWCLELVVSGFKVSAGSNGKLAWNHSSSQPFHANKGPPRPLRRFFQ

SEQ ID NO: 133219 - protein, 177 aa, Glycine max
  Coding DNA Sequence Number=SeqID_16441
  Gene Ontology: Mol. function=sequence-specific DNA binding; Cellular component=intracellular; Biological process=regulation of transcription, DNA-dependent
  Homolog annotation: Hit_ID=UPI00006DBE1C; Match level="QueryCoverage =98%, HitCoverage=52%, E-value=6e-63, Identity=69%"; Hit description =COG2207: AraC-type DNA-binding domain-containing proteins
  Pfam annotation: Domain name=HTH_AraC; Domain location=128-172; Score= 33.0; E_value=1.1e-06; Accession=PF00165.13; Description=Bacterial regulatory helix-turn-helix proteins, araC family
  Pfam annotation: Domain name=HTH_AraC; Domain location=76-122; Score =38.9; E_value=1.7e-08; Accession=PF00165.13; Description=Bacterial regulatory helix-turn-helix proteins, araC family
  Pfam module annotation: Pfam domain module=HTH_AraC::HTH_AraC; Domain location=128-172::76-122
MPDVMLVSTLLAQYPEIQPILDAMERETRQRKAGFAGILSRLADVVAAQIVRGWVENGCGQGSGLVQALRDPRLSLAMAAMHRAPGENWTVERLARESGSSRSVFAARFQNATGMTPLRYLTELRMRLAVERIVNDGEAVESVAFHLGYGSLAAFSRAFKRIVGTPPGALRAGREAS

SEQ ID NO: 133220 - protein, 358 aa, Glycine max
  Coding DNA Sequence Number=SeqID_16442
  Gene Ontology: Mol. function=unfolded protein binding; Biological process=protein folding
  Homolog annotation: Hit_ID=Q5H336; Match level="QueryCoverage=98%, HitCoverage=53%, E-value=1e-149, Identity=77%"; Hit description =Hsp90xo protein
PAISVKGAVEVRAHSGRRPCQRTALRGNDDLQRAQQACRSFGLRMPVALGAQQRLHGGIVEVEVQPRRRTRLDARGELPGQAQRRHRDALVVLIVFQALLQFGLAIGHHHHRQCLRTEACRQQLFTIAQLLTQPCQLRLVEAVVSAEQRAVALLCAELDQAQALGLGPAPQEWHHRIAMAVRHRHAHRTEQHFLEAAAIVEDHVHRTACRQRTGWQVALRSRHAHVFQQQVEQALIAQRRTQQGLVVAGQHAPPGFRLLLRNVGQAVDQRLQQCMLHRAVLVIALQVFAAGGGRQPRGFDHPADETGPRRQQVARVVIQQHAAHEHRQVAVVAGAIGGAVLDPQQAGGIAVAIGTQWH

SEQ ID NO: 133221 - protein, 126 aa, Glycine max
  Coding DNA Sequence Number=SeqID_16443
MMIGNLISLCMMPTALVCTNQADMTRRLLAGSLAFENCILHYLIVKKGAQPIDEEGNLPVREDSSLLQKILDRFDGFQTFVGERFDALELQVDMRFDEMDSRITKVERDVSYIYTCFDLPPPPPSS

SEQ ID NO: 133222 - protein, 272 aa, Glycine max
  Coding DNA Sequence Number=SeqID_16444
  Subcellular localization annotation: CTP_CleavageSite=68; ConfidenceScore=5.02e-01
MAVDLCSENCVVASSSSVSPRISFSHDFSQSDVIPVEQLPFRSNSSGLNPTIDFDFCVSESFELESSSADELFSHGRILPTEVKRKNNIVPPMKQLAPKSSTSLPPPPYAGPNSVSTGRNLKKEITPKESKCLNDEVYDQKQSSKSFWNFKRSSSCGSGPRRSFCPLPLLSRSNSTGSSTPSVKRNPLSKEGVNNIKQKHSSTRLAHHSFVPNSYHHHQKPPLNYKSHHGSYGTSVRVNPVLNVPPANLFAVTAISSLKIPTSNKLVACNPS

SEQ ID NO: 133223 - protein, 126 aa, Glycine max
  Coding DNA Sequence Number=SeqID_16445
  Gene Ontology: Mol. function=metallopeptidase activity
  Homolog annotation: Hit_ID=Q28RU0; Match level="QueryCoverage=59%, HitCoverage=33%, E-value=1e-12, Identity=49%"; Hit description =Expressed protein
MPNWELRNCCDHDQKVFIACVAAFTVVILVLWRTFLLTPFKLITVFLHEASHAIACWLTCGKVEGIQVHANEGGVTQTRGGIYWVILPAGYIYDDLISRRVHSSDAEKFAEVCPCPCNGFGWGVIW

SEQ ID NO: 133224 - protein, 43 aa, Glycine max
  Coding DNA Sequence Number=SeqID_16446
MEVLTPAKVMRDATMVGTVGGVDADKGDARQRENDEEEEDRYE

SEQ ID NO: 133225 - protein, 250 aa, Glycine max
  Coding DNA Sequence Number=SeqID_16447
  Homolog annotation: Hit_ID=Q1SKD7; Match level="QueryCoverage=81%, HitCoverage=52%, E-value=1e-08, Identity=25%"; Hit description =Ankyrin
MAHTLSAPHPLIQQRIRSTRLAGSAAPSALIYWEARAKRALMTSRKRRAVPTPGEASNWDTSRFTSEIAWHRYHDNIQLRNILPERNVELGPGMFDEFLQELRRRRWDQVPTHLPEKRIDVALVKEFYSNLYDPEDHSPRFCRVRGQVVRFDADTINDFLDTPVILEDGEEYPAYTRYLSTHPDPDTIAATLCTPGGRFVLNADGLPWKLLRKDMTTLAQTWSVLSYYDLAPTSHTSDVNLDRARLIYGL

SEQ ID NO: 133226 - protein, 53 aa, Glycine max
  Coding DNA Sequence Number=SeqID_16448
AYRQRVAWPGDQPSTDRGEEPSGAAEDPAVDEDLIADLATADWGPWADLGGGS

SEQ ID NO: 133227 - protein, 44 aa, Glycine max
  Coding DNA Sequence Number=SeqID_16449
MKAREPTKFYVGVPMSTSVLVCLQLLLKSAAVITNTGMRKIIYK

SEQ ID NO: 133228 - protein, 272 aa, Glycine max
  Coding DNA Sequence Number=SeqID_16450
  Gene Ontology: Cellular component=chloroplast envelope
MKPCGSVGKGKNFAFPIRSNGAELCDGHIVRSRVNLSGDWSFIGGSRIIVKPKATRLLLHYPKRGQMQASFFHFSELLTGEAGDFTIRSLCFKITKWSAVIFTLGKFPCILIYINITGFIGSQLASTVFTVGTIAVLPFYTLMVLAPKSELTKKSMESSIPYVVLSILYAYLLYLSWTPETVRLIFASKYLLPELAGIAKMFSSEMTLASAWIHLLVVDLFAARHIFQDGLKNQIETRHSVSFCLFFCPIGILTHVITKSMTKPARKEGHGL

SEQ ID NO: 133229 - protein, 275 aa, Glycine max
  Coding DNA Sequence Number=SeqID_16451
  Gene Ontology: Mol. function=acyltransferase activity; Biological process=aromatic compound metabolic process
  Homolog annotation: Hit_ID=Q9FF27; Match level="QueryCoverage=37%, HitCoverage=41%, E-value=3e-32, Identity=65%"; Hit description =Arabidopsis thaliana genomic DNA, chromosome 5, P1 clone:MXI10
MAICVSGSHTLFVNRSNLKTVAVLSREKKMRVQYDLKQGQSRNFHELPSGLSMEVIVQKGAKKNTNFEYPPLVFVHGSYHAAWCWAEHWLPFFSSSGHDCYAISLLGQGESDSPPDSVAGTLQWDSLALYLFQANCCLQGIWTEFSEECDFFCVYLLICLYPPPGRETFFSATMEDHVVRRYQELMKESSRMPLFDLRKLNASLPVPSVPNCPFEILVLGAKDDFIVDAEGLKETAKFYGVPPVCVDAIAHDMMLDVSWEKGAEVIFSWLNGSEK

SEQ ID NO: 133230 - protein, 112 aa, Glycine max
  Coding DNA Sequence Number=SeqID_16452
  Gene Ontology: Mol. function=nucleotidyltransferase activity; Cellular component=intracellular; Biological process=regulation of transcription, DNA-dependent
  Homolog annotation: Hit_ID=Q0X9C5; Match level="QueryCoverage=88%, HitCoverage=47%, E-value=5e-18, Identity=46%"; Hit description=DNA polymerase, beta-like region
MPPVRPITAQAVAFHVREIARRTATQAGTLHKELSRLAEGGILLRQRQGNQICYQANADCLIFPELAAIFRKACGPAARLRQVLTGFGEDIERAFIFGSVASGKATAASDID

SEQ ID NO: 133231 - protein, 71 aa, Glycine max
  Coding DNA Sequence Number=SeqID_16453
MGAKYLEAVKQRLHAIKQWSPDEIMGYLTLNIVINLLYEIYTKLLSIWYIEPCVWTDERERERPLSDAKRN

SEQ ID NO: 133232 - protein, 38 aa, Glycine max
  Coding DNA Sequence Number=SeqID_16454
MALYRILGCLAATFSTCPAPGRDDDLSVVTLSSICIRP

SEQ ID NO: 133233 - protein, 80 aa, Glycine max
  Coding DNA Sequence Number=SeqID_16455
MASHQREIRHLSESPTEGQEARQERFARLKTVLDSVDSRLDQAREIDRVRDNERARLRAEMDHDCDRWRALERKNAPKCD

SEQ ID NO: 133234 - protein, 65 aa, Glycine max
  Coding DNA Sequence Number=SeqID_16456
  Subcellular localization annotation: CTP_CleavageSite=44; ConfidenceScore=5.02e-01
MAELINKTQLSPKIIPTSSRRLGSSSTESHFLHPTTVILLLRTRMMHAPDLNSQMQCGTYHQPRK

SEQ ID NO: 133235 - protein, 239 aa, Glycine max
  Coding DNA Sequence Number=SeqID_16457
  Gene Ontology: Mol. function=structural constituent of ribosome; Cellular component=ribonucleoprotein complex; Biological process =translation
  Homolog annotation: Hit_ID=Q9BBS6; Match level="QueryCoverage=59%, HitCoverage=77%, E-value=4e-64, Identity=68%"; Hit description =Chloroplast 30S ribosomal protein S2
  Pfam annotation: Domain name=ATP-synt_A; Domain location=134-239; Score=-45.4; E_value=0.0005; Accession=PF00119.11; Description=ATP synthase A chain
  Pfam annotation: Domain name=Ribosomal_S2; Domain location=13-172; Score=144.8; E_value=2.2e-40; Accession=PF00318.10; Description =Ribosomal protein S2
  Pfam module annotation: Pfam domain module=ATP-synt_A::Ribosomal_S2; Domain location=134-239::13-172
MTKRYWNIILEEMMEAGVHFGHGTRKWNPKMSPYISAKRKADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRESILIIRNLQTIPAFGQNFFEYVLEFIRDVSKTQIGEEYGPWVPFIGTLFLFIFVSNWSGALLPWKIIQLPHGELAAPTNDINTTVALALLTSIAYFYAGL

SEQ ID NO: 133236 - protein, 103 aa, Glycine max
  Coding DNA Sequence Number=SeqID_16458
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q9XGX5; Match level="QueryCoverage=67%, HitCoverage=38%, E-value=3e-26, Identity=78%"; Hit description =Ribulose bisphosphate carboxylase small chain 2, chloroplast precursor
  Pfam annotation: Domain name=RuBisCO_small; Domain location=6-81; Score=75.6; E_value=1.6e-19; Accession=PF00101.10; Description =Ribulose bisphosphate carboxylase, small chain
MVMVLNFDGYVWGACNHRSPEYNDGRYWTMWKLPMIGCTDSAQVLKGVDEAVKAYPTAFVRIIGFDNVRQVQCVIFIAYKSNASFSLPTSPLATKLEFYKSHL

SEQ ID NO: 133237 - protein, 372 aa, Glycine max
  Coding DNA Sequence Number=SeqID_16459
  Gene Ontology: Mol. function=carboxypeptidase activity; Cellular component=membrane; Biological process=electron transport
  Homolog annotation: Hit_ID=Q9C9F2; Match level="QueryCoverage=87%, HitCoverage=96%, E-value=4e-59, Identity=37%"; Hit description=MtN21- like protein; 91922-89607
  Pfam annotation: Domain name=DUF6; Domain location=183-312; Score =33.5; E_value=7.3e-07; Accession=PF00892.11; Description=Integral membrane protein DUF6
  Pfam annotation: Domain name=DUF6; Domain location=22-134; Score =12.2; E_value=0.013; Accession=PF00892.11; Description=Integral membrane protein DUF6
  Pfam annotation: Domain name=TPT; Domain location=174-312; Score= -18.0; E_value=0.0063; Accession=PF03151.7; Description=Triose -phosphate Transporter family
  Pfam module annotation: Pfam domain module=DUF6::DUF6::TPT; Domain location=183-312::22-134::174-312
MNLTWKLMQELKPTLLMVLVQVSYAFSSVLYKLAINDGMSLRVLSAYRLIFGAAFSFSLALIFERGSLFLNLFFFALALVSTTYAYAVFNLVPATTFILSVLCGYENLNARTAAGKTKVLGTMLGIGGSMLLSFFKGMKINIWNFHIKLLHKNDNSDQLGTRTPHANPKTEWLGVLSGIGSCLSFSIWLIIQAKVSKEYPSHHSATALMALMGAIQATAFALCVEKDWSQWNLGSSIRLLTALFSGTVTSGFVIIATTWCVRKRGPLYASVFNPLSLVLVAIAASMLLQEHLYVGSVIGAVLIVCGLYMVLWGKNKEMKTATHLVSLDNTKEFGVITDVVVVSTTENSDRENNSHDNCGHGLNDIEKTGSWK

SEQ ID NO: 133238 - protein, 107 aa, Glycine max
  Coding DNA Sequence Number=SeqID_16460
MAGWGKTGEREVPPLELAGQVRAVLPTVVAGQGERGSRQQWLRDRLVKMQKTFLSSPPDLIAVIAVNNINGVGFTVWNERIALIKLYTLQYILTWRYLKPIAYEGCV

SEQ ID NO: 133239 - protein, 114 aa, Glycine max
  Coding DNA Sequence Number=SeqID_16461
MGSTFKEVGVGGSDVGQALNGRDREVCLYYGICHWEEGKSRKGNEEERKCMQMGTKIEEGRMRRVASTVRLLVFGNWMESGFVTKTKDWFPVLVLGLWARLMKEESIKANGFGV

SEQ ID NO: 133240 - protein, 268 aa, Glycine max
  Coding DNA Sequence Number=SeqID_16462
  Gene Ontology: Mol. function=glutamyl-tRNA reductase activity; Biological process=tetrapyrrole biosynthetic process
  Homolog annotation: Hit_ID=Q6AVG1; Match level="QueryCoverage=93%, HitCoverage=63%, E-value=8e-82, Identity=56%"; Hit description =Expressed protein
  Pfam annotation: Domain name=DUF266; Domain location=33-144; Score =201.4; E_value=2.1e-57; Accession=PF03267.4; Description=Arabidopsis protein of unknown function, DUF266
MFLARGPLPLAPLWEKFFKDHDGFYSIYLHQHPCYSETMPEDSVFYGRNIPSELVVWGAPSLMDAGKRLLANALMDLSNQRFVLLSESCIPLFGFRTIYDYLMNSSTSFSDSFDDPGYDARGRYCPKMRPIIDITDWRKGSQWFEVHRELAIHIVSDTKYYPIVQHYCTSPCFAEEHYIPTFVHMMYPQLSSNSSITWVDWSRRGPHPRTFGSNDITEAFLNHMRFGSTCVYEGNITNMCFLFARKFHPSALKPLLLLLSPLMLGADT

SEQ ID NO: 133241 - protein, 68 aa, Glycine max
  Coding DNA Sequence Number=SeqID_16463
  Subcellular localization annotation: CTP_CleavageSite=49; ConfidenceScore=5.09e-01
MCPITDFSSFFVKHYVAPERFVATKSQRFRSRILQHSTFDPKKRKRRVYGSSKFYQLLSQGHTALSRP

SEQ ID NO: 133242 - protein, 99 aa, Glycine max
  Coding DNA Sequence Number=SeqID_16464
MSEIKRKHCYAIRPLGSSRFFLQEAVASGGRNLARQLALLPYFVINRGRSEEGRGSAFLAFRNHLKLVRKIVSVGDFTKIFNRSSSFVIRSSSFCGLQP

SEQ ID NO: 133243 - protein, 106 aa, Glycine max
  Coding DNA Sequence Number=SeqID_16465
MPTSSNGATSCGIRARFLCGLNMKVRDKVELLSYRDLDELVHICIRVEQQLKRKHSSKSYASHSYPRKDQAHGILGAAPSKPKEDKGINETLGLIRILVMDLKRAN

SEQ ID NO: 133244 - protein, 41 aa, Glycine max
  Coding DNA Sequence Number=SeqID_16466
IAAVITVVIVVTMTAITVVVINHNSDDCNDDGDCDDDLNVN

SEQ ID NO: 133245 - protein, 273 aa, Glycine max
  Coding DNA Sequence Number=SeqID_16467
  Gene Ontology: Mol. function=oxidoreductase activity; Cellular component=membrane; Biological process=electron transport
  Homolog annotation: Hit_ID=Q9FF18; Match level="QueryCoverage=82%, HitCoverage=43%, E-value=3e-90, Identity=66%"; Hit description =Cytochrome P450-like protein
MAMVVLTPLLAILGILLLKLIYDSLSCYWLTPLRIKKTMDMQGVRGPKPRFFTGNILDMASLVSKATSQDMKTISHDIVGRLLPHFLLWSSQFGKRFLYWNGSEPRLCLTETELIKEFLSKHSTVSGKSWQQRQGSKNFIGEGLLMANGEDWYHQRHIVAPAFMGDRLKSYAGHMVECTKEMLQSLKIALESGQTEVEIGHYMTKLTADIISRTEFGTSYQKGKKIFHLLTLLQSRCAQASRHLCIPGSRFLNHPFLVFQDHVEISVNNVILF

SEQ ID NO: 133246 - protein, 329 aa, Glycine max
  Coding DNA Sequence Number=SeqID_16468
  Gene Ontology: Mol. function=transferase activity, transferring hexosyl groups; Cellular component=mitochondrion; Biological process= metabolic process
  Homolog annotation: Hit_ID=Q2QXL4; Match level="QueryCoverage=98%, HitCoverage=70%, E-value=4e-23, Identity=24%"; Hit description=Rf1 protein, mitochondrial, putative, expressed
  Pfam annotation: Domain name=PPR; Domain location=158-192; Score =29.9; E_value=8.8e-06; Accession=PF01535.11; Description=PPR repeat
  Pfam annotation: Domain name=PPR; Domain location=193-227; Score =38.1; E_value=3.1e-08; Accession=PF01535.11; Description=PPR repeat
  Pfam annotation: Domain name=PPR; Domain location=228-262; Score =17.1; E_value=0.063; Accession=PF01535.11; Description=PPR repeat
  Pfam annotation: Domain name=PPR; Domain location=23-57; Score=39.1; E_value=1.5e-08; Accession=PF01535.11; Description=PPR repeat
  Pfam module annotation: Pfam domain module=PPR::PPR::PPR::PPR; Domain location=158-192::193-227::228-262::23-57
ESSLEMIELALSIFHKIDAPDTYSCSNMIVGLCKLGRLESALEIFDRMNRIGVLPTRSAVNLLIGELCLMSGKEGSVEKVRVRNTRRPYTILVPNMGGNSGAIQPAVQVFWAVCSSGLLPSAFVVVKLMSELCRLGNTVEAVRVLRIVEERKLTSVQEGYSVVINALCECCRVEEASDLFGRMLSCGLKPKLVVYNSVISMLCKFGKLKDATRVFEIMNKNRCLPDGLTYTALIHSHGEVRNWKVSYDLLMEMLGLGWIPHFHTFNLVESLLREHDQLDLCVKLERKLENQKLQKLCKGGELDAAYEKAQSMLEKGIPLSAYARDIFQQ

SEQ ID NO: 133247 - protein, 149 aa, Glycine max
  Coding DNA Sequence Number=SeqID_16469
  Subcellular localization annotation: CTP_CleavageSite=51; ConfidenceScore=5.46e-01
MLSLCRSRHALHVFNASSRFLHSSSSRIPRKAPPSDVVYPSSSSLLSDLVSCATDDAHIRRVFSRHKRDLTSPLVLRVLKSYKQLGRAKTLKFFSLAGTHLGFRFDDSVVEYMADFLGRRKLFDDIKCLFNTMSFHKGRVSPKALSICI

SEQ ID NO: 133248 - protein, 192 aa, Glycine max
  Coding DNA Sequence Number=SeqID_16470
  Homolog annotation: Hit_ID=Q39265; Match level="QueryCoverage=38%, HitCoverage=39%, E-value=1e-21, Identity=70%"; Hit description=Zinc finger protein 6
MAEIEYHAKSNTNTQPLKLFGINISKSPEDQTHEAGSNSEPFSSRKYECQYCCREFANSQALGGHQNAHKKERQLLKRAQMQAARGFVSSQIHNTIISSFSPQSQPPLSWLCTPHGGAYHSGAAFVASGRRIYVAAAGASITDGHGHRHPLPQFGGFNGGEGSGGGRERGLGLDLHLSLYSNIKSSLKVSTC

SEQ ID NO: 133249 - protein, 267 aa, Glycine max
  Coding DNA Sequence Number=SeqID_16471
  Homolog annotation: Hit_ID=Q10MM5; Match level="QueryCoverage=41%, HitCoverage=11%, E-value=4e-15, Identity=40%"; Hit description =Expressed protein
MDAISFIPDIVFPSFFTSMEQNKKGHGFHPDPMNYSYYGQPEHDTELSDSATSFNKGRMDEILSDVVNQIPRALESLLTFGTELTRSKLNHMKDILLNSELVLRIATDRREDQGPQLLIYQFLVDDLDSMVSDAMWTDANGIVGCEDSKQRKELKGFLLDCVIEYLESNCCQYFNSGFKKWTKLPLCMEAEMLAQEVKREINKWLSMVGMVPDEIIEWEMSHSLGKWTDFDIEAFEAGVDIDGDILQILVDEVVQDLQVASRGTIYF

SEQ ID NO: 133250 - protein, 203 aa, Glycine max
  Coding DNA Sequence Number=SeqID_16472
  Gene Ontology: Mol. function=aminoacyl-tRNA hydrolase activity; Cellular component=ribonucleoprotein complex; Biological process =translation
  Homolog annotation: Hit_ID=Q1SIX5; Match level="QueryCoverage=98%, HitCoverage=82%, E-value=3e-80, Identity=77%"; Hit description =Peptidyl-tRNA hydrolase
  Pfam annotation: Domain name=Pept_tRNA_hydro; Domain location=19-193; Score=126.9; E_value=5.7e-35; Accession=PF01195.10; Description =Peptidyl-tRNA hydrolase
MELKWNILLGSLLAWAILVGFEIIDSLSRAEGIQMNTIQSKALIGIGSIGEVPILLAKPQTYMNFSGESVGPLAAYYQVPLRHILLVFDETSLPNGVLRLQPKGGHGHHNGLKNVMGHLDGCSAFPRLAVGIGNPPGTMDLRAYLLQKFSVEERKQKKNMKGLEQIDASLEQAVAAVRTVVLNGFDQHVNRFNLGQKYKYHKV

SEQ ID NO: 133251 - protein, 687 aa, Glycine max
  Coding DNA Sequence Number=SeqID_16473
MNDSTVKNLAITEKKVQQHKPGGCVGIFFQLIDWKRKLSKKKLFSKKLLPPARAKKFKGDEKMPNSKLHLIANENSGGFPGAKKVGNHGLDVEQKSEMRVPSLVARLMGLESIPAAQRDKSKKALCADGKKESLGDHCELDRQGVDLEMGVVKHDSRPQKLQKTGSYERRAVTRFGAEALQIKSVLSRARKYNHHHHQKLASLRTPRIPSGKSASRSSRLIGAATKILEPGLQSRSRAKNSLTYPASMYPPKTGIVTNGVEDGSAIMQNQSCFETSSCKQLMGQTSCKNCGNLLDVLDCKLEVGRQSLVPPPIVSDVITATSMVSLEKKGKSFPPHGHERDVVLPRSQEKLISLVTEGKGKNNAQQSWSEPTARRMPMPHDGPAKWNSSCQPSRALEDDASSFALKHKTQTQEQMLSSERYSSGSTTSDMQVKRVSSSMSAVNGTKDFVAMNRSLSGRSRIRSLTKADGSKFDLEKKPYNRQQSSLSHVRTLERKRRIPNVTQLEGTGSVYSVGTKQRNLHSGGMGGKRRDFNASSLNNSIVKNKQDGQGERVIKVNDNKINDVVSFTFNSSLKQKIEIPGKREETSSDNESMVYFQRPSPLRVDALGAFLEQKLMELTSQRDEELATGAPPKKSSAMILQELISALSSEHLICHDGHHMFNENVCFHFPVAQFHIEFVVNVIPMIC

SEQ ID NO: 133252 - protein, 67 aa, Glycine max
  Coding DNA Sequence Number=SeqID_16474
MGTSLQNLTAAGLRQKATLDTAKRHRRRKSKEQYNYYIATFLNHKHQQTMQLMLYALRLLLQGAKQS

SEQ ID NO: 133253 - protein, 101 aa, Glycine max
  Coding DNA Sequence Number=SeqID_16475
  Gene Ontology: Mol. function=transition metal ion binding; Cellular component=cytoplasm; Biological process=fucose metabolic process
MDIEYQKIHACPNDCILYRHEFEELSKCPRCGVPRYKVKDDEDCSSDENPKKGPPVKVLWYLPIVPRFKCLFANGDDAKDLTWHAKGTNYDGMVRHLADCS

SEQ ID NO: 133254 - protein, 83 aa, Glycine max
  Coding DNA Sequence Number=SeqID_16476
MAYTHIPDSTSDSPQISASPHQLDLAPYASEPYNAQWNAPGLLRDKHTLRSSRILGEMEVDEPWLGLWLPFELSSRYGIEFSI

SEQ ID NO: 133255 - protein, 52 aa, Glycine max
  Coding DNA Sequence Number=SeqID_16477
MASIGKALKTLDGVWSQSYFFHRKSLSICQRFPWSSSFKPLDCGGMEVDAVV

SEQ ID NO: 133256 - protein, 125 aa, Glycine max
  Coding DNA Sequence Number=SeqID_16478
MGEIIKLCASCPHHQINEKFLIQYLYEGLIVDIPCDAASHWSTIECDGSQSTKAVWYICALDHPTDCGSNVFQDYFDDAKESRVKQVSRIKIKIQDSRIIKIKIQDSRIIKIKIQVKRRLNQDKY

SEQ ID NO: 133257 - protein, 145 aa, Glycine max
  Coding DNA Sequence Number=SeqID_16479
  Gene Ontology: Mol. function=DNA binding
  Homolog annotation: Hit_ID=Q1SFS3; Match level="QueryCoverage=67%, HitCoverage=18%, E-value=2e-11, Identity=39%"; Hit description =Lambda repressor-like, DNA-binding
MRVGPVPRRCLEEKAKALANQGEWASFVDILALLIFGVVLFPNVKGVVDLAVIDIFLAFHHGKESPIVAILADMYDTFDRRCEKSSARIVCCTLTLYVWLVSHLFRQEGRPACPLQRHRSCAEKGKANWDQFLASMCWIKWPQNN

SEQ ID NO: 133258 - protein, 103 aa, Glycine max
  Coding DNA Sequence Number=SeqID_16480
MKARVIGGRITLLGVTGTPNDWQSPVINAGNPRALLDLSGSRGCLDGIHQLALRQREIGVMIARQDIAEQQCHPRLGQGGHAGAHDPHPPPSSGPGEILPRCA

SEQ ID NO: 133259 - protein, 142 aa, Glycine max
  Coding DNA Sequence Number=SeqID_16481
  Homolog annotation: Hit_ID=Q1SKD7; Match level="QueryCoverage=97%, HitCoverage=39%, E-value=5e-10, Identity=29%"; Hit description =Ankyrin
MAPKKLSMKRSRKKAAGEGSSTALEFDSHRFRSVEHQQRFEAIKGWSFHRERRVQLREDEYTDFQEEIARRCWTPLVTPMAKFDPEIVLEFYANAWPTEEGVRDMHALSQFLGDPLVLEEGQQCEFSQRRNKADGFDEEAIS

SEQ ID NO: 133260 - protein, 132 aa, Glycine max
  Coding DNA Sequence Number=SeqID_16482
MEAIKEQMATMMKAMMSMKKIMEANAVIVAAISAVAKVNPMLPSSLKQMNHPTSNMVGKDLGSTDDPMMCKFKTSTPSHHMACLPTIHHPMWHTLSMKISITPLRYSLRTNNLIRHMSFKPWKRHMKFPTTI

SEQ ID NO: 133261 - protein, 69 aa, Glycine max
  Coding DNA Sequence Number=SeqID_16483
MDGGGSHRHCAQVQRRLRSRCLVPGGTASHSAQPLQVAAQEQAVVDAVIRQKPSSFSWVSICRLPPTPA

SEQ ID NO: 133262 - protein, 151 aa, Glycine max
  Coding DNA Sequence Number=SeqID_16484
  Gene Ontology: Mol. function=DNA binding; Biological process=DNA recombination
  Homolog annotation: Hit_ID=Q6D8C0; Match level="QueryCoverage=98%, HitCoverage=36%, E-value=2e-47, Identity=55%"; Hit description =Putative integrase
EELSVEEAKSTSYVDLANRKIFFFDTKNRTNHELPICDAAKCLLEDRRDIVLDKETKASRRKWVFPARSPRSQAGHYSDSKSLREYLCEEAGIVKLGTHDLRRTFGRIAEELVSYAVVKRLLNHRNTTDPTESLLASAKYPPIPENAGKDA

SEQ ID NO: 133263 - protein, 71 aa, Glycine max
  Coding DNA Sequence Number=SeqID_16485
MPKSSPNMHVKQVSTRVKPRLLCKQSIGQNTPNKIDDDGSNSHQGENKDSIHKMPRNSYFKNNYPLPVHNL

SEQ ID NO: 133264 - protein, 122 aa, Glycine max
  Coding DNA Sequence Number=SeqID_16486
GVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 133265 - protein, 43 aa, Glycine max
  Coding DNA Sequence Number=SeqID_16487
AFSEELAKRAYRAKRVHPLRMNTHPLADYLLLSEAKSLSPDGF

SEQ ID NO: 133266 - protein, 77 aa, Glycine max
  Coding DNA Sequence Number=SeqID_16488
MSLDQQFLTCSGAAFEVSNCDHHFTKACLCNGGYCLLFSEPDGEVGILSYMFEQYFLEVQQSNILVEWYCSSKTRGG

SEQ ID NO: 133267 - protein, 115 aa, Glycine max
  Coding DNA Sequence Number=SeqID_16489
MRTCFSKETKLPTDQSNICFLDEKQCVYRGRRHFISKRPFRGNTGSNKDRRKSLKVYQSHTGQGLTFSPWVKVYDKLGFWLKACRTAGHDICQGLASGSGIKGMCYIISMIHMRQ

SEQ ID NO: 133268 - protein, 175 aa, Glycine max
  Coding DNA Sequence Number=SeqID_16490
AGESGGAATSLSESSGMSIKGGAGGAGGGGRISTSGEAGGSTTGGCDSTGAGSVLVAELQARPLYLKIAPWIPLACYEPTTAGTIGCACRPSGSMVVVGGGGLDDEGMSSALALFLEAIFFTENTIPAWRPIDLVMPKTYRNDVRLALPEPRLVPHLATSTYPKDEYSSSTDPIA

SEQ ID NO: 133269 - protein, 155 aa, Glycine max
  Coding DNA Sequence Number=SeqID_16491
MNSLSTEGSLSEFIANFQKTAENASGNLLYNKEKNKMKDCKNTSGEDVSFTSRISQSLTNSSQALRTASASNSRLCRSSHSKISQNSLELGPFSLKNLRGLVRARALSADLDRLARISGFWLSTLVLLSGLTEVVRLANLTTHLLLDSSLRLATK

SEQ ID NO: 133270 - protein, 328 aa, Glycine max
  Coding DNA Sequence Number=SeqID_16492
  Gene Ontology: Mol. function=two-component response regulator activity; Cellular component=intracellular; Biological process=two -component signal transduction system (phosphorelay)
  Homolog annotation: Hit_ID=Q8PN44; Match level="QueryCoverage=54%, HitCoverage=83%, E-value=2e-85, Identity=92%"; Hit description=Two -component system regulatory protein
DCADPEPGSGRPPGRGPGAGPCEALARPGQAVAGQRARGGQPAATRRGPTCCCAAPRRSSPTRCATPAPATCGSRCTVKPPTGWWWRPATTVSARIWSMWAMACAACASACNNVVASCRSKPGPVKASGCGRRCRQRCWWPPLPRFLKECVDDSRLPGRRPNPGAAGNPLPAGARRRYRGGGRGRRWPAGGRADTAGASRRGADGHAHAGDVRAGGAAGAVAPGAAAADHHPHHLRRRPAGAGRAQGRCQGLPAQGRDPGAAGRCHPHRGRRRFAGAAGRDPAPAVRPGAHAQRVRQPGPAGPVDRPRDRDPAPDGQWLLQQGDRQFA

SEQ ID NO: 133271 - protein, 133 aa, Glycine max
  Coding DNA Sequence Number=SeqID_16493
  Gene Ontology: Mol. function=transition metal ion binding; Cellular component=chromatin; Biological process=cytoskeleton organization and biogenesis
  Pfam annotation: Domain name=Transposase_21; Domain location=12-133; Score=84.6; E_value=3.1e-22; Accession=PF02992.5; Description =Transposase family tnp2
FKHLFASGDDAKDLTWHAIGRNHLDDCPQWRKIDRLFPDFGKEARNLRLGLASDGMNPYDNLSTQHSSWPVLLPGNDIDVYLSSLIGDLTKLWGEGVLVFDGFRNETFQMRAMLFCTINDFPAYGNLSGYSVK

SEQ ID NO: 133272 - protein, 144 aa, Glycine max
  Coding DNA Sequence Number=SeqID_16494
MKLPPCLEIGSCMRSLTAVGRRSRQGSLMYMNLSIQGNKDKGKDKAIEVSSETNSEATVTVTPPRPKGVVIGSPKWRSSGKAKKSKKKRRRSEYEVTALFRDRKLHEKFDSSWVKKNVANGSYIDLLEIKEYGWDILCFVKKEK

SEQ ID NO: 133273 - protein, 990 aa, Glycine max
  Coding DNA Sequence Number=SeqID_16495
  Homolog annotation: Hit_ID=Q10NT0; Match level="QueryCoverage=99%, HitCoverage=98%, E-value=1e-64, Identity=32%"; Hit description =Expressed protein
  Pfam annotation: Domain name=DUF593; Domain location=623-716; Score =180.2; E_value=4.9e-51; Accession=PF04576.6; Description=Protein of unknown function, DUF593
MAANKFATMLQRNTNKITLVLVYAILEWILIILLLLNSLFSYLIIKFADYFGLKRPCIWCTRIDHILEPGKYKSSCKDLVCEAHASEISKLGFCSNHHKLAESQDMCEDCSSSSQPDYVKLSQSFGFFPWMKQIGMIQDEGAEDAVDKAIVKVEEALRCSCCGVNLDNRFYPPCILIKPSLNVLEYDQKQNSERRVGVEIDEDHTRSDIVLDHHQEEKENEENKGSHMVFEVDRGLDRKDEEVEKSCDCSVCDGVEILCDEICNLDLGVEKGKETIEEESLNVPKPKDNDGDDVVAAADDEDQACEKSTAQVDCTREITVETPSIHLEFFIHGDDCRLIPIELVDSPALENRKQSKYKVGGEGINSNEDFILDFDKSADAEAEPVVENWHISGDIVAEFSAQGNENVSKSNGGESVQLRTRGQSSELLQVEEENLEQNCEDVRFVQTSDDLTKDDNVEVNMERRDAELCSDVSLASEDASQMEGEEYEAEVSIGTEIPDQEQVDEYQSQDVLLDTNQQMQEDPSTSTVRFNVQDEIGHDKGEEFVEFKTMSLEVKMPTVNNHLPSLLELNENEEEKVPETPTSLESLHQLHKKLLLLERKESGTEESLDGSVISDIEGGEVTIEKLKSALKSERKALSTLYAELEEERSASAIAANQTMAMINRLQEEKAAMQMEALQYQRMMEEQSEYDQEALQLLNELMMKREKEKLELEKEIEVYRKKVHEYEVREKMMMSRRDGSMRSRTSSPSCSNAEDSDGLSIDLNHEAKEENGFCSHQDQECSNQNTPVDAVLYLEESLANFEEERLQILEQLKVLEEKLVILNYEEDHCSDDAKSVEHLCEENGNGYHHDHDDHNGQVNGFANGHVKEINGKHQGRKIMGAKGKRLLPLFDAMSSEADVELSGDELDFPHLQNNSVEKVNSDKKKLALEDEVDNVYERLQVLEADREFLKHCISSLRKGDKGLHLLQEILQHLRDLRNVELRLRNMGDLAV

SEQ ID NO: 133274 - protein, 1325 aa, Glycine max
  Coding DNA Sequence Number=SeqID_16496
  Gene Ontology: Mol. function=nucleic acid binding; Cellular component= beta-galactosidase complex; Biological process=DNA integration
  Homolog annotation: Hit_ID=Q1SRN1; Match level="QueryCoverage=98%, HitCoverage=98%, E-value=0.0, Identity=54%"; Hit description =Integrase, catalytic region
  Pfam annotation: Domain name=rve; Domain location=620-774; Score =127.9; E_value=2.7e-35; Accession=PF00665.16; Description=Integrase core domain
  Pfam module annotation: Pfam domain module=RVT_2::rve; Domain location=897-1109::620-774
MDPLFPSSQVKLPHLISVKLDDKNFKQWKQQIDGVVRGHRLQRFVTVPVIPPPSSSGSDSSLHDANSRYSNWEQQDALICTWLLSTISDSILPKLVDCKHAWQVWMEVHRYFGTLLSTKARQLRSELRRLTKGTLTIAELMIRVREISESLVSIGDPVPLRNLIEIVLDALPEEYDSIVAAINSKEEVGSLDELESSMLAHESRLEKHRKAILTEPVTVNLTQASKPSSPATSDQSSAGTDAFPQGTSHVTANAENHGYGSRGGRSNRGGGRFGRGGGRFGKTQCQICHKSGHDASICYYRYSNSVAAMYQPQRAPFNPFLMPSRPMYQPPFSYAAPRGAPQPQVFYAGTDAGFSNQWWYPDSGASHHVTPDPSNVSDSTSVPGTEQVFMGNGQGLSIHSIGSMPFPLPNYPHMSLTLQNLLLVPHITKNLMSVSKFAQDNKVFFEFHPKFCVVKSQASSEVLLRGLVEADGLYKFLIPASQISKSPPSLNSCIAESSNKCSSSSLCSSVANENDSYNCISLCTTDLFMNKDNSMCSNFPSLNATTYDSLSSQHVNNSLSIATNKYVLWHSRLGHPHHHALTEVFKLCHLPVPSKPLAELCSACCLGKSHRLPTSLSATVYSQPFELVVCDLWGPAPMQSLGGYNYFLTCVDAFSRFVWVFPLRLKSDTLPQFIQFKKMVELQFNYPIKSVQSNGGGEFRPFTKYLNDLGIVHRFTCPHTHHQNGIVERKHRYTVETGLALLAQSTLPLKFWDHSFVTAAYLINRLPSGIQLLIKATSVWLPMATSTSLKMSCSKSPNSLTPHYSTLFHTIPSSVPTKSSTTSFFTVPLMSPTPIHQVSPKPSTSATPLSSAPTDAASNGSPNTVPEPNNLSEQSPVLSSSPNTSFHNSTSAPELITYDLAEASYEGRVLGTDEKSDLDTENSDGSLNKYKARLVAKGFHQQAGSDFTETFSPVVKPVTVRIVLTLAVTHKWTIQQIDVNNAFLNGTLEEEVFMQQPPGFESSDKSLASKCDPSLFLLHHGKLQIMILVYVDDIIITGNSASFITALIKHLNDVFSLKQLGKLDYFLGIEVTHLPNGSLLLSQSKYITDLLAKVNMTSANGMPTPMVSSNKLSKIGSNEVDDPTQFRSVVGALQYATLTRPEISFSVNKVCQFLSNPLEEHWKAVKRILRYLSGTKHHGLLIQPASLQQPLHLLGFCDADWASDPDDRRSTSSACVFLGPNLSLLRELHCPFQTPKVLCDNLSTVTLAHNPVLHNRTKHMELDIFFVREKVLNKSLVVAHVPAQDQWADAFTKPLSANKFLPLRSKLRVFDKHSLLGLSSASKGE

SEQ ID NO: 133275 - protein, 61 aa, Glycine max
  Coding DNA Sequence Number=SeqID_16497
MGFVFKLLTDDLFLYGYRQKNWQHSYHVGAATEDGEMHWRHQRNNYLVNSSDNIRKNRLPY

SEQ ID NO: 133276 - protein, 154 aa, Glycine max
  Coding DNA Sequence Number=SeqID_16498
  Gene Ontology: Mol. function=protein serine/threonine kinase activity; Cellular component=integral to membrane; Biological process=protein amino acid phosphorylation
  Homolog annotation: Hit_ID=Q17U57; Match level="QueryCoverage=72%, HitCoverage=53%, E-value=9e-31, Identity=57%"; Hit description =Receptor protein kinase, putative
  Pfam annotation: Domain name=Pkinase_Tyr; Domain location=56-153; Score=-142.7; E_value=0.001; Accession=PF07714.7; Description =Protein tyrosine kinase
MEKDKSHTHSFLHSIVKHFKFGSPKERNNEADVHQMAAQEQKIFAYETLTAATKNFSAIHKLGEGGFGPVYKGKLNDGREIAVKKLSHTSNQGKKEFMNEAKLLARVQHRNVVNLVGYCVYGTEKLLVYEYVAHESLDKLLFSKCFNANPYSVQ

SEQ ID NO: 133277 - protein, 262 aa, Glycine max
  Coding DNA Sequence Number=SeqID_16499
  Gene Ontology: Mol. function=protein serine/threonine kinase activity; Cellular component=membrane; Biological process=protein amino acid phosphorylation
  Homolog annotation: Hit_ID=O65470; Match level="QueryCoverage=74%, HitCoverage=31%, E-value=4e-54, Identity=53%"; Hit description =Serine/threonine kinase-like protein
  Pfam annotation: Domain name=Pkinase; Domain location=1-188; Score= -39.5; E_value=3.3e-06; Accession=PF00069.15; Description=Protein kinase domain
  Pfam annotation: Domain name=Pkinase_Tyr; Domain location=1-188; Score=-78.3; E_value=1.1e-07; Accession=PF07714.7; Description =Protein tyrosine kinase
  Pfam module annotation: Pfam domain module=Pkinase::Pkinase_Tyr; Domain location=1-188::1-188
MDDAESEKREELDWKRRVGIITGVAKGLLYLHEDSHNCIIHRDIKASNILLDEKWTPKIADFGMARLFPEDQTQVNTRVAGTNGYMAPEYVMHGNLSVKADVFSYGVLVLELITGQRNSSFNLDVDAQNLLDWAYKMFKKGKSLELVDSALASRMVAEEVAMCVRLGLLCTQGDPQLRPTMRRVVAMLSRKQGNMQEPTRPGIPGSRYRRPPRRHSALSSTLGTSGSDSSNNDNTTVTTSATGTSSATAETDPKGKRPMREA

SEQ ID NO: 133278 - protein, 154 aa, Glycine max
  Coding DNA Sequence Number=SeqID_16500
  Homolog annotation: Hit_ID=Q9ZU41; Match level="QueryCoverage=90%, HitCoverage=25%, E-value=1e-08, Identity=40%"; Hit description =Predicted by genscan and genefinder
MHHAFTFRIWTKLPRYTGEDSDGDYYRDSCSEGSSDYEYGKRTEFMTQRSSQYLTGGISLQMNTLSMHDKHSTVQEGFSSDDSETGNPQDLLFEYFEQDPPYSREPLADKAITDPLLMCDLFTHNLICPSYTYNILTDSRSCTPLSCPQVVEKL

SEQ ID NO: 133279 - protein, 96 aa, Glycine max
  Coding DNA Sequence Number=SeqID_16501
MVADYSICNAYCLMKSTTRVNVVLRGQNDFGPLMQHDLKLNQKIGNMSTIQFYNNPLKEIVANSKFLTVGKVEGEVDSTYGLSGKDRLKRLNRGER

SEQ ID NO: 133280 - protein, 155 aa, Glycine max
  Coding DNA Sequence Number=SeqID_16502
  Gene Ontology: Mol. function=protein serine/threonine kinase activity; Cellular component=integral to membrane; Biological process=protein amino acid phosphorylation
  Homolog annotation: Hit_ID=Q9FF35; Match level="QueryCoverage=79%, HitCoverage=12%, E-value=6e-29, Identity=56%"; Hit description =Similarity to protein kinase
MANLLMDNDNNVHMSFGVVLIELISSMPAVDISRRRHEINLSNMAIKKIQSGALHEIVDTTLGFETDFKVRKMISDVAELAFQCLQSSKDVRPSMAEVLDMLEDIRSDGSYKSKHEVQEDISEDDDALLKNVPPPPSPHSHLVTISNSTPPNGSQ

SEQ ID NO: 133281 - protein, 50 aa, Glycine max
  Coding DNA Sequence Number=SeqID_16503
MEEKKKKKLKEVAQSRSTDSVINRPSPIRRHIHWRSRLHRVPLLPLDAKN

SEQ ID NO: 133282 - protein, 84 aa, Glycine max
  Coding DNA Sequence Number=SeqID_16504
MESSTVTTYPSARRRCGAHGCVFQERKMRRVATNIYSRKMSEKLERFGLRTLSVKGSGVVFMHGEGYFPRSYVFLNCDKEIRPT

SEQ ID NO: 133283 - protein, 744 aa, Glycine max
  Coding DNA Sequence Number=SeqID_16505
  Gene Ontology: Mol. function=zinc ion binding
  Homolog annotation: Hit_ID=Q10PC5; Match level="QueryCoverage=99%, HitCoverage=91%, E-value=1e-159, Identity=42%"; Hit description =Tropomyosin, putative, expressed
  Pfam annotation: Domain name=DUF1423; Domain location=216-739; Score =740.5; E_value=1.1e-219; Accession=PF07227.2; Description=Protein of unknown function (DUF1423)
  Pfam annotation: Domain name=PHD; Domain location=369-431; Score=0.9; E_value=0.046; Accession=PF00628.19; Description=PHD-finger
  Pfam module annotation: Pfam domain module=DUF1423::PHD; Domain location=216-739::369-431
CENSNQDGKWVERDFLSLSEPREDSSKRSLEEVVERESNREKKPKLETLNLSLALPDVSLSLTASNALQNGDQQQPIRTKPCRPSTTTHTSYSNDYTAASLSYSYSHPFSHNPSCSLTRNSTDNFDYSVSKDDQIWNCGEGTNGSVHSRFKPIGDGLVGLSNHGGAAGGISSFMQGNNSQYKTTSSDNHSFFPSELPARSRFEAQSGDSRGRNSKNLRILEGLDDGKVRKISRPERIVREIVSESIPVMALTIQELTDDVIASTKEYLRNLIEKPEKKEELVSLQNRLERRSDLTKESLSKCHKVQLEVLVAVKMGLASFLSNKIQLSEMVEVFLFKRCRNVTCKHLLPVDDCDCKICSGNKGFCSSCMCPVCLNFDCASNTCSWIGCDVCSHWCHATCGIQKNLIKPGPSLKGPSGTSEMQFHCIGCGHASEMFGFVKDVFVCCAKDWGLETLMKELDCVRKIFRGSEDCKGKELHVKTDDMLLKLQTKMISPLDACNYIMQFFSYIFILALAFCTEVLHEIGSNGMPLVLENCSGGRNWKDAYITVTYADSMSDFHTSGISSKDLPASQSNLTKDTPSLSKPNSLLPEYGYDMGYSRSHPDAMSSDLLQKDLKASILSELKNEADFHLGALLRKGGLESLESIVRIKEAEARMFQTKADEARREAEGFQRMIRTKTAQMEEEYAEKLSKLCLHETEETQRKKLDELKVLENSYFDYYKMKKRMQDEIDGLLRRMEATKQQWV

SEQ ID NO: 133284 - protein, 98 aa, Glycine max
  Coding DNA Sequence Number=SeqID_16506
VLLGHQIPKIGGMMNVLSGATLFRNHPCTQHLYDSCKNRDSLGSDQGVPIDVKRIKVISEWPTPTPPRGVCVAKLKHLISRSYALTSQGSFSRKLLKE

SEQ ID NO: 133285 - protein, 459 aa, Glycine max
  Coding DNA Sequence Number=SeqID_16507
  Homolog annotation: Hit_ID=Q1ZY19; Match level="QueryCoverage=91%, HitCoverage=76%, E-value=3e-21, Identity=23%"; Hit description =Fgenesh protein 60
  Pfam annotation: Domain name=DUF247; Domain location=8-448; Score =109.0; E_value=1.4e-29; Accession=PF03140.6; Description=Plant protein of unknown function
MQSIERDLQTQQPKIQRVDIHMRKNQNFAKYFSPRMLSIGPIHHGKENLRLGEHYKLIWTAMYLKESKQNPEDLCQKIELHIEEVKGFYTKEAIGDYNDNDLVWMLFVDGCSVLQIMQKLDAVHPKKLRIKFDQQEHVIMDLHLLENQVPYKVLELLSNNDEAMLLHSMFNLGFDGFLSYIVYDSLIPFNDSESWAKIFEKLLSDEDLPQAKRKPNHVLDFVRLMFLKIDYKDLMVNKSKQENEIPKKGDGEHKIDVKGRHSSWLTYKNIRELKAAGIQVRKNETLCLNNVSFVSKWFSGELTLPWFHVDELFFYIYLNMIAYEKCPDFHYNYDICSYLAFLDTLVDDANDLKELRLAGVCQNTLGSDEEVAKLLNSIGTELASKEFCLLSTGMMAYNEKYTRVRDEIKKHCNTKWKTWMAQVYNTHFSNPWSICAFLAAALALVLTAIQTWLAFLSNN

SEQ ID NO: 133286 - protein, 96 aa, Glycine max
  Coding DNA Sequence Number=SeqID_16508
MKLVEDNKSLEDQVLALTIEAKGLETRAANAEALVKSREDTGVFDINKDVYDGKLVLIDDISKDAASTLERLMTLAEDFHAKDADAEDEDHTRPRE

SEQ ID NO: 133287 - protein, 130 aa, Glycine max
  Coding DNA Sequence Number=SeqID_16509
MGHKKVLALIMFVMAYGLGTTTFSTVSQHLPAKCNGYEPLIDTCKPDLTAPGSGVHPTLECCVLANYAFTIAMQNNGRGVGNMCDCLQFATKTLHYDPYKIIGLPGACNIKTDIPIAICIFWPNDESSDN

SEQ ID NO: 133288 - protein, 179 aa, Glycine max
  Coding DNA Sequence Number=SeqID_16510
  Gene Ontology: Mol. function=nucleic acid binding; Biological process= DNA integration
  Homolog annotation: Hit_ID=Q1SIY6; Match level="QueryCoverage=91%, HitCoverage=15%, E-value=3e-39, Identity=49%"; Hit description =Integrase, catalytic region; Zinc finger, CCHC-type
MRPNTRKTRTLMERDQVQHQPMQKEIGINLIHLANIAERKDILHSYVGKDPMLSAVSVIKWGMKLLFAKIGINHIVKLQRLLIWRRSTCLLLHVFSNIESSQNRLIDSGCTNHMTNNKDLFKELSNISTLKVRVGDDKFITMNGKGTTTISTNKDEEDNDILKVKMREKSFALNPLEEK

SEQ ID NO: 133289 - protein, 163 aa, Glycine max
  Coding DNA Sequence Number=SeqID_16511
  Gene Ontology: Mol. function=ribonuclease H activity; Cellular component=mitochondrion; Biological process=DNA integration
  Pfam annotation: Domain name=rve; Domain location=22-147; Score=-6.4; E_value=0.02; Accession=PF00665.16; Description=Integrase core domain
  Subcellular localization annotation: CTP_CleavageSite=25; ConfidenceScore=5.15e-01
MPPMPKAWKSNTSVGQRVTSNGFPLVVAIWTLNILGPFPTTPGKRKFLLVAVDYFTKWVEVEPLTNIMAYAIKKFFWKNIITCFEIPNTLHPQANGQAKATNKVILEELKKWLDGAKGRWAKELAKVLLANKCTPQSITQETHFRLTYGTNMMLSIEVEEVSL

SEQ ID NO: 133290 - protein, 153 aa, Glycine max
  Coding DNA Sequence Number=SeqID_16512
  Gene Ontology: Mol. function=DNA binding; Cellular component=proton -transporting two-sector ATPase complex; Biological process=DNA integration
  Homolog annotation: Hit_ID=Q1T2W1; Match level="QueryCoverage=99%, HitCoverage=23%, E-value=5e-42, Identity=50%"; Hit description =Integrase, catalytic region; Asp/Glu racemase
MGIFYKKGGAEDLFAFTDSDYAGDEEDSKSTSGYVFLLSSRAMSWMSKKQPIITLSTIEAEFVAPTVSSACQAVWMRRVLRNLNHAQEVMYGKSKHIRVGFHFLRDLVKDGEIELAHCGTQEQVADLMTKALKLEAFQKLRKKMGMLDLTEVD

SEQ ID NO: 133291 - protein, 173 aa, Glycine max
  Coding DNA Sequence Number=SeqID_16513
  Gene Ontology: Mol. function=nucleic acid binding; Cellular component= endoplasmic reticulum membrane; Biological process=DNA integration
MGYSQQHGIDFIEVFAPDACMDTVRMIVALAACKGWNIFQLDVKSAFLHGELREDVYIEQPKGYVKKGKEHNIYKLHKALYGLRQAPRAWFSRIESHFVKKGFQKCPNEQTLFIKRGTKDNILIVSIYVDDLIYAGNDKGMMIEFKQSMMQAFDMTGLGKMRFFLGIEVLKKS

SEQ ID NO: 133292 - protein, 51 aa, Glycine max
  Coding DNA Sequence Number=SeqID_16514
MEIIERRQPAWMGEFVNGEGLSEEEAEAYMVQDVVGDDPTQFEEAMKHEKW

SEQ ID NO: 133293 - protein, 158 aa, Glycine max
  Coding DNA Sequence Number=SeqID_16515
  Gene Ontology: Mol. function=enzyme inhibitor activity; Cellular component=cell wall; Biological process=cell wall modification
  Homolog annotation: Hit_ID=Q708X4; Match level="QueryCoverage=79%, HitCoverage=22%, E-value=4e-40, Identity=60%"; Hit description =Pectin methylesterase
  Pfam annotation: Domain name=PMEI; Domain location=17-152; Score =30.9; E_value=4.5e-06; Accession=PF04043.6; Description=Plant invertasepectin methylesterase inhibitor
MVIQECKEIYENSLVDGRPPKAGSTFYLELCFSAIAYEPNITHKVTNHCDVIQLSLSVTFRAVKHNYFIMKKLLTKQDLMKHVHDCLEIIDETFNKLRETHNDLELYPNMKTLYQHANDLKILISVAITNQVMCLDGFSHDDTDKHMRETNLKEKARL

SEQ ID NO: 133294 - protein, 347 aa, Glycine max
  Coding DNA Sequence Number=SeqID_16516
  Homolog annotation: Hit_ID=Q1T6B2; Match level="QueryCoverage=97%, HitCoverage=43%, E-value=1e-178, Identity=93%"; Hit description =Exocyst complex component Sec6
  Pfam annotation: Domain name=Sec6; Domain location=1-346; Score= -62.7; E_value=7.6e-05; Accession=PF06046.3; Description=Exocyst complex component Sec6
VTGWVVEYQDNLIGLGVDESLAQVCSESGAMDPLMNSYVERMQATTRKWYLNILEADRTQPPKKTEDGKLYTPAAVDLFRILGEQVQIVRDNSTDLMLYRIALATIQVMIDFQAAEKKRLEEPASEIGLEPLCAMINNNLRCYDLAMELSNSTIEALPQNYAEQVNFEDTCKGFLEVAKEAVHQTVSVIFEDPGVQELLVKLYQKEWSEGQVTEYLVATFGDYFGDVKILLRKTKFRPSIYSRYIEERSFRRFVEACLEETVVVYVDHLLTQKNYIKEETIERMRLDEEVIMDFFREHISVSKVENRVSVLSDLRELASAESLDTFTLIYTNILEHQPDCPVKLCPI

SEQ ID NO: 133295 - protein, 825 aa, Glycine max
  Coding DNA Sequence Number=SeqID_16517
  Gene Ontology: Mol. function=hydrolase activity; Cellular component =intracellular; Biological process=metabolic process
  Homolog annotation: Hit_ID=Q1SZI6; Match level="QueryCoverage=99%, HitCoverage=70%, E-value=0.0, Identity=73%"; Hit description =Tetratricopeptide-like helical
  Pfam annotation: Domain name=PPR; Domain location=119-153; Score=7.3; E_value=1; Accession=PF01535.11; Description=PPR repeat
  Pfam annotation: Domain name=PPR; Domain location=185-219; Score =33.3; E_value=8.7e-07; Accession=PF01535.11; Description=PPR repeat
  Pfam annotation: Domain name=PPR; Domain location=220-254; Score=3.8; E_value=2.7; Accession=PF01535.11; Description=PPR repeat
  Pfam annotation: Domain name=PPR; Domain location=286-320; Score =35.5; E_value=1.8e-07; Accession=PF01535.11; Description=PPR repeat
  Pfam annotation: Domain name=PPR; Domain location=387-421; Score =46.4; E_value=9.4e-11; Accession=PF01535.11; Description=PPR repeat
  Pfam annotation: Domain name=PPR; Domain location=422-456; Score=8.5; E_value=0.74; Accession=PF01535.11; Description=PPR repeat
  Pfam annotation: Domain name=PPR; Domain location=488-521; Score =34.2; E_value=4.5e-07; Accession=PF01535.11; Description=PPR repeat
  Pfam annotation: Domain name=PPR; Domain location=588-622; Score =39.9; E_value=8.5e-09; Accession=PF01535.11; Description=PPR repeat
  Pfam annotation: Domain name=PPR; Domain location=623-657; Score =17.8; E_value=0.04; Accession=PF01535.11; Description=PPR repeat
  Pfam annotation: Domain name=PPR; Domain location=659-693; Score=1.7; E_value=4.8; Accession=PF01535.11; Description=PPR repeat
  Pfam annotation: Domain name=PPR; Domain location=725-759; Score=0.8; E_value=5.9; Accession=PF01535.11; Description=PPR repeat
  Pfam module annotation: Pfam domain module=PPR::PPR::PPR::PPR::PPR::PP R::PPR::PPR::PPR::PPR::PPR; Domain location=119-153::185-219::220 -254::286-320::387-421::422-456::488-521::588-622::623-657::659 -693::725-759
MLFEDEESKTESAMLIMSKSIATLTTYPTYHSHRNKSNYAKSPNCFILFRQSWSTFLLPSNMDLSCGSSVGVSATLSETTHNNVTVDKNAKICKFCEMGDLRNAMKLLSRSQRSELELNTYCSVLQLCAELKSLEDGKRVHSIISSNGMAIDEVLGAKLVFMYVNCGDLVKGRRIFDGILNDKIFLWNLLMSEYAKIGNYRESVGLFEKMQELGIRGDSYTFTCVLKGFAASAKVRECKRVHGYVLKLGFGSYNAVVNSLIAAYFKCGEVESARILFDELSDRDVVSWNSMISGCTMNGFSRNGLEFFIQMLNLGVDVDSATLVNVLVACANVGNLTLGRALHAYGVKAGFSGGVMFNNTLLDMYSKCGNLNGANEVFVKMGETTIVSWTSIIAAHVREGLHYEAIGLFDEMQSKGLRPDIYAVTSVVHACACSNSLDKGREVHNHIKKNNMGSNLPVSNALMNMYAKCGSMEEANLIFSQLPVKNIVSWNTMIGGYSQNSLPNEALQLFLDMQKQLKPDDVTMACVLPACAGLAALEKGREIHGHILRKGYFSDLHVACALVDMYVKCGLLVLAQQLFDMIPKKDMILWTVMIAGYGMHGFGKEAISTFEKMRVAGIEPEESSFTSILYACTHSGLLKEGWKLFDSMKSECNIEPKLEHYACMVDLLIRSGNLSRAYKFIETMPIKPDAAIWGALLSGCRIHHDVELAEKVAEHIFELEPENTRYYVLLANVYAEAEKWEEVKKIQRRISKGGLKNDQGCSWIEVQGKFNIFFAGDTSHPQAKMIDSLLRKLTMKMNRGGYSNKIKYALINADDRLKEVLLCAH

SEQ ID NO: 133296 - protein, 249 aa, Glycine max
  Coding DNA Sequence Number=SeqID_16518
  Gene Ontology: Mol. function=zinc ion binding
  Homolog annotation: Hit_ID=Q1SZI5; Match level="QueryCoverage=94%, HitCoverage=76%, E-value=8e-83, Identity=66%"; Hit description=Zinc finger, RING-type; RINGv
  Pfam annotation: Domain name=zf-C3HC4; Domain location=181-238; Score= 12.4; E_value=0.0082; Accession=PF00097.15; Description=Zinc finger, C3HC4 type (RING finger)
MDQAISKGSGEILNHVDERVDEDLNQLVEGKAIDAGAGHSLGEGVSVSGEDGTSEEMCNDLRLKKELKEGPQEVNDQNMGDPQEINDTLHGVDQGTSYSSRDLVSGEVPETCVVIDPFTQIECVNGDNRKLEAKPKESGLNKVSMKVTKGVSETDKNSCVIDINRGSCDGFSENLEGEMICRICHLASGQRLEAADVGTASSATTNTDLIQLGCACKDELGIVHSHCAEAWFKLKGNSFLLMPATLNMP

SEQ ID NO: 133297 - protein, 1028 aa, Glycine max
  Coding DNA Sequence Number=SeqID_16519
  Gene Ontology: Mol. function=binding; Cellular component=integral to membrane; Biological process=electron transport
  Homolog annotation: Hit_ID=Q8KT64; Match level="QueryCoverage=99%, HitCoverage=49%, E-value=0.0, Identity=32%"; Hit description=PalA
  Pfam annotation: Domain name=Fil_haemagg; Domain location=133-202; Score=28.7; E_value=2.1e-05; Accession=PF05594.4; Description =Haemagluttinin repeat
  Pfam annotation: Domain name=Fil_haemagg; Domain location=2-59; Score= 8.8; E_value=3.3; Accession=PF05594.4; Description=Haemagluttinin repeat
  Pfam annotation: Domain name=Fil_haemagg; Domain location=213-284; Score=27.5; E_value=4.6e-05; Accession=PF05594.4; Description =Haemagluttinin repeat
  Pfam annotation: Domain name=Fil_haemagg; Domain location=296-383; Score=26.0; E_value=0.00013; Accession=PF05594.4; Description =Haemagluttinin repeat
  Pfam annotation: Domain name=Fil_haemagg; Domain location=462-514; Score=14.9; E_value=0.3; Accession=PF05594.4; Description =Haemagluttinin repeat
  Pfam annotation: Domain name=Fil_haemagg; Domain location=684-738; Score=7.0; E_value=5.1; Accession=PF05594.4; Description =Haemagluttinin repeat
  Pfam annotation: Domain name=Fil_haemagg; Domain location=71-129; Score=25.5; E_value=0.00019; Accession=PF05594.4; Description =Haemagluttinin repeat
  Pfam module annotation: Pfam domain module=Fil_haemagg::Fil _haemagg::Fil_haemagg::Fil_haemagg::Fil_haemagg::Fil_haemagg::Fil _haemagg; Domain location=133-202::2-59::213-284::296-383::462 -514::684-738::71-129
MQSAQNLALRIKQDIDNHSGKVSAQGQLTVQGAADGEHAGTINNTGGEWLAGQALTIAARSLDNVQAGQLYSQKQLRLNLNGGLDNRGGKIQSGDALALDAQALNNAGGTIDGQQRVALRILGLLENTGGAVRSNGGQEVSAAGINNTRGVFSSRGGITVASKQLDNTGGTLISQGAGTYRLDRLNNQHGKVHSGDALTLEGAQVNNRGGQLVSTHGLALKAGTLDNSGQGTLSSQAELDVQAERLNNRDGGLILGTTRTDITSRDIDNTAGRLQSSGQMTLSGVTQLDNRQGRILANGNLNINTDRSRTDSPLALLNQGGRVESAGQLTLHARTLDNQNGTLLGLQALTLSAQQDYTHQAGETISSNGTVTFSLSGAFTNLADWLLPGKLALNAASITNPAALVGKTLQLTTGALQNTGRLEADSMTLNVDTLDNAAALMGDDITVNGRIIDNHGAPAVMAATHSLTVQAGERLTNREGALIYSADRLHLHSDDLIENRASFIEADGDATVEARRLNNLREGLVIERNAEKSDYKWHRYNYYWRSYGSKVNPDKSTLAPTTQQLTYQDDAAAQTNRYGTLLAIDVAGKRAQVRVKDNKGQLTDLWVNYLALKPNADGSYAVTFYETRGGNQLATIPTPYQNGFHWEHDWTQVMTWDPEKHVDIDSAPFITDYNNFRERTESGTVTRDKLVSEGIGARILAGGNMVLRITGALLNDASVITANGNLTQDGGGSVDNRGYSVNERRQAAIVDHYDKDTHHWYPTFNRDETTALATVDGVITGNGTVTINGARITNTTVNQAQISQLDAALKAVDAERAELERNPLAFTVEGAARPDGDTTLAPGEQMTRPGDTPSSPLGRPLLPSELALTQLQHLGNVATAIPNNGLFSQHTATGSPFLVVTDERFTRRDNFISSDYMLERVGYDPAQAHKRLGDGFYEQRLVREQVLALTGKPSVKGWDAMEQYQQLMNNGSKVAQDFHLVPGVALTPEQIAALQQDIVWLVSETVQTEGGPQTVWVPKVYLAQIRCA

SEQ ID NO: 133298 - protein, 116 aa, Glycine max
  Coding DNA Sequence Number=SeqID_16520
MAIDNDECIVAIVVDGGDGHGVLARLDVEVYTDQEKFVVAVEGLDVVASSGVPYTEGTIIRVESKDQDSLEMSLEWPMKWWRREMMTKDHNFTCEGQGFVDGGQHFGASIIGELHT

SEQ ID NO: 133299 - protein, 309 aa, Glycine max
  Coding DNA Sequence Number=SeqID_16521
  Gene Ontology: Mol. function=molecular_function; Cellular component =membrane; Biological process=auxin mediated signaling pathway
  Homolog annotation: Hit_ID=Q9LI65; Match level="QueryCoverage=91%, HitCoverage=84%, E-value=7e-86, Identity=50%"; Hit description =Nodulin-like protein
  Pfam annotation: Domain name=DUF6; Domain location=1-109; Score=13.3; E_value=0.012; Accession=PF00892.11; Description=Integral membrane protein DUF6
  Pfam annotation: Domain name=DUF6; Domain location=150-280; Score =38.5; E_value=2.3e-08; Accession=PF00892.11; Description=Integral membrane protein DUF6
  Pfam module annotation: Pfam domain module=DUF6::DUF6; Domain location=1-109::150-280
MVNILLKKVLQEGMNHLVFITYRLSVATIFLAPIGYFKERASVTQYFFLLGIQYTSATFACAFVNMVPVITFIMALPFGLETVNIKCKGGKAKILGTFVCIGGALLLTLYKGKPLFDGSHYQSAMDQASSTTRSTQKWTIGVIALIMGTLFWSFWFILQSKIGKRYPCQYSSTAIMTFFGAMQAAILGFSTGSSNLSSWVLKDKIQIITVLYSGIVGSSVCYVGMSWCVKKRGPVFTAAFSPLVQIMSGMIDIPFLHEQLHLGSVVGSMLVMIGLYILLWGKSKDMMQNNGATKFAQEVEETKEQEPQV

SEQ ID NO: 133300 - protein, 314 aa, Glycine max
  Coding DNA Sequence Number=SeqID_16522
  Homolog annotation: Hit_ID=Q6DXT6; Match level="QueryCoverage=90%, HitCoverage=83%, E-value=6e-51, Identity=39%"; Hit description =Putative G-protein beta
  Pfam annotation: Domain name=WD40; Domain location=212-253; Score =38.0; E_value=3.2e-08; Accession=PF00400.22; Description=WD domain, G-beta repeat
  Pfam annotation: Domain name=WD40; Domain location=46-84; Score=1.7; E_value=23; Accession=PF00400.22; Description=WD domain, G-beta repeat
  Pfam module annotation: Pfam domain module=WD40::WD40; Domain location=212-253::46-84
MAEKDVPKLKLKPRRLKGHDDSTTCCIASRERSHLIVTSGDAAAQWKPLENYNYNKEEINKVVCNSKSSFVAAADDNGEVKLTVPGLSLQIPHSFPSCLLILVLPNRFFLSSNYPAMCAATFDVSSGIAGRCVNPAFVHAIAVPEVDMLDKLDKICAAARGDGAIDVINIETEMAATKSKSSSNSRKGSHSRSKDGSSSSNTDADQNGKKRLHLNYTLGGHTAAVSSLAFSLFGERGKFLISGGNDKLVKIWNWSCYPDVGLSDDNNNNILHLNIEVSRKVNWLCTTSADTDNLVVCDTSKVVKEYGKGFCNAF

SEQ ID NO: 133301 - protein, 974 aa, Glycine max
  Coding DNA Sequence Number=SeqID_16523
  Gene Ontology: Mol. function=cellulose synthase (UDP-forming) activity; Cellular component=membrane; Biological process=cellulose biosynthetic process
  Homolog annotation: Hit_ID=Q2IB43; Match level="QueryCoverage=99%, HitCoverage=100%, E-value=0.0, Identity=75%"; Hit description =Cellulose synthase 1
  Pfam annotation: Domain name=C1_3; Domain location=7-40; Score=11.6; E_value=0.022; Accession=PF07649.3; Description=C1-like domain
  Pfam annotation: Domain name=Cellulose_synt; Domain location=176-968; Score=1994.4; E_value=0; Accession=PF03552.5; Description=Cellulose synthase
  Pfam module annotation: Pfam domain module=C1_3::Cellulose_synt; Domain location=7-40::176-968
MVQSSVPLCNTCGEQVGLNDNGEVFVACHECNFPICKDCFEHEINEDHRVCMRCGTPYEERTKEEDDFHEIKVHENEDDDFHEIKVHENQSATPSEISNSQDVGLHARHVSTVSAVDSEVNEESGKSIWKNRVESWKGKDKKNKKKKSAPKEEKEASIPPEQQMEETRPAEAAAAPLSVVIPMSKSKIAPYRTVIIMRLIILGLFFHYRVTNPVESAFPLWLTSIICEIWFAFSWVLDQFPKWSPINRQTFIDNLSARFEREGEPNELAAVDFFVSTVDPLKEPPLITANTVLSILAVDYPVDKVSCYVSDDGAAMLTFESLVETADFARKWVPFCKKFSIEPRAPEFYFSQKIDYLKDKVQPSFVKERRAMKRDYEEYKVRVNAMVAKAQKTPEEGWTMQDGTPWPGNNSRDHPGMIQVFLGHTGARDIEGNELPRLVYVSREKRPGYQHHKKAGAENALVRVSAVLTNAPFILNLDCDHYVNNSKAVREAMCFLMDPEVGRDVCYVQFPQRFDGIDRSDRYANRNTVFFDVNMKGLDGIQGPVYVGTGCVFNRQALYGYSPPSMPSVPRSSCCCFPSKKSTNDVSDFQRNAKREELEAAIFNLKELDNYDEHERSMLISQMSFEKTFGLSTVFIESTLMENGGVPESADPSMLIKEAIHIGWIYGSVTEDILSGFKMQCRGWKSIYCMPLRPAFKGSAPINLSDRLHQVLRWALGSIEIFLSRHCPLWYGFSGGRLKWLQRMAYINTIVYPFTSLPLIAYCSLPAICLLTGKFIIPTLSNVASVLFLGLFLSIIITSVLELRWSGVSIEDLWRNEQFWVIGGVSAHLFAVFQGLLKMLAGVDTNFTVTAKAAEDSEFGELYLVKWTTLLIPPTTLIVVNMVGVVAGFSDALNGGYESWGPLFGKVFFAFWVIFHLYPFLKGLMGRQNRTPTIVILWSVLLASVFSLIWVKINPFVNTVDSETIAETCIAIDC

SEQ ID NO: 133302 - protein, 208 aa, Glycine max
  Coding DNA Sequence Number=SeqID_16524
  Gene Ontology: Mol. function=O-sialoglycoprotein endopeptidase activity; Biological process=proteolysis
  Homolog annotation: Hit_ID=O22145; Match level="QueryCoverage=75%, HitCoverage=42%, E-value=7e-62, Identity=63%"; Hit description =Putative O-sialoglycoprotein endopeptidase
  Pfam annotation: Domain name=Peptidase_M22; Domain location=76-205; Score=-3.0; E_value=9.1e-07; Accession=PF00814.15; Description =Glycoprotease family
  Subcellular localization annotation: CTP_CleavageSite=45; ConfidenceScore=5.73e-01
MVLSLSTLGFSSALSRLNFFPKPPPSLFSALTTFRRNQLPLKSSLAASKRDGDVVVLGIETSCDDTAAAVVRSDGEILSQVVSSQADLLAKYGGVAPKMAEEAHSKVIDQVVQEALDKAYLTEKDLTAVAVTIGPGLSLCLRGGHNLLVLARDLGQYIQLGTTIDDAIGEAYDKTAKWLGLDLRRSGGPAIEKLAMEGNAESVKFSVS

SEQ ID NO: 133303 - protein, 602 aa, Glycine max
  Coding DNA Sequence Number=SeqID_16525
  Gene Ontology: Mol. function=methyltransferase activity; Cellular component=nucleus; Biological process=regulation of transcription
  Homolog annotation: Hit_ID=Q2HS71; Match level="QueryCoverage=99%, HitCoverage=88%, E-value=0.0, Identity=54%"; Hit description =Methyltransferase small domain, putative
  Pfam annotation: Domain name=MTS; Domain location=374-549; Score= -41.1; E_value=8.9e-06; Accession=PF05175.4; Description =Methyltransferase small domain
  Pfam annotation: Domain name=Methyltransf_12; Domain location=397 -519; Score=12.3; E_value=0.036; Accession=PF08242.2; Description =Methyltransferase domain
  Pfam annotation: Domain name=PPR; Domain location=139-173; Score =38.6; E_value=2.1e-08; Accession=PF01535.11; Description=PPR repeat
  Pfam annotation: Domain name=PPR; Domain location=174-208; Score=2.3; E_value=4; Accession=PF01535.11; Description=PPR repeat
  Pfam annotation: Domain name=PPR; Domain location=243-277; Score =11.4; E_value=0.34; Accession=PF01535.11; Description=PPR repeat
  Pfam annotation: Domain name=PPR; Domain location=38-72; Score=42.1; E_value=1.9e-09; Accession=PF01535.11; Description=PPR repeat
  Pfam annotation: Domain name=PPR; Domain location=73-107; Score=4.6; E_value=2.2; Accession=PF01535.11; Description=PPR repeat
  Pfam module annotation: Pfam domain module=MTS::Methyltransf _12::PPR::PPR::PPR::PPR::PPR; Domain location=374-549::397-519::139 -173::174-208::243-277::38-72::73-107
MAHKTLVSWTTIVLGYARFGFLDVARELLYKIPEKSVVPWNAIISGCVQAKNSKEALHLFNEMKIRKIEPDKVAMVNCLSACSQLGALDVGIWIHHYIERHNFSLDVALGTALVDMYAKCSNIARAAQVFQEIPQRNCLTWTAIICGLALHGNARDAISYFSKMIHSGLKPNEITFLGVLSACCHGGRAGHLEEAEELIRNMPIEADAAVWGALFFAFRVHRNVLIGEREALKLLEMDPQDSDIYVLFASLYSEAKMWKEARDARKIMKERGVEKTPGCSSIEINCIVYEFMARDVLHPQSEWIYDYLVSLTKQLELIVFTHDIPEQFRAGVKKGHQYITVKVNNMGSHKELPRTAQIHLVSSHQEVYEPCDDSFALVDALLADRNNLLEHRPTLCMEIGCGSGYVITSLALLLGQEGCGINYIATDINPHAVRVTHETLEAHGVGAELIVTDIASGLEDRLAGLVDVIVVNPPYVPTPEDEVGVEGIMSSWAGGENGRSVIDKILPVADRLLSEKGWLYMVTLTANNPSEICHQMRKKGYASKIVVQRSTEEESLHIIKFWRDFDTEANETDQSASGFISFMLTQIPLLSYWRGTNSNNKS

SEQ ID NO: 133304 - protein, 82 aa, Glycine max
  Coding DNA Sequence Number=SeqID_16526
  Gene Ontology: Mol. function=DNA-dependent ATPase activity; Cellular component=nucleus; Biological process=DNA metabolic process
  Homolog annotation: Hit_ID=Q2HS72; Match level="QueryCoverage=86%, HitCoverage=20%, E-value=5e-20, Identity=69%"; Hit description=RecA bacterial DNA recombination protein; Rad51, N-terminal
MEVGMLPISASKRGKLLAAGYTTLDAIARASPTHLARDIDVSESEATEILNLASKPSALERPNGSHTAVVGGMCCVGSNLGI

SEQ ID NO: 133305 - protein, 232 aa, Glycine max
  Coding DNA Sequence Number=SeqID_16527
  Gene Ontology: Mol. function=DNA-dependent ATPase activity; Cellular component=nucleus; Biological process=DNA metabolic process
  Homolog annotation: Hit_ID=Q2HS72; Match level="QueryCoverage=83%, HitCoverage=56%, E-value=6e-90, Identity=83%"; Hit description=RecA bacterial DNA recombination protein; Rad51, N-terminal
  Pfam annotation: Domain name=Rad51; Domain location=2-224; Score= -5.4; E_value=2e-09; Accession=PF08423.2; Description=Rad51
GQTAWDMLNDEKFSSYITTSCADLDNILGGGIKCKEVTEIGGVPGIGKTQIGIQLAVNVQIPQEYGGLGGKAIYIDTEGSFMVERVLQIAEACIEDMAEYSRHFHKDFQACDVKMHPNNILENIFYFRVCSYTEQIALINYLDKFITENKDVKILIVDSVTFHFRQDFDDMALRTRLLSEMALKLMKLAKKFRLAVRINLFYLPVVFCTELVIDSISSQIMLMQFVWTLDQV

SEQ ID NO: 133306 - protein, 432 aa, Glycine max
  Coding DNA Sequence Number=SeqID_16528
  Gene Ontology: Mol. function=3-phosphoshikimate 1-carboxyvinyltransfer ase activity; Cellular component=chloroplast; Biological process =aromatic amino acid family biosynthetic process, shikimate pathway
  Homolog annotation: Hit_ID=Q1T6A9; Match level="QueryCoverage=84%, HitCoverage=69%, E-value=1e-140, Identity=72%"; Hit description=3 -phosphoshikimate 1-carboxyvinyltransferase
  Pfam annotation: Domain name=EPSP_synthase; Domain location=89-431; Score=289.5; E_value=6.4e-84; Accession=PF00275.10; Description=EPSP synthase (3-phosphoshikimate 1-carboxyvinyltransferase)
  Subcellular localization annotation: CTP_CleavageSite=75; ConfidenceScore=5.64e-01
MAQVSRVHNLAQSTQIFGHSSNPNEPKSANSVSLRPRLWGPSKSRILVHKTGSLMGNFNAGKGNSGMFKVSASVAAAAEKPSTAPEIVLEPIKDISGTITLPGSKSLSNRILLLAALSEGTTVVDNLLYSEDIHYMLGALRTLGLRVEDDQTTKQAIVEGCGGLFPTIKESKDEINLFLGNAGTAMRPLTAAVVAAGGNASYVLDGVPRMRERPIGDLVAGLKQLGADVDCFLGTNCPPVRVNGKGGLPGGKVKLSGSISSQYLTALLMAAPLALGDVEIEIVDKLISVPYVEMTLKLMERFGVSVEHSGNWDKFLVHGGQKSPGNAFVEGDASSASYFLAGAAVTGGTITVNGCGTNSLQNQILEEAFKNYIMMFPVQNRFADKREHLQVPLHMPKIPQLNNCQESCCEFQVGVDEIWCVYDSGNEHEVFS

SEQ ID NO: 133307 - protein, 364 aa, Glycine max
  Coding DNA Sequence Number=SeqID_16529
  Gene Ontology: Mol. function=protein-tyrosine kinase activity; Cellular component=integral to membrane; Biological process=protein amino acid phosphorylation
  Homolog annotation: Hit_ID=Q1SSI2; Match level="QueryCoverage=88%, HitCoverage=40%, E-value=1e-107, Identity=59%"; Hit description =Tyrosine protein kinase, active site
  Pfam annotation: Domain name=Pkinase; Domain location=68-335; Score =142.1; E_value=1.5e-39; Accession=PF00069.15; Description=Protein kinase domain
  Pfam annotation: Domain name=Pkinase_Tyr; Domain location=68-335; Score=88.5; E_value=2e-23; Accession=PF07714.7; Description=Protein tyrosine kinase
  Pfam module annotation: Pfam domain module=Pkinase::Pkinase_Tyr; Domain location=68-335::68-335
EVPSLLGKNSILDRLDLSYNNLTALYFARCFSKTKFEGGLAKNGDLFSVWNYDGKVAFEDIIEATEDFHIKYCIGTGAYGSVYRVQLPTGKIVAVKKLHQMEAQNPSFDKSFRNEVKMLTEICHRNIVKLHGFCLHNRCMFLVYQYMESGSLFYALNNDVEAQELNWSKRVNIIKGMANALSYMHHDCTPPIIHRDVTSSNVLLNSHLQAFVSDFGTARLLDPDSSNQTLVVGTYGYIAPELAYTLTVSEKCDVFSFGVVALETLMGRHPGEFISSLSNSSTQNILLKDLLDSRLPLPVFPKDAQDIMLVVALALACLCFQPKSRPSMQQVAQELCASKLPPPLPFYKISIAQLMTPDILLSFI

SEQ ID NO: 133308 - protein, 76 aa, Glycine max
  Coding DNA Sequence Number=SeqID_16530
MEDKKKKRLEEATRSGSTHTIVDPPSLIRQHVKWMARTKKSGQMTTEATKKIAYKIDSRKSRPQREALSLKDVRMY

SEQ ID NO: 133309 - protein, 312 aa, Glycine max
  Coding DNA Sequence Number=SeqID_16531
  Homolog annotation: Hit_ID=Q1SZI6; Match level="QueryCoverage=84%, HitCoverage=19%, E-value=2e-47, Identity=47%"; Hit description =Tetratricopeptide-like helical
  Pfam annotation: Domain name=DUF177; Domain location=67-308; Score =25.9; E_value=6e-06; Accession=PF02620.7; Description=Uncharacterized ACR, COG1399
  Subcellular localization annotation: CTP_CleavageSite=63; ConfidenceScore=5.58e-01
MSLVIPSSSAAPLHFSQLETNNFNSHQKFASNFFSPFQNRVGLGCKSRHIRTYLRNELNVLHKCNYIQKKRDNFTSGVLHYLGEGCCNGIACYKSHFPNGTPVQISIDVTKKKKLRLDGIIKTVITLLCNRYLDAKHRKYRCILIHLTELSNIFLHNYFNVSSFYEVANSANIAVSVKYCAPSAESIFSEFSLLLTDKPLEEPETIDKGVIFGEDKLTTSGNSGEDDDDDALIDMDDQLYFPPEQKQIDISKNIRDRVHLEITMNSVYGPGCKGMCLKCGQNFNTGNCNCSKQEVQEKSFGPLGNLKEKMQL

SEQ ID NO: 133310 - protein, 163 aa, Glycine max
  Coding DNA Sequence Number=SeqID_16532
MDLSRVAQSLDTLWFYTNILTCRDQPEPEASLIDQFAPLVHFKECPKRDLLKPITPLQHESQNVENSSPRCHKFEEVKAMVPTSKETKKRERRKRRKWHKLGIYGTNVVHGGPDLRFDYFDMFKEESREYQIQWQTKMPPFDDVVAMKQHLKSWAYAVACTVR

SEQ ID NO: 133311 - protein, 58 aa, Glycine max
  Coding DNA Sequence Number=SeqID_16533
MKVQQPEAILCKLKAKGGLGNKEIFQLNYYENEDIMGGSLTENFIGEAHECQRTSGSR

SEQ ID NO: 133312 - protein, 50 aa, Glycine max
  Coding DNA Sequence Number=SeqID_16534
MKEKDGSRPRLVTGEKGWLRIELGFKFTGERKRECCDCEADERLNQCLYY

SEQ ID NO: 133313 - protein, 87 aa, Glycine max
  Coding DNA Sequence Number=SeqID_16535
MARIQDTSLHSPPINTLPELSTHKSQYISFTFTKEEDEAKRTSLAKSTVLRLYKLKLALETVKRQYENLLATRRECVRLLNHVKESK

SEQ ID NO: 133314 - protein, 317 aa, Glycine max
  Coding DNA Sequence Number=SeqID_16536
  Gene Ontology: Mol. function=serine-type endopeptidase activity; Cellular component=extracellular region; Biological process =proteolysis
  Homolog annotation: Hit_ID=Q6X5Y8; Match level="QueryCoverage=99%, HitCoverage=54%, E-value=1e-140, Identity=80%"; Hit description =Minor extracellular protease StmPr2 preproprotein precursor
  Pfam annotation: Domain name=Peptidase_S8; Domain location=66-317; Score=230.1; E_value=4.8e-66; Accession=PF00082.12; Description =Subtilase family
MQQVRKLAVGPTLVKTDRPLDQAESEQLMRKLAADPNVEYVEVDQIMRATLIPNDTRFSEQWGFGTSNAGINIRPAWDKATGTGVVVAVIDTGITNHADLNANILPGYDFISDAAMARDGNGRDNNPNDEGDWYGANECGSGIPAANSSWHGTHVAGTVAAVTNNSTGVAGTAFNAKVVPVRVLGKCGGYTSDIADAIVWASGGTVSGVPANANPAEVINLSLGGGGSCSTTYQNAIDGAVGRGTTVVVAAGNCNTNVSSSVPANCPNVIAVAATTSAGARASFSNYGTGIDISAPGQSILSTLNTGTTRPGSATYA

SEQ ID NO: 133315 - protein, 159 aa, Glycine max
  Coding DNA Sequence Number=SeqID_16537
MVIPKFKVPDFDEYKGTTCPKNHLKMYCQKMRAYAKDEKLLIHFFQESLTGVAVTWYANLEPSRVHSWRDLMVAFIKQYQYNFDMASDRMQLWNLCKKKSMYAQRWRDLAAQVAPPIIEKEIITMIVDTLLVFYYEKWWVTHLQVLQIWSSPAKGSKWV

SEQ ID NO: 133316 - protein, 219 aa, Glycine max
  Coding DNA Sequence Number=SeqID_16538
  Pfam annotation: Domain name=Transposase_23; Domain location=38-108; Score=0.3; E_value=0.0011; Accession=PF03017.5; Description =TNP1ENSPM transposase
  Subcellular localization annotation: CTP_CleavageSite=8; ConfidenceScore=5.06e-01
MASFSHLQSQMQSQGVAVPPEPVVGPSPSRSSRNDPETGDSDRCGLYIEADPARLVAIGRVYEGSTVVHNTLLLPGQVKVSVEEVRDADAPVPVPTDEVSLVGQALHTFLAWPTHLVKSLSQQVRWDATVFGVVNPDFPLYIKHEDLSKIAHGGQCLSISVLQLWILHLTETCMRAGNFDIYAFLEPQSIQRSGQSPFEFESSTAADTGRWWSSYPRNT

SEQ ID NO: 133317 - protein, 122 aa, Glycine max
  Coding DNA Sequence Number=SeqID_16539
MEEGYAASENQNYHWAGSFADEEDVAVICLTSFSREGYGRASTVCCFWGVAVVVVATGLVEERGLLQCALHGRAKARLTGALSKGGKMRGVATNEGISTSHVDKSGAFAPTHPPSRRKSDLR

SEQ ID NO: 133318 - protein, 106 aa, Glycine max
  Coding DNA Sequence Number=SeqID_16540
MTMQNMQFQKETRASIESLTNQMGQLATQLNQQQSQNSDRLPSQSVQNPKNESAIKLRSGKQCESSTGNSDFQKQHIPLPFPPRAISNQKMEEAEKEILETFRKVE

SEQ ID NO: 133319 - protein, 312 aa, Glycine max
  Coding DNA Sequence Number=SeqID_16541
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=21%, E-value=1e-124, Identity=65%"; Hit description =Chromo
MEPELAMILYTYRTVFDVPSGLPPSRTHNHSIPLVEGAGPEGIIAPSRSPFSPPIILVKKKDGTWIFCTDYRALNAITIKDSFPIPTVDELIDELHGAVYFSNLDLRSGYHQILVNEEDRHKTAFRTHQGHYEWLVMPFGLTIAPATFQSLMNEVFQCYLRKFVLVLFDDILIYSPNWSAHLQHLETVLKVLEQHKLYAKLSKCSFGLQEIDYLGHTVSGKGVTMDQEKAQAVLNWPYPINLKQLRGFLGLTGYYRKFIKGYVSIATPLSNLLKKKNLHWNDHTSMAFDNLKAAITKAPVLALPDFSKAFTF

SEQ ID NO: 133320 - protein, 76 aa, Glycine max
  Coding DNA Sequence Number=SeqID_16542
MASCDKQKIALVMMQMTYGGPSSSSCLKQNCHGDVIYHSPAYGDENPETDQIQAKSPSGEGQSPRVEKDEAPSGER

SEQ ID NO: 133321 - protein, 264 aa, Glycine max
  Coding DNA Sequence Number=SeqID_16543
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TLVFRGLHVLTIRGLHVLAIRGLHALAFVGLHALTFRGLHVLTFRGLHVLTFKGLHALTFRGLHILHFRGLHVLAFRGLHVLAFRGLHVLAIRGLHVLAIRGLHALAFIGLHALTFRGLHVLIFRGLHALAFAFVGLDALTFRGLHVLTFRGLHFLTFIGQHTLTFRGLDVLAFRGLHVLTIRGLHALAFRGLHVLTFRGLYVLAFKGSCTFAFVGLHALTFRGLHVLAFKGSCTFAIVGLHALTFRGLHVLAIIGLHSLAFKR

SEQ ID NO: 133322 - protein, 310 aa, Glycine max
  Coding DNA Sequence Number=SeqID_16544
  Gene Ontology: Mol. function=motor activity; Cellular component =flagellar basal body, MS ring; Biological process=ciliary or flagellar motility
  Homolog annotation: Hit_ID=Q66BR7; Match level="QueryCoverage=99%, HitCoverage=54%, E-value=1e-131, Identity=77%"; Hit description =Flagellar M-ring protein precursor
  Pfam annotation: Domain name=YscJ_FliF; Domain location=22-230; Score= 303.8; E_value=3.1e-88; Accession=PF01514.8; Description=Secretory protein of YscJFliF family
  Pfam annotation: Domain name=YscJ_FliF_C; Domain location=255-310; Score=-55.3; E_value=0.0055; Accession=PF08345.1; Description =Flagellar M-ring protein C-terminal
  Pfam module annotation: Pfam domain module=YscJ_FliF::YscJ_FliF_C; Domain location=22-230::255-310
MSASITAGESRDNGLQAIWNRLRANPKIPLLVAASAAIAIVVALLLWVKSPDYRVLYSNLNDRDGGAIVTQLTQMNIPYRFAENGAALLIPAEKVHETRLRLAQQGLPKGGAVGFELLDQEEFGISQFSEQINYQRALEGELSRTIESLGPVQNARVHLALPKPSLFVREQKSPSASVTLTLQPGRALDDGQINAIVYMVSSSVAGLPPGNVTVVDQAGRLLTQSDGTGRDLNASQLKYANEVENGFQRRIEAILAPVVGSANVRAQVTAQIDFATREQTDEQYQPNQQPDKAAIRSQQTSLSEQIGGPQ

SEQ ID NO: 133323 - protein, 67 aa, Glycine max
  Coding DNA Sequence Number=SeqID_16545
  Subcellular localization annotation: CTP_CleavageSite=46; ConfidenceScore=5.62e-01
MASYGVASPFSPPSPFRCHSSSKKQRNPLMKKILGLQAPMKLTPTRLENIETRLSLSNLLNPNQDEA

SEQ ID NO: 133324 - protein, 90 aa, Glycine max
  Coding DNA Sequence Number=SeqID_16546
MEACLWGSYGGWIFELQLGPLMVIFHHGDVAEDKGEEAHENPRAFPWISGPIYLESSIQFPYEVGLHHSLHLGKDLTSNPEVLHVDKGSS

SEQ ID NO: 133325 - protein, 46 aa, Glycine max
  Coding DNA Sequence Number=SeqID_16547
MSFTEGKIGINKMAPKKLSTKRSRRDATGEGSSAASEFDSHCFPEC

SEQ ID NO: 133326 - protein, 100 aa, Glycine max
  Coding DNA Sequence Number=SeqID_16548
  Subcellular localization annotation: CTP_CleavageSite=52; ConfidenceScore=5.34e-01
MEANVVAVAATSVVAKENPMPPSGLNQMNHPTSAMRTLPVRMTITPLPYSLRADNLVMYMSLNPWGRHMKILHHNLADFEPCLGYATEGQAVGGIPLQNT

SEQ ID NO: 133327 - protein, 125 aa, Glycine max
  Coding DNA Sequence Number=SeqID_16549
  Gene Ontology: Mol. function=DNA binding; Cellular component =intracellular; Biological process=regulation of transcription, DNA -dependent
  Homolog annotation: Hit_ID=Q7X3W2; Match level="QueryCoverage=99%, HitCoverage=93%, E-value=1e-20, Identity=42%"; Hit description=Hns
  Pfam annotation: Domain name=Histone_HNS; Domain location=21-125; Score=116.5; E_value=7.5e-32; Accession=PF00816.11; Description=H-NS histone family
MSDALKALNNLRTLRAEARNIEVAVLNEMLEKFAVVVAERREETAAESAAQREKEEKLALYKEMLRKDGITINELAQLNQGETKSKAKRAPRPAKYKFTDEQGNEKFWTGQGRTPSPIKSAIDAG

SEQ ID NO: 133328 - protein, 298 aa, Glycine max
  Coding DNA Sequence Number=SeqID_16550
  Gene Ontology: Mol. function=quinoprotein glucose dehydrogenase activity; Cellular component=integral to membrane; Biological process=electron transport
  Homolog annotation: Hit_ID=Q8PAB0; Match level="QueryCoverage=99%, HitCoverage=37%, E-value=9e-98, Identity=60%"; Hit description =Glucose dehydrogenase
  Pfam annotation: Domain name=PQQ; Domain location=141-174; Score =15.6; E_value=0.11; Accession=PF01011.11; Description=PQQ enzyme repeat
  Pfam annotation: Domain name=PQQ; Domain location=71-108; Score=16.3; E_value=0.091; Accession=PF01011.11; Description=PQQ enzyme repeat
  Pfam module annotation: Pfam domain module=PQQ::PQQ; Domain location =141-174::71-108
GKELWRFDPRVKDASIPYTAACRGVSYYEQPSTPTVADAALADVAADLALPEPPPSITRNVAPGSRPACWARIIEGTLDGRIIAVDADSGRPCANFGNNGQVDITLGMGEVPPGYVSITSPPAIVRGVIVTGHQVLDGQRRDAPSGVIQAYDAITGKLRWAWDMDQPERSGLPPREQTYTRGTPNMWTTATGDEALGLWLAHGEPEPLCNLAGGDRRGHRQAGLAFPGGQPDRLPDGGGQGAGDPVADQAGRPLYPRSPQRPAADRRRRAQGAGRRRRTRAAFTHPAVFAVPHAAPRT

SEQ ID NO: 133329 - protein, 149 aa, Glycine max
  Coding DNA Sequence Number=SeqID_16551
MTEPLDESISFFLIKVDPWVLVPITFRGPYVLAIRGLHILVCRGLHTLAFRGLHVLIFILGPPPDIGGRPTVRAHPEREAITHLLCIPGQDLTRATAKRRVRIMRTNMTTLTWLWMTLLFSNILPSDHNANPPLQMDQLGSRPQDAQWT

SEQ ID NO: 133330 - protein, 76 aa, Glycine max
  Coding DNA Sequence Number=SeqID_16552
MAGHDWPLDFLFPTYRYIWTDASGDRVTTDRSLPLPGAKQAENVAARQPSSSGQTLAHKEGGDMVNVPLKKKKGTG

SEQ ID NO: 133331 - protein, 66 aa, Glycine max
  Coding DNA Sequence Number=SeqID_16553
MSLVVKDNRGKWAPNYEGPFVVKRVFSGGALMLTNMDGEELPSPVLRNGCNWGWGHDRLIVAPSLR

SEQ ID NO: 133332 - protein, 86 aa, Glycine max
  Coding DNA Sequence Number=SeqID_16554
MTDLVSAEDDVNLRVSTGLSAAIDEGCGMTIICLYVPSDTTVSEWQKRCGITIICLRMSSGPPPLDDKRVQNDQNLSLRAIGHDCV

SEQ ID NO: 133333 - protein, 85 aa, Glycine max
  Coding DNA Sequence Number=SeqID_16555
MVGAGLKKDLRVSRVVPGGSLNAFLFLLIGVISQRLAMESIDSLPIGWTVGAMIYFTGEVSAQLVELRSCNWVVAITGWMSNSPG

SEQ ID NO: 133334 - protein, 70 aa, Glycine max
  Coding DNA Sequence Number=SeqID_16556
MSLPSAVHVFSIIKCEACCDWEARYSVVFQIGSFAKRKKEEVEMRVVIAKRAGRTKSVSYLCFPLISDER

SEQ ID NO: 133335 - protein, 151 aa, Glycine max
  Coding DNA Sequence Number=SeqID_16557
  Gene Ontology: Mol. function=4-alpha-glucanotransferase activity; Biological process=carbohydrate metabolic process
  Homolog annotation: Hit_ID=Q7N978; Match level="QueryCoverage=98%, HitCoverage=21%, E-value=5e-41, Identity=53%"; Hit description=4 -alpha-glucanotransferase
MAVTTTHDMPTLRGWWQSDDLRLGSALGLYPDRAILAGLYRDRRLAKQALLRTLLRSGDLPPRRRFRRASVRMSHQLSQAIHRYLARSQCALLGLQPEEWLDMALPVNVPGTVDQYPNWRRKLSVTLEAMAEDDRIDALLTAVQSRQRQRN

SEQ ID NO: 133336 - protein, 68 aa, Glycine max
  Coding DNA Sequence Number=SeqID_16558
  Subcellular localization annotation: CTP_CleavageSite=46; ConfidenceScore=5.35e-01
MLSLAHQWAKRASTAKCSFSALSAIEESGRTSISRLRTKREISALSAVVVFSQAQRKTGAKLKSSYSR

SEQ ID NO: 133337 - protein, 68 aa, Glycine max
  Coding DNA Sequence Number=SeqID_16559
  Subcellular localization annotation: CTP_CleavageSite=62; ConfidenceScore=5.20e-01
MDTSKPYIGAMKGTMHKPQANLGADYKFSPNRFPATRSWQNKTIGTSKPYTGAMRGTMHKPQANLGAD

SEQ ID NO: 133338 - protein, 269 aa, Glycine max
  Coding DNA Sequence Number=SeqID_16560
  Gene Ontology: Mol. function=GPI anchor binding; Cellular component =anchored to membrane
  Homolog annotation: Hit_ID=Q9SUC9; Match level="QueryCoverage=65%, HitCoverage=76%, E-value=8e-47, Identity=60%"; Hit description =Uncharacterized GPI-anchored protein At4g28100 precursor
MARGRSRTEANQRPAACSLGQDYTWTREGAHCTSSHAALPKRVRGVTAIILEVANRSGWGGVPVRKRDVKRSVAGKRRDLVESDAAEAENSVARGVGLRDSDVAGEKRILERVDAFLGVVGHHRKVGGGRRRGGGDIKSGAGVSGEEPGGEDGAAAAPVEVLAAGILDAAEELVGEVEAAGKAGTVLEPGSRGWLGSLTGSESKPAREKGNEKGGGRWGWVEKMITWKGKRGGAKIETARAGLGKKVRIFWRLLWTLPVVVFLSLLCAL

SEQ ID NO: 133339 - protein, 370 aa, Glycine max
  Coding DNA Sequence Number=SeqID_16561
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=35%, E-value=1e-104, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVNLPSNKKAIEVKWVFKTKVKSSGEIAKYKARLVAKGFLQKPGLDFNEVYAPIARIETVRLIVAIASMRKWTMSQLDVKYAFLNGPLEEEVYSRQPPGYEKIGMEDRDYGVTGVVMLCLYVDDLLVTGDSKQEIDKFKKEMMDDFEMSDIGIIAYFLGMEFVTPKSGIFLHLKKYATDILKRPDITYGVGLVSRFMEKPCKDHLLTPKRILRYVKGTLECGILFPAAKENSETEIVGYTDVDWSGDVGDRKSTSSCEAEYILAAFGSSQALWLGMLLEELNIKCSNVMKLRIDNKSAIDLAKHPIVHGCSKHIEVKYHFLHDQVNKNKLALEYCRTEEQCVDMLTKALKPKRLEEMKNKIGMHKLTNLN

SEQ ID NO: 133340 - protein, 68 aa, Glycine max
  Coding DNA Sequence Number=SeqID_16562
MECPSSPARSSGLLLTELSSRSIAPPDRQRARHPNSLGMANNRQQRHRRHLQSPSAHPQKGYSIAYDT

SEQ ID NO: 133341 - protein, 83 aa, Glycine max
  Coding DNA Sequence Number=SeqID_16563
  Subcellular localization annotation: CTP_CleavageSite=58; ConfidenceScore=5.20e-01
MWGIPFILEPNQTLTCIMSSHSTTLSQNPGSPQTFTQGENVNPYPRKQKRRRKISNQRESKKEGKGNSQSKSGRKRKEKKENS

SEQ ID NO: 133342 - protein, 156 aa, Glycine max
  Coding DNA Sequence Number=SeqID_16564
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=92%, HitCoverage=16%, E-value=1e-41, Identity=52%"; Hit description =Glutamate receptor 3.4 precursor
MQRLKTKETPSFNSYALYAYDTVWLVARALDAFVKKGSVVSFSSDPKLLETNGSMLHLQSLRVFYDDPLFLETILSTNFSGLTGTAHFDIERNRNHPAYDMLNIGGSGMRRIGYWSNYSGLSVVTPEILYKKPPNTSTRGWVFPNNGKPLRIEVPN

SEQ ID NO: 133343 - protein, 214 aa, Glycine max
  Coding DNA Sequence Number=SeqID_16565
MTLTIPELFLRPYQVRWDVTMFRVFNPDFPLYIKHEDLSEIAHGGNSDIYGFLEPQSIQRSGQSQFESKSYIKSWMQSSQHDVYLGAYLNGFHCSGHWQMMVILPKEHLVVWFCSLHNRPDNYLKGIINSALKGLDDAPQPKSKGPARWIVIKCNRQKGSTECGYYVMHWMSTIILGTFMNNWEAYFNDPRPLELERLKALRIQWAQFYLRVRD

SEQ ID NO: 133344 - protein, 81 aa, Glycine max
  Coding DNA Sequence Number=SeqID_16566
MKDFQKNEWIKFVGAFANVEAKANQIYTTVRNPSFQVLTIGICKIRPLDILFSETSALSAIAHREDNSLSEINVLSEICRL

SEQ ID NO: 133345 - protein, 133 aa, Glycine max
  Coding DNA Sequence Number=SeqID_16567
MERSMIDAASGGALGDMTPAKARNLIEKMASNSQQFSARNDAIVIRGVHEVATNSAASSETKKLEGKLDALVNLVTQLALNQKSVPIARVCGESSTGNSDLQKQHIPLPFTPRAISNKKWKRQRRRSWKHLDK

SEQ ID NO: 133346 - protein, 142 aa, Glycine max
  Coding DNA Sequence Number=SeqID_16568
KKRENDARLDAQKQAHIFLLEKAQTAQHEVERLTKEAKEGSSEIKACDDNISSWEATIMDLLSQVDDLRQKIVTEQAKRKELQEKAAHSIQKLIAEKGREGLKAFSASQAVADEARVMEGADQVLTKEMATLKKLYEDLIMT

SEQ ID NO: 133347 - protein, 203 aa, Glycine max
  Coding DNA Sequence Number=SeqID_16569
MEAMKEKIATMREAMMSMKNIMEANAVTVAATRAVTKVNPMPPSDLNQMNHPTSDMVDKDLGSTDGPMKCKHAFPSYGSPPKEDVNNSAPILIESRQPHHAHEMPHHNLADFEPCLGYATEGQAVGGIPMPNTLKGPQFRPQPPPLHFAVGRAPPAMAEKGKLDHIEEMLKDIEGGEDYAFANLEELFLVPERGHSQVQGAGL

SEQ ID NO: 133348 - protein, 85 aa, Glycine max
  Coding DNA Sequence Number=SeqID_16570
  Subcellular localization annotation: CTP_CleavageSite=44; ConfidenceScore=5.17e-01
SAKVDVLLSELNARNKSHPLSEASTRLADRRNLEGNLSRRHALRASSARSASRLSPSKLSTSLALSENSLTRTKCENGAKRNVRA

SEQ ID NO: 133349 - protein, 199 aa, Glycine max
  Coding DNA Sequence Number=SeqID_16571
MTERLLAGSLAFECRIMHYLIVRILLPRSSNLAQVFLTDRQIDWAHLVRYRMHKALRSNAPLPYPHLITLFLQRFNVPLDSEPFVKVKRSFSISANVVSSFGYRKERGGSWVKKDAPVQAAEDRSPSPPPQRDDSSSLMHNILDRLDGLHTFVGEHFDSLNSRIDVMDARFAGMDTRITKLEEDVSYVRQFFDLPPPSS

SEQ ID NO: 133350 - protein, 39 aa, Glycine max
  Coding DNA Sequence Number=SeqID_16572
MSVNPDPGSQVADGGFYFRHPETFKFDDARDSSLLGGDD

SEQ ID NO: 133351 - protein, 72 aa, Glycine max
  Coding DNA Sequence Number=SeqID_16573
MSTRAEMKDGAQFDVLRRGIIYTEVLGWVDMGHARGSDIMELKSQFIAGERSGKPSYIVMYRQDMHFVKFNS

SEQ ID NO: 133352 - protein, 279 aa, Glycine max
  Coding DNA Sequence Number=SeqID_16574
  Homolog annotation: Hit_ID=Q1S0F5; Match level="QueryCoverage=47%, HitCoverage=24%, E-value=3e-13, Identity=34%"; Hit description=IMP dehydrogenase/GMP reductase
MAKVVKISEHELDRLKQNRNEVVGIPRKRLEEKAKALANQREWTSFIDILALLVFGTILFPNVDDLVDLAAINAYLAYHHSKESPVIVVLEDTYDTLDLRCEKSSARIVCCTPALYVWLVSHVLCHESRSVYPLQGHRMCPKNRKANWEELLAGMRIRKAWNIVERKDKELRGSSNGAINSYHKWLKSRTQEINWLPKLKGLSGKEAEVPEESKEVQALKVELEKTRVVKEKLKTEVTRVKKECDVLRDVNMTTVKALEWETKRARQEEWSRNMFRGAL

SEQ ID NO: 133353 - protein, 213 aa, Glycine max
  Coding DNA Sequence Number=SeqID_16575
  Gene Ontology: Cellular component=integral to membrane
  Homolog annotation: Hit_ID=Q9FJV7; Match level="QueryCoverage=71%, HitCoverage=49%, E-value=8e-43, Identity=56%"; Hit description =Arabidopsis thaliana genomic DNA, chromosome 5, P1 clone:MFO20
  Pfam annotation: Domain name=DUF607; Domain location=4-191; Score =165.9; E_value=1e-46; Accession=PF04678.4; Description=Protein of unknown function, DUF607
METAVQFLNYSCRLQRMMMTWILILVWRNGALAGSLETVSFGWDMWNVAKSIESLIYQSIANPNDPRRKELELMEKQKWMIDEKAKAQVRAELYFGLGFLTVQTLGFMRLTFWELSWDVMEPICFFVTSFGFALAYLFFLKTSTEPTFQGFFHHRFKAKQERLMKTHNFDMSRYNELFKACYTNYHGGAKFESSYPFHYPGETHLTDLRALHR

SEQ ID NO: 133354 - protein, 137 aa, Glycine max
  Coding DNA Sequence Number=SeqID_16576
MEKICNKLDAYICSNLRIREPRHESETNLREWTEKRRAHRRSNDDGFIGGAAGANTGEAVVLVRRGEGRFRDEGEVALERRAGGGAGSHPRRRGAAIGSSGGAGHEEAGKGEEMGPSGIGGKLEGNGRRIGRKGRVV

SEQ ID NO: 133355 - protein, 403 aa, Glycine max
  Coding DNA Sequence Number=SeqID_16577
  Gene Ontology: Mol. function=transcription factor activity; Cellular component=transcription factor complex; Biological process =regulation of progression through cell cycle
  Homolog annotation: Hit_ID=Q9LEL4; Match level="QueryCoverage=99%, HitCoverage=91%, E-value=1e-114, Identity=57%"; Hit description =Transcription factor E2F
  Pfam annotation: Domain name=E2F_TDP; Domain location=80-131; Score =78.4; E_value=2.2e-20; Accession=PF02319.11; Description =Transcription factor E2Fdimerisation partner (TDP)
  Subcellular localization annotation: CTP_CleavageSite=78; ConfidenceScore=5.39e-01
MKRKSGMNDSEGESLAQKWSNSPGYTNVSNVTNNSPFKTPVSAKGGRTQKAKASKGRSCPPTPISNAGSPSPLTPASSCRYDSSLEGGILDLNKAAETLEVQKRRIYDITNVLEGIGLIEKKLKNRIHWKGIESATSGDVDGDISLLKAEVEKLSLEEQGIDDQIREMQERLRNLSENENNQKCLFVTEEDIKDLPCFQNETLIAIKAPHGTTLEVPDPEEAVDYPQRRYRIILRSTMGPIDVYLIRYSLENIFVRLILMLGMVVSQFEEKFEEVNGAELPMIPLASSSGSNEQLMTEIVTAECSGKELEPQTQLSSHAFSDASQEFAGGMMKIVPSDVDNDADYWLLSDADISITDMWRTDSSVDWNGVDMLHPDFGVISRPQTPSSGFAEVPSTAANSIQK

SEQ ID NO: 133356 - protein, 170 aa, Glycine max
  Coding DNA Sequence Number=SeqID_16578
  Gene Ontology: Mol. function=chitin binding; Cellular component =extracellular region; Biological process=chitin metabolic process
  Homolog annotation: Hit_ID=UPI00006A17C9; Match level="QueryCoverage =78%, HitCoverage=100%, E-value=4e-15, Identity=39%"; Hit description= UPI00006A17C9 related cluster
MSKSCGFGMTGPLDESISCFLIRLHPLGTCTFTFRGLHVLTLRGLHVLAMRGLHVLAMRGLHVLTIRGLHALTSRGLHVLALRGLHVLTLGLHVLTIRGLHALTSRGLHVLALRGLHALTLGTSYPHRQRTTRPRLERTTRPHHQRAARPYLQRTTCPRLERATRPHLGY

SEQ ID NO: 133357 - protein, 104 aa, Glycine max
  Coding DNA Sequence Number=SeqID_16579
MAKDNDCASKPYTGAMKSTIFPTSRVQSFWMTGPLDESISCFLIKVDPWVLVPITFRGLYVLAIRGLHILACRGLHALAFRGLRVLIFSVLHIHTLKEYKVLCP

SEQ ID NO: 133358 - protein, 121 aa, Glycine max
  Coding DNA Sequence Number=SeqID_16580
MESSNMKNKSSGKRKMSSEDTRSYFAWNLEMELECVLADVLRDQRNLGNKDNAKNCFKLWRTWYGISHEEAKRFRFKVIPNWDDIVNLCAKDKATGLEAENALDADDIMSKEINEEEAIHS

SEQ ID NO: 133359 - protein, 92 aa, Glycine max
  Coding DNA Sequence Number=SeqID_16581
MESSIVDALAASRKRRRDEEEEEELEQAFFIIVSVATMLLSALTWYHDKSMETISRQFKNILQAIMKVSKEYLKFHDYNLEGSVENKWRWFK

SEQ ID NO: 133360 - protein, 38 aa, Glycine max
  Coding DNA Sequence Number=SeqID_16582
MELEHREPWERRLHTRCGDKSEMTKKRGAQRPHFVIPE

SEQ ID NO: 133361 - protein, 52 aa, Glycine max
  Coding DNA Sequence Number=SeqID_16583
MGLNQAHVHQVKVKYGSNQLAKVGAEDGSRCARVMSEIEEVQRADEGRYGRP

SEQ ID NO: 133362 - protein, 115 aa, Glycine max
  Coding DNA Sequence Number=SeqID_16584
  Pfam annotation: Domain name=DUF623; Domain location=45-85; Score =32.5; E_value=1.4e-06; Accession=PF04844.4; Description=Protein of unknown function, DUF623
MASFTNSGSYAISTRVAPPFKGEGTLKLKVKDNIGLGEEGKLLNDENVSKQMDDLLACYLTLNADEYHDLIIKVFRQVWSDMRQGGLDLTTIHNLHPIHLRIQVTMPEYGTWDNC

SEQ ID NO: 133363 - protein, 90 aa, Glycine max
  Coding DNA Sequence Number=SeqID_16585
MTSVNNVTAMTFGFSKAEKLTQKLTHEQRSAGRFDVKESRCCKTHLETHPREASARASITHSIISWNPPLEGWIKVNCDASDISRLWRNY

SEQ ID NO: 133364 - protein, 185 aa, Glycine max
  Coding DNA Sequence Number=SeqID_16586
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=43%, E-value=9e-25, Identity=39%"; Hit description =Integrase, catalytic region
MTNVVADALSRIPDNSIGQSLLLSVLNSAFLKELNTSKHSGLGVSPYEIAFGKKPLSLPQYIIGTSKIDVVDEFLSNRREMHFKIGDWVMIKLRPHTQSSTSGVSTSYSKLVKRFYEPYQVLDQIGKVAYKLLLPERSRIHPAFHCSFLKPFHQTSEEDCVPLALPSNDVENQPVISLLAILGTH

SEQ ID NO: 133365 - protein, 246 aa, Glycine max
  Coding DNA Sequence Number=SeqID_16587
  Gene Ontology: Mol. function=chromatin binding; Cellular component =chromatin; Biological process=chromatin assembly or disassembly
  Pfam annotation: Domain name=rve; Domain location=21-162; Score= -10.0; E_value=0.04; Accession=PF00665.16; Description=Integrase core domain
  Pfam annotation: Domain name=zf-H2C2; Domain location=1-34; Score =5.5; E_value=0.068; Accession=PF09337.1; Description=His(2)-Cys(2) zinc finger
  Pfam module annotation: Pfam domain module=rve::zf-H2C2; Domain location=21-162::1-34
MGITKTLAQVSENFLWPNMKKDVHQYVIACLDCQHTKYETRKTECCHPTVALLFMDIVGKLHGMPRSLVSNYDPLFISRFWWGLFQLSGTKLYMSSGYHSQTDGQAEMINQKLEKAQLNMKHFANTKRREVQFKICNWVMVQLRPHRQPSVPGVRTSYSKLAKCFYRPYQVLYQIGKVAYKLQLPEGSHIHSIFHYFVLKPFHQTSEEDCVPRALSSNDVENQPVISPLAIMGTQWAYESTDPKLK

SEQ ID NO: 133366 - protein, 371 aa, Glycine max
  Coding DNA Sequence Number=SeqID_16588
MGTRHFNYLLEAEQQRVWDQYQQVLAEEEVMFYQSQWHLVSDDIVDLVLRDFRPIGLCNVSYKLVTKILAYRLRGLIQNKKGVKGWMTIKVDLKKAYDRLKWEFVLETLFDIGCPSSFVKFGFVSLLLRCVCFGMGKFWRNSSPTAEFAKVIPSHLTCLCSSLSGFFNLSTWRTLFVDCNGPVVRSKYKCGRDQTPKGDKKHIPNQGSLKDKALIPLQESNLQSKVIDFVLPSRAVMLFGNVVGPNPLFEAIWKWRGHKRTKVHLWKMAHQALLTNQSRLRSHMTNNATCLGWHGGLIRVSECHEGYHAHFMDLRQYISPPSSEQAYGQKRLSNVEGDCPMSGRVYDVRGVVTTTVVWDRHVFGVLGEGSL

SEQ ID NO: 133367 - protein, 61 aa, Glycine max
  Coding DNA Sequence Number=SeqID_16589
MEGEEPMSRLKVECTWSTQTASPTGEFGVREQIAISPGDIYMHREPPAWDKEIAMPMGELA

SEQ ID NO: 133368 - protein, 44 aa, Glycine max
  Coding DNA Sequence Number=SeqID_16590
MVIRALRCDNNDAGIVKLPYIAGVGEEGEGHLCPIGVQEAKMKL

SEQ ID NO: 133369 - protein, 214 aa, Glycine max
  Coding DNA Sequence Number=SeqID_16591
  Gene Ontology: Mol. function=tyrosine decarboxylase activity; Cellular component=cytoplasm; Biological process=metabolic process
  Homolog annotation: Hit_ID=Q9FNH8; Match level="QueryCoverage=99%, HitCoverage=98%, E-value=1e-88, Identity=77%"; Hit description =Lysine decarboxylase-like protein
  Pfam annotation: Domain name=Lysine_decarbox; Domain location=53-186; Score=250.4; E_value=3.6e-72; Accession=PF03641.4; Description=Lysine decarboxylase family
MEETKSKFKRICVYCGSSSGNKASYQEAAVELGKEMVERRIDLVYGGGSVGLMGLVSQAVHDGGRHVLGVIPKSLMPREITGDPIGEVRAVSDMHQRKAEMARQADAFIALPGGYGTLEELLEIITWAQLGIHSKPVGLLNVDGFYNSLLSFIDKAVDEGFISPKARRIIVSAPTAKDLVRELEEHVPERDEVVSKLVWEDRLNYVVPESEVAM

SEQ ID NO: 133370 - protein, 231 aa, Glycine max
  Coding DNA Sequence Number=SeqID_16592
  Gene Ontology: Mol. function=oxidoreductase activity; Cellular component=outer membrane-bounded periplasmic space; Biological process=electron transport
  Homolog annotation: Hit_ID=Q1YHV8; Match level="QueryCoverage=100%, HitCoverage=57%, E-value=4e-90, Identity=67%"; Hit description =Possible glucose dehydrogenase B
  Pfam annotation: Domain name=GSDH; Domain location=147-231; Score =165.2; E_value=1.7e-46; Accession=PF07995.2; Description=Glucose Sorbosone dehydrogenase
MLDVALSPSFAADRTIYFSFSEPRDKGNGTTVAKAKLVESDGKARLEDVKVIFRQMPTYDGDKHFGSRLVFGPDNELYVTVGERSDATPRVQAQDLSSGLGKVFRIDADGKAFEGNPFAGQQNALPEIWSYGHRNLQAAALDGQGRLWTVEHGPKGGDELNLPKAGLNYGWPVITYGVEYSGRAVGEGATAKEGMEQPVYYWDPVIGPSGMAFYDGDGIPEWKGAFIVGGL

SEQ ID NO: 133371 - protein, 116 aa, Glycine max
  Coding DNA Sequence Number=SeqID_16593
  Gene Ontology: Mol. function=ribonuclease H activity; Biological process=DNA integration
MDIEPRYELLLGQRRTPWFMGWKRYSHLRSHGRLYQQRIKNVFDRKVCPRKFNEGDLVLKKISHTVKDNRGKWAPNYEGPFVVKRAFSRRALVLTNMDGKELPSPVNSDVVKRYYA

SEQ ID NO: 133372 - protein, 51 aa, Glycine max
  Coding DNA Sequence Number=SeqID_16594
MASAITWATWTLIRVRMAHTNWHLGKGWPRVSKNQNPMSACILKGVLAQES

SEQ ID NO: 133373 - protein, 116 aa, Glycine max
  Coding DNA Sequence Number=SeqID_16595
MAPTRHPLDPDKSKRALGFPALITGLCQSYVVPVTPSKSVIYSIWFASRQSTTADRCRYIIVSTPEQFGAEVAWPGDWRDAQAGEEHAGSSGEVDESHMDEDMTNLLGFLGGSGAA

SEQ ID NO: 133374 - protein, 105 aa, Glycine max
  Coding DNA Sequence Number=SeqID_16596
MAPNRTQLQNMVKKESETFKEYALRWRDLATQVAPPMVEREMITMMVDTLPVFYYEKLVGYMPSSFADLVFTGERIEVGLKRGKFDYVSSTSTNARRIGATGEKR

SEQ ID NO: 133375 - protein, 119 aa, Glycine max
  Coding DNA Sequence Number=SeqID_16597
MTTFTWIWMTLLFSNILPGDHNANLPLQMYRLESHPQRHSVDPEKSNRALGFPALGSRLQDTHWTRRSPTRSWSCQALITGLCQFYGVLVTSGKGIRPPANRAFIKKYCVPRQAQGETP

SEQ ID NO: 133376 - protein, 191 aa, Glycine max
  Coding DNA Sequence Number=SeqID_16598
MVGYTPSSFPDLVFARKMIEVGLKRGKSDHHALINAKKKTGANEEGENEGETHAVTVIPIRPSFPPTQQCHYSANNNPSPYPPPSYPQRPSLNQPQSLSTALPMTNTTFSTNQTTNQKGILQQKPVGFTPNAAITPARFPQPPFFQGYNSNATCAYHGGVLGHSIEHCMTSKRKVQSLIDAGWLKFEENCL

SEQ ID NO: 133377 - protein, 170 aa, Glycine max
  Coding DNA Sequence Number=SeqID_16599
  Gene Ontology: Mol. function=oxidoreductase activity, acting on the CH-NH group of donors, oxygen as acceptor; Cellular component =peroxisome; Biological process=electron transport
  Homolog annotation: Hit_ID=P40874; Match level="QueryCoverage=100%, HitCoverage=45%, E-value=3e-60, Identity=66%"; Hit description=N -methyl-L-tryptophan oxidase
  Pfam annotation: Domain name=DAO; Domain location=4-170; Score=8.2; E_ value=1.3e-06; Accession=PF01266.14; Description=FAD dependent oxidoreductase
MQYDLIIIGSGSVGAAAGYYARRAGLNVLMTDAHKPPHQEGSHHGNTRLIRHAYGEGEKYVPLVLRAQQLWDEFAQDSGETVFEKTGVINLGPASSDFLNNVAHSARQFKLNVEELDAEAVMKRWPEIRIPQDYRAIFEPASGVLRSELAVETWIRLAREAGCAQLFNCP

SEQ ID NO: 133378 - protein, 163 aa, Glycine max
  Coding DNA Sequence Number=SeqID_16600
MKQKRLVKAIVDEDKGLNNFGIAKRVQKIMSEQQKRKKRRKYTQREEKEEEFMAKDSMNKEIAKGAFTAIHPVAITPKKKRKVDIQKQASPTPKKARVTRATPTAKKPVIPSKFPRRLKTRATKANPKIIDKEWAPPKATYKEWTPPSPPSSSSSEITHDALI

SEQ ID NO: 133379 - protein, 142 aa, Glycine max
  Coding DNA Sequence Number=SeqID_16601
MPFENSPEEEIIPTMDFTTILTDGEPTIHVKHYFDIIELEKVGLKLDETLLFCCARLYFNEPQLVYLELIRMFWRKFEFLNSKAIVSWLLELRKLCQMTPLPRPLGVFVRATPIMKVGRGPMVVMYPKPFTKKLQTNLVTKR

SEQ ID NO: 133380 - protein, 211 aa, Glycine max
  Coding DNA Sequence Number=SeqID_16602
  Subcellular localization annotation: CTP_CleavageSite=46; ConfidenceScore=5.01e-01
MGGPHFVQVQNKHAFSPYGLPPNYTPPNMVHTPNQNVNDSTPIFIESQQPQSDHTPIPQPMGGTHETPHHNLANFKPCLEYATEGQTVGGVPLPNTLEGPQFRPQPQPLHFAMGRAPSAMAGKGKLDQIEERLRVVERGEDYALADMEDLCLLPDVVIPPKFKVPDFDKYKGTTCPKNHQKVYYRKMGAYAKDEKLLMHFFQKSLTEAAVT

SEQ ID NO: 133381 - protein, 178 aa, Glycine max
  Coding DNA Sequence Number=SeqID_16603
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=58%, HitCoverage=14%, E-value=4e-58, Identity=99%"; Hit description =Photosystem I P700 chlorophyll a apoprotein A2
PTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQ

SEQ ID NO: 133382 - protein, 160 aa, Glycine max
  Coding DNA Sequence Number=SeqID_16604
MASLLAISHVARKTPVVMASSYHLQVASPSGESEHRISLLFQREVPAFSYERIPLICFFNVAVLRFKGFIYVKFILTLLCTEISVFKIVHDEFDYNSVVFQWKGSKKAIQIKRGISFNALKKKIRDKILCQKNILPCKFAMTKTLKRCWKVLNNNKKCQF

SEQ ID NO: 133383 - protein, 249 aa, Glycine max
  Coding DNA Sequence Number=SeqID_16605
  Gene Ontology: Mol. function=nucleoside-triphosphatase activity; Cellular component=chloroplast
  Homolog annotation: Hit_ID=Q2PMM5; Match level="QueryCoverage=98%, HitCoverage=10%, E-value=1e-144, Identity=99%"; Hit description =Protein ycf2
MIHWKESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSK

SEQ ID NO: 133384 - protein, 273 aa, Glycine max
  Coding DNA Sequence Number=SeqID_16606
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q56834; Match level="QueryCoverage=99%, HitCoverage=40%, E-value=2e-95, Identity=63%"; Hit description=RpfC protein
VCDVQRDLDPEHAAARAVRRIADLPAHRLDQALGNGRAQTGAFMATGQADIALLEGIEQAPAQRHRHADAGIDDLESQAHPLAAQRIGAGHAQMHVAAVGELDRVAHQVQQNLLQMPGITQQARRHVVVHLHAIVQRFGAGLRGQDQVDRLQHIGQRELVPFHAHLAGFDRGDVQHLFHQRQQAAGRGLDGVQALALFIVQAGGGQHLGHAGQPVQRRAEFMAHVGQEAALGLIGLARLGHRPGQGMQQRIELPRNRAQAQQQAPAQIVVAAP

SEQ ID NO: 133385 - protein, 129 aa, Glycine max
  Coding DNA Sequence Number=SeqID_16607
MVAMSLAKIPQPPFPQGYNSNGACAYHGGVPGHSIEYCMTLKHKATTSDTSKPYTGAMIDAMREPRAKLGVNRKCSPAKTGHYGKSSRGPKSTDFHLLGASIIPLDALGFIVLFLRVQFLPPRRGKDEP

SEQ ID NO: 133386 - protein, 135 aa, Glycine max
  Coding DNA Sequence Number=SeqID_16608
MDQLGSCPQDAQSTRRSPTGPWGFQLWLRAFVVLQGARFPPADGLVGLCRHDIGIAPTKTPSGPEEVQQGPGVSSSGYGPLSVLQGARSPSEESHPQRHPVDPEKSNRALGFPALVTGLCSPTGCPFPPGKVTSS

SEQ ID NO: 133387 - protein, 66 aa, Glycine max
  Coding DNA Sequence Number=SeqID_16609
MASLSVMLLVEEDTVTPRQKVCIGAVWRVEEKAHWQKTSHVMVSPVENVVGTATVAICSGKCRKCR

SEQ ID NO: 133388 - protein, 129 aa, Glycine max
  Coding DNA Sequence Number=SeqID_16610
  Gene Ontology: Mol. function=RNA-directed DNA polymerase activity; Cellular component=cell wall; Biological process=RNA-dependent DNA replication
MRIPWVKWDVICLPKEDGGLGIKDISKFNAALLGRWIWALSSNLNQLWARILISKYGGWAELNNGRDKAWHSQWWRDLRKLNQQPEFSSIHQQMVWKVGCGDKIKFWKDKWLGVDCNIEQQYNQLFMIS

SEQ ID NO: 133389 - protein, 91 aa, Glycine max
  Coding DNA Sequence Number=SeqID_16611
MGCQVPTKWSNEGRIPTTGGSPDEIRTQNDHNLSLRFVGHDRAWAARHRMTIICLCVPPDTIVSGRRKGVRNDKGHKICLCAFITQLAKSE

SEQ ID NO: 133390 - protein, 68 aa, Glycine max
  Coding DNA Sequence Number=SeqID_16612
MKLCFYKHKLLLNPECFPVKQKLRRMKPEMSLEIKEEVKKQFDASFLAVARYPKWVANIVSVPKKDWK

SEQ ID NO: 133391 - protein, 110 aa, Glycine max
  Coding DNA Sequence Number=SeqID_16613
MARTRGLGCAIGRVVGRDRAADEDAGDVPESRRPTASARRLRVHQMTTEGRDMAEDPTEAPEMRADAQGADSGEGSDGDDAAEGFPGGPRDPSVLTSFAEHVAHAVWSGP

SEQ ID NO: 133392 - protein, 87 aa, Glycine max
  Coding DNA Sequence Number=SeqID_16614
MTKLGLCVPSDTTVSEWQRGADNRKVSPRIIMTKLGLCVPTDTTVSEWQRGADNRKVSPRIIMTKLGLCVPSDTTVSEWQRGADNRK

SEQ ID NO: 133393 - protein, 87 aa, Glycine max
  Coding DNA Sequence Number=SeqID_16615
MENGRTALGINLRGSRLVGGGHMNSARQSIHGSPNKIENGELASSARQSIHASPNKIGEWELANSARQINSRGSRLDGGGCMNNARQ

SEQ ID NO: 133394 - protein, 48 aa, Glycine max
  Coding DNA Sequence Number=SeqID_16616
MAILCVILKLEWARASKKLFAKMARKATAGEGSSSAPQAEIEFDGHYF

SEQ ID NO: 133395 - protein, 74 aa, Glycine max
  Coding DNA Sequence Number=SeqID_16617
MSGFTRNSPQISVSPHQLDLAPYASEPYHAQWNAPGLLRDKHTLRSSRILEEMEVDEPWLGGVRHWKCGRQTLW

SEQ ID NO: 133396 - protein, 67 aa, Glycine max
  Coding DNA Sequence Number=SeqID_16618
MTTLCKSEGRKSEHFHKDYLKCKSWFEKKSELNARRFLTIQTISPNEKFIFMGNRVKLQCKQSRLIA

SEQ ID NO: 133397 - protein, 183 aa, Glycine max
  Coding DNA Sequence Number=SeqID_16619
MTARCVFFVSLVLCRTPLEEQVTQGSFVPHGRQDILNTAIGRPEHGGRVRAAGSGVTITQYYGRASRTCSSSSTSISQQQLDEVVARLREDMTGQIREELRTQIKEELRTQLEEENKRSLEIMTNALKEAIKKELSNKGSPELLQIQSDIQQVAARVSTQGSNVVTNVQASQEHHADAIPLMG

SEQ ID NO: 133398 - protein, 126 aa, Glycine max
  Coding DNA Sequence Number=SeqID_16620
MTCALRGGCERVLGNILSSLGSEFIGNRGRFRMGYEPTHTDMRQIALGRRRRSMGQLQGLLVKRVPLCHINKRFVSAGWMCEGRITMIHKETPQEQPNWVRPCPPEFELGNWRIGKKPGISVASSM

SEQ ID NO: 133399 - protein, 165 aa, Glycine max
  Coding DNA Sequence Number=SeqID_16621
NEDKGYVGVRELIWRWATRDGGLYVICGCGELLCTIARPPPSTTCDGMVPGDMSQGSGDLGDVRRAPDSQQIKGTKTTKQGGLCGGWASCESCVIYGLWPLEARGASGNRLPGDVIDYHASKGNWKTVEASGNQLPVFVIDYTEEWVTVWPLVIDYQGCVIDYQG

SEQ ID NO: 133400 - protein, 56 aa, Glycine max
  Coding DNA Sequence Number=SeqID_16622
  Homolog annotation: Hit_ID=Q2HRM7; Match level="QueryCoverage=98%, HitCoverage=14%, E-value=1e-11, Identity=43%"; Hit description =Polynucleotidyl transferase, Ribonuclease H fold
MGSKWTLRKSRPSKNGPPQKVWEILGASMGWQASIEVKNFMVPPLTTPPMIKSFMP

SEQ ID NO: 133401 - protein, 221 aa, Glycine max
  Coding DNA Sequence Number=SeqID_16623
MLIIIDQYKEKVNLAASHGHMLEDEQAKVLALRVEREAREGVIELLHKEAMKWMDRFALTLNESPELPRLLARAKAVANTYSTPDKVHSLFNYCQHMNERALGHPYQTRAKARIMSEIEEVQEQMKADMEAMKDQMTTMMEAMMSMRKMVEVNAATVVAISIVTEVDLTHPSGINKVQSKHPFPSYGLPPNYAPPNVAHAPDQNVDNSAPIPIESQQPQFG

SEQ ID NO: 133402 - protein, 92 aa, Glycine max
  Coding DNA Sequence Number=SeqID_16624
MWAIIDQYKEKLNLAASHEQRLEDEHTKLSLAHQWAKRASTAKRSFSATEESGRASISSSCAKCEISVLSTADVFSQAQRTAGAMPESTFAR

SEQ ID NO: 133403 - protein, 153 aa, Glycine max
  Coding DNA Sequence Number=SeqID_16625
  Gene Ontology: Mol. function=electron carrier activity; Cellular component=membrane; Biological process=electron transport
  Homolog annotation: Hit_ID=P29602; Match level="QueryCoverage=71%, HitCoverage=76%, E-value=7e-15, Identity=41%"; Hit description =Cucumber peeling cupredoxin
  Pfam annotation: Domain name=Cu_bind_like; Domain location=21-112; Score=42.6; E_value=1.4e-09; Accession=PF02298.8; Description =Plastocyanin-like domain
MIFIIGVTEATNYTVGDSFGWSVPSNKSFYTDWASTKKFFVGDNLIFNWNGNHSIKITMKTIDYESCNSSWFDALTYLVTKNGTAMSIHTIDAPIGYRYFYCIVGNHCELGQKFSINVQSHSGSSPAPAPAPSFGILSAFLSSLAVYFFTLTR

SEQ ID NO: 133404 - protein, 162 aa, Glycine max
  Coding DNA Sequence Number=SeqID_16626
GTIVDDWKFDYSSHDACRMVYNDQAEMTGRLLAGSLTFDNRIMHYIIIDWAHLVRYRMHKALRANAPLPYPHLITLFLRHFQIPLDDEPFVQVKRSFAIGAGAVTSFGYRKDRNGQWLKKDALPPQDEREMLAAQLAQASQVASSRSNNLLEESSGGPKWAW

SEQ ID NO: 133405 - protein, 47 aa, Glycine max
  Coding DNA Sequence Number=SeqID_16627
MATIALSSRYGSKLAYDTEIEVLDVRQASLVADLGFLVDRVMGNEKG

SEQ ID NO: 133406 - protein, 344 aa, Glycine max
  Coding DNA Sequence Number=SeqID_16628
  Pfam annotation: Domain name=Transposase_23; Domain location=193-263; Score=-16.8; E_value=0.079; Accession=PF03017.5; Description =TNP1ENSPM transposase
MGPVLPDSQRPFLGGMYIAIQKQNIAPHVLSHGGYEYLEQKLLAEKTKKKLEKAGQSGSIDGIIDPPSPVKRHVKWKMVRVKTIGEMTTEAAKEIAEKIDSFEERATQGSFIPHGHQDVLTAAIRRPEHPGHVRAAGFGVTIKQYFGSAPWTSRSSSSLPLEELQQLTYPSSVLDAISGTCTASRASGNDPETGDSDRCGLYIEANPARLVTLGKVYEGSTIVHNTPLLLGQVKVGAKEVKDPNAAVPVPTDEVSLVGQTIHTFLAWPTHLVKSLSQQLVVSSAKPPEKSDPEVDDLLYLMTLTIPELFLRPYQVTWDATMFKAFNPDFPLYIKHKDLSEIAHG

SEQ ID NO: 133407 - protein, 84 aa, Glycine max
  Coding DNA Sequence Number=SeqID_16629
  Subcellular localization annotation: CTP_CleavageSite=55; ConfidenceScore=5.61e-01
MPLSAAADSLAVTSHYYSAGFTSTFSQSWSPLLIRTTTRIPRVSKLHQMLHFKITSSYGRTECTSCIVYLFNGRTTIGIVFLHS

SEQ ID NO: 133408 - protein, 57 aa, Glycine max
  Coding DNA Sequence Number=SeqID_16630
VKASEESDEVQALKAELERARVVEEKFKSIAIKSLKRGSNSKLKLRRGERNHHGSKA

SEQ ID NO: 133409 - protein, 117 aa, Glycine max
  Coding DNA Sequence Number=SeqID_16631
  Homolog annotation: Hit_ID=Q1SMW2; Match level="QueryCoverage=60%, HitCoverage=3%, E-value=1e-09, Identity=51%"; Hit description=SNF2 -related; HMG-I and HMG-Y, DNA-binding; Bromodomain; ATP-requiring DNA helicase RecQ
MADEVINARLFDQRTTHEERHLTLETLLHEEERYQETAFQCSVTAGISSDERNEYAHEEEIGEFDDDGYSVAHGAQTIDKDQLEYGLLCDAGYEFPQSLETTRNNQMVEEAGSSALS

SEQ ID NO: 133410 - protein, 132 aa, Glycine max
  Coding DNA Sequence Number=SeqID_16632
  Homolog annotation: Hit_ID=Q1S8C2; Match level="QueryCoverage=31%, HitCoverage=7%, E-value=6e-15, Identity=95%"; Hit description =Armadillo
MGDAGFMLEFVKFLNAKSFEVREMAAEALSGMVIVPRNRKRFSAGYAAIVVRPLAMADCTKECSKNIIVYAFVLCYHMLKTSILGKHIVIDEVSICIAFPCSKAMSFGYSYFLVVNEQCEHVAIANCSYHVA

SEQ ID NO: 133411 - protein, 65 aa, Glycine max
  Coding DNA Sequence Number=SeqID_16633
MDALLISKQVARTSNTQKDALSKIDESHGLNYEKRTKVYRIQHELVDMDLWLSVFLLHSLEGGFF

SEQ ID NO: 133412 - protein, 57 aa, Glycine max
  Coding DNA Sequence Number=SeqID_16634
MGSETETTNKELRERKRDIVREREETPFGAPLNTVVAPALRCNDFDPPGTIKGRWRL

SEQ ID NO: 133413 - protein, 125 aa, Glycine max
  Coding DNA Sequence Number=SeqID_16635
MSSEPICVYVYINGEIIHGSSDVSKGAHYSLTCTNNRINANLNNPHGIDERCRKGLLSESDWLSKAHPLNEEVSLLSEYKILENVESESSAQPTRPARMLSLLALSAQPLILAQLDMLAEHAFIS

SEQ ID NO: 133414 - protein, 323 aa, Glycine max
  Coding DNA Sequence Number=SeqID_16636
  Subcellular localization annotation: CTP_CleavageSite=50; ConfidenceScore=5.51e-01
MHSTATRSSRYRSRRSSAPTSRMAAASSYKQGARSRYSCHSSKETHGRPSAERERAPASTSGEGCAMTVTFDDTALRAHVDPALARTESRERVAREGRQVGVVLGSGWVVFQSAVLVAGAGVLAALAVVAVQFMFGGDGADLTTVVLAVLMVLPLAVVRIRSHLRGPRDREVEEYRLEKFAEANALTYRTGELDPERPAALFRLGTSRVASDIVAGTSPRPFEAANYSFDVWVARARMPRVANYVEFALRNPLPALTVVTKATDVAASGWEPAAGQERLPIEGDLASRFEVFTAGATAEPVRHLLSPEGEAALIAVAERCDVE

SEQ ID NO: 133415 - protein, 49 aa, Glycine max
  Coding DNA Sequence Number=SeqID_16637
MTRGSHGWLWVVKEGFPGFGESLEKERVSLSEVVSLSKLFPLGEIVLSE

SEQ ID NO: 133416 - protein, 76 aa, Glycine max
  Coding DNA Sequence Number=SeqID_16638
MACYDFPKHLLPVHLNLQFYTQKDLMSNIEENKYLGQMDVNASDKSANMPSSQKQEEAVKKKYGGMLPKKPPLISK

SEQ ID NO: 133417 - protein, 983 aa, Glycine max
  Coding DNA Sequence Number=SeqID_16639
  Gene Ontology: Mol. function=zinc ion binding; Cellular component =intracellular; Biological process=anti-apoptosis
  Homolog annotation: Hit_ID=Q10CF1; Match level="QueryCoverage=86%, HitCoverage=89%, E-value=0.0, Identity=48%"; Hit description =Expressed protein
  Pfam annotation: Domain name=zf-C3HC; Domain location=74-199; Score =172.6; E_value=1e-48; Accession=PF07967.4; Description=C3HC zinc finger-like
  Subcellular localization annotation: CTP_CleavageSite=65; ConfidenceScore=5.73e-01
MNEDGVTSANLNPSLPKPPSSPPTPAASSAGASSPAFPANAGNGDASRRDKSSADSHAVLGSVLLGASVPSCRPWERGDLLRRLSTFKLAGKLPKVAGSLACAKRGWVNVDVAKIECEICGAQLDFALPSASSFEADASSEEFSEQLDRGHKTTCPWRGNSCPESLVQFPPTSPSALIGGFKDRCDGLLQFYSLPIVSSSAVEQMRVTHSPQIDCLLTQLQIQTAGELGCRSENACGMGLTGEQAPHPYSHAQKLISLCGWEPRWLPNVLDCEEQSAESAKNGYSSGPAKGSAHDPAPSKKEYSTSSRKDTGDNDVLGSEFNCESRSPLLDCSLCGATVRVWDFLTAPRPVHMTPCGIDTPQTSKKIASTRGISAASGINEWATTDGVEKERTGDHDEATTSDKRQLVSNKSLDLSLRMASGPSFSPINLTSTSGHVQGAGEGKYLMIGRPSGSEVGDLATYYESQGPNAHKRKLDDGGTTYDRPHLNMQQADSAERTVTDFDNNEVMGSQQYSAHPFKRARDTNVLETSQFPLRNSSDVPSHSLDIQIEPDANTTNQLNPGRDHAIGILSTRDSAHASSIIAVNTVYQGSDDESMESVENFPVDVNNNVVNFPSVDLNETSELNQAQQSVCFQPLLERAGGETGVSSSNACGEVLNTEILTAHARDGPSFGISGGSVGMGASHEAEIHGTDASVHRGDSLGDVEPIAEVIENQGQAGEFEPSHGLTGDFVPGEMSREDPQGDSQAVVSQSTARADSGSKVIASAKVESVESGEKTSSSMQVLGLENGAHPSLSCNAVVCSAYEVSKEEVTQTRKASHIDDGASHESSRLITDVMGTPYRDNSNGGVEFDPIKLHNDYCPWVNGDVAAAGCDNPCSSSGVGSVALCGWQLTLDALDSFQSLGHLPVQTLESESAASMCKSIAPTIAGGQKWSDSLLQLRHLMQMPGCHGCCSVIHEKSQQYAGFTDDSPFVPFLDMPCDLCHC

SEQ ID NO: 133418 - protein, 498 aa, Glycine max
  Coding DNA Sequence Number=SeqID_16640
  Homolog annotation: Hit_ID=Q1SFS3; Match level="QueryCoverage=31%, HitCoverage=35%, E-value=2e-13, Identity=27%"; Hit description =Lambda repressor-like, DNA-binding
VHEKIWDLAMIEMSVEAIASLTQYYNQSLRCFTFGDFQLAPTIEDFKGILGCPIGGRKPYLFSGYYPSMARIAGVEKTKTLASQGEWVSFIDVLALLVFGSILFSNVDGLVDLATIDAFLAYHHNKESPVIVVLVDAYDIFNLRCENSSARIVCCMPTLYDKANWEELLVSMTGASISCFPQWKEGGAGGSMKILQRICKAWNKVGRKDKELRGRSNGIIDGYHKWLNSRMQGITWLQKLKSLNGEEAEVPKESEEVQALKAELEKTKVAKEKLKVAVTRVRKEYDKPKDINMTMAEVLDNELKLGKDKRDKSRMESVMLKDKVEREEREEVIELLHEEGMRWMDRFALTLNKSQELLKLLAKAKTVATTYSAPNEVHSLFNYYQHMEVQELMKVDMQAMKEQMTTMMKAMMSMRKMMEVNMAIVIAASTTTKVDPTHPFGLNQVSHPVSDIVGQGGEALGSTGSPHFMQVQSKHSFPPYGLSPNYTPPNVAHAPDKN

SEQ ID NO: 133419 - protein, 169 aa, Glycine max
  Coding DNA Sequence Number=SeqID_16641
  Homolog annotation: Hit_ID=Q1S7R2; Match level="QueryCoverage=38%, HitCoverage=10%, E-value=1e-07, Identity=46%"; Hit description =Tetratricopeptide-like helical
MASLTQNVGIIGLVLIVASLVALFYLLKRPTKPGMFDTEQAYYQNITIPKASTLSARANANNCRSCYKLHPVPSSALTPAYAANPCHFLDALKVFDEMLQPNVASLNASLSGFSRNGHHGEALRRLAKYVNDNGVTAEVIEDFAEALKWKEDGRNKRLEEIGKEDIHLN

SEQ ID NO: 133420 - protein, 123 aa, Glycine max
  Coding DNA Sequence Number=SeqID_16642
MLPFHPLCRLPGTQQPEENGQTRRNWVEHPNREGSVLEVEDQTPTQDPNQENPIAQEDGAVGSGCVREDDARLGHHPDLQVPPHGAWCFVRASWRRRNTSPVTRNGPNVNLKNKVNTTVYVAL

SEQ ID NO: 133421 - protein, 293 aa, Glycine max
  Coding DNA Sequence Number=SeqID_16643
  Homolog annotation: Hit_ID=A0EG06; Match level="QueryCoverage=23%, HitCoverage=18%, E-value=3e-17, Identity=61%"; Hit description =Chromosome undetermined scaffold_94, whole genome shotgun sequence
MWKQIEISHQNRIWRIFGNGGDKLEEGYLVTQVYGFLLQVDEEGNQNFFNKIWRFLIPFKVEEKEFVYYMAGNLDGCRMDIMGVGYKGIKEFGHCMPFSFCVSTESKERWITGGELSAYVGEICYSILFRINIPPLQTPNTSRTTRHRASTQIDGGDGFPRKTHHRSLMKPKPKPYSFLPLNRFLRALQSRPLMAQTPTSLDAEHPSDNDQHMGFRARSLSGESRAEQAWAHWTKLGRPRFIVAPMVDNSELPFRMLCRKYGAQGAYTPMLHSRIFTETEKYRNEEFTTCKVV

SEQ ID NO: 133422 - protein, 456 aa, Glycine max
  Coding DNA Sequence Number=SeqID_16644
  Homolog annotation: Hit_ID=Q7CKG3; Match level="QueryCoverage=39%, HitCoverage=97%, E-value=6e-50, Identity=51%"; Hit description =Putative transcriptional regulator
SADSALLVFVLRYAIAKEELPQLAAFRQVAQIAIIKKRNTHQPVAPGLARAADIAHRQRCRTLADADKIRAVGRTGYLITALHQWRLQQIAQVRPDAQIRHRLTVAPHGGRLIGAVKQHNQLMIKHIVQPATDVLIQPVAVRLRLRQLIGKRGPARQAAQLAQMFTQALIERGGDHPLLLLARLMVGGRGAPEQAETGTEKSQQQNRHQRQDHFAQKIAAKTVRKFEGVYHFKVSRSGQGLLIKLAEFTQPASGKGSVKGVKLHAIFLRLVTKRDGDIQTSDHCLSGGCRPAGAGAAGALSLRRLSAVRTAAGRSLRRQSPHAAPGRTLAGEQRPAAAAPWRRHPGADAPRHSLTHPAPRQRRAGVRDQPLSGRPVLVAGAADVPARFPARLHAAAARPAVESPSDPHQYPPRTGQRVQTAGDYAARAAAVRAHPEYTAGRSGGGVLRQPDAWRHD

SEQ ID NO: 133423 - protein, 280 aa, Glycine max
  Coding DNA Sequence Number=SeqID_16645
  Gene Ontology: Mol. function=translation initiation factor activity; Cellular component=intracellular; Biological process=translational initiation
  Homolog annotation: Hit_ID=P57997; Match level="QueryCoverage=99%, HitCoverage=28%, E-value=1e-121, Identity=79%"; Hit description =Translation initiation factor IF-2, chloroplast precursor
  Pfam annotation: Domain name=GTP_EFTU; Domain location=78-240; Score =130.9; E_value=3.6e-36; Accession=PF00009.17; Description=Elongation factor Tu GTP binding domain
  Pfam annotation: Domain name=IF2_N; Domain location=1-49; Score=42.6; E_value=1.3e-09; Accession=PF04760.6; Description=Translation initiation factor IF-2, N-terminal region
  Pfam annotation: Domain name=MMR_HSR1; Domain location=81-185; Score =4.4; E_value=0.00039; Accession=PF01926.13; Description=GTPase of unknown function
  Pfam module annotation: Pfam domain module=GTP_EFTU::IF2_N::MMR_HSR1; Domain location=78-240::1-49::81-185
MLVEELAYCLATSEGEILGYLYSKGIKPDGVQTIDKDMVKMICKEYDVEVIDADPFKVEGLVKKKEILDKDDLDKLKDRPPVITIMGHVDHGKTTLLDYIRKSKVAASEAGGITQGIGAYKVEVPVDGKNLPCVFLDTPGHEAFGAMRARGASVTDIAIIVVAADDGIRPQTNEAIAHAKAAGIDKDGANPERVMQELSSIGLMPEDWGGDIPMVPISALKGKNIDDLLETVMLVAELQELKANPDRSAKGTVVEAGLDKSKGPFASFICAEWAPSDGEI

SEQ ID NO: 133424 - protein, 260 aa, Glycine max
  Coding DNA Sequence Number=SeqID_16646
MVNIWQEPWLRKQGHRYVETPMVEGLEDMTVADIVSHQNDSWNLDIINQILIPDDIIDMLDEPNQVRAAISFGACGGVGEKSLDYKAIVQHGDFFYQDGIKAQEKIIISPTDPWDHQKQHCGASLQQEYNCTSIGISIRGSSGVFVETITQWRSPRLYVLEGETRTLCVALDFVLGMGLSNVIFEMDKTIVDKVHYNSLNETEVGIFIRECRIILDSNQTFNIGFLRRQHNGVAHASARVAPYFSCSQYSNHAPTCVLII

SEQ ID NO: 133425 - protein, 62 aa, Glycine max
  Coding DNA Sequence Number=SeqID_16647
  Subcellular localization annotation: CTP_CleavageSite=46; ConfidenceScore=5.02e-01
MKDNNQWCLYDHDPLLLTDVSLQQESSSYTHCSSSLSQASLSSRSLAMADKPVSRGDSPSIG

SEQ ID NO: 133426 - protein, 490 aa, Glycine max
  Coding DNA Sequence Number=SeqID_16648
  Gene Ontology: Mol. function=protein serine/threonine kinase activity; Cellular component=cytoplasm; Biological process=protein amino acid phosphorylation
  Homolog annotation: Hit_ID=Q43619; Match level="QueryCoverage=86%, HitCoverage=87%, E-value=1e-153, Identity=65%"; Hit description =PsPK3 protein
  Pfam annotation: Domain name=Pkinase; Domain location=93-402; Score =215.4; E_value=1.3e-61; Accession=PF00069.15; Description=Protein kinase domain
  Pfam annotation: Domain name=Pkinase_Tyr; Domain location=93-402; Score=-12.8; E_value=1.1e-11; Accession=PF07714.7; Description =Protein tyrosine kinase
  Pfam module annotation: Pfam domain module=Pkinase::Pkinase_Tyr; Domain location=93-402::93-402
  Subcellular localization annotation: CTP_CleavageSite=51; ConfidenceScore=5.55e-01
MDEPTLLFPDTDLDLSFTSTTTDRTTISARASLARTSSLTLSFNDRLSTFSAAENTTAAVTNRLPHRSADPNWSAIQAAVNLSSDGRLHLRHLKLLRHLGSGNLGRVFLCRLRDYDGAHFALKVVDKDLLTAKKLSHAQTEAEILQTLDHPFLPTLYARIDVSHYTCLLIDFCPGGDLHSLLRRQPQFRLPLAAARFFAAEVLVALEYLHALGIVYRDLKPENVLMREDGHVMLSDFDLCFKSDVAPCVDFRAHSPRRVGPTNGCFSYNCHRSQDRRKEKLVAEFVAEPVTAFSRSSVGTHEYLAPELVSGNGHGNGVDWWAFGVFVYELLYGTTPFKGCSKEGTLRKIASSKDVRFVHVAEREEPGMTEARDLIEKLLVKDPKKRLGCAKGATEIKRHRFFDGIKWPLIRTYRPPELKGLMRRNKSKVSCKSKRWWWWWKRLGHVVRTKGESEFMLLKAIKCSNEVKDKEFIVKQMRDIIIKVGASDLV

SEQ ID NO: 133427 - protein, 873 aa, Glycine max
  Coding DNA Sequence Number=SeqID_16649
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=95%, HitCoverage=71%, E-value=0.0, Identity=53%"; Hit description=Kinesin, putative; 56847-62063
  Pfam annotation: Domain name=Kinesin; Domain location=192-513; Score =533.0; E_value=3.1e-157; Accession=PF00225.13; Description=Kinesin motor domain
MESSEVCLFVNRDRFAVLSRKNDTEDIGMEAKFKRLKRDFDSQRKELTETRRELGEIKRENQQKSRECQEAWNSLKELQNELMRKSMHVGSLAFAIEGQVKEKSKWFSSLRDLTRKLKIMKMEHIKLLEEAEASKKYQADMREMGLIIKSKINEQLESHEDLKSKYIEGATERKDLYNKVLELRGNIRVFCRCRPLNTDEIYAGATVALDFESAKDGDLTVMSNGAPKRTFKFDAVFGPQAEQADIFKDTAPFATSVLDGFNVCIFAYGQTGTGKTFTMEGTEEARGVNFRTLEKMFDIIKERQKLYCYDISVSVLEVYNEQIRDLLVAGNHPGTAAKRLEIRQAGEGMHHIPGLVEAHVNNMTEVWEVLQTGSNARAVSSTNSNEHSSRSHCIHCVMVKGENLLNGECTRSKLWLVDLAGSERVAKTEVHGDRLKETQNINRSLSALGDVISALATKSSHIPFRNSKLTHLLQDSLGGDSKALMFVQISPNENDLSETICSLNFASRVRGIELGPARKQLDTVELLRHKQMVEKVKQEVRLKDLQIKKLEETIHGLESKMKERDSKNKNLQEKSSFPQVDGFSWTSLANVSSLSVFTSKVKELESQLLVERKLARQHVDSKIAEQHQMKHQEEQNNTLLRPALASRPLGSLKNFNDPVSGGWFKDQQINSAKPLTENNILKPRIPFSTMESSIKCIDHAEKENNPDMADKALLPKRPGRASICMMTPRVPSAVASRRNSLIPLPSIPSLTQFQSPLLPKLTNQFDQKDANGESETNCVPAQTHCESPKEVRSGAKRIGSILRRSLHKKIQVKSPLQQHMRKVGVNVGMEKVRVSIGSRGRLAPRGQVGSGRRGGAKDIQQKNSQKEKERGWI

SEQ ID NO: 133428 - protein, 103 aa, Glycine max
  Coding DNA Sequence Number=SeqID_16650
MKGTFYLELVKVFYTFASANMQGNLYSTVNGVEMIIGVVVWKVVAGINMGGVCKFEESTDGYNKMQTYRVMLLDPIMAGEPLPVENINQMEEEMEEEAQQEYA

SEQ ID NO: 133429 - protein, 125 aa, Glycine max
  Coding DNA Sequence Number=SeqID_16651
MTRTTLLFATVPTIQVLKNDSLISVAEPKYEDTLTLNLNPDPYANLPGGSAQTKEYYSYSSSCRRKSLDRSSSIRRIIGVVVEMDELKVVANVGVGANVIARFLIEWGEENTISDLVYWGTTTLL

SEQ ID NO: 133430 - protein, 149 aa, Glycine max
  Coding DNA Sequence Number=SeqID_16652
  Gene Ontology: Mol. function=sequence-specific DNA binding; Cellular component=nucleus; Biological process=regulation of transcription, DNA-dependent
  Homolog annotation: Hit_ID=Q9SXK9; Match level="QueryCoverage=90%, HitCoverage=48%, E-value=2e-15, Identity=39%"; Hit description=Heat shock factor
  Pfam annotation: Domain name=HSF_DNA-bind; Domain location=2-137; Score=-46.3; E_value=4.4e-06; Accession=PF00447.8; Description=HSF -type DNA-binding
MFLVIFYQVKGFRKTVPDKWEFANEYFKRGQKDLLAEIKRRKTVSSVSGKSGSGGNISASHSGGDDMGSTSTGSMEAATATVTTTQCADLSGENEKLKKDNEKLSDELARTKKHCDDLVAFLRDSLNVGPDVIDCIIRQGTCGSSNDDA

SEQ ID NO: 133431 - protein, 126 aa, Glycine max
  Coding DNA Sequence Number=SeqID_16653
  Gene Ontology: Mol. function=protein serine/threonine kinase activity; Cellular component=integral to membrane; Biological process=protein amino acid phosphorylation
  Homolog annotation: Hit_ID=Q9SHI2; Match level="QueryCoverage=78%, HitCoverage=8%, E-value=3e-35, Identity=72%"; Hit description =Similar to leucine-rich receptor-like protein kinase
MKVTEKCDIYSFGVVLLELVTGRSPVQPLEQGGDLVTCVRRAIQASVPTSELFDKRLNLSAPKTVEEMSLILKIALFCTSTSPLNRPTMREVIAMLIDAREYVSNSPTSPTSESPLDEDDGISSKG

SEQ ID NO: 133432 - protein, 238 aa, Glycine max
  Coding DNA Sequence Number=SeqID_16654
  Gene Ontology: Mol. function=hydrolase activity; Cellular component =cytosol; Biological process=pyrimidine nucleotide metabolic process
  Homolog annotation: Hit_ID=Q9WYN5; Match level="QueryCoverage=66%, HitCoverage=78%, E-value=3e-89, Identity=100%"; Hit description =Deoxycytidylate deaminase, putative
  Pfam annotation: Domain name=dCMP_cyt_deam_1; Domain location=25-146; Score=134.9; E_value=2.2e-37; Accession=PF00383.13; Description =Cytidine and deoxycytidylate deaminas
GEFVKDRLEEYLNNLKIEKKPDSRESWDSYFMRIARMVSERSTCVHRKVGAVIVKDHRILATGYNQPPSKFPHCNEIGCIRDDLEINSGEHQEICYALHAEQNALMQAAKFGIAVNGATIYVTHKPCSICARLIVNAGIKRVVYEKDYPDPLTDFFFKPGRWPSVWCPGCGNGIVLKAFLEAVDDLALPKEKVAVVSGIGCSSRATGYLDFNTLHTLHGRAIAFATGVKLESRISKWL

SEQ ID NO: 133433 - protein, 113 aa, Glycine max
  Coding DNA Sequence Number=SeqID_16655
QHSAQRPQCQSPPADVSVGLCRHDIGIAPTRRPVDPKKSNRALGFPALVTSLCSPTGCPFPPARSHHHDIVLVAPSKVIWPPTNRAFIKKYCVPRQAQGETPQQPGDGRRKLR

SEQ ID NO: 133434 - protein, 105 aa, Glycine max
  Coding DNA Sequence Number=SeqID_16656
  Homolog annotation: Hit_ID=Q8GU80; Match level="QueryCoverage=99%, HitCoverage=9%, E-value=6e-07, Identity=31%"; Hit description=MDR -like ABC transporter
MEKQYVISKGEALVKGVGSRKSNPIRHNDCSDEYSLWCHERKKPPSGLFRIEKRISHLCNTDMQIFNQEKAAGYKVFQVIQRKPLISIETKGMVPKKIKGDTKLR

SEQ ID NO: 133435 - protein, 84 aa, Glycine max
  Coding DNA Sequence Number=SeqID_16657
MQLILGFDIQNLVHCYYSVGVAARIRAIIEVAINNLMKTPMDYLTPEVGKTNNIPLLTLTQGLKFNFKHDGSLLVELLDRVASE

SEQ ID NO: 133436 - protein, 33 aa, Glycine max
  Coding DNA Sequence Number=SeqID_16658
MVKEMLRTSIGATPFSFVYGMEVVLPFEVEVPS

SEQ ID NO: 133437 - protein, 54 aa, Glycine max
  Coding DNA Sequence Number=SeqID_16659
MAQIDPGIGPNISMCVRVHSGVTNCHNLPFGGGCDVRLDGASSKEGKRVECHQR

SEQ ID NO: 133438 - protein, 1407 aa, Glycine max
  Coding DNA Sequence Number=SeqID_16660
  Homolog annotation: Hit_ID=Q10K57; Match level="QueryCoverage=53%, HitCoverage=96%, E-value=1e-105, Identity=34%"; Hit description =Expressed protein
MDNLVLGFDEGVQVGMPNEEFERTLKDEETTFMAPQASEECVSYDNARDNGKALQPVNDTSQVNLNSTSTVFQESEKPAQDLVIQPSNSLSPVVSESLVNEEASNGLLTQHSTTPSPVTVAPHYSSSNAPSQAEVPIKLQFGLFSGPSLIPSPVPAIQIGSIQMPLHLHPQVGAPLSHMHPSQPPLFQFGQLRYTSPISQAIMPLGPQSMSFVQPNIPSSFSYSHNPGGQMPVQTAPETSDSFMKNEIRHHSVDSQPGNSRNLPQSSLPSEDAENIAGIKGRFEAAHDPNNSSRTSSFQLDKKGNQNVVGKSSNISSSAKESEVQPVTRDASLHPVSKENFMESKTQFCGRGKRYAVTVKNSNPRSSGPATRVNRPDSGGFMRRPRRNMQRTEFRVRESAEKRQSTSSVLTDQFGLDNRSNINGRGAGVSGRTGHRKAMANKLGKQTVESATENSQGMDSGSRGEKVDGKESAKTQGFSHSGQSNLKRNLCSEEDVDAPLQSGIIRVFEQPGIEVPSDEDDFIEVRSKRQMLNDRREQREKEIKAKSRVAKAQRRPRSGSQSVVAVANSTKGSITAVEVANSIHADFVAADVRGMTKMDASSGFNSSLLSQALPPIGTPPLKIDAQPDLRSQMSRSHKTSLPAVSGGEKDPGSGVIFESKNKVLDNVQASLGSWGNAQISQQVMALTQTQLDEAMKPQQFDSQVSVGNMTGAVNEPSLPTSSILTKEKIFSSASSPINSLLAGEKIQFVIHLFSDRKFSCSLSRVVSHGIGPPRSSRSDMQMSHNLTGSDNDCSLFFDKEKHGNETHGHLEDCDAEAEAEAAASAVAVAAISSDEIVGNGLGTCSVPASDGKSFVAADIDRVVAGVGCEQQLANQSRSEEPLSVSLPADLSVETLPISLWPPLPSTQNSSGQMISHFPSVPPHFPSGPPSHFPFYEMNPMMGGPVFAYGPHDESASTTQSQPQKSTTSASRPIGSWQQCHSGVESFYGPPTGFTGPFIAPPGGIPGVQGPPHMVVYNHFAPVGQFGQVGLSFMGTTYIPSGKQPDWKHIPTSSAAGAGEGDINSMNMASSQRNPANIPSPIQHLAPGSPLMPMASPVAMFDVSPFQPSTEMSVQARWSHVPNSQLPLSMPLQQQEGIQTSQFSHVPSVDQPLNAKRFTGSRASTSSEGDRNFPRATDVNVNQLPDELGLGDTSNSTPTKTSAQSVVNKTPSVIPITDTLKVDVLNGNSHSSNNQNASSSFKNQPSQFDHSSGHGNYQRGGISQRNNSGGEWSHRRGYQGRNQSLGSDKNFSSTKGQRRNRRKGKEGSTVEKEELFGEGRRERANLKESGRRIFALCALSFISHGLTIRLPLTLVARHRYPIVILGPSLVFTHWERMRCEFNLEWGKDGVLRRSNNSNSNTGKEEGLL

SEQ ID NO: 133439 - protein, 951 aa, Glycine max
  Coding DNA Sequence Number=SeqID_16661
  Pfam annotation: Domain name=DUF947; Domain location=414-569; Score= -62.6; E_value=0.054; Accession=PF06102.2; Description=Domain of unknown function (DUF947)
  Subcellular localization annotation: CTP_CleavageSite=47; ConfidenceScore=5.65e-01
MAANSGTKYVSVNLNKSYGQHSSAFGSARTPRPAAGAAAAPSSSRPRSSHKAGPKLSVPPPLNLPSLRKEHERFDSLGSGGGPAGPGGSGTGARPSSSGLGWTKPIAEDVSRPVVKPAAAAAAVPVSSAVLRGEDFPSLRATLAPGPGPNQKIQENQNSIQNQNLNQKQKHSLGDENVFVEEKEGSLVTDQFSVPRRVNVVGGGDGGRGSRVVHPKYGGGLGRKQEEYFPGPLPLVRLNPRSDWADDERDTGYSLSREGRDHGFRGEAFWDVDMPRVGGLPHKHDQRGQLRGNEVGKVMNSEVEAYDRMGPEGNSWRSSNLSFPKDAGNERNGVGVGVRPSSGSRDVGKDSNKYVPSPFRDEDAGKRDGQGGKQQPWNNVVEPYGDRNHDQLNRSRADSVQSSVSRTAFLMGGKGLPVNDPLLNFGREKWALPKSEKGFLEDPFMKDFGGSGFDGRDLLGGLVGVVKKKKDVLKQTDFHDPERQRIIEEQERALELARREEEERLRQAREQEERQRRLEEEAREAAWRAEQERIEALRKAEEQRLAREEEKQRIVLEEERRKQAAKQKLLELEQRIARRQAEVSKSGSNAPVVVDEKMPAILNEKEASRATDVGDWEDSERMVDRILTSASSDSSSVNRALEMGSRSHFSRDLSSTFVDRGKPVNSWRRDGYENWNSSAFYPQDQDNSHNSPRRDLSIGGKPFMRKDYNAGAGFVSSRPYHKGEISEPHLDEYAHVKPQRWNQSADGDHLSRNTEIDSDFHENYFERFGDGRTQGHSRGNPCPPFPERTYPNSESEGPYALGRSSRYSVRQPRVLPPPSLGSVHRTYKNENEHPGPSSFLENEMHYNQATRSDSTLPTGYDNGNRGQPEVVDARQETTENEDHKVEITPRCDSQSSLSVSNPPSSPTHLYDEDDLDDSGDSPTILTSEGSKNGPLTAPDNESIATPAGNEN

SEQ ID NO: 133440 - protein, 387 aa, Glycine max
  Coding DNA Sequence Number=SeqID_16662
MKPCKVSYQNIKQKMKFGIQELPVLTNEFHYPGREAVNDKFNCLIDNIWNIPKNTNNNEQFVCSVKKGIICALYNLCIADNHGVPLLTKASPSGKGYTAFVLLSGPHKGVYTNFKDLCLAKEGIQSPIYKGFYSREEAEKALELNTTDINKIKRSLEPENPTIVINADQTKTSQKTYKDTVSPNVPGSINDLNLDNFKKIQSLLFKVHNNQTQIPGLYIGVHAYFNQKFVCINKTPYCQDKTNCPCKIKFLFRKARLDIDQFKSFGYEDLAISAKSLLDYGCLESILIPPSDRFEGFNSSINETINLIQAEMMDYIAIKITTCPSNFTAQNYPCHVMKLLVEDHRDYPCLFDDEYESWDVQGNTQYQYSLMRAQIQGYQWFFSEEEK

SEQ ID NO: 133441 - protein, 238 aa, Glycine max
  Coding DNA Sequence Number=SeqID_16663
  Gene Ontology: Mol. function=nucleic acid binding; Cellular component= intracellular; Biological process=DNA integration
  Homolog annotation: Hit_ID=Q1S1X7; Match level="QueryCoverage=97%, HitCoverage=22%, E-value=4e-52, Identity=40%"; Hit description =Integrase, catalytic region; Zinc finger, CCHC-type; Peptidase aspartic, catalytic
MVAAKKIMGIEIKRDRVQKKLFLCQKEYIHLMYAIVCTISNRAQAVNVESRYMGNPRKKHWQAMKRIFRYHKGKIDIGLVYHGDMSCALVGYSDSDYATNLDAKRYVIRYAFMIHNSLSSWKATLQPTMVLCTIEVEYIALVEATKEGIWLKGLISNLGFPHEKTIILCDNRSAKYLANDQLHHETTKHIDIKYHFIHSEKRFKVQKVDLMENPADMFTKPIPRSKFMHCLDLLNIDC

SEQ ID NO: 133442 - protein, 139 aa, Glycine max
  Coding DNA Sequence Number=SeqID_16664
  Gene Ontology: Mol. function=oxidoreductase activity; Cellular component=membrane; Biological process=metabolic process
  Homolog annotation: Hit_ID=Q2SKG5; Match level="QueryCoverage=76%, HitCoverage=42%, E-value=9e-46, Identity=84%"; Hit description=Short- chain alcohol dehydrogenase-like protein
MAPHHQYFHGLARFTLPGYSAYAAMKGGIEVLTRYMAKELGARQIVVNTVAPGAIETDFGQGLVRDNKEVNAYIASQTALGRVGVPNDIGPMIASLLSEHNRWVNAQRIEASGGSFEAACFFTALADREGVSPDQTFEK

SEQ ID NO: 133443 - protein, 123 aa, Glycine max
  Coding DNA Sequence Number=SeqID_16665
MERGMVAGIDSRAAGGQAIARSDIDPAIIYAEILRRDEDTLSILNALRNPASSNEEKSQLVRAGFERMQNSPNPAYQAYIDKLTQQTCETIANLQASTTVKQRLHAQQWVEDYKTQFTQLQSK

SEQ ID NO: 133444 - protein, 274 aa, Glycine max
  Coding DNA Sequence Number=SeqID_16666
  Gene Ontology: Mol. function=RNA-directed DNA polymerase activity; Cellular component=intracellular; Biological process=RNA-dependent DNA replication
MTATCGPIFKLLRKDQGVIWTEDCQKAFDSIKNYLLEPPILIPPVEGRPLIMYLTVLEDSMGCVLGQQDETGRKEHAIYYLSKKFTDCESRYSLLEKTCCALAWAAKRLRHYMINHTTWLISKMDPIKYIFEKPALTGRIARWQMLLSEYDIEYRTQKAIKGSVLADHLAHQPIEDYQPIKFDFPDEEIMYLKMKDCDEPLLGEGPDPESRWGLIFDGAVNVFGNGIGAVIITPEGNHLPFAARLQFDCTNNMAEYEACVLGIEKAIDLRIKNL

SEQ ID NO: 133445 - protein, 61 aa, Glycine max
  Coding DNA Sequence Number=SeqID_16667
MEQPSALVLSGWEFLCLNSSVQLFTRFGPLSLEVGTTVPFPTLHSHLRLVFIVSARVLLKY

SEQ ID NO: 133446 - protein, 35 aa, Glycine max
  Coding DNA Sequence Number=SeqID_16668
MTYANARMTCSLCWHEEMHDVIKEQARVSCMNGAT

SEQ ID NO: 133447 - protein, 158 aa, Glycine max
  Coding DNA Sequence Number=SeqID_16669
MPVSSSFKLNYSAKTKKKDDDIVDLSSSQTPSQIGDNEIWTYSFRQWMPATPEQKRVKTKKMILKAIMNPLHQSKFIIEEPPIVDARDIQRETNPLDVDLFTFINIWSYDSMPLKAFESSHNRPFTHFDEVVAKFQRLAFDQPLEDSLSNPDYKPQLQ

SEQ ID NO: 133448 - protein, 75 aa, Glycine max
  Coding DNA Sequence Number=SeqID_16670
  Homolog annotation: Hit_ID=Q8W4M7; Match level="QueryCoverage=86%, HitCoverage=8%, E-value=2e-17, Identity=68%"; Hit description=DNA repair helicase UVH6
MLAAYPLQPPLCTRTIHKMEKTLVELRLFYNYQLRHLGPAAKIFALDLSFRKNLCVNLWVLAAENCDSVDADAGS

SEQ ID NO: 133449 - protein, 101 aa, Glycine max
  Coding DNA Sequence Number=SeqID_16671
MKGLVDVAPCGACRPWIFFINGVLYFLKINGSGMEKEESPLIQDQVQDSPLSVSRCHGASHGSKIYPKAHENPRAFSCISGPIFLDSPSHGSGDGSLPWKD

SEQ ID NO: 133450 - protein, 322 aa, Glycine max
  Coding DNA Sequence Number=SeqID_16672
  Homolog annotation: Hit_ID=Q1T1Y0; Match level="QueryCoverage=15%, HitCoverage=12%, E-value=1e-09, Identity=60%"; Hit description =Ankyrin
  Pfam annotation: Domain name=DUF1723; Domain location=70-119; Score =29.9; E_value=8.7e-06; Accession=PF08330.1; Description=Protein of unknown function (DUF1723)
MGKELSIAISLDENFKEKPTATARRQWAVTTVAEDVDHTANEVHEEPQEPVIDDERTELKLASHERKVEKFGRSTLEIEGIRWHKETSSFHLPVGEVTIILDDMASLLHLPVIGAFYTFDALDVDQVVDLIIMKGNHVLVDGSLERHYQCRCITIPPHIVAPSLSIEEIDDRWLQFSEYLAPVGQICSAHGQCSPDYMERFYRISHPFMSLTQPREPPGNSPVVHDDTFIVPDPPQQVIDAAATPEPPAPTLAAADVDMPRRVVDACQRIAKSLEHMINMRIVTVGTEAYTLTQHCLRLARGAIEQHNVYVRSRRRRDTQDT

SEQ ID NO: 133451 - protein, 251 aa, Glycine max
  Coding DNA Sequence Number=SeqID_16673
  Homolog annotation: Hit_ID=Q1RXW3; Match level="QueryCoverage=69%, HitCoverage=24%, E-value=3e-08, Identity=29%"; Hit description=Zinc finger, CCHC-type
MPEVTHEDIVNVKRARKHTLVSKYEAFQMKNGETISKLQTRFTHIVNHLLGLGKTFEDKELNINILNCLTRTWEHYKDSSCSEEDANNFNLMVRKFGKFLKKSKDRKFPKSSKKIENNNNFTCFECDNASTTSNSSVIEETKVNPEFEEVLEAFNEIDAILPRKGLVTRAMSKRLQEDWARALEEGPRVLMNLRAHLLLEVASPFIFLLLHSAAIRPQEAKESIDEEDPRPRSSTWSYIRNASRSSMSCLF

SEQ ID NO: 133452 - protein, 132 aa, Glycine max
  Coding DNA Sequence Number=SeqID_16674
  Gene Ontology: Mol. function=ATP-dependent helicase activity; Cellular component=intracellular; Biological process=DNA recombination
  Homolog annotation: Hit_ID=Q9FT74; Match level="QueryCoverage=50%, HitCoverage=11%, E-value=2e-18, Identity=71%"; Hit description=DNA Helicase
MLSFNVVNGGWRFIAESKKSVIKIWQIQGLGSLKLHFPDVPVMALTATATHAVREDILKALRIPHALVLERSFDRPNLKYEVIAKTKEPIKQLGQLNAGDKLYSNILENLLIEETASMDLAPVITVSRLYCE

SEQ ID NO: 133453 - protein, 225 aa, Glycine max
  Coding DNA Sequence Number=SeqID_16675
MARSGFQQGKLNTICLAPLKVCKPDPRLLKEFVVVKGLYSSRELDNGICGAVGIIGDRIGAARYRRRVGNNIRVVGCAASYACHCFHFPCCLINFLVHIQLVGIWLFDFSFLVMDPRETRLCMSECLEVKARSGHAMVKGGECEPQSKALLSIIHLHHHQPHHTIHPFKHLHMRKPGTKKIILSCPPTVIRRKPQSTPDLSPSISTMMSFTCTRLLMASWTYLYP

SEQ ID NO: 133454 - protein, 81 aa, Glycine max
  Coding DNA Sequence Number=SeqID_16676
MQHIKNEDRITIVSFFTETSPLSNYTLNSKGSKTYPKYSDNKTSREHRESETEKSKERRLRKKGEVKRNGYREDAEAEEAE

SEQ ID NO: 133455 - protein, 420 aa, Glycine max
  Coding DNA Sequence Number=SeqID_16677
  Gene Ontology: Mol. function=catalytic activity; Biological process =fructose 2,6-bisphosphate metabolic process
  Homolog annotation: Hit_ID=Q00ZF3; Match level="QueryCoverage=63%, HitCoverage=38%, E-value=1e-31, Identity=35%"; Hit description=[G] KOG0234 Fructose-6-phosphate 2-kinase/fructose-2
  Pfam annotation: Domain name=Brevenin; Domain location=3-48; Score =4.4; E_value=0.084; Accession=PF03032.6; Description=Breveninesculent ingaegurinrugosin family
MDPALKLCVLLLILLGLVNGSFAENDYGRCESVVKSWARSSLDEEMTKDDKHTLRDLLFFLHVPRTGGRTYFHCFLKKLYPSYLECPRSYDKLRFDPSKPKCRLLVTHDDYSITSKLPRERTSVVTILRDPVDRVFSTYEFSIEVAARFLVHPNLTSATKMALRLSSKTKGVSTLDIWPWKYLVPWMREDLFARREARYSRGLNIIESNDSYDMEDFAMPLQEYINDPVAVDVVHNGATFQVAGLTNNSYIAEAHEVRHCVQKYKTLGKYVLQVAKHVLQCLYILQKRLDEMLYVGLTEEHRKSATMFANVVGAQVISQLNAPNTSLETTDKTERSSFTDNDPDSSEHQNSTLDRGESAVTSSEGGEATEFNMTVGELMDAYEVCISNLRKAQSRRRISSLKRISPVNFTKEVVPVFQAI

SEQ ID NO: 133456 - protein, 934 aa, Glycine max
  Coding DNA Sequence Number=SeqID_16678
  Homolog annotation: Hit_ID=Q9FF50; Match level="QueryCoverage=99%, HitCoverage=100%, E-value=0.0, Identity=78%"; Hit description =Arabidopsis thaliana genomic DNA, chromosome 5, P1 clone:MUP24
  Pfam annotation: Domain name=Glycos_transf_2; Domain location=181 -344; Score=16.9; E_value=5.1e-05; Accession=PF00535.16; Description =Glycosyl transferase
MGFGRNSTSRSGDYLEGMLNDYVGGRNKLKAQKSAATTTKFVAVLTCLQFFFAVYATFLLYYMGPSIDLRTKPEFTWATKIAQQWKQLIITPHVVGHYQEAASSLIKEDLLPTTPSQVCENEKIDFMQKKSNDVQMIKIKRELYDEVLSFQSKTFGSETLQELISMKSKWDLKGPNRPKITVLLNHFKRKTLCAQLDSLLQQTLPFHHVWVLSFGSPNEASLKRIVDTYNDSRISFISSSYDFKYYGRFQMALQTESDLVYVVDDDMIPGRKMLQILAHVAGTDKYKNSVLGSIGRILPFRQKDFTFPSYRKFRSKEAGLYLPDPAYDITVDKIVQVDFLSSSWFLSADLVKTLFTETPFTFSTGEDLHLSYQLQKYKNAGSFVLPVDPKDKETWGDSEHRLAYVSETTVIFKDVVQVRDDQWWKALSTGYVTQWAAMYPQKIDALFYAHSVDEVKMLAPLLEKFRSTVGKKAYIVVSGGNYCPCEDAARALKWPALVCKERRFKIFDLAIEALSGVSDSEAPVIHAVYTSLKGLIKIHNPSVVISLADIDPHVRKALKMASETNSNDTTLVLLPRSSVSQVLWMADLRSTALPNWNRMRVSVNIITQNRANSLARLLKSLSNAYYLGDEIPITFNMDSKVDEATIRLVGSFEWPHGPKTLRRRIVQGGLIRAVSESWYPSSDDDFGLLLEDDIEVSPYYYLWIKYALMAYHYDPQVSLPELSSISLYTPKLVEVVKERPKWNATEFFKHIHPNTPYLHQLPCSWGAVFFPKHWREFYVYMNMRFTEDAKSNPVQIPKSRTNGWQASWKKFLIDMMYLRGYVSLYPNFPQQASFSTNHMEPGAHISAKDNLVKHNKQDFEVPLMKEDFRNFLPAMKMPSASRLPSLNLFNQPVSLKGLKAAGAKLGQDVLRCDNATEVVAVDKDTGLPYTCSKF

SEQ ID NO: 133457 - protein, 103 aa, Glycine max
  Coding DNA Sequence Number=SeqID_16679
MSRVRAEKPSSEMWKMQYNWHLRRLNDVYSSLLLILYYFVGSSIPSALVLWVMRELPPEEAASISEESSTIAFVADSSIAIHHPQRWTTATSMQNQTSRASPI

SEQ ID NO: 133458 - protein, 100 aa, Glycine max
  Coding DNA Sequence Number=SeqID_16680
MELFYALTNRFKARLQVPEEILHKIRSLNDLDLQLYEYAKAIFNKQHKTSLLITEESWDNISGSAYGLWRVVTLAITCVFFIFLFLLIVNVRRRTSKVKK

SEQ ID NO: 133459 - protein, 139 aa, Glycine max
  Coding DNA Sequence Number=SeqID_16681
MAGEIGATANVEHVSPLALAKHHAGVASNFSEGVAINSGEIPFQKGIAIRSGEISFVIMLVLCGSFSCAVLQSIFGCLKLATKHQFATQEFHILPSSVETQGIGRRREVVEAEPYFYPQMEERGRGMYYTPPTFSQYPT

SEQ ID NO: 133460 - protein, 594 aa, Glycine max
  Coding DNA Sequence Number=SeqID_16682
  Homolog annotation: Hit_ID=UPI0000D55C32; Match level="QueryCoverage =28%, HitCoverage=21%, E-value=5e-15, Identity=31%"; Hit description =PREDICTED: similar to SAPS domain family, member 3
  Pfam annotation: Domain name=SAPS; Domain location=1-211; Score=21.4; E_value=2.3e-16; Accession=PF04499.6; Description=SIT4 phosphatase -associated protein
MLYPSVISSFSLGGGGGGCSSYYVPCEFLVLLDVSSDNKVLPTTYGELRPPLGKHRLKIVEFIAVLLKTGNEVAEKELANSGTIRRVIDLFFEYPYNNSLHHHVESIISSCLESKSNAIIDHLLRDCDLVGRFLQADKHCILSVESSQHTVPAAGKRGTRVGNIGHITRIFNKLVHLARNQSHILACLQENSEWNEWQATVLQQRNVVENVHRWACGRPTSLQDRMRDSDDEDLHDRDYDVAALANNLSQAFRYKIYGNDDNEEEHGGLDRDDEETRYFMTEIREKPLLQRSESQDVYFDDDSAEVVISSLRLGDDQGSNLFTNSNWFAFQDNRIGDAPGGTSSSEMMDEIKLNAAANGGSNSSDDEVVVGEDEELVDSKNTVNGTSSSSTDFFSGLTGSDSLNGGTLNIESEKTSPSHDMGFFRFEAPDNEDLFGDRPLPDWVGWGEPSEMQDAGSSMNPFLDNDESGSNLPIKPQEGSPNLSSPSNGESIPSNGSPTTSDSINGSSDSSPTSVAVPSLFEEDVEFVGVELEGTEKAMDQALKEGVVGEAGPLKRNVVSKVPEKENSEEGSPGVKEFNDANYWRVDNEVAVLE

SEQ ID NO: 133461 - protein, 793 aa, Glycine max
  Coding DNA Sequence Number=SeqID_16683
  Gene Ontology: Mol. function=nucleoside-triphosphatase activity; Cellular component=nucleus; Biological process=DNA replication initiation
  Homolog annotation: Hit_ID=Q1SA78; Match level="QueryCoverage=99%, HitCoverage=100%, E-value=0.0, Identity=83%"; Hit description=MCM; Nucleic acid-binding, OB-fold
  Pfam annotation: Domain name=AAA_3; Domain location=334-475; Score =0.2; E_value=0.00031; Accession=PF07726.2; Description=ATPase family associated with various
  Pfam annotation: Domain name=AAA_5; Domain location=334-481; Score= -9.0; E_value=0.0087; Accession=PF07728.4; Description=ATPase family associated with various
  Pfam annotation: Domain name=MCM; Domain location=276-654; Score =596.5; E_value=2.4e-176; Accession=PF00493.13; Description=MCM235 family
  Pfam annotation: Domain name=Mg_chelatase; Domain location=334-485; Score=-130.0; E_value=0.00058; Accession=PF01078.11; Description =Magnesium chelatase, subunit ChlI
  Pfam module annotation: Pfam domain module=AAA_3::AAA_5::MCM::Mg _chelatase; Domain location=334-475::334-481::276-654::334-485
MDLSEEVRAAHKREFSDFLDQDVGKGIYMDEIKTLINHKRHRLIVNISDLHNFRDLGNRILRSPSEYMQPFCDAVTEATRAIDPKYLKEGEQVLVGFEGPFVSRRVTPRELLSEFIGSMVCIEGIVTKCSLVRPKVVKSVHFCPTTGSFTSREYRDITSNLGLPTGSVYPTRDENGNLLVTEFGLCKYKDHQTLSIQEVPENSAPGQLPRTVDVIAEDDLVDSCKPGDRVAIVGIYKALAGKSKGSVNGVFRTVLIANNVSLLNKEANAPIYSAEDVKNIKEIAARDDAFDLLSNSLAPSIYGHSWIKKAVVLLMLSGVEKNLKNGTHLRGDINMMMVGDPSVAKSQLLRAIMNIAPLAISTTGRGSSGVGLTAAVTSDQETGERRLEAGAMVLADRGVVCIDEFDKMNDQDRVAIHEVMEQQTVTIAKAGIHASLNARCSVVAAANPIYGTYDRSLTPTKNIGLPDSLLSRFDLLFIVLDQMDPDIDRRISEHVLRMHRFRSAVDGGEAALDGSSRYGREDEADMDSSVFVKYNRMLHGKKTGRGQKRDTLTIKFLKKFIHYAKHRIQPELTDEASENIATAYAELRNSSSNAKTGGTLPITARTLETIIRLSTAHAKLKLSRETFQLSQYLSCQVSKSDVEAALKVLNFAIYHKELTEMEEREQERERELDRKRKADHDENDGPDRGPKDRRGPKDKRGPTSTDAMEVDDNSATHAAVGPTPERIEEFNSLFNQHMHANRLEQITIANLGNVINRGQDPPPYSAADILLLLERLQDDNRVMITDGVVHMIS

SEQ ID NO: 133462 - protein, 69 aa, Glycine max
  Coding DNA Sequence Number=SeqID_16684
MSIPPVKLAIQAVTWRGFRHCHWRNTSGSTGRLLGAAGIAGRAQCCMHISPLPWAKQVYDEFGYFDALF

SEQ ID NO: 133463 - protein, 313 aa, Glycine max
  Coding DNA Sequence Number=SeqID_16685
  Gene Ontology: Mol. function=catalytic activity; Cellular component =chloroplast thylakoid membrane; Biological process=cellular metabolic process
  Homolog annotation: Hit_ID=Q1RTF1; Match level="QueryCoverage=99%, HitCoverage=100%, E-value=1e-119, Identity=75%"; Hit description=NAD- dependent epimerase/dehydratase
  Pfam annotation: Domain name=3Beta_HSD; Domain location=57-307; Score= -137.5; E_value=0.0079; Accession=PF01073.9; Description=3-beta hydroxysteroid dehydrogenaseisomerase family
  Pfam annotation: Domain name=Epimerase; Domain location=56-293; Score= -34.3; E_value=0.00063; Accession=PF01370.11; Description=NAD dependent epimerasedehydratase family
  Pfam annotation: Domain name=NAD_binding_4; Domain location=58-280; Score=-101.0; E_value=0.043; Accession=PF07993.2; Description=Male sterility protein
  Pfam annotation: Domain name=NmrA; Domain location=56-305; Score= -96.5; E_value=0.013; Accession=PF05368.3; Description=NmrA-like family
  Pfam annotation: Domain name=adh_short; Domain location=54-229; Score= -61.8; E_value=0.065; Accession=PF00106.15; Description=short chain dehydrogenase
  Pfam module annotation: Pfam domain module=3Beta_HSD::Epimerase::NAD _binding_4::NmrA::adh_short; Domain location=57-307::56-293::58 -280::56-305::54-229
MAATLTAVRIPTFHQRHLRKHFTAPSSSLRLLNLAKMEGSEISEQVGEDLGAKKKVFVAGATGSTGKRIVEQLLAKGFAVKAGVRDVDKAKTTLSSANPSLQIVKADVTEGSDKLAEAIGDDSEAVVCATGFRPGWDLLAPWKICKFLCCHVLSVAEFSRLSLVIFEGVDNFGTVNLVEACRKRNVNRFILISSILVNGAAMGQLFNPAYIFLNVFGLTLVAKLQAEKYIRKSGINYTIIRPGGLRNDPPTGNIVMEPEDTLYEGSISRSLVAEVAVEALAYPEASYKVVEIVSRPDAPKRPYHDLFGSIRQQ

SEQ ID NO: 133464 - protein, 697 aa, Glycine max
  Coding DNA Sequence Number=SeqID_16686
  Gene Ontology: Mol. function=protein dimerization activity; Cellular component=nucleus; Biological process=regulation of transcription, DNA-dependent
  Homolog annotation: Hit_ID=Q8S976; Match level="QueryCoverage=95%, HitCoverage=98%, E-value=0.0, Identity=59%"; Hit description=Auxin response factor 10
  Pfam annotation: Domain name=Auxin_resp; Domain location=272-355; Score=164.0; E_value=3.7e-46; Accession=PF06507.4; Description=Auxin response factor
  Pfam annotation: Domain name=B3; Domain location=108-213; Score =116.3; E_value=8.6e-32; Accession=PF02362.12; Description=B3 DNA binding domain
  Pfam module annotation: Pfam domain module=Auxin_resp::B3; Domain location=272-355::108-213
MKEGEKVLDPQLWHACAGGMVQMPQVHSKVFYFPQGHAEHAHTTIDLRVPPFILCNVEAVKFMADPETDQVFAKLSLVPLRNSELGPDSDSAAGDDAAEPSSCEKPASFAKTLTQSDANNGGGFSVPRYCAETIFPRLDCTAEPPVQTVVAKDVHGETWRFRHIYRGTPRRHLLTTGWSSFVNQKKLVAGDSVVFLRAENGDLCVGIRRAKKGIDEGSGLASSSVWSSASGSGIGPFSFFLKEENKMLRNGCGVGGNLSGRVKVRAEDVVEAVTLAASNKAFEVVYYPRASTPEFCVKASSVGAAMRIQWCSGMRFKMAFETEDATRISWFMGTIASVQVVDPICWPNSPWRLLQVTWDEPDLLQNVKRVSPWLVELVSNIPLINFTPFSPPRKKLRPQHPDFPLDVQFPIPMLSGNQHGPNSPLCGFSDNAPAGIQGARHAQFGKSLSDLHLNNNKLQLGMLPTNIHQLGGVYTGISSGNMMTKHDKSKESLSCFLTMGKSSKSLEKSDDVKKHQFLLFGQPILTEQQISSCSRDVLSRGKRSLGDEKDKAKCVLDDSQSTLSQQFSPGKASSAEFFWQLGLDTGHCKVFLESEDVGRTLDLSQFGSYEELYRRLGNMFGIERSEILNHVLYYDAAGAVKQTGEEPFSDFMKTAKRLTILTDSGSKNIKRAFITGTGNGEQGLDPSNKTGPLSIFA

SEQ ID NO: 133465 - protein, 94 aa, Glycine max
  Coding DNA Sequence Number=SeqID_16687
  Gene Ontology: Mol. function=nickel ion binding; Cellular component =cytosol; Biological process=protein complex assembly
  Homolog annotation: Hit_ID=Q9XGS2; Match level="QueryCoverage=79%, HitCoverage=27%, E-value=1e-35, Identity=98%"; Hit description=Ni -binding urease accessory protein UreG
  Pfam annotation: Domain name=cobW; Domain location=1-73; Score=-63.3; E_value=0.0083; Accession=PF02492.9; Description=Cobalamin synthesis proteinP47K
NLAANFSRELADYIIYIIDVSGGDKIPRKGGPGITQADLLVINKTDLAPAIGADLAVMQRDALRMRDGGPFVFAQLMITRNMPIQKVHYVKGAV

SEQ ID NO: 133466 - protein, 314 aa, Glycine max
  Coding DNA Sequence Number=SeqID_16688
  Gene Ontology: Mol. function=protein phosphatase binding; Biological process=regulation of phosphoprotein phosphatase activity
  Homolog annotation: Hit_ID=Q8R3Q2; Match level="QueryCoverage=75%, HitCoverage=24%, E-value=2e-18, Identity=26%"; Hit description=SAPS domain family member 2
  Pfam annotation: Domain name=SAPS; Domain location=81-314; Score= -30.3; E_value=3e-13; Accession=PF04499.6; Description=SIT4 phosphatase-associated protein
LRDRAQVEQLLRYIIEEPLEDDENKRVFKFPFISCEIFTCEIDVILKTLVDEEELMNLLFSFLEPDRSHSTLLAGYFSKVVICLMIRKTVPLMNYVQAHQHVFRQLVDLIGITSIMEVLVRLVGADDHVYPNFIDVMQWLAESNLLEMIVDKLSPSMIHGIFFDLPHIAILHLPGVKSPPEVHANVAETLCTITRVASSTLAIKLSSPSFVAKILGYALEDSQSMSSLVNSLSVCISLLDPKKSAISSPLFHSFRSQNMYEPPIPVNPDTIGAMLPKLDFKENYQKVNPSLQEGVGSMLLSSIRIFWSLVEPCQ

SEQ ID NO: 133467 - protein, 229 aa, Glycine max
  Coding DNA Sequence Number=SeqID_16689
  Homolog annotation: Hit_ID=Q9SKN3; Match level="QueryCoverage=32%, HitCoverage=39%, E-value=9e-19, Identity=67%"; Hit description =Expressed protein
MVWVAWWFGEGHMGNARSFNDASGEGCLGDGLMPRGKREDSMEIEFGFGKSANGVVEGRGGEEATEGGRGGRGVVVVNGVVHVFGHDDQGKQMMVKKKSGEESQHENYNEYKSDEDETLMLLNAACWILGTVASHREGVGDEEKDATHGVRGEEMNVSHASVHPVEEAPTTEGGGDQNVNAPRVRMKDVQGMPGTAGGLSLRVSQFVFAAAALSIMASTSDFPSVTAFW

SEQ ID NO: 133468 - protein, 136 aa, Glycine max
  Coding DNA Sequence Number=SeqID_16690
EKEENEAEYELRIRELTGEEEEIEASFQNMREKKARNIEEAENPNLEIEKAFETLIECDSDSTMALQFIASGVVPTHPYYLIVQKIRFAHTLLEANSCADSLAKKDTKFLILKDAPSNLNTSLMADALAVFFTRNR

SEQ ID NO: 133469 - protein, 63 aa, Glycine max
  Coding DNA Sequence Number=SeqID_16691
MTKDIVVFKMHAMPEDIFVFKMCVDYRIGRLRMLPDFSQITLGYLCMLPDFSQVGVAELCVYG

SEQ ID NO: 133470 - protein, 123 aa, Glycine max
  Coding DNA Sequence Number=SeqID_16692
MRLHCHQASRRPSMTTDSPPLLMAHIDLGIGPNISMSTKNQRYKGRENINKEDVMMRCCTLIDWPNSLKKSPVESPTVATYPSAGGRRRAHGCVIQGKKARRVATNVYSRKMSEKPEHVVYEL

SEQ ID NO: 133471 - protein, 145 aa, Glycine max
  Coding DNA Sequence Number=SeqID_16693
MGETHEISHRNLADFEPRLSYAIEGQTVGDIPMQNTLEGPQYHPQPHPLHSTVGKNPPALAEMGKLDHLEERLKAIEGGRDYAFANLEELFLVPNIVTPPKFKVSDFDKYKGTTCPKNHLKMYCRKMGAGQKFSPVDVFKQKKRE

SEQ ID NO: 133472 - protein, 144 aa, Glycine max
  Coding DNA Sequence Number=SeqID_16694
MHTGARFRSDHSKETRIVPTRHLMDPKKSNRVLGFPALIMGLCQFYGVLVAPNKVIKPPINRVFIKKYHAPREAQGEAPQQPGDGQQQATDAPPPPPESTSAHLQRLEHCLRHMADQQATNHPGRYEQVLVLGPISHHASDSRS

SEQ ID NO: 133473 - protein, 81 aa, Glycine max
  Coding DNA Sequence Number=SeqID_16695
MGVKYLEAVKRRLHATKQWSPDEIRMNSLSAPTALSEFIFWGRTFISLMSCLWLSRANLLSLSNLVNYFVERRTLSLAYLG

SEQ ID NO: 133474 - protein, 70 aa, Glycine max
  Coding DNA Sequence Number=SeqID_16696
MWDTLTITYKGSSEVKHYKLSLLTHSSSKALAINDALEEESNDDDFDEEDDELSSVTRKIRKMRKKQELL

SEQ ID NO: 133475 - protein, 100 aa, Glycine max
  Coding DNA Sequence Number=SeqID_16697
MSQPTIQQGCKKAIMDRPKRLSPREKTSGVATNVYLRKTLEKPKRRRSANFENEGLGVIYARERLILIANKSCLRRWTLKRCFTGKVERIVKALDLEMIF

SEQ ID NO: 133476 - protein, 76 aa, Glycine max
  Coding DNA Sequence Number=SeqID_16698
MRRVATNIYLRKRQEKPKRRRFADFENEGSGVVYTRGRLILIANKSRLRRWTLKQCLTRKAERIVKVLDLDLETIF

SEQ ID NO: 133477 - protein, 155 aa, Glycine max
  Coding DNA Sequence Number=SeqID_16699
  Gene Ontology: Mol. function=transferase activity; Biological process= DNA integration
  Homolog annotation: Hit_ID=Q8S798; Match level="QueryCoverage=46%, HitCoverage=22%, E-value=2e-22, Identity=67%"; Hit description =Putative retroelement
MESTTKVMMKLKNTLVQLLNSFKNMDLVKFPKGCKRVGCKWDFKTKHDCHGNLEHYKTKLVAKVFTQRNGVDYKETFSPVSRKLSFRIIIAPVAHYDVAPCGACRPWIFFINGVFCFLKITATEWRRRKGDWRCHFKEKMSQEQAHHHKKLWIRA

SEQ ID NO: 133478 - protein, 104 aa, Glycine max
  Coding DNA Sequence Number=SeqID_16700
MEETNLESDKSTCRKTQLARVRTQPMNQGRKYNISNHHTQLFVQRGRCYLCEQCQCNELWVLRKAPKRHAELGGRFAFRGVKVLRDVAREVFKGSLRSSLTRKT

SEQ ID NO: 133479 - protein, 81 aa, Glycine max
  Coding DNA Sequence Number=SeqID_16701
MARAEIDIASTVPDLDSLTYTSVSARTRLRYLMGSARTISQAGIDSSTFGTACSDNRFGESKQKVESFMVCHYMGYLELEE

SEQ ID NO: 133480 - protein, 77 aa, Glycine max
  Coding DNA Sequence Number=SeqID_16702
MTDSERESESEGEIRASIEPSSPDSSGYAGEGRGSTSATSGSQFEIEQEDDMRIEIDRISISDSHTTRIPDKRHFNE

SEQ ID NO: 133481 - protein, 147 aa, Glycine max
  Coding DNA Sequence Number=SeqID_16703
  Homolog annotation: Hit_ID=Q47522; Match level="QueryCoverage=27%, HitCoverage=50%, E-value=2e-17, Identity=100%"; Hit description=LacZ protein
MRKEKIPHQAPFAIQAAQLLGRAIGAGLFAITPAGERGMCCKAIKLGNARVMTCRPRSDLFMNLPALHKLDNMLLEILDGCKDMEFWYVDQGIVAQDADGSASFCKRIQRQEDGTELEFVIMVIAVSCVKLLSAHNSTQHTSRKHKV

SEQ ID NO: 133482 - protein, 191 aa, Glycine max
  Coding DNA Sequence Number=SeqID_16704
MHPTKALGPDGTPVLFYKHFWEVVGEDISRIVVDILNGATDPIGINQTFIALSQSAFMPHVHITDNALIAFECLHYTRTKNDGKKGDTDTRKIHWMSRKKLAKNKLEGSITELDDDARALFFAVLTTIRPLLVLMKLVTMDLGKDGKPFLVIFKVNFDFAIGMGKGSRLDLVARDDKGILDLREVEANAFG

SEQ ID NO: 133483 - protein, 75 aa, Glycine max
  Coding DNA Sequence Number=SeqID_16705
  Subcellular localization annotation: CTP_CleavageSite=21; ConfidenceScore=5.03e-01
MEDFSLPRIHLKPTEMTSSTRARKGNGLRAASIRLTPLDRKKRASRFFEGLQALFQRRAWIPPGTSLPQLGTFKE

SEQ ID NO: 133484 - protein, 116 aa, Glycine max
  Coding DNA Sequence Number=SeqID_16706
MNCVFVHASSTLEFGAMRSDCLGQFSILNLFRSPMNRIFVHVSSTLEFGAMHSDCLVQFSILNLFRSPMNCVFVHVSSTLEFGAMRSDCLVQFSILNHFSEIHELRFRSCVLHLRV

SEQ ID NO: 133485 - protein, 42 aa, Glycine max
  Coding DNA Sequence Number=SeqID_16707
MKTLNNESLAKVDAMFQQFFLMYAKLIMGLSDSNARVSEVTP

SEQ ID NO: 133486 - protein, 135 aa, Glycine max
  Coding DNA Sequence Number=SeqID_16708
  Gene Ontology: Mol. function=zinc ion binding
  Homolog annotation: Hit_ID=Q9SKM7; Match level="QueryCoverage=75%, HitCoverage=100%, E-value=3e-18, Identity=50%"; Hit description =Expressed protein
MILRNIIKTAQLKAQEHCSDKSVAGKQNKRKRMISILTQERLLGASLGVVLTGVVVFEQRRYIYASISDSQSQLVILPHFTAWEGFKMRDGIVHHVHVKEPIFGKKSRSEFAHVWNKTVDQTFGPLIKSLSSRGW

SEQ ID NO: 133487 - protein, 591 aa, Glycine max
  Coding DNA Sequence Number=SeqID_16709
  Homolog annotation: Hit_ID=Q84UR3; Match level="QueryCoverage=44%, HitCoverage=32%, E-value=7e-73, Identity=52%"; Hit description =Proline-rich protein family-like
  Subcellular localization annotation: CTP_CleavageSite=56; ConfidenceScore=5.79e-01
MKQESPASPLPSSLPQPSPTMTTTKNVIKLQNSLTPSRLRLPSKYREPPKTPPEVVVNNVVVSTPSRRAKSVTPELKHNSRIKRGLVLNKAKPNEEVVGTTQRGREAEETKVVARFVRPHVVEQFARPRNGAGDFAFKRDKEDSDEKSKKELMEKLEASESLIKNLQSEVQALKAELEKVKGLKVELESHNRKLTEDLAAAEVKVVSLGGNEKFWSGGSSMEPNGEHQSPKFKHIQKLIADKLERSIVKKEAIANGGFVEASIPPPTAIPAIPDAPTARKGRKPTPNSCLPPPPPPMPPSIPSRPIAKASNTQRVPAFVKLFHTLKNQEGMKSTTGTVKQQKPVSVNVHSSIVGEIQNRSAHLLAIRADIETKGAFINDLIKKVVEAAYTDIEDVLNFVNWLDGELSSLADERAVLKHFNWPERKADAMREAAVEYRELKLLEQEISSFKDDPEIPCGASLRKMASLLDKSESSIQRLIKLQNSAMRSYQEYKIPTAWMLDSGIMTKIKQASMILVKMYMKRVTMELGSARNSDRSSQESLLLQGMHFAYRAHQFAGGLDAETLCAFEEIRQHVPGHLAGSRELLAGIASS

SEQ ID NO: 133488 - protein, 191 aa, Glycine max
  Coding DNA Sequence Number=SeqID_16710
MMKYELKHKSEEVSKSKQKSWYEVKKRRIQVLLREIKAKSRRKKALMNWTARSVRKPLKCKVSHGYERLNPSVGAYQPKPFSFFFLFYSTPFPIAYKLGIYQRKYKQSLCGLNTRSSILIFITCDKIGTLVNRLTETYICTKTFRTRARECNDKDLFQSKTVSLKSPDQGSETVRESMIARVKVNIQLHQE

SEQ ID NO: 133489 - protein, 528 aa, Glycine max
  Coding DNA Sequence Number=SeqID_16711
  Gene Ontology: Mol. function=zinc ion binding
  Homolog annotation: Hit_ID=Q6H6V3; Match level="QueryCoverage=81%, HitCoverage=88%, E-value=2e-83, Identity=44%"; Hit description=Zinc finger (C3HC4-type RING finger) protein-like
  Pfam annotation: Domain name=zf-C3HC4; Domain location=282-329; Score= 52.9; E_value=1.1e-12; Accession=PF00097.15; Description=Zinc finger, C3HC4 type (RING finger)
MTSTEEKPVTVSEEHDASSCRRTVSLPVQKVPLSVIRFASSLASIFWGNRVDDPMAITEETTHVPPRKRQNLLLEIPSRTEESSQEFVAIKMPPTPSSNPTPTPKRVNFLVSSRSVDPPTYHSPGPSTSRGKSSIRNLLPKLSFRYRTPADIEKPNTAAPEVSSTGTGEKPSISRSLSLTKIFTPRIKRASSLPLDEIRQSNNESSQGGSVGGPLNKREAQRKIARSLSVPANDKDKSLRRMDSFFRVVPSTPQLVTCLKYFHGAENEDANGEDIAEEEAVCRICLVDLCEGGETFKLECSCKGELALAHQECAIKWFSIKGNKTCDVCKEEVRNLPVTLLRIQSIRNRNNGGNRTQLEDEVPVLVIVSMLAYFCFLEQLLVGKMGTGAIAISLPFSCVLGLLSSMTSSTMGRFIWIYASVQFALVVLFAHIFYSVVHVQAVLSILLATFAGFGVVMSGSSILVEYFRWRRRVQALSEQRHGPQLMPQAGQNPRTSNVQRPGPGSGSGLAPSNHSQPVVQNQQNSNQS

SEQ ID NO: 133490 - protein, 917 aa, Glycine max
  Coding DNA Sequence Number=SeqID_16712
  Gene Ontology: Mol. function=methyltransferase activity; Cellular component=nucleus; Biological process=metabolic process
  Homolog annotation: Hit_ID=Q9SKM5; Match level="QueryCoverage=99%, HitCoverage=96%, E-value=1e-161, Identity=47%"; Hit description =Putative RNA methyltransferase
  Pfam annotation: Domain name=RRM_1; Domain location=160-221; Score =7.9; E_value=0.027; Accession=PF00076.12; Description=RNA recognition motif. (a.k.a. RRM, R
  Pfam annotation: Domain name=zf-CCCH; Domain location=66-93; Score =28.2; E_value=2.9e-05; Accession=PF00642.15; Description=Zinc finger C-x8-C-x5-C-x3-H type (and similar)
  Pfam module annotation: Pfam domain module=RRM_1::zf-CCCH; Domain location=160-221::66-93
MTEPLSNTELSSSKTLDPTNRHDSTSEPHQTAPEEVELNREDDVVPTAKRKRNDGVVEDRLLHPLWKTSLCSYFRSHNGSCSHGGACRYAHGEEELRLRPDNTWDPTSERAKKALKTESDDKRAVSEEVMMTEAVVDDGDADGDDGCGANHALSKCLVHLPRKWSSENFRTFLSEQGIAFKHAKKKKGMMIGFVTFEDEEQLKSSTKELEGKSIGNKTVKVADVLPRSFEKKSNASVASHQELDEGVDVASSGTLDGETNNDNLAKTRNVRDAVTPLAHMAYADQLEQKKSALMLILKKLTRNARKACPNGVSLPEWILKSREIGGLPCKLEGIIASPIVNGYRNKCEFSVGYSLGGKVTVGFMLGNFREGVTAVEEAVDCPNVSTIACKYATIFQEFLQDSDLPVWNRFKNTGFWRQLTVREGRTNGNAVDAETFGGIAEVKKNVGSTLWDGQVMSGSFLFGDKTPDYLKLMICIPPFFLNVIQNSLPLRLAQAFVVGATSHCSTLPLTALVVQDHQGISNVAPADAPLHLLPIPKAAGDSEVDENNNAKDVRIHDYVNNLQFSISPTAFFQVNTLAAEKLYSLAGDWACLGPDTLLFDICCGTGTIGLTLAHRVGMVIGIEMNASAVSDAHRNAEINGIKNIKFICSKAEDVMGSLLREHLNVTKEQVDDPNISGKGNDSPEDSACPEPENGELASHCPENNNAEVGSEVQKGSTCEQADGISEQAEDVMGSLLRDDANMPKEQSDYPNISGSGNDIPEDSTFPVPENGETTSHSESNNAEVGGEVQKGSTSRNGKTSLQQFKNVVAIVDPPRAGLHPTVIKALRTHPGLRRLVYISCNPETLVANAIELCTPSPLKIEKGNKDNRGWRNMSSAGLARHRAKSMPISEAFHPVKAMAVDLFPHTPHCELVMLLER

SEQ ID NO: 133491 - protein, 768 aa, Glycine max
  Coding DNA Sequence Number=SeqID_16713
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=84%, HitCoverage=55%, E-value=1e-156, Identity=56%"; Hit description =Peptidase S8 and S53, subtilisin, kexin, sedolisin; Integrase, catalytic region; Zinc finger, CCHC-type
  Pfam annotation: Domain name=rve; Domain location=428-583; Score =24.5; E_value=5.3e-05; Accession=PF00665.16; Description=Integrase core domain
  Pfam annotation: Domain name=zf-CCHC; Domain location=251-268; Score =24.2; E_value=1e-04; Accession=PF00098.13; Description=Zinc knuckle
  Pfam module annotation: Pfam domain module=rve::zf-CCHC; Domain location=428-583::251-268
MSAESSNFVQPAIPKFDGHYDHWAMLMENFLRLKEYWHLVETGIPTVAEGIQSTEAQRKSIEDHKLKDLKAKNYLFQAIDRNIMETILDKGSSKSIWDSMKQKYQGTSRVKRAQLQALRKEFEVLQMKGGEKVEEYFARTLTIVNKMKIYGENITQVMIVEKILRSMTSRFDYVVCSVEESNNLDSLTVDELQSSLLVHEQRMNSHGGDTRDEQALKVSHEEQNGGRGRGRGFGRGRGRGRGRQSPNKAAVECFKCHKLGHFQYECPRWKESANYAEIYEEEEMLLMSLVEADNLQQEETWFLDSGCSNHMCGNREWFSTIDEAFRHSVKLGNDSKMEVLGKGNIRLQINGAIHVVTDVYYVPDLKNNLLSVGQLQERGLALLIQDGKYKLYHPRRGLIMQTEMTANRMFVLLASVVLEETSTFLQLATEDSSQLWHRRFGHLSYKGLRTLQHKQMVKGLPFFKDSSKSCPGCFVGKQHRDVIPKKSQWRASHKLQLVHADICGPITPNSNSNKRQLTTSYTPQQNGVAERKNRTIMNMVRCMLCDKQVPKAFWPEAAKWTVHVLNRSPTLTVKDKTPEEMWSGIKPKVDYFKVFGCLTHVHVPDQKRTKLDDKSLQCVLLGVSDESKAYRLFDPVARKFIVSRDVSFEEDKGWNWGRTAEEVKHDVLIWEGSNDSEDASSENEEEAVVEGTETAGVTDQDAEATTSTSSDSSNEDASVHATAEGRSRRAPNYLQDYETGEGLSEDEDYFAMFTSHEDPSSFEEAERD

SEQ ID NO: 133492 - protein, 169 aa, Glycine max
  Coding DNA Sequence Number=SeqID_16714
  Subcellular localization annotation: CTP_CleavageSite=56; ConfidenceScore=5.14e-01
MLILSLNLHLNKRKGTLKPQAPPSLTPQTQPKHALSPISKREATTFSKAKKKFMVEACKKEKLDETLERNKTLELEEELKRVEMNELERVQSALEHVAGIMSLDVAQRQVEMEATIVPEDMDPVENETLEEAMLQSIIEVSLVKAKDEIIEIDNGIAPIRQRPMSDVDE

SEQ ID NO: 133493 - protein, 257 aa, Glycine max
  Coding DNA Sequence Number=SeqID_16715
  Homolog annotation: Hit_ID=Q9FNJ1; Match level="QueryCoverage=78%, HitCoverage=42%, E-value=5e-08, Identity=27%"; Hit description =Arabidopsis thaliana genomic DNA, chromosome 5, P1 clone:MDJ22
  Pfam annotation: Domain name=F-box; Domain location=25-72; Score =19.6; E_value=0.011; Accession=PF00646.23; Description=F-box domain
MTQGMIIAVQGSRNMNARNRFENRDIISTMPDDILGNILSRLTMKEAVRSSVLGTKWRHNWTFFSGVLEFEQSRRNFHLRREHVGILTKCNVFVSEWERFMTHMSKVMKSLKSSSMQGLRICMDLGDPWRAAEWVKYAAEKDVQTLDLDFSYHFSVPIYKMSELTIHNVFPSRGYEMKSLCNLRLSSVDINVLKLELSMPYPGFIEGMPVFDNVKQLEIRIPHRSGASLDHHVYLLSSFPSVRVLKIKVSPTIVSDT

SEQ ID NO: 133494 - protein, 96 aa, Glycine max
  Coding DNA Sequence Number=SeqID_16716
MPFFTSLDLQKLIGPIYALNVVLPWDHTMSEILFRQRTSIWRHQRTFQTSKIGNNQNMDNYYKCKELLIKEDEDAPTTKYVKACPRRLFKYELEAL

SEQ ID NO: 133495 - protein, 285 aa, Glycine max
  Coding DNA Sequence Number=SeqID_16717
  Gene Ontology: Mol. function=gamma-glutamyltransferase activity; Cellular component=integral to membrane; Biological process=cellular response to nitrogen starvation
  Homolog annotation: Hit_ID=Q12CJ0; Match level="QueryCoverage=98%, HitCoverage=51%, E-value=1e-106, Identity=67%"; Hit description =Gamma-glutamyltransferase
  Pfam annotation: Domain name=G_glu_transpept; Domain location=37-285; Score=17.7; E_value=1.7e-16; Accession=PF01019.11; Description=Gamma -glutamyltranspeptidase
  Subcellular localization annotation: CTP_CleavageSite=53; ConfidenceScore=5.04e-01
MMTKALDFTSGYLSRRPPMMGRNAVATSQPLAAQAGMKMLQLGGNAVDAAIATAMALTVVEPTGNGIGSDAFAIVWDGEKLHGLNASGRSPASWHADLFAGKTAVPEIGWDAVTVPGAVSGWVALAERFGTLPLTTLAQPAVDYARNGFPVSPLIGHLWQRGYLKLKDQPGFSACFAPEGRAPRVGEIFRNPAQANSLELIARTNGEAFYRGELAQKIAAFAKEHGAHLTAEDLANHRVDWVELLSRDFAGGSVQELPPNGQGIATLIALGILEQCGIEKHHPDS

SEQ ID NO: 133496 - protein, 204 aa, Glycine max
  Coding DNA Sequence Number=SeqID_16718
MNTHPLDKYLWLSEADSPSPRRAKRTSLQQVLGLAGSIGAKRMATRKRARAEDIPSSSNPPPPTATMELDGLQAQPIVSMLQSLFRGQLIIVYNQQQLAHNRPIVFMEKFLDKVACPEAQLRLGRSPEVMPPSPIPTRTEPAPAESQPPVADPSASPKVEILPPPSAPPLILILDDSDNEVAAPPDSPAYYYLEDGSDFSNWMD

SEQ ID NO: 133497 - protein, 109 aa, Glycine max
  Coding DNA Sequence Number=SeqID_16719
MWPQPKHWNRKQRGPERKHGAETSSEGLCRGSNSELKLRRVERDQSRVEGMILKDKLKACQRSKRSLSEQFSRTKGNMWAIIDQYKEKLNLASTHEQRLEDECAKVSVL

SEQ ID NO: 133498 - protein, 92 aa, Glycine max
  Coding DNA Sequence Number=SeqID_16720
  Gene Ontology: Cellular component=periplasmic space
  Homolog annotation: Hit_ID=P0AEE1; Match level="QueryCoverage=97%, HitCoverage=48%, E-value=2e-16, Identity=48%"; Hit description =Protein dcrB precursor
MRNLVKYAGIGLLVLGLAACDQKKDDTAANSNGASASQSAQTVNLMDGKLSFSLPAGMSDKSGKLGSESTNMHVYADETGQRAIIVIAGDPT

SEQ ID NO: 133499 - protein, 105 aa, Glycine max
  Coding DNA Sequence Number=SeqID_16721
  Gene Ontology: Cellular component=integral to membrane
  Homolog annotation: Hit_ID=Q7NU43; Match level="QueryCoverage=95%, HitCoverage=45%, E-value=2e-37, Identity=74%"; Hit description =Probable membrane protein
  Pfam annotation: Domain name=DUF165; Domain location=1-71; Score= -4.1; E_value=2e-05; Accession=PF02592.5; Description=Uncharacterized ACR, YhhQ family COG1738
MAYALGQILDVHVFNRLRKLPQWWIAPACAMFLGNISDTLAFFFIAFYKSPDPFMASHWVEIALVDYSFKVLICMVFFLPAYGVLLNAALKRLAERSAQRQMNFG

SEQ ID NO: 133500 - protein, 126 aa, Glycine max
  Coding DNA Sequence Number=SeqID_16722
  Gene Ontology: Mol. function=metal ion binding
  Homolog annotation: Hit_ID=Q4WCJ7; Match level="QueryCoverage=32%, HitCoverage=5%, E-value=9e-09, Identity=61%"; Hit description=C2H2 zinc finger protein
MGNKLGRRRQVVDEKYTRPQGLYNHKDVDHKKLRKLILESKLAPCYPGDEETTYDREECPICFLYYPSLNRSRCCTKSICTECFLQMKVPNSTRPTQYPALLVVCLQYIEYIPRSCQSSNFNLLLL

SEQ ID NO: 133501 - protein, 38 aa, Glycine max
  Coding DNA Sequence Number=SeqID_16723
MGGDECHGHHDEGYYDSDIGGNPWWLTTNSCWLREYRG

SEQ ID NO: 133502 - protein, 403 aa, Glycine max
  Coding DNA Sequence Number=SeqID_16724
  Gene Ontology: Mol. function=sugar binding
  Homolog annotation: Hit_ID=Q1SN84; Match level="QueryCoverage=76%, HitCoverage=79%, E-value=1e-147, Identity=79%"; Hit description=Root cap
  Pfam annotation: Domain name=Root_cap; Domain location=331-387; Score= 111.9; E_value=1.8e-30; Accession=PF06830.2; Description=Root cap
MAKMGGRKWSILVAIFILLLAMEAVIAQGQGNGNGNNGNGNGNGNGNGKGNDKEEKEREKREKEKEKREKKEKKEKEKEKKEKEKQAKKQQGEATNYDKLSPLPTGQERGFCRKNTACEFKTIVCPSECAYRKPKKNKKQKACFIDCSSSTCEATCKVRKANCDGYGALCYDPRFVGGDGVMFYFHGAKGGNFAIVSDDEFQINAHFIGTRPKGRTRDYTWVQALSVMFDTHTLAIAANRVSHWDDNVDSLIVKWDDELVNIPTDGEAEWRANGDEREVVVERTDDTNSVRVTVSGLIEMDISVKPIREQENKVHNYQLPSDDAFAHLETQFRFKKSTDNFEGVLGQTYRPGYVSPVKRGVPMPMMGGEDKYQTLSMFSTSCNLCKFQRPSEIASTEGLVAQY

SEQ ID NO: 133503 - protein, 414 aa, Glycine max
  Coding DNA Sequence Number=SeqID_16725
  Gene Ontology: Mol. function=protein serine/threonine kinase activity; Cellular component=nucleus; Biological process=protein amino acid phosphorylation
  Homolog annotation: Hit_ID=Q1SJP6; Match level="QueryCoverage=98%, HitCoverage=96%, E-value=1e-157, Identity=67%"; Hit description =Protein kinase
  Pfam annotation: Domain name=Pkinase; Domain location=122-384; Score =202.4; E_value=1.1e-57; Accession=PF00069.15; Description=Protein kinase domain
  Pfam annotation: Domain name=Pkinase_Tyr; Domain location=122-385; Score=30.9; E_value=2.3e-14; Accession=PF07714.7; Description =Protein tyrosine kinase
  Pfam module annotation: Pfam domain module=Pkinase::Pkinase_Tyr; Domain location=122-384::122-385
MGCCSCFGFIRTPNRQSQRSKPATNNNNLCQEPLLDDDIEDEEGEHLYNDEVTNTSGDEGEEETRPKRSEEILNLRVENDMICTRFPVKETHKLVRTEANIETRWASVSFQDENGNKMINEYIRECKIGSGSYGKVALYQSSVDGKNYAIKAFHKSHLLKLRVSPSETAMTDVLREVLIMKMLEHPNIVDLIEVIDDPQSDNFYMVLEYVEGKWICEGSGTTCGLGEETARRYLRDIVSGLTYLHAHNIVHLDIKPDNLLITRHGTVKIGDFSVSQAFEDDKDELRRSPGTPVFTAPECILGGVKYGGKAADTWAVGVTLYCMILGEYPFLGDTLQDTYDKIVNNPLVLPNDMNPPLKNLIEGLLSKDPRLRMSLSDVAEDSWVIGDDGPIPDYLCWCKMKSLGIEDNDESNTD

SEQ ID NO: 133504 - protein, 212 aa, Glycine max
  Coding DNA Sequence Number=SeqID_16726
MVDILPQYQCATYKENGRQRNLSFSDATSGHYVADGRYVSSASSITGPPTGSSSSPSGGLACAIAALAERQQMAGESSMSITDENMPSFNTLPGSRRFYNRLGRDMAYYPPAENLNEEPLDEAVAMTRSHGEWDTDHGTPLTETATSYTNSVTAEDRGELSSLLRSDDIDGSLQSAPEPIVPESFEEQMMLAMAVSLAEARAMSSGQSASWQ

SEQ ID NO: 133505 - protein, 100 aa, Glycine max
  Coding DNA Sequence Number=SeqID_16727
MNHIHFTYELCNSHDYSIVFKIILTRRVPTVDPITILIALKGSYNCVIAQFIAHVVTYPSAGGRRGAHWCVFQGRKMHGVATNVYSRNMSKKPKRVVYEL

SEQ ID NO: 133506 - protein, 61 aa, Glycine max
  Coding DNA Sequence Number=SeqID_16728
MTKVNIFFSFPNKNVGGLIVTPTCACISIVACSLSMILEIARSTSLIGTHPEGKHFLHSYL

SEQ ID NO: 133507 - protein, 383 aa, Glycine max
  Coding DNA Sequence Number=SeqID_16729
  Gene Ontology: Mol. function=sugar binding
  Homolog annotation: Hit_ID=Q1SN84; Match level="QueryCoverage=97%, HitCoverage=75%, E-value=1e-119, Identity=70%"; Hit description=Root cap
  Pfam annotation: Domain name=Root_cap; Domain location=311-367; Score= 114.5; E_value=3e-31; Accession=PF06830.2; Description=Root cap
MTSCHLCQQVKKRGFCRKNTACEFKTIVCPSECAFRKPKKNKKQKACFIDCSSSTCEATCKGMGDGCCTQPYPCICKEAVSGFKSMTNKSPRHNFTAAPGLALMISDESCKVSLHSKFVAFYKTHFKMISDWLRSETVRKANCDGYGSLCYDPRFVGGDGVMFYFHGAKGGNFAIVSDNEFQINAHFIGTRPQGRTRDYTWVQALAVMFDTHTLVIAANRVSHWDDKVDSLIVKWDDEPVNIPTDGEAEWRANGDEREVVVERTDDTNSVRVTISGLVELDISVKPIGEQENKIHNYQLPSDDAFAHLETQFRFKKSTDNFEGVLGQTYRPGYVSPVKRGVPMPMMGGENKYQTLSLFSTSCNLCRFQRPSEIASTEGLVAQY

SEQ ID NO: 133508 - protein, 720 aa, Glycine max
  Coding DNA Sequence Number=SeqID_16730
  Gene Ontology: Mol. function=beta-galactosidase activity; Cellular component=beta-galactosidase complex; Biological process =carbohydrate metabolic process
  Homolog annotation: Hit_ID=Q1SN78; Match level="QueryCoverage=98%, HitCoverage=84%, E-value=0.0, Identity=79%"; Hit description =Rhodopsin-like GPCR superfamily; D-galactoside/L-rhamnose binding SUEL lectin; Galactose-binding like
  Pfam annotation: Domain name=Gal_Lectin; Domain location=642-719; Score=121.8; E_value=1.9e-33; Accession=PF02140.8; Description =Galactose binding lectin domain
  Pfam annotation: Domain name=Glyco_hydro_2_N; Domain location=312 -455; Score=-53.8; E_value=0.025; Accession=PF02837.8; Description =Glycosyl hydrolases family 2, sugar binding domain
  Pfam annotation: Domain name=Glyco_hydro_35; Domain location=1-221; Score=241.9; E_value=1.4e-69; Accession=PF01301.10; Description =Glycosyl hydrolases family 35
  Pfam module annotation: Pfam domain module=Gal_Lectin::Glyco_hydro_2 _N::Glyco_hydro_35; Domain location=642-719::312-455::1-221
MAFNFSKQWFPSLANFIPGIQFRTDNKPFEAEMKRFTVKIVDMMKQESLYASQGGPIILSQVENEYGNIDAAYGPAAKSYIKWAASMATSLDTGVPWVMCQQADAPDPIINTCNGFYCDQFTPNSNAKPKMWTENWSGWFLSFGGAVPYRPVEDLAFAVARFYQRGGTFQNYYMYHGGTNFGRTTGGPFISTSYDYDAPIDQYGIIRQPKWGHLKDVHKAIKLCEEALIATDPTITSPGPNIEAAVYKTGSICAAFLANIATSDATVTFNGNSYHLPAWSVSILPDCKNVVLNTAKINSASMISSFTTESFKEEVGSLDDSGSGWSWISEPIGISKSDSFSKFGLLEQINTTADKSDYLWYSISIDVEGDSGSQTVLHIESLGHALHAFINGKIAGSGTGNSGKAKVNVDIPVTLVAGKNSIDLLSLTVGLQNYGAFFDTWGAGITGPVILKGLKNGSTVDLSSQQWTYQVGLKYEDLGPSNGSSGQWNSQSTLPTNQSLIWYKTNFVAPSGSNPVAIDFTGMGKGEAWVNGQSIGRYWPTYVSPNGGCTDSCNYRGAYSSSKCLKNCGKPSQTLYHIPRSWLQPDSNTLVLFEESGGDPTQISFATKQIGSMCSHVSESHPPPVDLWNSDKGRKVGPVLSLECPYPNQLISSIKFASFGTPYGTCGNFKHGRCRSNKALSIVQKACIGSSSCRIGISINTFGDPCKGVTKSLAVEASCA

SEQ ID NO: 133509 - protein, 179 aa, Glycine max
  Coding DNA Sequence Number=SeqID_16731
  Gene Ontology: Mol. function=intramolecular transferase activity, phosphotransferases; Cellular component=6-phosphofructokinase complex; Biological process=glycolysis
  Homolog annotation: Hit_ID=Q2QPB6; Match level="QueryCoverage=51%, HitCoverage=21%, E-value=3e-35, Identity=79%"; Hit description =Metalloenzyme superfamily protein, expressed
MWKELQIKVAELPKAKPQKRKLHQGRGGNYYQAAPTSRYATEHRCGVVVKGPNLSGNISGTEPLKDNHILLKAEALDDSHEPSNIAVVVNELSKEITKNLVSHPVNAKCTAEGKSIANVVLLRGCGIQIERITEGQNKVIITDRMWARLLSSTNQPSFTIAKTVSEEKREEEANGHISE

SEQ ID NO: 133510 - protein, 196 aa, Glycine max
  Coding DNA Sequence Number=SeqID_16732
MMLRLGSRDHVRDKDRLCMYKVMVDEKVNMNEVIFFYLLQAFKDRFHAKGKKNLVPYRILLTKITRNKRVDVSMLEPSVGATQLKGVTFVKMGIVDKFLEYAQKHIKRKSSRAANRSRVWSSVSVNSGGEKFFEEIQEDVILESLKILFVEEVQMKIVEEATMVDIDGEPLPEEVIVESNQAQSKLKAKQAEMEGL

SEQ ID NO: 133511 - protein, 857 aa, Glycine max
  Coding DNA Sequence Number=SeqID_16733
  Gene Ontology: Mol. function=RNA-directed DNA polymerase activity; Cellular component=chromatin; Biological process=chromatin assembly or disassembly
  Pfam annotation: Domain name=rve; Domain location=699-825; Score =25.9; E_value=4.1e-05; Accession=PF00665.16; Description=Integrase core domain
  Pfam annotation: Domain name=zf-CCHC; Domain location=276-293; Score =9.3; E_value=0.029; Accession=PF00098.13; Description=Zinc knuckle
  Pfam module annotation: Pfam domain module=RVT_1::rve::zf-CCHC; Domain location=357-521::699-825::276-293
MTERVDVLEARMNSLENSLTQSMEEFCRSLMTEFAKLQDCCVNDETRSPSFSTESVLEYKMPAKKVELPPFDKEDLVGWITHAETYFEVHGSSEEMKVRLAKLSMEGSAIHWFNLLCETEDALTWSKQKKSLIERYGGRVGHLLAEQYLRIAQDVEAKLRGSLMPHISGSVIQWRGGRELDPGSGGKRGVRSNFPSGARSDSGSHYNSGPYKGTFRSGPLSSDPTQTMQSGSNVNPNSSSNSVQKERDEGGRGNNPRNRDIKHLPYSELMDGKVCGLCFQCGERFHPLHQCTEKQFHLVILGNNEVVIAEGEVIAIEVRDDEDEATLDCNIMGVFGLTEGMKTMKRPTTITGFDNTDIPTITKGRLRNKDALWRMRVDYRELNKVTIPDKYPIPVVEELLDELHGATYFPNLDLKSRYHQIRVKEEDMHKTAFRTHEGHYEFMVMPFGLTNAPPATFQSTMNQVFKPFLRKTALVFFDDILVFSKGWKEHMEHLTQVLKALQENKLVELKGVMTQAPVLTLPDFNQPFEIECDASGRGVGAVLMQNRKPIAYFSKALSENNLSKSAYEKELMVLVLAVQHWITTADQQNWIAKLLGYQFEVIYKPGPDNKAADSLSRIYEEGDLKSITSFPIWMQEQQVQHEVLRDPFLKQVIADLHENPASQPMFSLQQGDFVKSCDVCQGQKYSASSPACLLQPLPIPAQIWEDISLDFVMGLPKSKGFEAVFVVVDRLSKYAHFIPLRHPYTDRKVAEVFTKEIGTVLKMSSSYHPETDGQTEEVNRCLESYLRCFASEQPKNWSFWVLWAELWYYTTFHVSTGVTPFESVYGRKPPTLVRVLQGETRVEAVEVELMDRDEALQ

SEQ ID NO: 133512 - protein, 105 aa, Glycine max
  Coding DNA Sequence Number=SeqID_16734
MGMEKGERSENEDGMAMGKEEMGKPGQDTWREGQNNGKRKRNKSKHGHNTWIEAGKIIKPKKRQKPKLFDEYEILIMNQKIKPGLVEFPDKNCTCSVLFYQMCMQ

SEQ ID NO: 133513 - protein, 341 aa, Glycine max
  Coding DNA Sequence Number=SeqID_16735
  Gene Ontology: Mol. function=protein translocase activity; Cellular component=mitochondrial inner membrane presequence translocase complex; Biological process=intracellular protein transport
  Homolog annotation: Hit_ID=Q1PF33; Match level="QueryCoverage=88%, HitCoverage=64%, E-value=2e-77, Identity=51%"; Hit description =Mitochondrial import inner membrane translocase subunit TIM44
MATRKLIRDLLLSKRSLLHHQGWSRSRRLPLVWEDRRRYSVFNEFSKNIKGQAVRNQEFQQSVKELKEKADELKGVKEELKERTKQKTEKLYKQVDEAWTEAEAAARKVSYNVKEKISAASEEVKETFGIGKQDSSGSTDSSTKQGADANGGNQTSREEEKNQQSGSSKDADSLFGKFKSTISSPNVSAAFQKLKDAKLVDITKKGYDIVKEELSSTPTKRKRVPFASSGETSTRTDLVVMPSKQSWWSKKFDEFREKVKGHPVSKRFLKYSDPVKTKGQEIVEDLRERYETSDSPIIHKIQDIVVNTGVTEWSGRPQKWDSRIADGGMTAFLMCFFIHVK

SEQ ID NO: 133514 - protein, 99 aa, Glycine max
  Coding DNA Sequence Number=SeqID_16736
MHGAIGDGAFDRDEPRGCVATATGDKGLHIAAPIGASKGAWERWFDQRLQHLQAAGIVCSSTCSYSDRSWKAPLEVIACVEKGSWWCCLVCVLPFSKSL

SEQ ID NO: 133515 - protein, 204 aa, Glycine max
  Coding DNA Sequence Number=SeqID_16737
MEMLNLLDLLELDLTICSNMSLKLSNTSLRSQIWMYMPWEVSTGYKNVVLVWEEKLAVDAYHHEVGQYYQTLNHTCFTQETPFNMLYTWKREFYEVKSGVEVAFDSMVVPVYDPPPFRSCVCLLEVELVRAREAFAQVLKDRAHVEKEVHKWSLIGDYFYKKAIGWKPHCPPTPPGSPILSYDNEDSGDEFLNEEVAKQKGAKK

SEQ ID NO: 133516 - protein, 121 aa, Glycine max
  Coding DNA Sequence Number=SeqID_16738
MTILYRMNSVITVLYFNGRIYEDNDGVIFEGSKKAIQIKRGISFNALKKKIGDKDVAGGSMFHSANSLTSCGNYLSNDETQPATNMSNLHIDEDDDDHDDDDYLVSNSYVEESVDEDDSVE

SEQ ID NO: 133517 - protein, 263 aa, Glycine max
  Coding DNA Sequence Number=SeqID_16739
  Gene Ontology: Mol. function=methyltransferase activity; Cellular component=cytoplasm; Biological process=metabolic process
  Homolog annotation: Hit_ID=Q6Z8K5; Match level="QueryCoverage=91%, HitCoverage=79%, E-value=3e-65, Identity=55%"; Hit description =Methyltransferase-like
  Pfam annotation: Domain name=Methyltransf_11; Domain location=7-82; Score=47.8; E_value=3.6e-11; Accession=PF08241.2; Description =Methyltransferase domain
MMLLRRISVPPGCDISPSLIKICLDREHEVLVADAVNLPYRTGFGDVAISIAVLHHLSTENRRRKAIEELVRVVKKGGLVLITVWAVEQEDSKLITKWTPLNEKYVDEWVGPGSPRTRAPSSSSLESIPESEVSRSGEHMEVCNEPHVSRDLEEEKNIKNQQEYFVPWHLPYHRAEISGASAEALAAGLATKDDKKGAVVYNRYYHVFSEGELESLTTGINNARIVDQFFDKSNWCIILEKTLQKLDRMIIWPFHHPDQAAFF

SEQ ID NO: 133518 - protein, 143 aa, Glycine max
  Coding DNA Sequence Number=SeqID_16740
MISCTNDVKHVDHAVDEIHKQPKEIVVDDVVADAEGFSGGPHDTLVLMDYVHHVAATVWNGEERAELKLSFHGRKVKKFGRPASEIEGLVAACYLDIGDWGLIYAFAKSAFHSFEAIQVDEVVDLLVDLLEVSLEEARAETLQ

SEQ ID NO: 133519 - protein, 110 aa, Glycine max
  Coding DNA Sequence Number=SeqID_16741
  Homolog annotation: Hit_ID=Q9FMI8; Match level="QueryCoverage=38%, HitCoverage=9%, E-value=7e-07, Identity=65%"; Hit description =Arabidopsis thaliana genomic DNA, chromosome 5, P1 clone:MHJ24
  Subcellular localization annotation: CTP_CleavageSite=25; ConfidenceScore=5.29e-01
MLAKLLISPSRLSSLLQGSGVWTTRACGRSGRRSEAGVLTKGGVVKVKARLWGLQRGFEPREGQWLQGVDAREDDVREKGDKGEDYQVDVGVRGEEGVVEPLAEVVHSRN

SEQ ID NO: 133520 - protein, 1673 aa, Glycine max
  Coding DNA Sequence Number=SeqID_16742
  Gene Ontology: Mol. function=zinc ion binding; Cellular component =membrane; Biological process=signal transduction
  Homolog annotation: Hit_ID=Q513P3; Match level="QueryCoverage=93%, HitCoverage=94%, E-value=2e-37, Identity=19%"; Hit description=Viral A-type inclusion protein repeat, putative
  Pfam annotation: Domain name=ERM; Domain location=1375-1664; Score= -205.1; E_value=0.069; Accession=PF00769.9; Description =Ezrinradixinmoesin family
  Pfam annotation: Domain name=Filament; Domain location=826-1086; Score=-181.3; E_value=0.072; Accession=PF00038.11; Description =Intermediate filament protein
  Pfam annotation: Domain name=KID; Domain location=1013-1023; Score =4.9; E_value=44; Accession=PF02524.5; Description=KID repeat
  Pfam annotation: Domain name=KID; Domain location=1079-1089; Score =0.4; E_value=3.9e+02; Accession=PF02524.5; Description=KID repeat
  Pfam annotation: Domain name=KID; Domain location=1222-1232; Score =3.0; E_value=1.1e+02; Accession=PF02524.5; Description=KID repeat
  Pfam annotation: Domain name=KID; Domain location=1478-1488; Score =4.7; E_value=48; Accession=PF02524.5; Description=KID repeat
  Pfam annotation: Domain name=KID; Domain location=1632-1642; Score =1.5; E_value=2.3e+02; Accession=PF02524.5; Description=KID repeat
  Pfam annotation: Domain name=KID; Domain location=947-957; Score=4.7; E_value=48; Accession=PF02524.5; Description=KID repeat
  Pfam annotation: Domain name=M; Domain location=1033-1053; Score=8.5; E_value=9.4; Accession=PF02370.7; Description=M protein repeat
  Pfam annotation: Domain name=M; Domain location=1057-1077; Score=4.8; E_value=29; Accession=PF02370.7; Description=M protein repeat
  Pfam annotation: Domain name=M; Domain location=1099-1119; Score=4.4; E_value=33; Accession=PF02370.7; Description=M protein repeat
  Pfam annotation: Domain name=M; Domain location=1519-1539; Score=8.7; E_value=8.8; Accession=PF02370.7; Description=M protein repeat
  Pfam annotation: Domain name=M; Domain location=643-663; Score=8.1; E_ value=11; Accession=PF02370.7; Description=M protein repeat
  Pfam annotation: Domain name=M; Domain location=887-907; Score=3.0; E_ value=50; Accession=PF02370.7; Description=M protein repeat
  Pfam annotation: Domain name=M; Domain location=925-945; Score=6.0; E_ value=21; Accession=PF02370.7; Description=M protein repeat
  Pfam annotation: Domain name=M; Domain location=967-987; Score=8.7; E_ value=8.9; Accession=PF02370.7; Description=M protein repeat
  Pfam annotation: Domain name=M; Domain location=991-1011; Score=0.0; E_value=1.2e+02; Accession=PF02370.7; Description=M protein repeat
  Pfam annotation: Domain name=Myosin_tail_1; Domain location=700-1568; Score=-522.4; E_value=0.074; Accession=PF01576.9; Description=Myosin tail
  Pfam annotation: Domain name=Pox_A_type_inc; Domain location=1012 -1034; Score=4.9; E_value=16; Accession=PF04508.3; Description=Viral A-type inclusion protein repeat
  Pfam annotation: Domain name=Pox_A_type_inc; Domain location=1047 -1072; Score=0.1; E_value=79; Accession=PF04508.3; Description=Viral A-type inclusion protein repeat
  Pfam annotation: Domain name=Pox_A_type_inc; Domain location=1140 -1166; Score=0.5; E_value=68; Accession=PF04508.3; Description=Viral A-type inclusion protein repeat
  Pfam annotation: Domain name=Pox_A_type_inc; Domain location=1353 -1375; Score=2.7; E_value=33; Accession=PF04508.3; Description=Viral A-type inclusion protein repeat
  Pfam annotation: Domain name=Pox_A_type_inc; Domain location=1473 -1492; Score=0.2; E_value=76; Accession=PF04508.3; Description=Viral A-type inclusion protein repeat
  Pfam annotation: Domain name=Pox_A_type_inc; Domain location=1624 -1646; Score=4.3; E_value=19; Accession=PF04508.3; Description=Viral A-type inclusion protein repeat
  Pfam annotation: Domain name=Pox_A_type_inc; Domain location=350-372; Score=1.1; E_value=56; Accession=PF04508.3; Description=Viral A-type inclusion protein repeat
  Pfam annotation: Domain name=Pox_A_type_inc; Domain location=587-609; Score=1.1; E_value=56; Accession=PF04508.3; Description=Viral A-type inclusion protein repeat
  Pfam annotation: Domain name=Pox_A_type_inc; Domain location=946-968; Score=5.9; E_value=11; Accession=PF04508.3; Description=Viral A-type inclusion protein repeat
  Pfam module annotation: Pfam domain module=ERM::Filament::KID::KID::KI D::KID::KID::KID::M::M::M::M::M::M::M::M::M::Myosin_tail_1::Pox_A _type_inc::Pox_A_type_inc::Pox_A_type_inc::Pox_A_type_inc::Pox_A_type_ inc::...
  Pfam module annotation: Pfam domain module=Pox_A_type_inc::Pox_A_type_ inc::Pox_A_type_inc::Pox_A_type_inc; Domain location=1375-1664::826 -1086::1013-1023::1079-1089::1222-1232::1478-1488::1632-1642::947 -957::1033-1053::...
  Pfam module annotation: Domain location=1057-1077::1099-1119::1519 -1539::643-663::887-907::925-945::967-987::991-1011::700-1568::1012 -1034::1047-1072::1140-1166::1353-1375::1473-1492::1624-1646::350 -372::587-609::946-968
MENHVHSRVKLKRESKDLPRISSLEGESGVNEDYADSAAGFDGSSSTSESIYTEKHDISSTHEVDSLKSTISGDLGGLSLSQSPQPEKGEAPDNQFPAQGSERVHDWSIDYSAANSLAAASEDRSSNRLMGNLDAVESSILDLKLKVSSLQNHADEIGVETHKFSEQLAAEISSGEELVKEVAVLKSECSKFRDEFEQLKSSKLSLALPHKEPTGTDRDKLFQNLQHKWHKGLLLMEGKIRDIQKVSLGFPERDFRFLNLELEALAEILQNLKQESGEPISGAKVVNERENKKMDMHKSEQFLTDIGSDTGLFQPESMTHYLTIPGLVSHEFDSVDPALAMKEKVFELLRELDESKTERESLVRKMDQMECYYEALIQELEQNQRQMMAELQNLRNEHSTCMYTISAGKSEMEKMHQNMNEQIMKFAEDKHILESLNSDFERRAISAEAALKRARLNYSIAVGQLQKDLELLSCQVLSMHETNENLIKQTLSDSSLPNADGSPEPVTYPKISEGRTFNRSLCQNHSSSLQRQHLGEDILLSDLKRSLQLQEGLYRQVEEEISQMHFVNIYSDVFSKALQETLLEASLDIQLMKEKIVQLSQQLELTNESNELLVLRLQNAMNDILSLNEYKEICTAKSNDIALQNQILEANLKDLAHENNLLTEKINELEVLLTEYRSYEGKYMACSTENSELRSLLKKESLGKKHLHDEISILQEELKSIRTKFDEQVSMKDNLQNNAIFLSKKLQKLLASYEERHSELSLCSRSACLDSECEDVEGLLLQLEELQQSAFHRILLLIEEKEILVHEKLMAQVSLNTAESDVLVMKQKVEHDLQEMVQKITVSGALLQKLQLNFEVIINRINAGFEAEELYSQHHKEFLSGLDHLEAELQQLNSRNQDLAQEIIKLDTSSSDLEMCKLTLATIKEEKKDLESSLQEKTEESTKISSELDFLKKNLDSLHNELHAEKTVREKLEKTVSDLTTELNEKQRQLQGKKDLESSLHERAEEAAKISSEVDFLKKNLHSLHSELHAEKTVREKLEKTISDLTTELNEKQTQLQGKKDLESSLQERAEESAKISSELNFLEKNLYSLHTELHAEKIVREKLEKTVSDLTTELNEKQCQLQDSDLKRQELVHLKQMVTDLEFENSRISDLLQKSEKHLTDALKESSSISCLETQLSEMHEFCIATDVVMTFTRAQFEDHMEELAQKLHSTCWQLDVVHKKNLDVESELDGYLSRERTCIEENTRLLTSLDFVKSEIDVLTTQNRALIDQNSANMLELKEHKSRTEKISDTYVRERQSVPEVARLEQLLASCCRNAEELFLSKEAAEFKCIVLLGKLDELETAFTSLKQSDNELIRLQNQCNELTKRLAEQVLKTEEFKNLSIHLKELKDKAEAECANAHDRRGPEGPPVAMQESLRIAFIKEQYESKLQELRQQLSLSKKHSEEMLWKLQDAVDETEKRKKSEASQIKINEELGMKILELEAELQAVLSDKRNLLNAYDLLKAEKECSVISLECCKQEKQELEASLVKCNEEKSKIEVELTLAKELVETSGSHVNSLNEGNGTFSSLNPQENSTHAACSHEPESASINMQSKDPLAFSVMNGCQTLGTEKDLQLEEVMKHVASTQSLKSSIDHLNKELERMKNENMLPSVDGQSHESSFPGLQRELMQLHE

SEQ ID NO: 133521 - protein, 162 aa, Glycine max
  Coding DNA Sequence Number=SeqID_16743
  Gene Ontology: Mol. function=RNA-directed DNA polymerase activity; Cellular component=intracellular; Biological process=RNA-dependent DNA replication
MAPEDMAKTTFITLWGTFCYKVMSFGLKNAGATYQQAMVALFHDMMHKEIEVYVNDMIAKSKTEELNPTKCTFGVKSKKFHGFIMSQKEIEVDRDKLTATCEPFFKLLRKNQSIQWDDDCQVAFERIKRCFMNPSALVSLVPGRPLVLYMTVLDESMGCVLG

SEQ ID NO: 133522 - protein, 246 aa, Glycine max
  Coding DNA Sequence Number=SeqID_16744
  Homolog annotation: Hit_ID=Q69S84; Match level="QueryCoverage=99%, HitCoverage=49%, E-value=2e-72, Identity=52%"; Hit description=Kelch repeat-containing F-box-like protein
  Pfam annotation: Domain name=Kelch_1; Domain location=1-37; Score =19.7; E_value=0.011; Accession=PF01344.15; Description=Kelch motif
  Subcellular localization annotation: CTP_CleavageSite=56; ConfidenceScore=5.07e-01
LYVVGGVSQGQAGLVPLQSAEVFDPSTDTWSHVPSMPFSGAPVLPSAFLADMPKPVATGLSSYMGRLCVPQSLFSWIFVNVGGQIYDPETNSWIEMPAGMGEGWHVRQAGTKLSVVVDGELYAFDPSNFVDGGRIKVYDQGEDAWKVVIGKVPIYDSSDSESPYLLAGFHGKLHVITKDANHDIAVLQAGLRDNLDSSPSLSTLSPSTSQESPEVAAESEAATVWRIVANRDFGQAELVSCQVIDI

SEQ ID NO: 133523 - protein, 123 aa, Glycine max
  Coding DNA Sequence Number=SeqID_16745
MSVKNLVGHLGVYEKTDHTLNVTSFIFGLDLDLVARVFRRHVVDLELFRGSDDERLLEVIELVNEGEDGEFGAKNLFLLLVQGLALGDDLFHGEGRGCGSASSLGDRVYVGSKMRTIEECDRA

SEQ ID NO: 133524 - protein, 248 aa, Glycine max
  Coding DNA Sequence Number=SeqID_16746
MEEETTESEPSPPPLSWLRSPSSPAFQTTMLGDVIGTESGDCMITDVEELRTESEPRKTIIKRRERGRKREFPPPITLLRETGEMPWSLEREYSGDGRLIITAVPETVVKRGHEYCSIMEARREDGRLTMRFAPEEDGDYCEECGYAIDYEEDLEFNQGFDSVDDEDECGFEFEEESAKEASNESERCGKLDLRECVTYDGPGLGPVEMLQLPHSDSDPFLKGTGFGDLNTCLGRPASAPLRPMTPVM

SEQ ID NO: 133525 - protein, 144 aa, Glycine max
  Coding DNA Sequence Number=SeqID_16747
  Homolog annotation: Hit_ID=Q69S84; Match level="QueryCoverage=100%, HitCoverage=40%, E-value=1e-27, Identity=37%"; Hit description=Kelch repeat-containing F-box-like protein
  Pfam annotation: Domain name=F-box; Domain location=41-88; Score =45.5; E_value=1.7e-10; Accession=PF00646.23; Description=F-box domain
MGAFFSVASTKPEQREWNEISPNETCKRQRMSPTVDEESPTLIPNLPDELSLQIIARLPRICYFNVRLVSKRWKSTIMSSELYKLRKELGTTEEWLYLLIKVGENNLLWHALDPHSKTWQRVPNAFDEMPFCGCAIGAVDGCLY

SEQ ID NO: 133526 - protein, 556 aa, Glycine max
  Coding DNA Sequence Number=SeqID_16748
  Gene Ontology: Mol. function=GPI anchor binding; Cellular component =membrane; Biological process=cell adhesion
  Homolog annotation: Hit_ID=Q1SN67; Match level="QueryCoverage=92%, HitCoverage=81%, E-value=6e-79, Identity=60%"; Hit description=Beta -Ig-H3/fasciclin
  Pfam annotation: Domain name=Fasciclin; Domain location=26-160; Score= 90.7; E_value=4.5e-24; Accession=PF02469.12; Description=Fasciclin domain
  Pfam annotation: Domain name=Fasciclin; Domain location=330-464; Score=84.0; E_value=4.6e-22; Accession=PF02469.12; Description =Fasciclin domain
  Pfam module annotation: Pfam domain module=Fasciclin::Fasciclin; Domain location=26-160::330-464
MVQSPSTDTSDSSPDDIIRILRKAKSFNVLIRLLKTTQLINQINAQLITIRSGGLTIFAPDDGSFSQLKAGFLNSLADNQKIELLQFHVLPTYVSSSNFDSLSNPVRTLAGDNPTRLQFNVTAYGSNVNISTGVVNATVTGVVYSDKVLAVYHVDKVLLPLDFFRPKPPAPAPSPAMAPKADNDNSSADARLGTSKDSADASSLISTRGMTLLSFGVALVALNLFHLLDCARLKLLCGREDSKTMSKNEYDSRIKQATLFSFSLFLLFSATTFAISPAPAAAPKAPAKPPPTPKATAPSPKPLVPTLPQSPNSPDSVPDDITRILKKAKMFSVLIRLLKTTEIMNNINSQLITAKSGGITILAPDDSAFSNLKAGFLNSLNEGQKIELVQFHILPEFVSSSNFDSLSNPVQTVAGKDPARLPLNVNALGNSVNISTGVVNATVLGVVYSDNKLGIYHVDKVLLPLDFFVTNKAPALAPTTLAKAPKSAKDNSSEDDQEGTNQHQNKSGAVSVVSIGRTTLMLLGIALVAVATMGLISNMELIHLAAAFSIFFAKHC

SEQ ID NO: 133527 - protein, 50 aa, Glycine max
  Coding DNA Sequence Number=SeqID_16749
MAIGGFTMRRGERKGASSARHPLAQRVLLLDRGLSACVAGLARASVGSWA

SEQ ID NO: 133528 - protein, 238 aa, Glycine max
  Coding DNA Sequence Number=SeqID_16750
  Homolog annotation: Hit_ID=Q949V3; Match level="QueryCoverage=21%, HitCoverage=7%, E-value=3e-12, Identity=70%"; Hit description =Putative receptor protein kinase
MENLMLEDVGTQCYDRMDRWCHKTFLHWHHCHNRCGVCSWLGIVVASIVVVSPVVEKIAREGGDIVVEGGYHQWFGGGGEEQACDLLKALVEVLGKGSVGISYKLVMEEGTTMEVKRFKDIVETKKEFEMQMEVLIAPIKLVVDKFQLLLEFLKIGMGVEQEVGSQAGIFSSRFRHCWVYLLSLIAFSNRKRVFNFWGKTHQILEVQSKHVIDMHIYSLCSNICFLMEQETEQRFGAD

SEQ ID NO: 133529 - protein, 46 aa, Glycine max
  Coding DNA Sequence Number=SeqID_16751
MESVEPDAADCLDGCTTGCVQSDLRLQARCDRKCNIRCGPGKIILS

SEQ ID NO: 133530 - protein, 72 aa, Glycine max
  Coding DNA Sequence Number=SeqID_16752
MTIEGFTMRRGERKGVSETPRRELLKWALGLRRRARRDTPSLSPTPPRSARVDRALSAHVAGLACASVRSRA

SEQ ID NO: 133531 - protein, 282 aa, Glycine max
  Coding DNA Sequence Number=SeqID_16753
  Gene Ontology: Mol. function=GPI anchor binding; Cellular component =membrane; Biological process=cell adhesion
  Homolog annotation: Hit_ID=Q1SN67; Match level="QueryCoverage=82%, HitCoverage=82%, E-value=1e-72, Identity=63%"; Hit description=Beta -Ig-H3/fasciclin
  Pfam annotation: Domain name=Fasciclin; Domain location=77-211; Score= 81.3; E_value=3e-21; Accession=PF02469.12; Description=Fasciclin domain
  Subcellular localization annotation: CTP_CleavageSite=74; ConfidenceScore=5.07e-01
MKQAILLSFSLLLLLASTTLAISPAPAAAPKAAAKTPPTPKAAAPSPKQLVPTLPQSPDSPDSVPDDITRILKKAKMFSVLIRLLKTTEIMNNINSQLITAKSGGITILAPDDSAFSNLKAGFLNSLNEGQKIELVQFHLLPEFVSSSNFDSLSNPVQTVAGKDPARLPLNVNALGNSVNISTGVVNATVLGVVYSDNKLGIYHVDKVLLPLDFFVTNKAPALAPTAPTKVPKDAKDNSSEDDQEETNRDHNKSGAVSLVSLGGTKLMSLGIALVAVATMWS

SEQ ID NO: 133532 - protein, 56 aa, Glycine max
  Coding DNA Sequence Number=SeqID_16754
MLVSAENGIGGVTSVATARVTSSGAMMMNEVGSGTGSKKWGRPGSIHCRHEKGIYG

SEQ ID NO: 133533 - protein, 95 aa, Glycine max
  Coding DNA Sequence Number=SeqID_16755
MNHLMRGTTIDTTKYQIMGNSSFGVVAVGDEIGVNLVKFGCGPSGMVCTQWWGETEVLRAQIYWCRGVVWVAKQRCCSSDIWLCDIVVDMVVMAV

SEQ ID NO: 133534 - protein, 79 aa, Glycine max
  Coding DNA Sequence Number=SeqID_16756
MSMKESCHGGQGGKRGFKDNPFLVLAEGLGNLGAIHVFRDLIQSQIPDVMFLSETLVHASKVEEIKRTIDFYNCFAVDR

SEQ ID NO: 133535 - protein, 332 aa, Glycine max
  Coding DNA Sequence Number=SeqID_16757
  Homolog annotation: Hit_ID=Q656B0; Match level="QueryCoverage=90%, HitCoverage=54%, E-value=2e-19, Identity=37%"; Hit description =Putative Noc3p
  Pfam annotation: Domain name=NOC3p; Domain location=98-149; Score= -5.6; E_value=0.0007; Accession=PF07540.2; Description=Nucleolar complex-associated protein
VDRVDALPIKTLDGKIHYGTATKTVLENDPSEEGTGEDVNKDKGMVKLTKAEKRAKLKKMRKEAKQQGKEVAKAEVEETPQAAVLAEVKEDLTAEEAFESKKHKLAELGNALLTDPELPTEKELEMKVSKTVRKMRYYESSLLSAYKEIWRSLEHEGAFSASHALSTRKLPYSLSVVIALSAKVEADYKAASLAPDVMEKKHMQAETVSAVFETYFRILKHTMQSINARPEANTGALSAAVGPLPLLAPCLKGLAKFSHLIDLDFMGDPMNHLRLFAFGGSTSGNTSDKCSKYLIVSEHFQQTQGVSSLSGQPKLSMKKLKGTLSANLAPSM

SEQ ID NO: 133536 - protein, 73 aa, Glycine max
  Coding DNA Sequence Number=SeqID_16758
MKIPVAPLALDATKNGSNNNTPNILSESTDKQRTPEKRKSHGSNIDKRKTKEVVFIGGKHLASRDDFMDLRPT

SEQ ID NO: 133537 - protein, 505 aa, Glycine max
  Coding DNA Sequence Number=SeqID_16759
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=O22216; Match level="QueryCoverage=99%, HitCoverage=99%, E-value=0.0, Identity=75%"; Hit description =Glycerol-3-phosphate dehydrogenase
  Pfam annotation: Domain name=NAD_Gly3P_dh_C; Domain location=272-474; Score=117.0; E_value=5.4e-32; Accession=PF07479.4; Description=NAD -dependent glycerol-3-phosphate deh
  Pfam annotation: Domain name=NAD_Gly3P_dh_N; Domain location=41-259; Score=-34.4; E_value=0.00087; Accession=PF01210.13; Description=NAD -dependent glycerol-3-phosphate deh
  Pfam module annotation: Pfam domain module=NAD_Gly3P_dh_C::NAD_Gly3P _dh_N; Domain location=272-474::41-259
MVGSNGNAHSNGSLLNVNGGSLEEKVDEIRGLLGKVEGDPLRIVGVGAGAWGSVFIAMLQEAYGSLREKVLIRIWRRPGRMVDRATAEHLFEVINSREDVLRRLIRRCAYLKYVEARLGDRTLYADEILKDGFCLNMIDTPLCPLKVVTNLQEAVWDADIVINGLPSTETREVFEEISKYWKERITVPVIVSLAKGVEAELGTEPRIITPTLMINQATGVPLDSILYLGGPNIASEIYNKEYANARICGAEKWRKTLAKFLRQPHFIVWDNGDLVTHEIMGGLKNVYAIGAGMVAALTNESATSKSVYFAHCTSEMIFITHLLAEEPEKLAGPLLADTYVTLLKGRNAWYGQKLAKGELSLEMGDSIKGKGMIQVLKAVRDCDFSFNEVFWVIVAAFVCNVSQYQGSQQNRNCHHESGVSAVRAFYELLSQSSLNVLNPEENKHVAPVELCPILKMLYRILIIREYPAQAILEALRDETMNDPRDRIEIAQSHVFYRPSLLGHKP

SEQ ID NO: 133538 - protein, 90 aa, Glycine max
  Coding DNA Sequence Number=SeqID_16760
  Gene Ontology: Mol. function=nucleotide binding; Cellular component =intracellular; Biological process=small GTPase mediated signal transduction
  Homolog annotation: Hit_ID=Q75KN8; Match level="QueryCoverage=69%, HitCoverage=31%, E-value=2e-22, Identity=79%"; Hit description =Putative GTP-binding protein
  Pfam annotation: Domain name=Arf; Domain location=1-82; Score=-98.0; E_value=0.034; Accession=PF00025.11; Description=ADP-ribosylation factor family
MELHVLILGIDKAGKTTLLEKMKSVYSNIEGIPPDRIIPTVGLNIGRIEVANSKLVFWDLGGQLMCCLFKLFHSRSSVAKAIIIYIVAEV

SEQ ID NO: 133539 - protein, 257 aa, Glycine max
  Coding DNA Sequence Number=SeqID_16761
MTATKCDRRWPQKDPMTVERDQEWAISLLKVVSRMRRELKNLRIKIICYKKERKRIEKALKGVEAWLNSISHTTRIRFGAISVSSSFFLILILMGISWSGNSRRRNNYLQNRPPPPSYYYPPESHPPPPPPPPPPPQSQGYFLPSTTPYAPPPPLPPPPGPPQSHSISFYYNSNPNSYGTPTLAPRFHYQHYYQPHPSACPAPRPASTTPPPYVDHQTAKKIRNYVNVHKDTLRLEVDDHNPDHHLLSFVFDAVYDG

SEQ ID NO: 133540 - protein, 206 aa, Glycine max
  Coding DNA Sequence Number=SeqID_16762
MSSTLSTTSSRMRDPIMTLPCILQFIAAFHNEKWAPCYPEFARFNYDGASYQICLRQYQRKLFFADGLKQLRKHLNIYEPITINFMACEHRWNFDLHFSPSLEQQACGRPLPAFRMHMLPPIAAIHLPSCGFHMTILRKFGPPLQWSVVPIGPSFHGKYVAEPWYRFLAEGDFVHGDELLFYYRSHEDIWETVIRKQRNWGDNDDW

SEQ ID NO: 133541 - protein, 221 aa, Glycine max
  Coding DNA Sequence Number=SeqID_16763
  Gene Ontology: Mol. function=metal ion binding; Cellular component =nucleus; Biological process=ubiquitin cycle
  Homolog annotation: Hit_ID=Q8RUJ8; Match level="QueryCoverage=92%, HitCoverage=47%, E-value=1e-60, Identity=55%"; Hit description =Putative hydroxyproline-rich glycoprotein
  Pfam annotation: Domain name=zf-C3HC4; Domain location=166-204; Score= 26.8; E_value=7.7e-05; Accession=PF00097.15; Description=Zinc finger, C3HC4 type (RING finger)
  Pfam annotation: Domain name=zf-P11; Domain location=164-213; Score =1.5; E_value=0.078; Accession=PF03854.4; Description=P-11 zinc finger
  Pfam module annotation: Pfam domain module=zf-C3HC4::zf-P11; Domain location=166-204::164-213
MSSANEIPMRNHSITILYFAKEEEKCRFVPLYPDAFQPVRIPFQKGVGQKFAQPSGTGIDLGFFELDDLSKPSPGEDVFPLVICAETSLKTTSEDETPGDSLLDASPHMQITQGILEKSNGAGPFLIKVVKQILWIDGVRYELRELYGIGNSSTDDFDDNDPGKECVICMTEPKDTAVLPCRHMCMCSECANALRQQSNKCPICRQPIEELIEIKVNNGDQ

SEQ ID NO: 133542 - protein, 100 aa, Glycine max
  Coding DNA Sequence Number=SeqID_16764
MVILHPLSLRNNKSSDTRAETNYGHSAPFVIHGQFRWQGDSLAEWCFARTKLVSYLYFPFISNKRQVKRGNCHTQISSGDHLFVGMRPSFDHFEVLGTHR

SEQ ID NO: 133543 - protein, 708 aa, Glycine max
  Coding DNA Sequence Number=SeqID_16765
  Gene Ontology: Mol. function=protein binding; Cellular component =nucleus; Biological process=defense response
  Homolog annotation: Hit_ID=Q19PN6; Match level="QueryCoverage=79%, HitCoverage=50%, E-value=8e-42, Identity=27%"; Hit description=NBS -LRR type disease resistance protein
  Pfam annotation: Domain name=LRR_1; Domain location=264-285; Score =11.8; E_value=1.8; Accession=PF00560.23; Description=Leucine Rich Repeat
  Pfam annotation: Domain name=LRR_1; Domain location=287-308; Score =14.0; E_value=0.56; Accession=PF00560.23; Description=Leucine Rich Repeat
  Pfam annotation: Domain name=LRR_1; Domain location=310-332; Score =1.5; E_value=1.5e+02; Accession=PF00560.23; Description=Leucine Rich Repeat
  Pfam annotation: Domain name=LRR_1; Domain location=364-395; Score =0.7; E_value=2.1e+02; Accession=PF00560.23; Description=Leucine Rich Repeat
  Pfam annotation: Domain name=LRR_1; Domain location=475-494; Score =0.2; E_value=2.5e+02; Accession=PF00560.23; Description=Leucine Rich Repeat
  Pfam annotation: Domain name=LRR_1; Domain location=503-540; Score =2.1; E_value=1.1e+02; Accession=PF00560.23; Description=Leucine Rich Repeat
  Pfam annotation: Domain name=LRR_1; Domain location=553-575; Score =4.9; E_value=34; Accession=PF00560.23; Description=Leucine Rich Repeat
  Pfam annotation: Domain name=LRR_1; Domain location=577-598; Score =1.2; E_value=1.7e+02; Accession=PF00560.23; Description=Leucine Rich Repeat
  Pfam annotation: Domain name=LRR_1; Domain location=626-646; Score =2.1; E_value=1.2e+02; Accession=PF00560.23; Description=Leucine Rich Repeat
  Pfam annotation: Domain name=LRR_1; Domain location=648-668; Score =7.0; E_value=14; Accession=PF00560.23; Description=Leucine Rich Repeat
  Pfam annotation: Domain name=LRR_1; Domain location=670-692; Score =12.5; E_value=1.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =264-285::287-308::310-332::364-395::475-494::503-540::553-575::577 -598::626-646::648-668::670-692
MAGSPSASAKKAIVETSTKSCKKVIDEIHIKFGGVIDDLCTNIHGQIREAEAEAKANEIALAILEERLKKVVIPKEVPTKLMTSEVLEKLESVAKDAKNLNKMVVAMDQSKEVWDIVAYFSLFPQHGELDAERLIDLWMAEKFCNSPKGGRRCLSQLDGNSMFQDVKKDEFGQVRSFKLHLLMHEIAELVEKHHHSIRENITIPNENQVHSKVQRASIDLSDSRLDPKQLYHQAKQLRSIFFFKEGTPQVDIDKILEKIFKNLKLRVLDLRNLGIEVVPSSIGDLKELEYLDLSQNKMKKLPSSIAKLSKLHTLKLFSCFDLTRMPCEMSKLSSLKTLSTFVASKKETMGGLGELAKLNDLRGNLEILHLDRVRCSSSTNGERKLLLAKEHLQRLTLSWTPKGDKEGGHLSQLLESLKPHSNLGSLILVGFPGSSLPGWLNSLTKLVKLSLQDFQKPHGCKLKYLSEQDNQLPPKLKILELENLENLEYITEKCIDGENFYKSLEEMTIKNCRKLESWRGTETEAGPLFEKISKLHLHNCTLKLLRLNTTSIPLKDLHIQYCRDLENLSGVFQHLSSLQRLTIENCDMSSLDGESKAWEGLKSLSCLTLRDIKHLSSLSFGDGVTTLQQLTLEKCHLLPSISIGKLTSLQELTLRNCDKLTSICIDKVASLRSLKISGCNKLESLPKTSEALNSLKTLHILDCALLQP

SEQ ID NO: 133544 - protein, 73 aa, Glycine max
  Coding DNA Sequence Number=SeqID_16766
VDQSSPQQLADPPTPVHEMPADPSTPLLEILEDPATPVLGLTTTPSTTHVLHFTDKEGTQDQDTQQDDQSHEF

SEQ ID NO: 133545 - protein, 109 aa, Glycine max
  Coding DNA Sequence Number=SeqID_16767
  Gene Ontology: Mol. function=transporter activity; Cellular component= integral to membrane; Biological process=transport
  Homolog annotation: Hit_ID=P37621; Match level="QueryCoverage=55%, HitCoverage=14%, E-value=2e-10, Identity=52%"; Hit description =UPF0226 protein yhhS
GASAEPGQRAGHLHSVYGYVARHHRSDREFYHELRRCTAGLSADCAAGGICAALYPADDQASGWDASRGRGVQVKKRPPTEANTNKSVYAPALTLSLTDRPANLPAADY

SEQ ID NO: 133546 - protein, 131 aa, Glycine max
  Coding DNA Sequence Number=SeqID_16768
MVKFDPEVVLEFYANAWPTEEGVRDMRSWVRGQWIPFDVDDLSQFLGDPPVLEEGQECEFSQRRNRADGFEEEAIAQLLCTPGQDFTRTAVGRRVRIMRTSMTTLTQTWMTLLLSNALPSDHNSDLPLPKC

SEQ ID NO: 133547 - protein, 84 aa, Glycine max
  Coding DNA Sequence Number=SeqID_16769
  Subcellular localization annotation: CTP_CleavageSite=50; ConfidenceScore=5.08e-01
MECYVNFWFRERKKGKKSQRISRVLVRLSDGFSIKTSHSGRSSLKRPEARSSVSKQRTKVKIQVGSLKRAISCLSTIVIEAQYQ

SEQ ID NO: 133548 - protein, 88 aa, Glycine max
  Coding DNA Sequence Number=SeqID_16770
  Gene Ontology: Mol. function=3-deoxy-7-phosphoheptulonate synthase activity; Cellular component=cytosol; Biological process=aromatic amino acid family biosynthetic process
  Homolog annotation: Hit_ID=P0AB91; Match level="QueryCoverage=98%, HitCoverage=25%, E-value=6e-34, Identity=77%"; Hit description =Phospho-2-dehydro-3-deoxyheptonate aldolase, Phe-sensitive
MIDFSHANSSKQFQRQMVVAADVAQQIAGGEQAITGVMIESHLVEGNQSLDSGKPLVYGQSVTDACIGWDDTEKALRQLAQAIKTRRG

SEQ ID NO: 133549 - protein, 47 aa, Glycine max
  Coding DNA Sequence Number=SeqID_16771
MSARTPSSRASATPVAPSTSLSPPPRRAEGDDVGVLMANHKNNISIS

SEQ ID NO: 133550 - protein, 101 aa, Glycine max
  Coding DNA Sequence Number=SeqID_16772
  Homolog annotation: Hit_ID=O04076; Match level="QueryCoverage=44%, HitCoverage=13%, E-value=1e-11, Identity=68%"; Hit description=ACC -oxidase
MENFPVINLENINGEERKTILDQIQHACQNWGFFEISNLHHSSPMTGHFKPQPNLVRLGTSFYWSSMYFDTKAFVRNCTTCQQNQYLPHQKPGYFTKAFVF

SEQ ID NO: 133551 - protein, 223 aa, Glycine max
  Coding DNA Sequence Number=SeqID_16773
  Gene Ontology: Mol. function=nucleic acid binding; Cellular component= nucleus; Biological process=DNA replication
  Homolog annotation: Hit_ID=Q9FHJ6; Match level="QueryCoverage=68%, HitCoverage=18%, E-value=8e-49, Identity=60%"; Hit description =Replication protein A1-like
MQIVEPFIAHYIFALGVARFLSCAQWVLQVFSFDVVDFDGGEIWATCFNVVADQFYNVIEAGKNINHEKNGTEVQKRTLQLKDMSGRSVELTLWGNFCIVEGQRLQTICHVGEFLVLATKVVILNDFNGKSVGTITTSQLYVEADFPEACTLKRWFENEGKSVPTLSISREMSNLGKTDVWKTISQIKDEKLGTLEKPDWIFVFVVVSHIKVDNFCYPGCPLR

SEQ ID NO: 133552 - protein, 299 aa, Glycine max
  Coding DNA Sequence Number=SeqID_16774
  Gene Ontology: Mol. function=RNA-directed DNA polymerase activity; Cellular component=intracellular; Biological process=RNA-dependent DNA replication
MAPYRFIKEPGKPYSSTGGSSSQVISIIEEFPITTLTVYYTTRGSQDDTFDMDLGVTPSTKAKHQSKSSSTDMPGIYPSIICHKLVVFPQPKPVSQKKRKIGEELHKVVREKLDKLLKAQFIRDVRHSTWLANVVMVKKANGKWRKCTDYNNLNKVCPWDGYLLPSIDKLVDGVSGFQLLSFLDAYSGYKQIKMHPPDDEKTSFITKDAHFYYWVMPFGLKNVGATYQMLIDRVFKWNIGQNFELYMDDMVVNSHSIAQHVADLEEMLGEIRKYDMYLNPEKCTFGVGNKKILGFMITQ

SEQ ID NO: 133553 - protein, 131 aa, Glycine max
  Coding DNA Sequence Number=SeqID_16775
MDGGIGSILDLTLKEVKRIEGLKRKRRIHGDPLVEYWNDLKSALGKRHIPSYYEREIMDKLQRLRQGSMSVKQYRQQIERLILRVELSDVSSIRACRPRIFFINGFLCFVEDEWQRNGEGRERGDATFRRR

SEQ ID NO: 133554 - protein, 266 aa, Glycine max
  Coding DNA Sequence Number=SeqID_16776
MQSQGLALPPEPMVGPSSPCVSIKESFVDPSGNDPETGDSDKCGLYIEANPPRLVALGRVYEGSIVHNVPLLSGQVKVGVEEAKDAQAPVPVPTDEAAVSPAKPPQRSDLEVDDPLYLMTLTIRELFLKPFQVNWDATMFGVFNPDFLLYIKHDALSEIAHDGQCLSIYVIQLWILNLTETSMRARNSDVYGFLEPQSIQRSGQSQFELESYMKSWMQSSQRNVYLGAYLNGGHWQMVIILPKENVIVWFCSLHNRPDNYLKGIIN

SEQ ID NO: 133555 - protein, 131 aa, Glycine max
  Coding DNA Sequence Number=SeqID_16777
  Gene Ontology: Mol. function=ER retention sequence binding; Cellular component=integral to membrane; Biological process=protein retention in ER
  Homolog annotation: Hit_ID=Q1SSF8; Match level="QueryCoverage=51%, HitCoverage=15%, E-value=2e-12, Identity=55%"; Hit description=ER lumen protein retaining receptor
MVDKAKRYNWQALDLDAKILMQQLSLGTIRTLSSCDNKEKLRENRNSFKINTKCPENPIKWMMPGYWMNLQGQHNTRKYIHLRDKVGYLGLKLRHFHSKISQVIKPNKLAGMIEHTIKQCVSLLLFWKIVR

SEQ ID NO: 133556 - protein, 84 aa, Glycine max
  Coding DNA Sequence Number=SeqID_16778
  Gene Ontology: Mol. function=nucleic acid binding; Cellular component= nucleus; Biological process=DNA replication
  Homolog annotation: Hit_ID=O49671; Match level="QueryCoverage=98%, HitCoverage=11%, E-value=3e-27, Identity=62%"; Hit description =Replication A protein-like
  Pfam annotation: Domain name=Rep_fac-A_C; Domain location=29-81; Score=-49.3; E_value=0.0027; Accession=PF08646.1; Description =Replication factor-A C terminal domain
MSNLGKTDVWKTISQIKDEKLGTLEKPDWIFVFVVVSHIKVDNFCYPGCPLKIGDRQCNKKVTNNADGTWHCERCNQFIDACDF

SEQ ID NO: 133557 - protein, 427 aa, Glycine max
  Coding DNA Sequence Number=SeqID_16779
  Homolog annotation: Hit_ID=Q1ZY19; Match level="QueryCoverage=82%, HitCoverage=71%, E-value=2e-18, Identity=24%"; Hit description =Fgenesh protein 60
  Pfam annotation: Domain name=DUF247; Domain location=23-422; Score =154.8; E_value=2.2e-43; Accession=PF03140.6; Description=Plant protein of unknown function
MTQQPDFSWMVPIEVMLGALYHGQVQACSISSVTDELRSPNEAAFKPKEVSIGPLHRGTTRHVQLMEETKWHYMREFLDRRGTQEQNRRSERRLRECGTDILKLDKIIMACYGGNIRSEPQELAKIMIVDGCFLLELLIRLGDFICNNSSSYANDPILKNEEKMVSVLNDITLLENQIPFIVLKKLYRKVFPDGSDINNDNRVADIVCKAFGYTEVKAPVHILHLMHLSTVEQTQQEGKRVEQELLRCATRLQAAGVEIKAANTIARHKLVDWFNFEISFSDSVLRIPPLYVKDTTEVRWRNLIAWEQSRIWIRCKYTSYALFFQGLVCCKHDIELLEKNGVIVNKAGKSTDELLDLFRTIAKGAEYMDSSYSEIGARLNMYNRGKITTAFQGLPVVTWHKCRHVLQIIVYYWGNWYRILIRDHIPT

SEQ ID NO: 133558 - protein, 155 aa, Glycine max
  Coding DNA Sequence Number=SeqID_16780
  Subcellular localization annotation: CTP_CleavageSite=54; ConfidenceScore=5.26e-01
MKQPQSLSLLELGFGGGKACVSSPSPCRSSQLVRNHLFHQPCHWRIPPTTPMPLCATPQTPPIAVPTIPSSIAIATPPRRGGLTGVRIKGLRGNKVGAKVQGIRHQPHGGVVGIVGNEGLVRQGQGGAGGGGGGGNVINRVGGNGVGNNVSVVSS

SEQ ID NO: 133559 - protein, 109 aa, Glycine max
  Coding DNA Sequence Number=SeqID_16781
MLVCLTGCRRVLWFKANLSQIWGNVLGDFDCGKKSNSHRKLYKEAAKEEKVEVADDSLSEWHLLSEAYNSLTKSGNPRRERFRDVLAQRVASQPSEDVVSSRTQCAQSC

SEQ ID NO: 133560 - protein, 104 aa, Glycine max
  Coding DNA Sequence Number=SeqID_16782
MVLGSEDGVTSNEDFLLDDRELESDYYLSISDSLTFESLSPAINLAYIRKNCWNLDNPTITFPGTRKTRARGPSNASTSAPASTSTPAPAPAPSQITAPSNTSV

SEQ ID NO: 133561 - protein, 266 aa, Glycine max
  Coding DNA Sequence Number=SeqID_16783
  Gene Ontology: Mol. function=DNA binding; Cellular component =mitochondrion; Biological process=DNA integration
  Homolog annotation: Hit_ID=Q1T192; Match level="QueryCoverage=99%, HitCoverage=50%, E-value=1e-25, Identity=32%"; Hit description =Polynucleotidyl transferase, Ribonuclease H fold
MLLKYYHIVMSLIDNFKCFEMYYIPRESNTRVDLLSKLASTKKGVLPSIEDETQCLKRKVNYYVILNGELFKRGLTTPLLKCLNSQHEDNIMRELHEGIYGLHTGGRSLATKEMCYAPLLTTFIVSAPHAPFPCGEWTYWDHYQRPRELSTQTYKDFLTRLGIMYLVTSVEHPQTNRQAEAANGVIPRALRTRLNKSKGLGKKNSTVYSGRTTEPSIKRLLFQQQQNEENMRVELDTTEEVREMAMIKEEAAKLQAARRYNTKIKP

SEQ ID NO: 133562 - protein, 512 aa, Glycine max
  Coding DNA Sequence Number=SeqID_16784
  Homolog annotation: Hit_ID=Q4CN50; Match level="QueryCoverage=51%, HitCoverage=33%, E-value=5e-09, Identity=26%"; Hit description =Cellulosomal scaffoldin anchoring protein, putative
MKLAEDNKNLEDQVLALTIEAKGLGMRAINAEALVRSWDAKIARIWLALAATDKEKEEVISDKKMIQQKDFNDLMMIDDISEDTTLTPERQMTLTEALHVEGVRERNVNKSSSSTLVEEGTREGTVSEPSSSTLVEEDSQEGTVSESLSSTLAEEGTWEGIVSESSSSNLAEEGTREGNVIELSSSTLVKGGTREGLVSKSPSSTLAEGGTRDGTVSESSNSTLVEEGNRKGIVSESSVRTSPIEGGGRAPAKDTLSLKLVEISNPTCDCSIDEPDQPSKEFCSLLEGTFSWKDATWKKPISLENFEGKGIVLHKKTPTPEEAEKQMAMDALIAKELVEEEVKGATQSKGNKKGKGKKNKKNALHIEEQVALEEAIRNNLKDSTVVSNSQTRTPLNIRPNRLRFKPLRLFTRGFHPHPNDIIFAKRIMVCPRMPTLDPKKRKKPKPCAPTLPIWQAIKSQRFSFLIAKKLKQLFVERRKFFEDDAGRIGGEILPCRVYNFDGVIPCFLVDDP

SEQ ID NO: 133563 - protein, 152 aa, Glycine max
  Coding DNA Sequence Number=SeqID_16785
  Gene Ontology: Mol. function=nucleic acid binding
  Homolog annotation: Hit_ID=Q1RWL4; Match level="QueryCoverage=67%, HitCoverage=26%, E-value=3e-11, Identity=36%"; Hit description=Zinc finger, CCHC-type
  Pfam annotation: Domain name=zf-CCHC; Domain location=102-119; Score =14.3; E_value=0.0043; Accession=PF00098.13; Description=Zinc knuckle
MEKSERKTFNDKKAKKAYITWEDNNMNSSRDSKNEVVNFIEEIKDLKNSLAKFTIGKNNLDIILGKQRCVFDKTGLGYRPDKQQKLYKNFFASTQKNSSPFLICFYCGKKGHNASTCYFRKNSNNIKMIWVPKESFIKTDIQGPQKVWVPKS

SEQ ID NO: 133564 - protein, 398 aa, Glycine max
  Coding DNA Sequence Number=SeqID_16786
  Gene Ontology: Mol. function=transporter activity; Cellular component= outer membrane; Biological process=transport
  Homolog annotation: Hit_ID=Q5QVF8; Match level="QueryCoverage=99%, HitCoverage=54%, E-value=5e-76, Identity=41%"; Hit description=Outer membrane protein
  Pfam annotation: Domain name=Plug; Domain location=1-92; Score=31.1; E_value=3.8e-06; Accession=PF07715.5; Description=TonB-dependent Receptor Plug Domain
MNVQDISDLDAQVPNLTIYAARGASSTVTAYIRGIGQSDPTWGADPGVGIYLDDVYIARPQGALLDVFDVSRIEVLRGPQGTLYGKNTIGGAIKYISRGLPTQTEGFAQITVGNYSQLDAKAAIGGPIGGADSGLRARVAVASMNHDGFGENTFNGQPVSDKQINAARLNLGAYAGDDFDVQFALDWIDDQSGMRGSKMLAPNPFLRAYPPMDSRYDIRSGMRNLNNVESKGASATVNWRPNEDIALKYVIAKRESDSEANIDFDTAPVKLADVGGTYHDDQVSNEVQVNYDAGGRMRGVVGLYQFSGEAGGQIQNNYFSAQFADNQGKVLTDSIALYADWTFDLTSRLKLDVGARYTDEDKRAIVLNRLYADPGFSRPVAVTADFAKKTNFKNVSPK

SEQ ID NO: 133565 - protein, 179 aa, Glycine max
  Coding DNA Sequence Number=SeqID_16787
HLVKIDADRLNTFLETPVVLTEGETLPAYSRYYRLPTNYREIEAVLCILGRGFILNLKGHPGKILKKDLTRLAQVWSVLSYSNLAPTSHTSNLIVDRARLIFGLVSHLDMNIGALISGQMTSIAQSNTSRLGFPALINALCRARGVVFDSLTFEHLSPIINLAYIRKNCWNLEDLTVSI

SEQ ID NO: 133566 - protein, 81 aa, Glycine max
  Coding DNA Sequence Number=SeqID_16788
MDAGVRAVEVEGSSASLALALLAPQIETVRSSRCSKVRLSKTTPLALHNALIRAGNPSLEVLDWAIEVIWPEISAPMFISK

SEQ ID NO: 133567 - protein, 158 aa, Glycine max
  Coding DNA Sequence Number=SeqID_16789
MTKSKGKDPLEGLGGPMTRARARKAKEALQQVLSILFEYKPKFQGEKSKVVSESLLKSAVKLLYKLNHFINKHKLSFIQKIRVYLFYLNESDSPKFLSDSRTPWLYQKTFTTLCVALVGKSDSSFLSSSPLFFKPQFQKIHLCPELSRGHNFHFTHSN

SEQ ID NO: 133568 - protein, 74 aa, Glycine max
  Coding DNA Sequence Number=SeqID_16790
MKNKKACMLSENHPLSKALSPLSELGESGGESAKLLHAQHVISLLSESFVFSHAKRSQLAQWKITYSRLAQKWR

SEQ ID NO: 133569 - protein, 191 aa, Glycine max
  Coding DNA Sequence Number=SeqID_16791
VPLGVGVQQKATTARGGHRWSWVVEKKLGGVGKGLGEEKKEEVATSQGHAIRPTSGVLRTESFNKGVEAFYGHRKASICSSRSVVPSYHSRLSGFHLKDMSTSILRKGVGGLLIALGTSGHGQPLALSTIPCGVSPSPRCDFGVAIEINERSWDMFYRGPMVASNVLTKIRNLDTSGWTWLNGISNFTGQH

SEQ ID NO: 133570 - protein, 35 aa, Glycine max
  Coding DNA Sequence Number=SeqID_16792
MTCLGVGLVSGRAKSGSEEYLKLFKVSGTWWVVKN

SEQ ID NO: 133571 - protein, 252 aa, Glycine max
  Coding DNA Sequence Number=SeqID_16793
  Gene Ontology: Mol. function=amino acid transporter activity; Cellular component=integral to membrane; Biological process=auxin mediated signaling pathway
  Homolog annotation: Hit_ID=Q9SEL4; Match level="QueryCoverage=99%, HitCoverage=52%, E-value=1e-130, Identity=86%"; Hit description=AUX1- like protein
  Pfam annotation: Domain name=Aa_trans; Domain location=43-252; Score=- 72.9; E_value=7.3e-05; Accession=PF01490.8; Description=Transmembrane amino acid transporter protein
MLSQKQAEEAIVTNETEHEVSSTREEEKEQDQSMFSLKSILWHGGSVWDAWFSCASNQVAQVLLTLPYSFSQLGMLSGIIFQVFYGIVGSWTAYLISVLYIEYRTRKEKENVSFKNHVIQWFEVLDGLLGPYWKALGLAFNCTFLLFGSVIQLIACASNIYYINDKLDKRTWTYIFGACCATTVFIPSFHNYRIWSFLGLGMTTYTAWYLAIAAILHGQVENVTHTGPSKLVLYFTGATNILYTFGGHAVTV

SEQ ID NO: 133572 - protein, 70 aa, Glycine max
  Coding DNA Sequence Number=SeqID_16794
  Subcellular localization annotation: CTP_CleavageSite=51; ConfidenceScore=5.39e-01
MSLPNAVHVSPLSSAKLLVTGKHVILLFSRSVPSPKEKKKEWRRESSSQKRAGRTKSVSYLCFPLISDER

SEQ ID NO: 133573 - protein, 61 aa, Glycine max
  Coding DNA Sequence Number=SeqID_16795
MAFFQSYLDYKAQNAQVSNALRNGNVAHTPDIFSKIPMGVTTLPPFLKFRPQNLPDSNKDG

SEQ ID NO: 133574 - protein, 94 aa, Glycine max
  Coding DNA Sequence Number=SeqID_16796
MKGENFLQLGWMDIDYAIWKNEPPTIIDESSPAVVVLYEQWERSNQLSLMFIKTKISAKIHGSVDQHEKVRDLLKAIDDQFITSDKALASTLII

SEQ ID NO: 133575 - protein, 85 aa, Glycine max
  Coding DNA Sequence Number=SeqID_16797
MSTKKSKECLKNKADKSSRKMLWYQGKAQLSTDIMEAVQKMTSPRRPSLAVELHSTRLTQDTAVSVTMDMGSEMMTVTTPRKSES

SEQ ID NO: 133576 - protein, 127 aa, Glycine max
  Coding DNA Sequence Number=SeqID_16798
MTLTYSCLPLESSSTYRMTLITPWKRKGSDQAYILLRDDRSLHVLFDLTGSTYPLGRQTLDVFHRLDLLLRPHISTLGVPNRSFSHYIQNLPPNLANPSLLGSKVHIHELTVEINTQGLFSPFNNNM

SEQ ID NO: 133577 - protein, 263 aa, Glycine max
  Coding DNA Sequence Number=SeqID_16799
  Homolog annotation: Hit_ID=Q1SD80; Match level="QueryCoverage=17%, HitCoverage=13%, E-value=7e-09, Identity=66%"; Hit description =Cellular retinaldehyde-binding/triple function, N-terminal
ALHSLSYPIFDYENHESKAPQCHQIYLCAGGNCTNEDLNPRQRSEHCGGKDLWYKGEGHEDHKDDDDSDGGELPVAAAMEGRGIFLGDKGGGMDCGDGGGKGEVGREEGEDGAHAEERDSGVIGLMPNVTCLDAHGSDAHDGLKVEDMGSEGEGGDCEGPRMLFIAQKSIASCTKIGKSSKDEDLEDPHSSHGKEKLESGKPVTKIIGSIANKFSTLCSDASVLRYLRVRNYNTKKAAKMLKGSIKFLVRCSLELDPVTKATS

SEQ ID NO: 133578 - protein, 91 aa, Glycine max
  Coding DNA Sequence Number=SeqID_16800
MDFMKTKPSAKKGFQEGNTHTNPRPAKMLVLQNLDDQPSSKDNKDIQEINTLTREQDLVFEAINSIPDPQEKKTQRPYLTPGLIQIVFWKD

SEQ ID NO: 133579 - protein, 145 aa, Glycine max
  Coding DNA Sequence Number=SeqID_16801
ANAFPLTITLKKFISWGISRGKGILKEDFQASSKVLIISKVSGGHTLATSSIKTKVTMSNHKSTKSILKNLEVYMGQLAKQIADKSSNNFGANTENNPKEECKAMMTRSKRFVEVEDEENMVDKEQLSEKTGAEIMKNDVKGKEK

SEQ ID NO: 133580 - protein, 89 aa, Glycine max
  Coding DNA Sequence Number=SeqID_16802
MENSWKCTALPILEMHSPTDVIEVQKLNGRLTSLSRESNTSVDFLSKLASTKKIGHPKNIIQETLQSPMTNTKEVMKGEKGGTELDDPL

SEQ ID NO: 133581 - protein, 111 aa, Glycine max
  Coding DNA Sequence Number=SeqID_16803
MASYYVILDKELFKRGSTTPLLKCLNNQQAGYVTREIHGGIYKQAMSREKYMEESMVLIHGDALWKPRNGLPYAIVTNNDTQFKALAYEELLSRLGVKHLVTYVKHPQTNN

SEQ ID NO: 133582 - protein, 157 aa, Glycine max
  Coding DNA Sequence Number=SeqID_16804
  Gene Ontology: Mol. function=unspecific monooxygenase activity
  Homolog annotation: Hit_ID=O04892; Match level="QueryCoverage=70%, HitCoverage=26%, E-value=5e-30, Identity=59%"; Hit description =Cytochrome P450 like_TBP
GIGLKFLNRDVAADGNVRESGDPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 133583 - protein, 201 aa, Glycine max
  Coding DNA Sequence Number=SeqID_16805
MGDKLHRREGNSPDHQLRPLNDRSVIKEMNGAKRSAEAVGCKKESVGERSALEGRTRASSAGRSGSENVGLSNANVGENPMPRKPKGSSARFVHGGTEEARLAERWLSVQGRKVPLLFQGNKGAEVIHAILPGKARTTFNKWVPVPETDTGVPPHKGGRSDQARATVYQKHRSPQSREPTTEAPVNGGRNYNGPKVAKFLV

SEQ ID NO: 133584 - protein, 491 aa, Glycine max
  Coding DNA Sequence Number=SeqID_16806
  Gene Ontology: Mol. function=oxidoreductase activity; Cellular component=proton-transporting two-sector ATPase complex; Biological process=ATP synthesis coupled proton transport
  Homolog annotation: Hit_ID=Q1SCC5; Match level="QueryCoverage=52%, HitCoverage=68%, E-value=2e-91, Identity=63%"; Hit description=2OG -Fe(II) oxygenase
  Pfam annotation: Domain name=2OG-FeII_Oxy; Domain location=210-309; Score=99.4; E_value=1.1e-26; Accession=PF03171.10; Description=2OG -Fe(II) oxygenase superfamily
MAGSLFPQLSMAVQAFPPATMAACTSITDPVCYKFEKKPSLKIRGYSIRRVENQRQRCPRFAGVTKIPPMFHVNVDLTDTSPNNDFTIPIVDLRDKVRRVEVVDKVRGIRGFHEKNGEQRKRFYSRDNEKRVRYFSNGKLFRYMAANWRDNIVFVANSEPPNSAEMPPLCRDIVAEYTKKVRVLGITIFELLSEALGLKPSYFKEMDCAEALYILGQYYPQWPEPELTMGITKHTDCDFMTILLQDMIVGLQILHENQWINVPPVRGALVVTIGDILQLVTNDRFISVYPQVLSKNIGPRISVATFFMNYTISECTSKIYGPIKELLSEENPPVYRDITMKEILTNYYAKGLDGNSYSQPLSILLNFYKQHSLSSRGKRAIQEIFFRGCSFCTYPAWEAPVELATSCMCDKCQVLEESAILIGDLTIELQHAIPVSALTGVVLSSSSSRSAGLGLGAGKRHSHWRFLPPEGAGAIGASCFFVYKIRLAFKF

SEQ ID NO: 133585 - protein, 288 aa, Glycine max
  Coding DNA Sequence Number=SeqID_16807
  Gene Ontology: Mol. function=protein binding; Cellular component =integral to membrane; Biological process=xylan catabolic process
  Homolog annotation: Hit_ID=Q1SPZ8; Match level="QueryCoverage=89%, HitCoverage=31%, E-value=4e-80, Identity=56%"; Hit description =Leucine-rich repeat; Leucine-rich repeat, cysteine-containing type
  Pfam annotation: Domain name=LRR_1; Domain location=120-142; Score =10.5; E_value=3.1; Accession=PF00560.23; Description=Leucine Rich Repeat
  Pfam annotation: Domain name=LRR_1; Domain location=144-166; Score =14.1; E_value=0.51; Accession=PF00560.23; Description=Leucine Rich Repeat
  Pfam annotation: Domain name=LRR_1; Domain location=168-190; Score =15.5; E_value=0.19; Accession=PF00560.23; Description=Leucine Rich Repeat
  Pfam annotation: Domain name=LRR_1; Domain location=192-213; Score =5.2; E_value=31; Accession=PF00560.23; Description=Leucine Rich Repeat
  Pfam annotation: Domain name=LRR_1; Domain location=42-65; Score =15.9; E_value=0.15; Accession=PF00560.23; Description=Leucine Rich Repeat
  Pfam module annotation: Pfam domain module=LRR_1::LRR_1::LRR_1::LRR _1::LRR_1; Domain location=120-142::144-166::168-190::192-213::42-65
MIDLSNNNLSDQLPRALLKVVALSDNHLYGSIRCPTTCTFPKLHIIDLSHNQFSGSLPSKTIQNWKSMKVSRKSQLQYEYYMAYKLLGRFSWQDDQYSYSFTMCNKGMVMVYEKLQQFYNLIAIDLSSNKFCGEIPDVMGDLTGLVLLNLSNNMLGGSIPSSLGKLSNLQALDLSLNSLSGKIPQQLEELTFLSYFNVSFNNLSGPIPQNKQFATFEGSSFEGNQGLCGNQLLKKCEDDGGSPFAPPSASDNNDQDSGFLADFDWKVVLIGFGGGLLAGVALESYFSH

SEQ ID NO: 133586 - protein, 121 aa, Glycine max
  Coding DNA Sequence Number=SeqID_16808
  Gene Ontology: Mol. function=protein binding
  Homolog annotation: Hit_ID=Q1SPZ8; Match level="QueryCoverage=65%, HitCoverage=8%, E-value=1e-12, Identity=62%"; Hit description =Leucine-rich repeat; Leucine-rich repeat, cysteine-containing type
MEYVHLNCCEIGIIQIGIDPEKLHREIDNQFKDLRFPMDAGFGYAPNLDISSLEGGIFQMEIPHIVHNGKERVVAKIKIKALKVFEVKEAAISIQYTKDLTATKINGNDMTCVLITLNAIP

SEQ ID NO: 133587 - protein, 114 aa, Glycine max
  Coding DNA Sequence Number=SeqID_16809
MVNESTKMIDTSWVRGPEPPKKKKETQRTKGREKITSITEMVLLPLEARQQSQQILCDSVEGKDYKHNGNGMQACEWPSSVFLLAPPYCYLNSELLPAPLFHFPYQVQMSSVDF

SEQ ID NO: 133588 - protein, 1107 aa, Glycine max
  Coding DNA Sequence Number=SeqID_16810
  Gene Ontology: Mol. function=RNA-directed DNA polymerase activity; Cellular component=chromatin; Biological process=chromatin assembly or disassembly
  Pfam annotation: Domain name=RVP; Domain location=141-245; Score= -13.7; E_value=0.086; Accession=PF00077.10; Description=Retroviral aspartyl protease
  Pfam annotation: Domain name=RVP_2; Domain location=128-259; Score= -36.2; E_value=0.00067; Accession=PF08284.2; Description=Retroviral aspartyl protease
  Pfam annotation: Domain name=rve; Domain location=793-947; Score =65.3; E_value=2e-16; Accession=PF00665.16; Description=Integrase core domain
  Pfam annotation: Domain name=zf-H2C2; Domain location=734-775; Score =15.9; E_value=0.0027; Accession=PF09337.1; Description=His(2)-Cys(2) zinc finger
  Pfam module annotation: Pfam domain module=RVP::RVP_2::RVT_1::rve::zf- H2C2; Domain location=141-245::128-259::320-602::793-947::734-775
  Subcellular localization annotation: CTP_CleavageSite=81; ConfidenceScore=5.16e-01
MTLVQAAGLARLQEDKLLDTHSSFRHRAPPALTIPISRPTPTSALLPSPPPRSPTPRPQPTLKRLSPEEIISRRERGLCFNCDEKYHRGHRCASRVFFLVAEEDPAAVEVNIEELDPRPDPTETHDLLAAQISFNSLAGHLAPETLRLLWTISSHQVIILVDGGNTHNFVQEELVVRLGLTTQETRPLRVMVGNGQHLACNQWCEVVAVNIQGISFTIDMYVLPIAGANLVLGVQWLKSLGPVLTDYNSMLIKFFHEGQLVELHGDTELTLNLLSVPQFRRLLRKPHTRVYFHITVLEDAPQIAPFFTATGPRNRPPHPPPAASCASQLRKQDGSWHFCMDYRALNAITVRDRFPIPTIDELLDELGKAYWFSKLDLLQGYHQIRMHSDDIAKTAFCTHHGHYEFKVMPFGLCNAPSSFQVLAENQFVLKLTKCSFGQPQVEYLGHLVSSRGIEPVASKVSAIHHWPVPKSTRALRSFLGLAGFYKRFIRGYASIAAPLVRVTMVEPFQWTTEAQDTFVMLKKALSEAPVLALPDFQIPFTVETDASGVGMGAILSQRGHPIAYFNKPFPLKLHHASTYVRELFAVTTAVRKWRQYLLGHHFTIITDHRSLKELLTQVIQTPEQHMYLARLMGFDYQIQFRSGASNQAANALSRLPEHTTSLFLTLSVPCLTFKDELRAQLTESSEFQDMVKAIQTSPSAYTDYMIVNDLVLRKGRIWLPPKLALIPTLLTEFHATPTGGHLGTTKNVARIMENFHWNGLRKDIVDFVAQCIDCQCAKYETKRVAGLLCPLPVPHRPWEDLSLDFIVGLPPYHGYTVILVIVDRFSKGIHLGMLPTSHTAHSVACLFMDIAGKIHGMPRSLVPDRDPLFVSHFWQELFRLSGTQLRMSSAYHPQSDGQTKVLNRVIEQYLRSFMHRRPSSWVNFSSGLNGHTIRRGMRPLGPRHMRSPSVGNLSTFRNTLPARPKWMRWKKCWSIKLLKAKALMKHYADTKRRDVEFHPGDWVMLKLRPHRQSSAKHLQATSGKLSKRYYGPFQLPEGARIHPVFHSSALKPFKGSPEKTEPVALPSRFDQNQPIIAPLTILDYRQRTDKQWEDLVQWEGLSPDETT

SEQ ID NO: 133589 - protein, 217 aa, Glycine max
  Coding DNA Sequence Number=SeqID_16811
  Gene Ontology: Mol. function=nucleic acid binding; Biological process= DNA integration
MEAQPSKTKIKKTIEGIKDIKQMQDSALGKVLEVSAYGRIEPTREEELGVEDKDECCSRCDQKIVWYKRLGHISEKDVCSMSEKSLSGAQYFVTFIDDRSIKETRRKLKCLRSDNGGEYRGSFEAYYETHGIRHEKDEYNNCRESHMYAFTFKTPQDILGVFGCKAFVYISKDERSNLAKAKECTYLGSPRDELGFRLCDPNNKKIIQSRDMVFFED

SEQ ID NO: 133590 - protein, 94 aa, Glycine max
  Coding DNA Sequence Number=SeqID_16812
MSKSWISIESLIIKVTLKSYNNVSLYIEDNNSLTGPYIPIDGQGRSVKWIRNLEKRIGSEGWARGPSPEPVGCRWTTRAASVASRSSRASRGTD

SEQ ID NO: 133591 - protein, 78 aa, Glycine max
  Coding DNA Sequence Number=SeqID_16813
MGCYNATINDEALVKSPDGEISRLRSALTIAKKEKEEATTEDILEDAAPNPVRAMTPVEDFHADNVGAEDEDNVGPMD

SEQ ID NO: 133592 - protein, 143 aa, Glycine max
  Coding DNA Sequence Number=SeqID_16814
MATWATDSRLQNQLIQCNIIYNFVGWRRATKCMQMEELAEYRNRVLMDAVSAKKDNDKPNSNKSCNDGMRERPPREQRYAHYTLFTTSRSHIMDQSFYRQKEPTHRQKLTTQNIDSITAIAITRRRNDWPSKGVRPQATVIQA

SEQ ID NO: 133593 - protein, 102 aa, Glycine max
  Coding DNA Sequence Number=SeqID_16815
  Gene Ontology: Mol. function=DNA binding; Biological process=DNA integration
MEHPQTNGQAKTTNKIIPGELRKQLDEARERWVEELAEVLWVYICTPHSTTQETPFWLTYRTDVMLLVEFEQGDLVWRACGEARKVLTDGNLATIWEGAFRV

SEQ ID NO: 133594 - protein, 84 aa, Glycine max
  Coding DNA Sequence Number=SeqID_16816
  Subcellular localization annotation: CTP_CleavageSite=47; ConfidenceScore=5.62e-01
PVSPMEKARSYVAVSPMQKARPSRLSYVVVSPMQKARPSRLSYMACVASAEGETFLSLVSPMEKARPSPTWPVSGPVTPMPVTG

SEQ ID NO: 133595 - protein, 584 aa, Glycine max
  Coding DNA Sequence Number=SeqID_16817
  Homolog annotation: Hit_ID=Q1S1P8; Match level="QueryCoverage=90%, HitCoverage=85%, E-value=3e-59, Identity=48%"; Hit description =Cyclin-like F-box
  Pfam annotation: Domain name=F-box; Domain location=9-57; Score=22.4; E_value=0.0016; Accession=PF00646.23; Description=F-box domain
MSEVKNKVDFIQLLGPDMSIKILTHLDDPCDLIRVSAVSSSWHRFVIEQGLCKQLCLKMFPEISGVAHIVELDNIIEPLINTLGSYVNWESLKRIHRVYAFLASGLTPMRKNCISKSISASSTDNYPEESILHTLEPGDRTQYRASYWSSKGESHPSVPETLVYKLASKLCLVTEIYVHPFQAYFQHGFPIYSAKAVRFRMGHPRHPMELESAVDKMATNDVLGDNQFIWTYTSPEFPMFQMASTSDVVDCLDEEAFQNVVGANVWTHGGASNIMKALNPAFDSKEELLVPSWDLSPMLWGTLQLSSRWSIYARNRKKSVQKGSRATMCSTTKPSGHRAYTQQSGELGSCHIMNLAEGKRGRLLFVKNGNPRRKDSGKDMATIRSWFPNFTIVDKVEGTVLIEPDELSETAVKGETLETQKQDSLPFLLRFNNPSQFCSLSLSLAFSVLSIENRLQKFKLPEPVLCIGGVLLVELLGRVQKQEMDELFYICISHVQAMGRSISPEFDVKIHHPSGKCTLKYCPQIDCYVSSSTSSQRSDSSNPSRLRTITSNIMQRGVRRWEQFLLSALLGTATDPVVVDNDDQ

SEQ ID NO: 133596 - protein, 261 aa, Glycine max
  Coding DNA Sequence Number=SeqID_16818
  Gene Ontology: Cellular component=nucleus; Biological process =regulation of transcription, DNA-dependent
  Homolog annotation: Hit_ID=Q6H974; Match level="QueryCoverage=85%, HitCoverage=26%, E-value=1e-108, Identity=86%"; Hit description=SEU1 protein
MQLRQQLQQQVMQPSSAGKRPYDSGVSGVCARRLMQYLYHQRQRPNDNSIAYWIKFVAEYYSPRAKKRWCLSLYSNVGHHALGVFPQAAMDAWQCDICGSKSGRGFEATYEVLPRLNEIKFGSGVIDELLFLDLPRETRFPSGAMMLEYAKAVQESVYESLRVVREGQLRIIFTQDLKILSWEFCARRHEELLPRRLVAPQVNQLIQVAQKCQSTIAESGADWVSQQDLQTNSNMEVAKAVSDKTNFDKEVIQDYERLRSS

SEQ ID NO: 133597 - protein, 193 aa, Glycine max
  Coding DNA Sequence Number=SeqID_16819
  Subcellular localization annotation: CTP_CleavageSite=34; ConfidenceScore=5.12e-01
MAFLGETSSKTVVNSTLGFIFPNGSIVHNDSGVSFQASTSIPIRVPNGCDFQTLKTRIHNTLKLTDKQLLDEIYYRQRFTYAGKNPKNFDIPTGCTMDELKDLIKQVAPRGIPPYGVDETQMVIRTLIRKTLTDQLDPEVTDQVDPGSLLRIKVIRKKKNKQGQFCHFVSMLGAPSNTPKIFGMDSFIKGLWF

SEQ ID NO: 133598 - protein, 175 aa, Glycine max
  Coding DNA Sequence Number=SeqID_16820
MPSKDYFDDAKESRVKQIPKIQESNFKKQDSRFKNHVSRIKIKIQESREDSIKISTKKSFSITLSSTRSFHKIITKEFYCLVIDYQKRVHLLGDCYTENKRCYISCGSVQVEGTSTWLFKENKGGYIPCGSLLEKDFTRLLEISRTGGCLGTGCRHGLWPNQYKSCVCLPLPYTL

SEQ ID NO: 133599 - protein, 134 aa, Glycine max
  Coding DNA Sequence Number=SeqID_16821
CLRKIRWFHKWGLKSKDELRENYIGRWLKEAGKEIYIAPYLNQAHWQLVVLCPGDNVVVWLCSLKKKPDAAIKGAVNSAMKSVTKTAEGKPPQHGPQWIEAKSHVQTGNYECGCYVMQWIWCIVSGGLKDDWIH

SEQ ID NO: 133600 - protein, 99 aa, Glycine max
  Coding DNA Sequence Number=SeqID_16822
REDESSDTSTPEPLIRWKRIVETQEVAATSEKSLEATSEPSERVVDTTSIQQAVDPSTLEDQNTPVLSPNTSPLATPVLHLTDEEDVQTLDTQDRSQDF

SEQ ID NO: 133601 - protein, 155 aa, Glycine max
  Coding DNA Sequence Number=SeqID_16823
  Gene Ontology: Cellular component=nucleus; Biological process =regulation of transcription, DNA-dependent
  Homolog annotation: Hit_ID=Q6H974; Match level="QueryCoverage=96%, HitCoverage=19%, E-value=5e-71, Identity=80%"; Hit description=SEU1 protein
MQPSSAGKRPYDSGVSGDNSIAYWRKFVAEYYSPRAKKRWCLSLYSNVGHHALGVFPQAAMDAWQCDICGSKSGRGFEATYEVLPRLNEIKLGSGVIDELLFLDLPRETRFPSGAMMLEYAKAVQESVYEPLRVVREGQLRIIFTQDLKVTKLLL

SEQ ID NO: 133602 - protein, 126 aa, Glycine max
  Coding DNA Sequence Number=SeqID_16824
  Subcellular localization annotation: CTP_CleavageSite=47; ConfidenceScore=5.34e-01
MAFSRCSTLTTIITPLEQVKDLSVASFLPPFSKSFASHFRAALSLVRGGSSVERSGEGEGSGVELCGGRWRQTRYADGGLFVADMDKDEWMYKIMSERGDMDYENAESCGANEPRVDCSDAFKTSQ

SEQ ID NO: 133603 - protein, 58 aa, Glycine max
  Coding DNA Sequence Number=SeqID_16825
MEMAVVWLSFLVQKQNLGGVRECMALQIKTNWIPLAVIFASVDPAVIAVSKSAPALII

SEQ ID NO: 133604 - protein, 61 aa, Glycine max
  Coding DNA Sequence Number=SeqID_16826
MGWLCRDGFRVGKLIKSPIVRNNYVEEDGKDKQFLGGNGGWRKGRRVKTWKGRVRNDEGED

SEQ ID NO: 133605 - protein, 70 aa, Glycine max
  Coding DNA Sequence Number=SeqID_16827
MAMGSFSQARGALGKIARFQTTISCMGTNNSTGWEWNLTWRRDLFESELLLADTFIGDLAQQQVQPHRED

SEQ ID NO: 133606 - protein, 88 aa, Glycine max
  Coding DNA Sequence Number=SeqID_16828
  Homolog annotation: Hit_ID=Q9FJ81; Match level="QueryCoverage=70%, HitCoverage=22%, E-value=2e-18, Identity=73%"; Hit description =Arabidopsis thaliana genomic DNA, chromosome 5, P1 clone:MSG15
ILGLDESYLPRWIGYGFGSLLLLNHFLGSDSATVTPAQLSTEVLGLSLASFSIVLPYLGKFLKTNAANVCSCNCGCRGVKNLDFVAAI

SEQ ID NO: 133607 - protein, 155 aa, Glycine max
  Coding DNA Sequence Number=SeqID_16829
  Gene Ontology: Mol. function=catalytic activity; Biological process =trehalose biosynthetic process
  Homolog annotation: Hit_ID=O65664; Match level="QueryCoverage=96%, HitCoverage=62%, E-value=1e-57, Identity=66%"; Hit description =Puative protein
  Pfam annotation: Domain name=Trehalose_PPase; Domain location=2-155; Score=77.5; E_value=4.2e-20; Accession=PF02358.7; Description =Trehalose-phosphatase
MRELARCFPTAIVTGRCKDKLYYVGSHGMDIKGPTTTSKYNKDSKAEPILCQPASDFLPLIDEVYQQLVEKTKSTPGALVENNKLCLSVHFRCVDEKKWSELARQVKSVLKEYPKLRLTQGRKVLEIRPTIKWDKGKALEFLLESLDNAHECGSA

SEQ ID NO: 133608 - protein, 352 aa, Glycine max
  Coding DNA Sequence Number=SeqID_16830
  Gene Ontology: Mol. function=oxidoreductase activity; Cellular component=proton-transporting two-sector ATPase complex; Biological process=ATP synthesis coupled proton transport
  Homolog annotation: Hit_ID=Q9XH70; Match level="QueryCoverage=57%, HitCoverage=63%, E-value=1e-55, Identity=51%"; Hit description =Hypothetical protein p69RF
  Pfam annotation: Domain name=2OG-FeII_Oxy; Domain location=257-348; Score=74.7; E_value=2.8e-19; Accession=PF03171.10; Description=2OG -Fe(II) oxygenase superfamily
TPDAILNLLQSTITPTHDAIMYYNGKWNIPRQGEFLGYSFAGTNLIIRFGIPPGCGMKKLKDLIKQVAPIGVSPNGIHGSQLVRRLFFRQSGHSKYSENLIEYEITELKNDEDVLKDLAAGDPVSAEPADAQFTILAIDLNGLAVDRYGIVAGVRRAAETVGFFQAVNHEIPVKVLEEAMAAVREFHELPQELKGEYYNRELMKKVKFGSNFDLYQSKDVAMEYCRQVQVLGRVLFGLLSEALGLNPAHLQRMDCAKGHSILFHYYPTCPEPELTMGTTRHSDPDFLTILLQDHIGGLQVLSHNGWVDVPPVPRALVVNIGDLLQIPSFSATNGTVNFTFSQYAFVRNPNRE

SEQ ID NO: 133609 - protein, 424 aa, Glycine max
  Coding DNA Sequence Number=SeqID_16831
  Pfam annotation: Domain name=Transposase_23; Domain location=276-342; Score=-17.3; E_value=0.09; Accession=PF03017.5; Description=TNP1ENSPM transposase
  Subcellular localization annotation: CTP_CleavageSite=39; ConfidenceScore=5.49e-01
MATPPSSPPSPTVAESQSPSTLKRTRKATQLRSLATRLVGAERPMVHVDPGTGKANNPHRKKLRTYLGIVARDKAKFDIPEASGLRTKKKILQTVGEQWRQFKYDLTSKCALAVDKESVTNTICEKMCEKMHRSPRSKTLPLTCCLMGEVAQSESTDTVNDPPSPIRRHVKWKIARTKKTRQMTSEPTKEIADKIDSLEDQASQEHPSRVHATGAGVTIKQYFGPALRTSPTSSSMAPEDLEQLMQQIKDQLEESIPEKGLALPPEPKVGPSTAHVSTNESCVDPLGNDPDTERVFEGSTTVRNIPLLHDQVKVGVEEVRDVDAPIHVPTAEVKLVGHALNTFLAWLTHLFKRLSEQVLCDATVFRLFNEDFPLYIKHEDLFEIPHDGQCLNIFVIQLRILPDNYLKGIINSIPIMLDHWNQRD

SEQ ID NO: 133610 - protein, 263 aa, Glycine max
  Coding DNA Sequence Number=SeqID_16832
  Homolog annotation: Hit_ID=UPI00005F9AAA; Match level="QueryCoverage =26%, HitCoverage=17%, E-value=3e-16, Identity=54%"; Hit description =COG0840: Methyl-accepting chemotaxis protein
  Pfam annotation: Domain name=Collar; Domain location=169-246; Score =29.6; E_value=1.1e-05; Accession=PF07484.2; Description=Phage Tail Collar Domain
LNKDNSVAINQILPFGTVPGANVLDPADYQALAARLGGFSAGTAKSKELNTVWRQASFVAAMIGQYIVDKAGQDVLDDGDLAALQAKFVAALAASPALTGTPTAPTPAAGDKSTRIATTAFVAGNFPRIYSINALPTQDVGPIIVMERSEIWGWFANQYFSGYRSPMCGMSASWPMATPPTGWLVEDGAAISVAAYGALAAAIYCGDANNSTAEWGYRCASASSPASSRSTTGGYIVLRDRRGLFERGLDGGRGVDAGRSLWT

SEQ ID NO: 133611 - protein, 86 aa, Glycine max
  Coding DNA Sequence Number=SeqID_16833
MSLEDKPKEEKVQVADDSLSEADPLSEWHLLNEAYSSLSGAQPARPTRSLSLLALSTPNHAKPKFTYSRLASSLSEPSEVERSKSL

SEQ ID NO: 133612 - protein, 67 aa, Glycine max
  Coding DNA Sequence Number=SeqID_16834
MSSGCLLVDPNGHNLGRIDGDPVLRETRIWATWEYVSSDGGGQQGMVGLCAHCGCGKLVVHHRPTAT

SEQ ID NO: 133613 - protein, 83 aa, Glycine max
  Coding DNA Sequence Number=SeqID_16835
GHLIQQVVSEQISCRKFNNFKIHSLFRFFVFQKGYKVSFDFEKCVIKHEHDCRNLPFGGKATRDSRDAFSTKGIRAESPPTFI

SEQ ID NO: 133614 - protein, 235 aa, Glycine max
  Coding DNA Sequence Number=SeqID_16836
  Gene Ontology: Mol. function=transferase activity; Biological process= biosynthetic process
  Homolog annotation: Hit_ID=Q48454; Match level="QueryCoverage=55%, HitCoverage=34%, E-value=2e-31, Identity=53%"; Hit description =Hypothetical 42.6 kDa protein in cps region
NVSKRDVVVKHSYQNFKAKLASLPDGKNRVFIIGTPLYEAGVTSVDDIDLTLRMINDLKSNQMGAELVYIPHRREREEKIDEIRKSVEVRRLDFPFEVYPIVAGENIALINTLYAPYKIGGAEVSVQLLAESLQRAGHEVGVFCLHEFDEIKYDTLNGVHIAYLPLKNMYWPFQASSASKLKKAVWHLLDSYNPFMARAMRKELRKFSPDVVHTNNLSGFSVAAWRVAKKLGARV

SEQ ID NO: 133615 - protein, 314 aa, Glycine max
  Coding DNA Sequence Number=SeqID_16837
  Homolog annotation: Hit_ID=UPI0000382A12; Match level="QueryCoverage =36%, HitCoverage=62%, E-value=2e-13, Identity=44%"; Hit description =COG3871: Uncharacterized stress protein (general stress protein 26)
  Pfam annotation: Domain name=Pyridox_oxidase; Domain location=29-121; Score=8.6; E_value=0.021; Accession=PF01243.10; Description =Pyridoxamine 5'-phosphate oxidase
DIDLPRFGHHSAQTLGFHLMKDDTMTQLTLPELAKKMADIDFTMLQTRAGGEIAGRPMSNNGDVDYDGDSWFFTTEDTDMVHEIEADPAVALGFSGSRSLLGKPPLFVHVQGRAALVRDRAVMREHWVKDLERWFEQGVDTPGLRGIPMRPAFFWLALALLPTLAVAQPARTPKAKAPAQDPFSELFDTACMQHIGAPARLQSLMESNGLSPLQPAEAATLLQGQSGMAWMVPLASGRYAVSWADDGTCTVYAEKADAAVVQKGFARAWATVGRSGGHPVRLGHAGAGQAAGALPPGHAAAADAGVQAMASATP

SEQ ID NO: 133616 - protein, 98 aa, Glycine max
  Coding DNA Sequence Number=SeqID_16838
  Gene Ontology: Mol. function=protein binding; Cellular component =integral to membrane; Biological process=protein amino acid phosphorylation
  Homolog annotation: Hit_ID=Q1T2W0; Match level="QueryCoverage=86%, HitCoverage=8%, E-value=9e-23, Identity=60%"; Hit description =Leucine-rich repeat; Leucine-rich repeat, cysteine-containing type
  Pfam annotation: Domain name=LRR_1; Domain location=29-51; Score=8.6; E_value=7; Accession=PF00560.23; Description=Leucine Rich Repeat
  Pfam annotation: Domain name=LRR_1; Domain location=5-27; Score=13.7; E_value=0.65; Accession=PF00560.23; Description=Leucine Rich Repeat
  Pfam annotation: Domain name=LRR_1; Domain location=53-72; Score =10.4; E_value=3.3; Accession=PF00560.23; Description=Leucine Rich Repeat
  Pfam module annotation: Pfam domain module=LRR_1::LRR_1::LRR_1; Domain location=29-51::5-27::53-72
MMNGTLEVLNLKNNNLSGPIPDTVPVSCGLWTLNLNGNQLDGPIPKSLAYCSKLEVLNLGSNQITDGFPCFLKEISTFRVLVFEEQQISRFPKMFESQ

SEQ ID NO: 133617 - protein, 425 aa, Glycine max
  Coding DNA Sequence Number=SeqID_16839
  Gene Ontology: Mol. function=mannose-1-phosphate guanylyltransferase (GDP) activity; Biological process=lipopolysaccharide biosynthetic process
  Homolog annotation: Hit_ID=P24174; Match level="QueryCoverage=98%, HitCoverage=91%, E-value=1e-148, Identity=62%"; Hit description =Mannose-1-phosphate guanylyltransferase [GDP]
  Pfam annotation: Domain name=Cupin_2; Domain location=335-405; Score =47.6; E_value=4.2e-11; Accession=PF07883.2; Description=Cupin domain
  Pfam annotation: Domain name=MannoseP_isomer; Domain location=254 -420; Score=425.1; E_value=9.4e-125; Accession=PF01050.9; Description= Mannose-6-phosphate isomerase
  Pfam annotation: Domain name=NTP_transferase; Domain location=3-243; Score=295.1; E_value=1.3e-85; Accession=PF00483.13; Description =Nucleotidyl transferase
  Pfam module annotation: Pfam domain module=Cupin_2::MannoseP _isomer::NTP_transferase; Domain location=335-405::254-420::3-243
MNFPCCKRQSCGLKEHRFIVAEQLRQITRLSHNIILEPVGRNTAPAIALAALQAVSSGDDPLMLVLAADHVIQDEAIFRDAVNQAIPYAEAGKLATFGIVPTGPETGYGYIQKGASVDGSSICGVSRFVEKPNLETAQQYLASGDYLWNSGMFLFKASRYLEELGRFRPDILDACKQSLAHLTPDMDFIRVDRDAFIACPDESVDYAVMEQTADAVVVPLDAGWNDVGSWSALWEISEKDTKGNSTFGDVLEHNCSNNYIRAEHKLVAAVGVTNLVVVETKDAVLIADKDNVQDVKEIVNQLKRQKRSESKQHREVYRPWGKHDAIAQGDRFQVRRITVKPGEKLSLQMHHHRSEHWVVVSGTAKVHTNGKMQLISENESVYIPLGVEHSLENPGKIPLDLIEIQSGAYLGEDDIVRIGDSAQHN

SEQ ID NO: 133618 - protein, 141 aa, Glycine max
  Coding DNA Sequence Number=SeqID_16840
MVMGDPISRLSFPACLHFSGENTETFSSLTSYPELRRSEFLIGGYVGARASLLSTTPPFVAMTQELVARGDTLRLSAPRHSVTPSVIHEQRPIWSFAPFPEMSAFSDGDFPSLTSYPELRRSEFLIGGYVGARALLLSAAP

SEQ ID NO: 133619 - protein, 434 aa, Glycine max
  Coding DNA Sequence Number=SeqID_16841
  Gene Ontology: Mol. function=binding; Cellular component=outer membrane; Biological process=protein secretion
  Homolog annotation: Hit_ID=Q1H1N3; Match level="QueryCoverage=70%, HitCoverage=47%, E-value=2e-68, Identity=45%"; Hit description=Type II and III secretion system protein
  Pfam annotation: Domain name=STN; Domain location=306-357; Score =22.4; E_value=0.0016; Accession=PF07660.4; Description=Secretin and TonB N terminus short do
  Pfam annotation: Domain name=Secretin_N; Domain location=368-428; Score=29.2; E_value=1.4e-05; Accession=PF03958.7; Description =Bacterial type IIIII secretion system short domain
  Pfam annotation: Domain name=TPR_2; Domain location=122-155; Score =11.0; E_value=1.7; Accession=PF07719.7; Description=Tetratricopeptide repeat
  Pfam annotation: Domain name=TPR_2; Domain location=170-203; Score =11.0; E_value=1.7; Accession=PF07719.7; Description=Tetratricopeptide repeat
  Pfam module annotation: Pfam domain module=STN::Secretin_N::TPR _2::TPR_2; Domain location=306-357::368-428::122-155::170-203
MPALKATDTTAVTAETPAAEQDVGVDLFAVLEMPAMATAESEVPAAVNPYTYAGRLQEAGRWTVFLTDGQQQYVVHEGDHFAEGWRVAKVNHKNWVWACALPWLVSCSSFNPTGLGPENPAGDATLEQARIYAARGQDEEAIRLLQPLVEANPRQPQYKNWLSLLQEKKLQKQLQQADSLLAGQQFDAASAMYLQVLQEAPNNRAASDGVQKVQSARQHAAQIEQVKIAIAAEDWAGAEFGLRSILAEQPAHVEARQLFEQLEQKKNEKSSVVRPLQSSLRKKVTLELKNTPVKQAFEYIGKAGNLNFSFDQELNEGIRVNVLLRETPIEQALEVILTSHQLGKKVLNSNTLLIYPQARAAQYEELFVRSFYLTHMDAKRALNMMKTVLRASDVYIDEKLNTLVIRDTLDRIKVAEKLIASQDLNEPEVMLEVE

SEQ ID NO: 133620 - protein, 135 aa, Glycine max
  Coding DNA Sequence Number=SeqID_16842
MGKVEEVQEQMKADMEAMKEQMATMMEAMMSMKKIMEANAVAVAVTRAVAKVNSMPPSDLNQMNHPTLAMVGKDLGSTGGPYYVQIQNKHAFPPYGLAPNYTPPNVAYTPSENINNSTPILIESRQPQTDHAHVS

SEQ ID NO: 133621 - protein, 183 aa, Glycine max
  Coding DNA Sequence Number=SeqID_16843
MTITLHDVALILGLSIAGLELPSSHATVVPISVTTVEHHALDSILSEALRIKSTTNKSARSILESIFAIVDDSILKLNGILRGSALLDLGLFNFRRLAQRACLTECKLVNFHLASMGALSVRKDNILAGWAGCTLGVQISGLSSFRVSHPLSKLDASLSRCISLSGSASLSEASTALTFSSLA

SEQ ID NO: 133622 - protein, 115 aa, Glycine max
  Coding DNA Sequence Number=SeqID_16844
MLLPRGYFPQVNISHIDQEGRGSNSSGGCAALHQNEGPKKTLHGQSIAQMERNFTCHMDQHRPHQCHISLLNVFIQPCKSFSFNLMAGILDVYTPTVMDSPPPRHSEVDRSIGIS

SEQ ID NO: 133623 - protein, 136 aa, Glycine max
  Coding DNA Sequence Number=SeqID_16845
  Gene Ontology: Mol. function=cytokinin dehydrogenase activity; Cellular component=vacuole; Biological process=electron transport
  Homolog annotation: Hit_ID=Q1SII4; Match level="QueryCoverage=100%, HitCoverage=24%, E-value=3e-59, Identity=81%"; Hit description=FAD linked oxidase, N-terminal
MRYPSFSLLREHNILFIRGFMILFLSCITIQLNFCISSTPSSLKALPLEGHFSFEEADLKHAASDFGNRYQSHPMAVLHPKSVSDIANTIKHIWNLGPSSQLSVAARGHGHSLQGQAQAHGGVVINMESLSVPEMQ

SEQ ID NO: 133624 - protein, 75 aa, Glycine max
  Coding DNA Sequence Number=SeqID_16846
MAQIISNYEGNRYKDTHQEKKAFGAREASPGELELSQVSQLLRLKGKLAQVSWLLKDEGIPWPKRARCWPERTQA

SEQ ID NO: 133625 - protein, 158 aa, Glycine max
  Coding DNA Sequence Number=SeqID_16847
  Homolog annotation: Hit_ID=Q2HRX8; Match level="QueryCoverage=82%, HitCoverage=18%, E-value=9e-16, Identity=36%"; Hit description=IMP dehydrogenase/GMP reductase
  Pfam annotation: Domain name=DUF1723; Domain location=90-139; Score =48.8; E_value=1.8e-11; Accession=PF08330.1; Description=Protein of unknown function (DUF1723)
MDDVAEEVFQHVEEVGVDAQGFPGGSHDTSMLVAYVDHVAVIIWNGEERPELKLSSHGRKVQKFGRPTIEIEGLVAITGISLLIACSLDTGDRRLISTFVERWHKETSSFHLPIGELTITLDDMASLLQLPIICAFHSFNTFHGDKAVLMLVDFLEFT

SEQ ID NO: 133626 - protein, 126 aa, Glycine max
  Coding DNA Sequence Number=SeqID_16848
MRWYRMVIRIFCQPGANEPVDVQRLTSSLTSFVNQGQTSPLTHKDLRRLLHLLSSRGDEPDDMRGYRMVIRTFCHPETASPMTCGGANKPVNAQGLTSSSTPFINLGGSEPVDVQRLTPSSAPLVI

SEQ ID NO: 133627 - protein, 49 aa, Glycine max
  Coding DNA Sequence Number=SeqID_16849
MGVEAQNKYKSKRKRKEKKNNRYTNKEITFQRMSSKIRNSYSTDLRNAN

SEQ ID NO: 133628 - protein, 97 aa, Glycine max
  Coding DNA Sequence Number=SeqID_16850
MARGLLDRPNPLLFKTAEMTNKQKGTSRQTWEMEKDWWFWWKSRIPNKILWAVKAESYETKEDRNHTKNCFKNTTLCRGGWRKTAAVFSHHHPQPHK

SEQ ID NO: 133629 - protein, 182 aa, Glycine max
  Coding DNA Sequence Number=SeqID_16851
MSVDHGVPHRMPKVMRIVENHVNGINKHMPETHIFHLPWGQCTIIVGRVVAGPSSLHWDELCDELLGEVPPESAHKGATLKLTWLLSILRTPLPEEPTTHQLQCSCRAYIIHGLGTSCLLLHQESHDPKQLIHWLKGTSVEQTHFEIPHPQSMYCTPSLVHQTFGQTGESVSKCHASNIKVT

SEQ ID NO: 133630 - protein, 712 aa, Glycine max
  Coding DNA Sequence Number=SeqID_16852
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=63%, E-value=1e-177, Identity=49%"; Hit description =Multidrug resistance-associated protein 3
  Pfam annotation: Domain name=ABC_tran; Domain location=124-295; Score= 151.2; E_value=2.8e-42; Accession=PF00005.17; Description=ABC transporter
  Pfam annotation: Domain name=ABC_tran; Domain location=497-680; Score= 159.6; E_value=7.8e-45; Accession=PF00005.17; Description=ABC transporter
  Pfam annotation: Domain name=Dynamin_N; Domain location=127-279; Score=-46.2; E_value=0.095; Accession=PF00350.13; Description =Dynamin family
  Pfam annotation: Domain name=MMR_HSR1; Domain location=125-202; Score= -12.9; E_value=0.015; Accession=PF01926.13; Description=GTPase of unknown function
  Pfam annotation: Domain name=SMC_N; Domain location=113-299; Score= -134.6; E_value=0.095; Accession=PF02463.9; Description=RecFRecNSMC N terminal domain
  Pfam module annotation: Pfam domain module=ABC_tran::ABC _tran::Dynamin_N::MMR_HSR1::SMC_N; Domain location=124-295::497 -680::127-279::125-202::113-299
GTAIVRFLFYNAPTFIAVVTFGACALIGIPLESGKILSALATFRILQMPIYSLPDTISMIAQTKVSLERIVSFLRLDEWKTDVVEKLPRDSSDKAIELVDGNFSWDLSSPNPTLKNVNLTVFHGMRVAVCGNVGSGKSSLLSCIVGEVPKISGTLKICGTKAYVSQSPWIQSGKIEDNILFGKEMDREKYDKVLEACSLTKDLEFLPFGDQTTIGENGINLSGGQKQRVQIARALYQDSDVYLFDDPFSALDAHTGSHLFKECLLGLLKSKTVIYITHQVEFLSDADLILVMREGRITQSGKYNDILRSGTDFMELVGAHKAALSSIKSLERRPTFKTSTTTKEDTSSVSYFELDKNVVYDQNDMSDDIVEPKGQLVQEEEREKGRVGFNVYWKYITTAYGGALVPFILLSTILTVAFQIASNYWMILATPMSATAEPDIGSFKLMVFYVALAIGSSIFTFARAFLAVIAGYKTATVRYAPHLPLVLRGLTCTFTAGAKTGIVGRTGSGKSTLVQTLFRLIEPVAGQILIDRINISLIEIHDLRSRLSIIPQDPTMFEGTVRTNLDPLEEYTDEQIWEALDMCQLGDEVRKKEGKLDSIVTENGENWSMGQRQLFCLGRVLLKKSKILVLDEATASVDTATDNTIQQTVKQKFSECTVITIAHRITSILDSDMVLFLNQGLIEEYDSPKKLLKNKSSSLAQLVAEYTRRSNS

SEQ ID NO: 133631 - protein, 609 aa, Glycine max
  Coding DNA Sequence Number=SeqID_16853
  Gene Ontology: Mol. function=RNA binding
  Homolog annotation: Hit_ID=Q69N36; Match level="QueryCoverage=69%, HitCoverage=42%, E-value=9e-44, Identity=29%"; Hit description =Agenet domain-containing protein / bromo-adjacent homology (BAH) domain-containing protein-like
  Pfam annotation: Domain name=Agenet; Domain location=303-384; Score =69.4; E_value=1.1e-17; Accession=PF05641.3; Description=Agenet domain
  Pfam annotation: Domain name=BAH; Domain location=80-196; Score=32.0; E_value=2.1e-06; Accession=PF01426.8; Description=BAH domain
  Pfam module annotation: Pfam domain module=Agenet::BAH; Domain location=303-384::80-196
MQSSANNGIKVSSGHNLVPAHETTNDTVNEITGLSVQITDDKDFPMSNSKLSNSDIVWSGVAWRCGKQLKHYPAFFRNGIKIAIQSFVFVMGKGENHYIAYVEDMYEDRRGQKKVKVRWFHHNQEVKGVVPVRNLHPREVFITPYSQVISAECVDGSATVLTREHYEKCMPFFSPTSRDRIHLCFRQFRSNKVKPFDFSKLRGYYTQPILSCLHHDSIQNPESLVGEDEELSAGEDVKVGAKRRRGDKGSPQSWISRQGVRKLIKSKQMMVYKTFQVANYARSERRLLSRKQVECQPWSNHTYKVDDKIELLCQDSGIRGCWFRCTVVQVARKQLKVQYDDVQDEDGSGNLEEWIPAFKLARPDKLGMRHSGRPTIRPAPTYEEQELAVEVGNAVDAWWSDGWWEGVVTRNDNCGDDSAQVYFPGECLLMKVCKKDLRISRDWLGDSWINIMAKPEITKTIIFTANNSFNTELYVSPSIAKDADSVGFANSCHGDPVSKKSNEPVIKEVNLVSCDGSTKEENFVSCDDSAEDRDCVQDNKPSSEKCTQAENIDSDVNCDHEDNCVDNDNDKNSDDGGNKNDDDNGNKDMEVFETSVLDGETVELMEVAV

SEQ ID NO: 133632 - protein, 703 aa, Glycine max
  Coding DNA Sequence Number=SeqID_16854
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=46%, HitCoverage=21%, E-value=2e-94, Identity=56%"; Hit description =Multidrug resistance-associated protein 3
  Pfam annotation: Domain name=Cytochrom_B561; Domain location=182-374; Score=-78.5; E_value=0.04; Accession=PF03188.6; Description =Cytochrome b561
  Pfam annotation: Domain name=DUF568; Domain location=88-212; Score =146.6; E_value=6.5e-41; Accession=PF04526.4; Description=Protein of unknown function (DUF568)
  Pfam module annotation: Pfam domain module=Cytochrom_B561::DUF568; Domain location=182-374::88-212
MASIRKSVLLFLTFLTVIIIPATPQPCNSYKFPNNFNYAACEDLPVLESSLHWKYHPSSGAVDVAFNKANVKGSSWVAWAINPTSKGMLGSQAFVAVYKQDGSIKAYTSPITSYATMLQEGNLTFPVYGVSASYTNGHVIIFASFQLPGNTTLVNHAWQEGLVSDDGTLRPHSFSRANLQSFGTLDFLSGKVSELVGIRTQDHVEKLLNTISWGVLMPIGVILARYLKAFDGLGPTWFQLHRACQSLAFLMGIAGFGTGLYIGNHYGIHNAPHRCVGITLLCLAITQVCLAVFLRPKKDHKYRMFWNIFHYIVGYSIIALAVWNVFKGFDILNAQNIWKKTYVGSIISLAIIAVVLEVITWIWVCKKKRVKEPENHVEIVIDFVAYGKHVFLPVMYVISDIGSSITGLFLCYVGCCLNNMRKLAPLEEALLNGHSSVCNNSDSRETRVNKNLTRYSNAGFFSILTFSWISPLITLGNEKTLDHEDLPLLATDDSAYGVFPTFRNKLESECGSLRNVTTLKLAKVLFLSTWQGILLSGLFAFLYTCASYVGPFLIDIFVQYLNGDHKFKNEGYVLAMAFVAAKLVECLSQRHWMFRFQQVGVRMQSKLVAMIYAKGLTLSCQSKEVHSTGEIINLMSVDAERIGEFCWYMHDPWMCVLQVALALLILYRSVGVGSIAALAATVIVMLLNLPVASLQEKFQGKIM

SEQ ID NO: 133633 - protein, 41 aa, Glycine max
  Coding DNA Sequence Number=SeqID_16855
MATPEATICQKAKWRGWSKGWGGGNTEEEELKCERRERGQR

SEQ ID NO: 133634 - protein, 341 aa, Glycine max
  Coding DNA Sequence Number=SeqID_16856
  Gene Ontology: Mol. function=phospholipid binding; Cellular component= coated pit; Biological process=endocytosis
  Homolog annotation: Hit_ID=Q1SDM1; Match level="QueryCoverage=85%, HitCoverage=86%, E-value=5e-43, Identity=37%"; Hit description =Phosphoinositide-binding clathrin adaptor, N-terminal
  Pfam annotation: Domain name=ANTH; Domain location=31-302; Score= -46.8; E_value=2.6e-05; Accession=PF07651.6; Description=ANTH domain
  Pfam annotation: Domain name=ENTH; Domain location=31-160; Score= -30.7; E_value=0.015; Accession=PF01417.11; Description=ENTH domain
  Pfam module annotation: Pfam domain module=ANTH::ENTH; Domain location=31-302::31-160
  Subcellular localization annotation: CTP_CleavageSite=56; ConfidenceScore=5.37e-01
MAQQNRLRNLAQSLKDKASVIAAALSTKRHVSSVRVHVLRATTHALAAPPSEETISAVLVVGSHQKRHPRACIDALMDRLHSTRSATVALKCLYTLHNVVVKGPFILKDQLSCYPSYGGHNFLNLSTFRDGSDLESLELSSWVRWYAGVLEQSLTVSRILGYYLNHSCESQEKKKTLVSKASNADLLYKLEALVGFVEQTSHVPDSLHLQRNELVYEVVRLVGENYRSVQGEILMRVEELGGRIMEDVGELNELVGYLGRLEETREKLVLLFVNRGKNNEFWDSVKKTKEKGVARKKEIERKWLAVVVVAGNAAEFTRSTNPFLDPGQLSPVPRLSFATVR

SEQ ID NO: 133635 - protein, 36 aa, Glycine max
  Coding DNA Sequence Number=SeqID_16857
MQMLSSVLASTGSNRGTGNGVQCRKKWTIQCKRAAQ

SEQ ID NO: 133636 - protein, 510 aa, Glycine max
  Coding DNA Sequence Number=SeqID_16858
  Gene Ontology: Mol. function=zinc ion binding
  Homolog annotation: Hit_ID=Q84KA9; Match level="QueryCoverage=44%, HitCoverage=69%, E-value=5e-49, Identity=46%"; Hit description =RING/C3HC4/PHD zinc finger-like protein
  Pfam annotation: Domain name=zf-C3HC4; Domain location=129-170; Score= 43.3; E_value=8.3e-10; Accession=PF00097.15; Description=Zinc finger, C3HC4 type (RING finger)
MTTFTHSIFHHDLLFLFYFFLLTEFPPQATAQPPNTLTPPPQQDRFTRLKFDKSMAIVLLILVVVFFILGFLSVYTRQCAERRMGGRFDLSILISRRQRGLGREVIETFPTFVYSTVKSLKIGRATLECAVCLNEFEEDETLRFIPNCSHVFHSDCIDAWLANHSTCPVCRANLTSKPDDRCSAPIQNPDPEQPVLTSSTRPETVGADLLSQNRTPPRPWSTGLSIASWFPRSHSTGHSLVQPGENCERFTLRLPEEVRNELMLSRTKSCGVSVTFTRENSGRRGYRARSLGSSLSPHVTRNSTSPHVRWWFSRPRSIKDDVGERSSDRLFSTTRDISELPRSCSSALPSSFVFFHGLPRSSLLPPRSSVPCSSLLLHFGCVPWSSSLGCLSVSSAIEIEHEVLPREEASSARVLGDGNGFSGRRCSSASSCGRNVKSSSAGTRGRTFLVSSAGARGRTPYSADSISVLLHSRKNTFFRRVHFLLAEEAVKLLPQEAFCCILVIFLENYV

SEQ ID NO: 133637 - protein, 69 aa, Glycine max
  Coding DNA Sequence Number=SeqID_16859
MVIRKQPNNFPIAVSAIAGNNGGRRRNAKEKRTSKKKQKRKEEAFHLIPTTMAATKMRKKHKREEEDFT

SEQ ID NO: 133638 - protein, 62 aa, Glycine max
  Coding DNA Sequence Number=SeqID_16860
MSPIIDELKSELRTKHGDAPTNVHDQCPCDIPDGLNKTSIIGEDPTWSGKKIQLCAWNMECE

SEQ ID NO: 133639 - protein, 68 aa, Glycine max
  Coding DNA Sequence Number=SeqID_16861
MRIALKGFNRVRMTWLKVEGEWNHVRSCQCLNPHCTGTTTHICRCSSIWVAWAINPTYDWFTSIRGSS

SEQ ID NO: 133640 - protein, 99 aa, Glycine max
  Coding DNA Sequence Number=SeqID_16862
MVIDYQQHITLCNRLHTNGASLLRYATGSHWLTMPGLGRDWPSLVLGNSTPPDVPKGLLGYGAPVICGTRWRSGDGAKQISHFHKPRHKHTIPSCPPLN

SEQ ID NO: 133641 - protein, 65 aa, Glycine max
  Coding DNA Sequence Number=SeqID_16863
  Homolog annotation: Hit_ID=Q1T1Y0; Match level="QueryCoverage=90%, HitCoverage=14%, E-value=2e-07, Identity=48%"; Hit description =Ankyrin
MYDLDWTYRGKRHDTSFKVMVISSTSRWKDEVFCCHLSTRTFMKPLFAIVYRVVIATHKPSSSAQ

SEQ ID NO: 133642 - protein, 119 aa, Glycine max
  Coding DNA Sequence Number=SeqID_16864
  Homolog annotation: Hit_ID=Q1SPZ1; Match level="QueryCoverage=77%, HitCoverage=27%, E-value=4e-12, Identity=39%"; Hit description =Ankyrin
MHKYPKLFNTHNIEGFSPLKILASRPSAFKSGINLKWWEALLYHCVSAESLDVEKTKESYMKDEPAEHNKHFGIRFASRKTKKKKQLPENYDTCRRLYCAFRLFVLVPIFLIDSIGFGM

SEQ ID NO: 133643 - protein, 42 aa, Glycine max
  Coding DNA Sequence Number=SeqID_16865
MTRLVSRGHLRVGPLRFLEARLMSQVYESEKDHVEGRGLDSR

SEQ ID NO: 133644 - protein, 67 aa, Glycine max
  Coding DNA Sequence Number=SeqID_16866
MCWSQVPRISVYDICHKVVEPLQEKIDLRMVIEGTTTWDNVQAALCCCLKVLMVEIIVEDEAVEELE

SEQ ID NO: 133645 - protein, 75 aa, Glycine max
  Coding DNA Sequence Number=SeqID_16867
MVVISIALVVSVTIVQVIIFGLRGEQGCFMRVSILSVVLKLALAPLEVEAKRTSFPLELSDHIGSTKDFHYSHTK

SEQ ID NO: 133646 - protein, 395 aa, Glycine max
  Coding DNA Sequence Number=SeqID_16868
  Gene Ontology: Mol. function=DNA binding; Cellular component =membrane; Biological process=DNA integration
  Homolog annotation: Hit_ID=Q1SS72; Match level="QueryCoverage=94%, HitCoverage=26%, E-value=1e-75, Identity=38%"; Hit description =Integrase, catalytic region
  Pfam annotation: Domain name=zf-CCHC; Domain location=247-264; Score =13.3; E_value=0.0063; Accession=PF00098.13; Description=Zinc knuckle
  Pfam annotation: Domain name=zf-CCHC; Domain location=285-302; Score =12.7; E_value=0.008; Accession=PF00098.13; Description=Zinc knuckle
  Pfam module annotation: Pfam domain module=Retrotrans_gag::zf -CCHC::zf-CCHC; Domain location=76-191::247-264::285-302
MNELTPNTESYLYLHPSENPVVALVSPVLDSSNYHSWSRSMVTTLSAKNKVEFINGNAPEPLKTDRTYGVWSRCNNMVVSWIMHSVSVAIRQSILWMNKAEEIWNDLKSRYTQGDLLRISDLQQEASSMKQGTLSVTEYFTKLRIIWDEIENFRPDPRCSCTIKCTCSVLTIIAQRKLEDRAMQFLRGLNEQYNNVRSHVLLMEPMPTIPKIFSYVAQQERQLSGNNFLPNFSLESKENASINVVKITCEFCGRIGHTESVCYKKYGVPSSYEGRSKSYNTRNGKACTHCGKIGHTIDVCFKKHRFPPGYKFGNSKVVANNIVAVEGKATSDQMQRHESHDLVRFSPEQDQALFALIQRPSSGSSAPTQSQVASISSCSTNTSPGYQHQSEDWYS

SEQ ID NO: 133647 - protein, 102 aa, Glycine max
  Coding DNA Sequence Number=SeqID_16869
MGTTGSGVAYMAPIDTFSIDPITHGDGGASHRGGGGGGGGGGRFANFQCQYYKTSCNSIILKVLIRSSQAMVKVYKFTPQVTNEVLLQGNAGFDGLYNFPHI

SEQ ID NO: 133648 - protein, 163 aa, Glycine max
  Coding DNA Sequence Number=SeqID_16870
  Gene Ontology: Mol. function=transferase activity
  Homolog annotation: Hit_ID=Q1SPZ0; Match level="QueryCoverage=95%, HitCoverage=40%, E-value=1e-34, Identity=42%"; Hit description =Ankyrin
MKQKHIWSAQLLRAFMEKPYLSYTGGPPPLNEGVQTDYRKVSVDSKETVILVAARNGIVEMVNEIISKIPSAIHETNSEKKNVLLVAVENRQTLIVEALKNWFEQEKKELIFYNLKLGVDDQENTVLHLAATLPNKGWMISGLALQMMWHIKWFQVYVYDIRM

SEQ ID NO: 133649 - protein, 301 aa, Glycine max
  Coding DNA Sequence Number=SeqID_16871
  Gene Ontology: Mol. function=DNA binding; Cellular component =mitochondrion; Biological process=DNA integration
  Homolog annotation: Hit_ID=Q1SS72; Match level="QueryCoverage=77%, HitCoverage=74%, E-value=4e-45, Identity=45%"; Hit description =Integrase, catalytic region
MENASNIWNTLKKRYYQGDVFHISDLQEELYLLKQGDATITSYFTKLKGLIHKLDNFRPIPSYTCAVATQSELSSLIKTNTWQLTHLPPDKKLIGCKWVFKTKFKVDGSIDKHKAILVAKGFTQTAGLDYIETFSPIVKMTIVRLVLSLATSQGWHLHQLDVNTAFLHGDLHEEASRRLITTLLDSGFQQSKADYSLFTKRCPTSLTIVLVYVDDLDLGILKYFLGFEVARSTSASTSLRGFSDSDWGACLDTRRSISGLIHLLLISSHEQSADILTKPLHAGPFNHNHSKLGMLDIHIPA

SEQ ID NO: 133650 - protein, 206 aa, Glycine max
  Coding DNA Sequence Number=SeqID_16872
  Gene Ontology: Mol. function=transferase activity
  Homolog annotation: Hit_ID=Q1SPY9; Match level="QueryCoverage=99%, HitCoverage=27%, E-value=5e-61, Identity=55%"; Hit description =Ankyrin
MEQYIKDLVPEHFTVRTNKDGKTARQIFKESHNCLVKDANEWLKGTSESCSVVAAFLAGVSFATSTSVPGSFDSDTGEPLLETNNAFESFAMCSLIGLSFSVTALVLFLSILTSRKELKDFRRSLPLKVLLGLSSLFISTAALFATFCSAHFFIVDEKYKQVLIVIYAVTCFPVGLYAIAQFPLFIDLVRAIATKVPQASDNENDI

SEQ ID NO: 133651 - protein, 355 aa, Glycine max
  Coding DNA Sequence Number=SeqID_16873
  Gene Ontology: Mol. function=DNA binding; Cellular component=oxygen evolving complex; Biological process=DNA integration
  Homolog annotation: Hit_ID=Q1SLU3; Match level="QueryCoverage=93%, HitCoverage=23%, E-value=1e-102, Identity=55%"; Hit description =Integrase, catalytic region
MFGILYTLSSLIPGSHLHIATDGTVERYKAHLVAKGYTQLEGLDFLDTFSPVAKLTTVRLLLALVALHNWHLRQLDVNNAFLHRDLDEEVYMTLPPGLVVNDLNLVCRLQRSLYGLKQASRQWFTRLSSFLISHDFRQSSVDHSLFLHFHNNDITAVLVYVDDIILAGTNLDTIAHITKLLDQAFSIKDLGTLKFFVDLEVARTSHGIHLSQHKYVLDILSDSGMLASRLASTPMDYSTRLTTSMGTPLSETSSSSYRRLIGQLIYLTNTRPDITHAIQQLSQYMAHPTSAHSQAAFCILRYLKGSPGSGIFLAAHGPLQLKAFSDSDWAGCRDTRHSITGFSVYLGPSLISWRS

SEQ ID NO: 133652 - protein, 48 aa, Glycine max
  Coding DNA Sequence Number=SeqID_16874
MRAVTEKHRPINEHIANDSNAGTVVDVAKELKHQQEELPQLSKILMSP

SEQ ID NO: 133653 - protein, 79 aa, Glycine max
  Coding DNA Sequence Number=SeqID_16875
  Gene Ontology: Mol. function=DNA binding; Biological process=DNA integration
  Homolog annotation: Hit_ID=Q1SS72; Match level="QueryCoverage=99%, HitCoverage=6%, E-value=4e-17, Identity=55%"; Hit description =Integrase, catalytic region
MVFIEDNITGCGDVMGMKVIDEIPFGVWFETNEDAWVGTRVKLLSVGFESTHVTQATIDSKGDLLFKKGVGMQLIKYAA

SEQ ID NO: 133654 - protein, 59 aa, Glycine max
  Coding DNA Sequence Number=SeqID_16876
MKLKRKASQYSNIMVLKEDNTKTKPEAKKRGRSKAFPLTTDSDFIGGEGVGAGCHSSQE

SEQ ID NO: 133655 - protein, 375 aa, Glycine max
  Coding DNA Sequence Number=SeqID_16877
  Gene Ontology: Mol. function=oxidoreductase activity; Biological process=electron transport
  Homolog annotation: Hit_ID=Q9LJI8; Match level="QueryCoverage=98%, HitCoverage=80%, E-value=5e-77, Identity=46%"; Hit description =Arabidopsis thaliana genomic DNA, chromosome 3, P1 clone: MZN14
MAKGVIGEETRLKLAEGLLSQSAVPSEALTHSNVGLLIGKFSSSLGRAFLFDLIPTPHNDSAEPACALTDPDKKKATKSNPADSSSLFIDKDWVAEHARQVSRMLVGGIKVVGLYVWVSDAAFKNSTIMLCQTVKGVAEAAPVLEGDWDERLLLHISYSPRRWNCRNCSLSSNITSSSLRPCDFKMGKVLTSLQTFKCMHNFNLRLPILRDSASKFQTLSDVLRHTISIHAKELAGAKALIDVVFCTEYYIAQDSFVIRVVESESYSSDGVHEVELLLSFLNDSSIEACSQGDVVGILSFSGLICSFAYLNSKEPNSQAITDIKGDIITSLQSRLDIICDEVDVDSGNNHDVGSQVSNEISAEKPVPQLVLHLLR

SEQ ID NO: 133656 - protein, 171 aa, Glycine max
  Coding DNA Sequence Number=SeqID_16878
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=84%, HitCoverage=32%, E-value=2e-76, Identity=95%"; Hit description =Ser/Thr protein kinase
  Pfam annotation: Domain name=Pkinase; Domain location=2-167; Score =72.7; E_value=1.2e-18; Accession=PF00069.15; Description=Protein kinase domain
  Pfam annotation: Domain name=Pkinase_Tyr; Domain location=2-171; Score=-105.6; E_value=5.5e-06; Accession=PF07714.7; Description =Protein tyrosine kinase
  Pfam module annotation: Pfam domain module=Pkinase::Pkinase_Tyr; Domain location=2-167::2-171
MVVRKVGNCCHSQALVSVVKRCFLQVLASRTKIYIILEFITGGELFDKIIHHGRLSETDSRRYFQQLIDGVDYCHSKGVYHRDLKPENLLLDSLGNIKISDFGLSAFPEQGVSILRTTCGTPNYVAPEVLSHKGYNGAVADVWSCGVILYVLLAGYLPFDELDLTTLYSKA

SEQ ID NO: 133657 - protein, 213 aa, Glycine max
  Coding DNA Sequence Number=SeqID_16879
  Gene Ontology: Mol. function=GTPase activator activity; Cellular component=integral to membrane; Biological process=small GTPase mediated signal transduction
  Homolog annotation: Hit_ID=Q1XG56; Match level="QueryCoverage=55%, HitCoverage=49%, E-value=6e-33, Identity=53%"; Hit description =Putative p23 co-chaperone
  Pfam annotation: Domain name=CS; Domain location=65-140; Score=43.2; E_value=8.7e-10; Accession=PF04969.6; Description=CS domain
MCHIIININGGWETETSNERPKWPRTKLDVVLKSLQFHTHIPLSLEHSRFRLLPSHSANEISRYPEVLWAQRSDKVYLTVALPDAKNVSVKCEPQGLFTFSASGVQEEAYSFSLELYGCIEPEGCKTKSGLRNILCSIQKGEKGWWKRLLKSEEKPAPYLKVDWNRWCDEDDEESTLQCTYWRASPGAAVKLCLGDLLVMGSNPETASLHMQG

SEQ ID NO: 133658 - protein, 510 aa, Glycine max
  Coding DNA Sequence Number=SeqID_16880
  Gene Ontology: Mol. function=oligopeptide transporter activity; Cellular component=integral to membrane; Biological process =oligopeptide transport
  Homolog annotation: Hit_ID=O04514; Match level="QueryCoverage=99%, HitCoverage=75%, E-value=0.0, Identity=59%"; Hit description =Probable oligopeptide transporter 2
  Pfam annotation: Domain name=OPT; Domain location=34-510; Score =373.5; E_value=3.2e-109; Accession=PF03169.6; Description=OPT oligopeptide transporter protein
MASIEMESAKEDDISPIEEVRLVVSNEDDPRQPVWTFRMWFLGIVAVILLSFLNTFFGYRKQPLLVTMISVQVATLPIGRFMARVLPPTKFRIRGRDFSLNPGPFNIKEHVLISIFANAGAAFGNGAAYAVGIVDIIRAFYGRKITFLAGVGVWMGGDNEEVRGGARRDVVALHSSAAQQIGSGEKGLGLGSFSLDWTTVAAFLGNPLVSPFFATANVLVGYILLIYLIIPVSYWGLNIYNAKNFPIYSSSLFVANGTEYNVKAIVNEKFEIDMLAYEKQGRVNLSAFFAISYGIGFAAIASSLTHVAIFNGREIYEQFRSSRSKKEDIHARLMKKYKRIPSWWFHVTLLVSFALALLLCIVMKDQIQMPWWGLIFASGIALTFTLPVSIITATTNQTPGLNIITEYIMGVILPGKPIANVCFKTYGYISMSQAVSFLSDFKLGHYMKIPPRSMFIVQVVGTLIAGTMDVGVAWWLLGSVKNICNQDLLPADSPWTCPGDKVFFDASVIW

SEQ ID NO: 133659 - protein, 89 aa, Glycine max
  Coding DNA Sequence Number=SeqID_16881
MDWGNFLHRILEEDSEHSTPTTSNGTSWWPLVVVGGGEGGIRILLSKLISLSGSPLFTLSATIGTERNSLCINSRSAQFPLRLKLHLAC

SEQ ID NO: 133660 - protein, 355 aa, Glycine max
  Coding DNA Sequence Number=SeqID_16882
  Gene Ontology: Mol. function=carbohydrate binding; Biological process= DNA integration
  Homolog annotation: Hit_ID=Q9SZK3; Match level="QueryCoverage=98%, HitCoverage=64%, E-value=1e-100, Identity=46%"; Hit description =LG127/30 like gene
MDNRVHGWISFSPPVGFWQITPSDEFRSGGPLKQNLTSHVGPTALAMFLSGHYVGQDLVPKFRGGESWKKVFGPVYMYLNSGAVGDDPLGLWEDAKIQPYSFPASEDFLKLDQWGNVSGRLLVFDRYICTDLISANGAYVGLAPPGDAGSWQRECKVLFAHLRKSSYIELGELVYEPLRDGPTLWEIGIPDRSAAEFYAPDPNPQHINKLFINHLDRFGQYGLWDGYSELYPDGDLVYTIGVSDYTKDWFYAQAPRLSCKPVIVGFLELYVTYNIRVNDANARQPVFTSGLIGRDNSIARHGIQGIYWLYNVNIPGSLLIDGTNTIYFSQPRCTSSFQGIMYDYIRLEGPPCEEI

SEQ ID NO: 133661 - protein, 597 aa, Glycine max
  Coding DNA Sequence Number=SeqID_16883
  Gene Ontology: Mol. function=helicase activity; Cellular component =mitochondrion; Biological process=protein amino acid phosphorylation
  Homolog annotation: Hit_ID=Q6Z7E0; Match level="QueryCoverage=86%, HitCoverage=91%, E-value=1e-165, Identity=46%"; Hit description =Putative pentatricopeptide (PPR) repeat-containing protein
  Pfam annotation: Domain name=PPR; Domain location=107-141; Score =15.8; E_value=0.1; Accession=PF01535.11; Description=PPR repeat
  Pfam annotation: Domain name=PPR; Domain location=142-176; Score =33.3; E_value=8.2e-07; Accession=PF01535.11; Description=PPR repeat
  Pfam annotation: Domain name=PPR; Domain location=209-243; Score =35.1; E_value=2.5e-07; Accession=PF01535.11; Description=PPR repeat
  Pfam annotation: Domain name=PPR; Domain location=244-278; Score =38.2; E_value=2.8e-08; Accession=PF01535.11; Description=PPR repeat
  Pfam annotation: Domain name=PPR; Domain location=279-313; Score =51.0; E_value=3.9e-12; Accession=PF01535.11; Description=PPR repeat
  Pfam annotation: Domain name=PPR; Domain location=314-348; Score =37.0; E_value=6.5e-08; Accession=PF01535.11; Description=PPR repeat
  Pfam annotation: Domain name=PPR; Domain location=349-383; Score =42.8; E_value=1.2e-09; Accession=PF01535.11; Description=PPR repeat
  Pfam annotation: Domain name=PPR; Domain location=384-418; Score =40.6; E_value=5.2e-09; Accession=PF01535.11; Description=PPR repeat
  Pfam annotation: Domain name=PPR; Domain location=419-453; Score =39.9; E_value=8.6e-09; Accession=PF01535.11; Description=PPR repeat
  Pfam annotation: Domain name=PPR; Domain location=454-488; Score =52.4; E_value=1.5e-12; Accession=PF01535.11; Description=PPR repeat
  Pfam annotation: Domain name=PPR; Domain location=489-523; Score =43.7; E_value=6.1e-10; Accession=PF01535.11; Description=PPR repeat
  Pfam annotation: Domain name=PPR; Domain location=524-558; Score =37.9; E_value=3.4e-08; Accession=PF01535.11; Description=PPR repeat
  Pfam annotation: Domain name=PPR; Domain location=559-593; Score =27.3; E_value=5.3e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=107-141::142 -176::209-243::244-278::279-313::314-348::349-383::384-418::419 -453::454-488::489-523::524-558::559-593
  Subcellular localization annotation: CTP_CleavageSite=61; ConfidenceScore=5.14e-01
MDLVAPAEQVCSFHHFHITRARVSDNSISRPFVLYPDSSVSHHFSKLKATRSRKRLENRVSAVSKSEASGLNGRLQQIVSTPNGDLNVIGMESSPIGVNGSRSFEEFASNIHLRKLVRNGELEEGLKFLERMIYQGDIPDVIACTSLIRGFCRSGKTKKATRIMEILENSGAVPDVITYNVLIGGYCKSGEIDKALEVLERMSVAPDVVTYNTILRSLCDSGKLKEAMEVLDRQLQRECYPDVITYTILIEATCNDSGVGQAMKLLDEMRKKGCKPDVVTYNVLINGICKEGRLDEAIKFLNNMPSYGCKPNVITHNIILRSMCSTGRWMDAERLLSDMLRKGCSPSVVTFNILINFLCRKRLLGRAIDVLEKMPKHGCVPNSLSYNPLLHGFCQEKKMDRAIEYLEIMVSRGCYPDIVTYNTLLTALCKDGKVDAAVEILNQLSSKGCSPVLITYNTVIDGLTKVGKTEYAVELLEEMRRKGLKPDIITYSTLLRGLGREGKVDEAIKIFHDMEGLSIKPSAVTYNAIMLGLCKAQQTSRAIDFLAYMVEKGCKPTEATYTILIEGIADEGLAEEALELLNELCSRGFVKKSSAEQ

SEQ ID NO: 133662 - protein, 142 aa, Glycine max
  Coding DNA Sequence Number=SeqID_16884
MSVGSQRVVRQFGYTQTIPAPPVDSWVSYDDIHDKWMHYSDHIIPAGEPRVVPQAPQTDIPHVLKPGAPSTSARPAMEEPRHAVVICYEIAERLERHLNLGVVTPGSSTHEVIEECLRMARSVTQDQLVYVRSRHRRHTDWA

SEQ ID NO: 133663 - protein, 128 aa, Glycine max
  Coding DNA Sequence Number=SeqID_16885
  Gene Ontology: Mol. function=carbohydrate binding
  Homolog annotation: Hit_ID=UPI00005DC1AF; Match level="QueryCoverage =91%, HitCoverage=37%, E-value=2e-35, Identity=47%"; Hit description =lyase
  Pfam annotation: Domain name=Rhamnogal_lyase; Domain location=1-128; Score=205.4; E_value=1.3e-58; Accession=PF06045.2; Description =Rhamnogalacturonate lyase family
MANYFVVMDNGIVQVTLTNPDGIVTGIRYNGVDSLLEVLNKETNRGFIMLRGSSGFYPYGIYEHLNGWPDFDISETRITFKLRKDQFQYMAMADNRQRVMPFPEDRLPGRCQTLGYPEAVLLVNPKDP

SEQ ID NO: 133664 - protein, 106 aa, Glycine max
  Coding DNA Sequence Number=SeqID_16886
MTNTQTGPPIFNLHGTTTSNTQTGPPKLQKLFTEKEYEEHRDEGETKKHFRKKVLPEEEGGLPEEPSSGISSGRRPSGTYYGSSSGSPPSSSGKTFFRKFSRRTSS

SEQ ID NO: 133665 - protein, 144 aa, Glycine max
  Coding DNA Sequence Number=SeqID_16887
  Subcellular localization annotation: CTP_CleavageSite=44; ConfidenceScore=5.49e-01
MSLAYFFLIKAFFFQKCTQPPFLFAFFPPFLWFLCGIVSGSLVRCEQLGAVKVKVRCGGRRRQTRYVEGGSFVADMDEDEWMYEIMYEQADMDYENAEACGANEPHVDCSNAFNTSGYDVNVFECREDALYCSRSLAQEDGFVV

SEQ ID NO: 133666 - protein, 64 aa, Glycine max
  Coding DNA Sequence Number=SeqID_16888
MDNDILCVISIYILPTNIDVPVKNESLLPCMGVSDRSSSSMTAEAGTCNYAPMLSNHQGIIVGF

SEQ ID NO: 133667 - protein, 292 aa, Glycine max
  Coding DNA Sequence Number=SeqID_16889
MELTSPVVLAEGETLPTYSRYCRLPTDYREIEVALCIPGRGFILNAGGHPERILKKDLTTLAQVWSVLSYSNLAPTSHTSNLIVDRARLIFGLVSRMDMNVGALISCQITSIAQSNFSRLGFPALITALCRARGVVSDSLTFEHLSPVINLAYIRRNYWNPNDLTGQIILLQSLQVVAPPGSIPFVEQFLERVAWPGAQPSLHMEDEGPTAQDRQVVAATPERSLEGTPEPPALVVDLSSPQYAADPSTPILEIPEDPTTPVLTLSTSLPATLVLHLTDEEDVQTQDTQDQS

SEQ ID NO: 133668 - protein, 202 aa, Glycine max
  Coding DNA Sequence Number=SeqID_16890
MVVNVSTEENKWLSQSWADTLKDLTMFDKCFSELVNSVGYLVDLDVSMRDMLRLNYARVLITTVSNQTICSSLRVKIDGAICLVRMEEENVLFINHCGCRDGVESSPLVDVEVKGSEIELDIGSMMSECSDDLAKEDEQSHQSPRQAVHMEETTVQNSLGIAHFIPLMESMTPIASVNDRNNTSCIEGNGVPNTEEAWRFKK

SEQ ID NO: 133669 - protein, 293 aa, Glycine max
  Coding DNA Sequence Number=SeqID_16891
  Gene Ontology: Mol. function=carbohydrate binding; Biological process= DNA integration
  Homolog annotation: Hit_ID=Q9SZK3; Match level="QueryCoverage=96%, HitCoverage=43%, E-value=6e-97, Identity=57%"; Hit description =LG127/30 like gene
LNLYRYISDAFIPVSGAYVGLAAIGEVGSWQRECKGYQFWTITDDKGYFSIINIRPGGYNLYSWVNGFIGDYQFDSVIYVTSGCETNVGELVYEAPRDGPTLWEIGIPDRSAAEFYVPDPNPMCINRLYVNHPDRFRQYGLWERYAELYPNEDLVYTVGISDYRKDWFFAQVNRKKDNGTYIGTTWQINFKLDSVNTNGTYTLQVALASVHSAELEIRINNLEANPPLFSSGVIGKENTIARHGIHGLYWLFSIHIQGTLLVQGNNTIFLTQTRDTSPFIGIMYDYIRLEYKR

SEQ ID NO: 133670 - protein, 105 aa, Glycine max
  Coding DNA Sequence Number=SeqID_16892
MEMSIIRETHLHLQGLTLPTMEEEKKKKTKNSLISPWTTNTQQGGKGVYSLFFRGRVRFRGGPKCRTPRSMAAKWRWKKDDWRCHFKKKISQEQAHHHRKPWIRP

SEQ ID NO: 133671 - protein, 171 aa, Glycine max
  Coding DNA Sequence Number=SeqID_16893
  Subcellular localization annotation: CTP_CleavageSite=27; ConfidenceScore=5.48e-01
MSCSGKFFRNNQRVIRKNPLPKTFRKKCSVNFPKEGFFQMTLWFFQKNPSSGNLPKQRLLELPEEVFFQKVSRRGFFRKKPSLLVRVLTIFFGVFYPKWRGVRETNLEGKTHQQRLIGADEADGARGEEEAAGEEEKEQRRRGSSGKRSAYILNFYLKGKMVHSLNCWVHQ

SEQ ID NO: 133672 - protein, 319 aa, Glycine max
  Coding DNA Sequence Number=SeqID_16894
  Gene Ontology: Mol. function=metal ion binding; Cellular component =integral to membrane; Biological process=ubiquitin cycle
  Homolog annotation: Hit_ID=Q5EAE9; Match level="QueryCoverage=84%, HitCoverage=71%, E-value=2e-51, Identity=41%"; Hit description=RING -H2 finger protein ATL5C precursor
  Pfam annotation: Domain name=PHD; Domain location=117-162; Score=0.5; E_value=0.05; Accession=PF00628.19; Description=PHD-finger
  Pfam annotation: Domain name=zf-C3HC4; Domain location=118-159; Score= 39.4; E_value=1.3e-08; Accession=PF00097.15; Description=Zinc finger, C3HC4 type (RING finger)
  Pfam module annotation: Pfam domain module=PHD::zf-C3HC4; Domain location=117-162::118-159
MLMPPSSFTLLLTLLLLFLTYEAESGETPPPTPPPPFRPGIAVLVCVLTTIISLTSLLLLYIKHCNGGIPDGGGGNSAPWTVAPFSGRKNSGIDRSVVESLPVFRFGALRGQKEGLDCAVCLNKFEAAEVLRLLPKCKHAFHVECVDTWLDAHSTCPLCRYRVDPEDILLVEDAKPFRQSHQQQRNKEEERVRLNLDLEKQEIVESRRRHSSVGVGEGETTEEQQQSRRWTTSFRRSLDSISATSRKKNESVGTERASVERRLEHRIIVSPGQGPGPGPGPGPCGLEQRWSDLQASDLLYLTSEMIMMRDSWNGRGSGV

SEQ ID NO: 133673 - protein, 215 aa, Glycine max
  Coding DNA Sequence Number=SeqID_16895
  Pfam annotation: Domain name=PWWP; Domain location=20-94; Score=4.5; E_value=0.0056; Accession=PF00855.8; Description=PWWP domain
MACGSKSGKSEISEGGANDSVAVGDVIFVKLRGSSWWPVQVVDENSVNKSVKPSKRTKRLPGDILVRHYGSYTYSYADPIKCRDEFKRILERNDGSLKKVLLQTLEQGLSEHLTKKVEDIVVIERDEWKQESWRRCVAVEGVIEVTFTTLVVKQDGHTQDNYYSLHGFPYKIAKVSQSPNPAIEQKIKSEGNHLSLFSANEYKEYLQLKEAYSLY

SEQ ID NO: 133674 - protein, 89 aa, Glycine max
  Coding DNA Sequence Number=SeqID_16896
  Subcellular localization annotation: CTP_CleavageSite=2; ConfidenceScore=5.39e-01
MVTMTPGAQKKLPDTTLATFSTNTHTLSKNKAKCHHHPSSFTAAQYSTQHQRQSTDILRLSQTSKQHPTPNQTHFPKIYSNQSPHCDQM

SEQ ID NO: 133675 - protein, 86 aa, Glycine max
  Coding DNA Sequence Number=SeqID_16897
  Gene Ontology: Mol. function=DNA binding; Biological process=DNA integration
  Homolog annotation: Hit_ID=Q1T010; Match level="QueryCoverage=91%, HitCoverage=5%, E-value=2e-15, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
VNLSANLPVLNGKNWDRWRVQMKAILSYQEVAEIVEEGYPMLIEDSTDAQKVLHKENKKKDCKATFLIHQCVDEAHFEKITGVATS

SEQ ID NO: 133676 - protein, 310 aa, Glycine max
  Coding DNA Sequence Number=SeqID_16898
  Gene Ontology: Mol. function=nucleic acid binding
MEVPLPGMKLMENWKVEEEGDKDDGDGDVGNDDSNGVDVNTNGEEQEDIASEEHDDIDGDKDVDVDVRVGREWWSDIPEYNDEVQEDEAEPIGYDSEKLDSSRSSDDEGGFEKEVFPQFNECSKFGNVHLEVGMEFSNMEIFKEAVRDYTIELGRDIKWKKNDAIRARAKCREPGNKQATRQWVVKKLEDKIREQPSLKYNEALDFFKKEYGVHIVERKIFRAMKEAKELVEGSEKEPFIGLDGCFLKGYFGGQLLSAVGLDRNNHIYVLAYAVVDVENKDNWKWFLTSLHEDIGDYKEHKWNFMSAIQK

SEQ ID NO: 133677 - protein, 1288 aa, Glycine max
  Coding DNA Sequence Number=SeqID_16899
  Gene Ontology: Mol. function=RNA-directed DNA polymerase activity; Cellular component=chromatin; Biological process=chromatin assembly or disassembly
  Pfam annotation: Domain name=Chromo; Domain location=1203-1251; Score= 25.1; E_value=0.00024; Accession=PF00385.14; Description='chromo' (CHRromatin Organisation MOdifier
  Pfam annotation: Domain name=rve; Domain location=927-1083; Score =76.3; E_value=9.5e-20; Accession=PF00665.16; Description=Integrase core domain
  Pfam annotation: Domain name=zf-H2C2; Domain location=868-909; Score =32.2; E_value=1.8e-06; Accession=PF09337.1; Description=His(2) -Cys(2) zinc finger
  Pfam module annotation: Pfam domain module=Chromo::RVT_1::Retrotrans _gag::rve::zf-H2C2; Domain location=1203-1251::515-769::105-195::927 -1083::868-909
MADFNPSFASFPTLEEILTRLSLQQLSLGDKIDALIHTLTLVVTSASPMPSPIPVVPHPHSSSTATIHKLKLDVPRFDGTNPLGWIFKINQFFDYHSTPAHERLTIASFYIEGRALAWFQWMSSNGQLTSWSVFLQALQTYFAQSPYDDPTGALFKLTQKGYVAAYLSEFEELANRVISLPQPFLLSCFISGLSPDIHREMQAMQPLTLVRAAGLARFQEEKVLEHKHVFRTQALSTSALVTIPLLSPPVQPPPPTVKRLTLDKIASRRERGLCFICDEKYHRGHRCASRVFLFVAEEEDPPPTIIADVDPLPYPPDAPDPSPAQISLNSLSGQVAPETLCFVGLVSNHHIVLLTTLLKVMVGNGQHLECRCICANVTMVVQSFPFTTNLYVLPITGANVVLGVQWLKSLGPVLTDYNTLSMQFIHEGRLVKLKGDDDANIQMISPPQLRRICRRQGDGTCFHIAVLIEEIGPMPNLVIPPEFQPLLTKFCGHKHKIKLQVEGMLQKGLIQPSTSPFSSPVLLVRKQYGSWRFCVDYRALNAVTIKDQFPIPTIDKLLDELGGAKCFSKLDLLQGYHQIRMNVDDILKTTFRTHHGHYKFKVEYLGHVVSHRGVEPVVAKVVAVQQWPIPRSTKALRSFLGLAGFYRRFIKHYASIAAPLVKVTTLKPFQWTSQAQSAFEHLKVALSSAPVLALPDFDIPFVVEYDTSGTGMRAILSQRGHPIAFFSKPFSPKLLRALTYIRELCAITTVVIQTPEQHMYLARLMGYDYDIQYRSGVTHQAADARSRLSESQTTMHMILFVPCLTFLTELRQQLAVNKEYRQRRSAILESPAAHPGFSVVHDLILHKGRIWLYHELPIIPTLIHEYHHATPTGRHTGVTKTLARILENFHWQGIRDDVTRFVAQCLECQLTKYETKKSAGLLCPLPVPHRPWEDLSLDFIMSLPPYKGHTVILVVVGRFSKGIHLGMLPATHTVHMVASLFLNIIVKLHGIARSLVSDRDPLFVNHFWHKLFRLSGILLRMSSTYHPQTDGQTEVLNRVIEQYLRAFVYRRPGSWGKLLPWVEWSHNSSWTVGTGSTPYEITFGRKPFSFPKYIVGSSNIDFVDELLTDRDVTFQAIRKKLVKAQEYMKTLADTKHREVVYHVGDWVLLKLRPYRQSTVKSHPGTPAKLVKHYYGPFKILERIGEQTHESALPPPAINGQPVVSPLAILDYCRSQALVNAPWEVLVQWQGLSPDEASWEDWAQLRDNYHLENKVVFSTKAQGVIGKQKQGTQHREQQTTSTRPKQQKT

SEQ ID NO: 133678 - protein, 117 aa, Glycine max
  Coding DNA Sequence Number=SeqID_16900
MAALNLASLPVTVLGQLNSSAMNFIPLIKCTRTKIIMLVRKKYFKRVMEKHGIQPELYFHDSDTEAKAGNTTQGATNNINKAQATENINKEGQRVPIANKPKRKVTRPSYLKDYARG

SEQ ID NO: 133679 - protein, 115 aa, Glycine max
  Coding DNA Sequence Number=SeqID_16901
  Gene Ontology: Mol. function=NADH dehydrogenase (ubiquinone) activity; Cellular component=integral to membrane; Biological process=ATP synthesis coupled electron transport
  Homolog annotation: Hit_ID=A0A380; Match level="QueryCoverage=64%, HitCoverage=13%, E-value=8e-32, Identity=88%"; Hit description=NADH -plastoquinone oxidoreductase subunit 2
MYGLMRLLRNIYSWGGGKLFYSGHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 133680 - protein, 105 aa, Glycine max
  Coding DNA Sequence Number=SeqID_16902
  Gene Ontology: Mol. function=nucleic acid binding; Cellular component= endoplasmic reticulum membrane; Biological process=DNA integration
MEVPDELESIKNNKVWDLVELPNGIKPIGCKWVFKTKKDSLGNIERHKARLVAKGFAQREGVGYRETFSPVSMKDSLGIIMALVAHFDLELHQIHVKMTFLNGDR

SEQ ID NO: 133681 - protein, 886 aa, Glycine max
  Coding DNA Sequence Number=SeqID_16903
  Gene Ontology: Mol. function=GTPase activator activity; Cellular component=intracellular; Biological process=signal transduction
  Homolog annotation: Hit_ID=UPI000034F109; Match level="QueryCoverage =82%, HitCoverage=84%, E-value=1e-119, Identity=49%"; Hit description= Rho GTPase activator
  Pfam annotation: Domain name=RhoGAP; Domain location=160-308; Score =130.9; E_value=3.4e-36; Accession=PF00620.17; Description=RhoGAP domain
  Subcellular localization annotation: CTP_CleavageSite=44; ConfidenceScore=5.07e-01
SWIYFCDFGITDMTNTSAELSQGNGGVSIPPPNSQSGPQEQNLRSQGGSGNMNAVSQKGNEVNLTLGGIDLNNSGSVVIKADKKLLTVQFPDVHDGRAFTLKAETTEDLYEWKTALENALALAPSAANVTEQNVKDREPVKSTVVGRPILLALEDVDGTPSFLEKALTFIEEHGANIEGILRQAADVDEVERRVREYEQGKVEFSPDEDAHVVGDCVKHVIRELPSSPVPASCCKALLEACRTERGSRVASMRAAINDTFPEPNRRLLQRILMMMQTVASRKAVNRMSSSAVAACMAPLLLRPLLAGECEIENDFDVGGDGSVQLLQAAAAANHAQAICITLLEEYSSIFGEGSVTPDIYTDSEEESGSESEEATDDDDDDDDLSYDYDDDDDEQDESIHESDADDDLVSESYSGTGDSEADDEDHDHASSSSKSSGKSEKLKASRKLSSKSLEGSLTQHEDIKSLEHVPSPKKTGYIDQSYKPDDIVGGVSTDEATLHNSNSPSPASCIKKSNTMSNGPAPRHRTILGRTSARKNLSMESIDFPIEDEDEIERLEAARTELQTQIDKEVKANEQLQSHVDKQKKALEERHLALEQDVARLQEQLHKEKNSRVALENKAELEELALVEADLANLEWKVDEIGVRLNELEQNYGTTSDSSIQLRQISNHERKLKRKTDAEVAAMSQSDRSISKGTVMAQQDTHIGGAENDFERKPDSPPLPNKHPPTSSKRSGTKGEGANSTPSALTKLTSRLNFLKVGRSQTPNELQNMDKGRDSSRYSINVEKGKGSERPQSLLSPKLPSPRLPSPRHPSPNRFGGSEAHSVPNPEKGKGSEPVQISDKSHQSSEKLKKSDSQPAHHSDGWNQQPKHLERGRSEGHQTYNVDKGR

SEQ ID NO: 133682 - protein, 466 aa, Glycine max
  Coding DNA Sequence Number=SeqID_16904
  Gene Ontology: Mol. function=pepsin A activity; Cellular component =cellulose and pectin-containing cell wall; Biological process =proteolysis
  Homolog annotation: Hit_ID=Q1RVV6; Match level="QueryCoverage=88%, HitCoverage=93%, E-value=1e-106, Identity=50%"; Hit description =Peptidase A1, pepsin
  Pfam annotation: Domain name=Asp; Domain location=99-437; Score= -128.4; E_value=5e-06; Accession=PF00026.14; Description=Eukaryotic aspartyl protease
MEAKLATTIILIFSVIWLMRVNGIDPCASQADNSDLNVIPIYSKCSPFKPPKSDSSWDNRIINMASKDPLRFKYLSTLVGQKTVSTAPIASGQTFNIGNYVVRVKLGTPGQLLFMVLDTSTDEAFVPCSGCTGCSDTTFSPKASTSYGPLDCSVPQCGQVRGLSCPATGTGACSFNQSYAGSSFSATLVQDSLRLATDVIPNYSFGCVNAITGASVPAQGLLGLGRGPLSLLSQSGSNYSGIFSYCLPSFKSYYFSGSLKLGPVGQPKSIRTTPLLRSPHRPSLYYVNFTGISVGRVLVPFPSEYLGFNPNTGSGTIIDSGTVITRFVEPVYNAVREEFRKQVGGTTFTSIGAFDTCFVKTYETLAPPITLHFEGLDLKLPLENSLIHSSAGSLACLAMAAAPDNVNSVLNVIANFQQQNLRILFDTVNNKVGIARELTRFGSFVGFKNVMVWLSLCTEIKRVRER

SEQ ID NO: 133683 - protein, 43 aa, Glycine max
  Coding DNA Sequence Number=SeqID_16905
MRTKKKGYYDSKIANGISGVLGFQSQNKKLLIRVFRGANYPRI

SEQ ID NO: 133684 - protein, 160 aa, Glycine max
  Coding DNA Sequence Number=SeqID_16906
  Gene Ontology: Mol. function=helicase activity; Cellular component =Golgi stack; Biological process=metabolic process
  Homolog annotation: Hit_ID=Q6K8I3; Match level="QueryCoverage=96%, HitCoverage=55%, E-value=9e-35, Identity=36%"; Hit description =Fertility restorer homologue A-like
  Pfam annotation: Domain name=PPR; Domain location=11-45; Score=40.3; E_value=6.6e-09; Accession=PF01535.11; Description=PPR repeat
  Pfam annotation: Domain name=PPR; Domain location=46-80; Score=33.9; E_value=5.6e-07; Accession=PF01535.11; Description=PPR repeat
  Pfam annotation: Domain name=PPR; Domain location=81-115; Score=17.6; E_value=0.046; Accession=PF01535.11; Description=PPR repeat
  Pfam module annotation: Pfam domain module=PPR::PPR::PPR; Domain location=11-45::46-80::81-115
MKGSGLKPDTVTYTSLINFLCRNGQIGEAMGLLKEIKENTCQADTVTFNVILGGLCREDRFEEALDMLEKLPQQGVYLNKGSYRIVLNSLTQKCELKKAKELLGLMLSRGFRPHYATSNELLMGFQPGLESWEVLIGLICRERKLLYVFELLNELVITNS

SEQ ID NO: 133685 - protein, 255 aa, Glycine max
  Coding DNA Sequence Number=SeqID_16907
  Gene Ontology: Mol. function=glucose-6-phosphate isomerase activity; Biological process=gluconeogenesis
  Homolog annotation: Hit_ID=Q9SEJ5; Match level="QueryCoverage=100%, HitCoverage=44%, E-value=4e-74, Identity=58%"; Hit description =Phosphoglucose isomerase precursor
  Subcellular localization annotation: CTP_CleavageSite=52; ConfidenceScore=5.53e-01
MASLSGICSSSPTLKKFPNQSPSLTDPLRKDHVSFPARLADRTLSLAPLRAVAREVSDGALAAAVKKGDEFVKEMEPRFQAAFRAMEELEKGAIANPDESRMVGHYWLRDPKRAPNSFLRTQIENTLDAVCSSLTTSLVIKPPSSPEGRFTQILSVGIGGSALGPQFVAEALAPDNPPLKDLVMTLSSFTSLPQIRFVDNTDPAGIDHQIAQLGPELASTLVIVISKSGGTPETRNGLLEVQKAFREAGLDFPKQ

SEQ ID NO: 133686 - protein, 395 aa, Glycine max
  Coding DNA Sequence Number=SeqID_16908
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=29%, E-value=3e-82, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASNSHFPSNLPILTGKNFNRWSVQMKALLGFQDLTDVIENGIEIPKEGASDSQKTEFKDLKKKDCKALVILHQCVDDSHFEKIANAKFAKEAWDILNKAYAGADKIKKVRLQTLRRQFELLQMEETESIGDYFGRLQVLANSITSCGDTITNLTLVEKVLRTLNPRFDHIVVAIEESKDLESLSVDELQGSLEAHEQRLQERLQEIANDKATEQALQAHHQSRNGGSDNHRGKKGRGRFQNTRGRGGYSKDKGKPQPDQRSGNNCNTRSGGSGTHGRGGKKKWDKRNVECFNCGKRGAVSDTEPVLLMVTTKTRADAKDQWYLDTGCSTHMTGHKDWFVSLDESVNHKVRFADDNTIKVEGHGKVVIKRRDGTVSYIEDVLYVPNMRCNLMSLG

SEQ ID NO: 133687 - protein, 197 aa, Glycine max
  Coding DNA Sequence Number=SeqID_16909
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=99%, HitCoverage=14%, E-value=1e-53, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
ETCSCNSKHERLVNVSACCKSAFLNGLLEEKVFVKQPPGFEVDGHEGKVYKLKKALYGLKQAPRAWNKKIDSVLIQIGFSKCISEHGVYVKAEYESDLVIQCLYVDDLLITGNNKIEIDKIKQLLKNQFEMTDLGSFSYFLGIEFKETEVGIVMHQSKYATYMLKKFRMTNCNAAATPTETGLALSLRDEGEPVDET

SEQ ID NO: 133688 - protein, 167 aa, Glycine max
  Coding DNA Sequence Number=SeqID_16910
  Gene Ontology: Mol. function=DNA binding; Cellular component =endoplasmic reticulum membrane; Biological process=DNA integration
  Homolog annotation: Hit_ID=Q1T010; Match level="QueryCoverage=87%, HitCoverage=10%, E-value=2e-45, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MATKRILRYIRGTINYGILLPNTITNSNMELVGYTDSDWRRDNDDRKSTVGYIFLLGDALVSWSSKKQDLVALSTCEVEYIAASMCSCQGLWLRKLLKEMKIQKTEAINILVDNKSAISLAKNPIDHGGSKHIETRYHFIRDKVSKGKGHICKAQQPQRNGLVTVSA

SEQ ID NO: 133689 - protein, 159 aa, Glycine max
  Coding DNA Sequence Number=SeqID_16911
  Gene Ontology: Mol. function=copper ion binding; Cellular component =chloroplast
  Homolog annotation: Hit_ID=P93009; Match level="QueryCoverage=59%, HitCoverage=58%, E-value=5e-25, Identity=62%"; Hit description =Protein CutA, chloroplast precursor
  Pfam annotation: Domain name=CutA1; Domain location=71-146; Score =20.3; E_value=9.2e-09; Accession=PF03091.6; Description=CutA1 divalent ion tolerance protein
  Subcellular localization annotation: CTP_CleavageSite=87; ConfidenceScore=5.71e-01
MTSTLCSSTSLFSSSTLRRRLPLVGAFCMLSLGLSNLCTPFHSSALKTGSKFGIRSHSSTRMEGSNSTVPSIVVYVTVPNKEAGKKLAESIVKEKLAACVNRVPGIESVYQWEGKICVTNYEAHSNMDTDTPTQLMPTIQNTATYKNRERGWEGETQMK

SEQ ID NO: 133690 - protein, 50 aa, Glycine max
  Coding DNA Sequence Number=SeqID_16912
MEGVESYTKVLSETSEEEDDLLIRSTRKVKRKDNKEDDLEMVEEFKNNGE

SEQ ID NO: 133691 - protein, 175 aa, Glycine max
  Coding DNA Sequence Number=SeqID_16913
MEGLVDLAAIDAFLAFHHGKESPVVAILAMYDTFDRGCEKSGARIEGRIRILSSCEGCPMRRVPSDESITPFIARGFSDHNARDRELRGSSNGIIGGYHKWLRVRTQGLDWLPNLKTERDDEVKASEESDEVQALKAELERAWVVEEKFKSIAIKGLNSELKLRRGERNHHGSKA

SEQ ID NO: 133692 - protein, 116 aa, Glycine max
  Coding DNA Sequence Number=SeqID_16914
  Gene Ontology: Mol. function=protein serine/threonine kinase activity; Biological process=protein amino acid phosphorylation
  Homolog annotation: Hit_ID=Q1SH45; Match level="QueryCoverage=98%, HitCoverage=30%, E-value=1e-33, Identity=67%"; Hit description =Protein kinase
  Pfam annotation: Domain name=DUF26; Domain location=19-73; Score =54.1; E_value=4.8e-13; Accession=PF01657.8; Description=Domain of unknown function DUF26
AATSKGYNHKSIGKNNSAVYGLYDCRGDVVGYFCQFCVSTASRQMLQRCPNRVSAIMYYNFCILRYSNENFFGNVTIYPPRHVVGTKNVSSEEEIQKVPLRKGMAWCSAAEISPMK

SEQ ID NO: 133693 - protein, 149 aa, Glycine max
  Coding DNA Sequence Number=SeqID_16915
  Homolog annotation: Hit_ID=Q47522; Match level="QueryCoverage=27%, HitCoverage=50%, E-value=2e-17, Identity=100%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLGNARDSTTSLNFPYFYVLGHAATGENVEDPFIAVEEIDKEVDTQFAKDIEDQVDIMLFLKPKLPQMLDK

SEQ ID NO: 133694 - protein, 49 aa, Glycine max
  Coding DNA Sequence Number=SeqID_16916
MGSKLQSTYSNKSNLDMHNSGCSGSRYILSSGCSNANFHRQSYGAPISI

SEQ ID NO: 133695 - protein, 75 aa, Glycine max
  Coding DNA Sequence Number=SeqID_16917
MGMRKGERSENEDGMTMGKEEMGKPGHDTWREGQNNEKRKRNKSKHGHNTWIEAGKIIKPKKRQKPKLFDEYEKF

SEQ ID NO: 133696 - protein, 424 aa, Glycine max
  Coding DNA Sequence Number=SeqID_16918
  Gene Ontology: Mol. function=nucleic acid binding; Cellular component= chromatin; Biological process=DNA integration
  Homolog annotation: Hit_ID=Q1T010; Match level="QueryCoverage=100%, HitCoverage=44%, E-value=1e-110, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MARSMMKQKSIPHSLWGEAVTIDVYLLNKCPTKRLKEKHILDSRRRKLEDKSEPMILSVRVNPGTGILRELKQSQPQRQTQLPIRFQHFEMLSDNAVNAEGDLIHFALLADIEPIDCKEAMKEQAWKNAMIEKLKAIERNHNWELTKLDLNKKPIEVKWVFKLKLNPDGSIARLVVKEFLQKLGVDYKEQNNWSLFHLDVKSTFLNGPLDELMFVTQPPGFKIKGKEKKVYFTRPYTHGVYYKKGVKSSRVLICLYVDDLLVTGSDHNGIEKFKSLMKSKFEMTTLGKLAYFLGMEFVKIVDGTVMHQRKYTSDVLKWFNMLDCNPTTTPTEFNSKLKEATDDELVDPTLYKQLIGSLRYLYNNRPNLCYAVGLVSRFKHEPRRSHLTAAKRVLRDKSDRMSTTRYLFKLFDAPISWCSKKQPV

SEQ ID NO: 133697 - protein, 262 aa, Glycine max
  Coding DNA Sequence Number=SeqID_16919
  Gene Ontology: Mol. function=nucleic acid binding; Biological process= DNA integration
  Homolog annotation: Hit_ID=Q1S0E3; Match level="QueryCoverage=39%, HitCoverage=14%, E-value=1e-20, Identity=40%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=zf-CCHC; Domain location=140-157; Score =17.8; E_value=0.0012; Accession=PF00098.13; Description=Zinc knuckle
MAGNNKIPKNLPILVMARIGIAGVHKWRCCFDLKMLLKLQRMTSKNQVIPLRRRKGKQQRGMEEPCSSFINVLTPNIFEKIQSSSSTKEARDILAKCYTRGDKESKKIQVMKVEELRLIQRGTSRFANSDDKKGFEKRKIQCFNCEKWGHYVDECWHKKGKQNRNHGEEANVAQKGDSNSDHVILMVTTSGDNSALVVEGMGNIIINRKDGKKEMIENVLYVPEIGVEFKVMYERHSGTMIKILRTNGGGEYTSRELENFCE

SEQ ID NO: 133698 - protein, 49 aa, Glycine max
  Coding DNA Sequence Number=SeqID_16920
MVNHERYTVRWSASLGNDMIYHLLKDGGMWIRGVKRGQGRGFGSNTRVW

SEQ ID NO: 133699 - protein, 152 aa, Glycine max
  Coding DNA Sequence Number=SeqID_16921
  Gene Ontology: Mol. function=protein-tyrosine kinase activity; Biological process=protein amino acid phosphorylation
  Homolog annotation: Hit_ID=Q1SH46; Match level="QueryCoverage=50%, HitCoverage=50%, E-value=5e-16, Identity=63%"; Hit description =Protein kinase
MEVDRCIHIGLLCVQEDAKDRLTMSDVVEMLASDTMTLPKPKQLTFSIGRMASAESSISKSSKNVSINDVTVSITLTRAKTLVLRRFGILSMHTIGTSGLSYVERGAQLDYHKSIFYLIRKAFDSLTTVLKVTRLCPWKSWDRLLKNKGIEE

SEQ ID NO: 133700 - protein, 365 aa, Glycine max
  Coding DNA Sequence Number=SeqID_16922
  Gene Ontology: Mol. function=transcription regulator activity; Cellular component=nucleus; Biological process=regulation of transcription
  Homolog annotation: Hit_ID=Q9FMF4; Match level="QueryCoverage=67%, HitCoverage=63%, E-value=1e-20, Identity=37%"; Hit description =Arabidopsis thaliana genomic DNA, chromosome 5, P1 clone:MSJ1
  Subcellular localization annotation: CTP_CleavageSite=50; ConfidenceScore=5.34e-01
MGGDCGTWVPHLQFGWQSPNLNPLDMGKPVGISAAMNPGFNMVSSNVTVPAFVSSALPHLQLGHSYEPSGWSYCLPPFRQGFSPALNFNAEGKTPADHVKTFGDKIGPYGESSSHQKQFLVIDQTGGQTTIVYSSMFGNPDECLASWHSKLHGANYLRGNEPSFRRDLNLNLNLKVNMTEPTLAHKVDENLKTSIESEMHEDTEEINALLYSDSYGYSTQDEDDDDEVTSTGHSPSTMTTHDNCEAFRGETAEEVASIAGKTKKRKQLDGYYDDIQLIDTGSSQNLNKSSATGDDAESRCSSNNNEGSLSGNKKMKKDKIRDVLSILRSIIPGGKDKDPAMLLDDAIHCLKNLKHKAQALRLDAL

SEQ ID NO: 133701 - protein, 44 aa, Glycine max
  Coding DNA Sequence Number=SeqID_16923
MTTRYLVHSFGTVMAKKPKDWKLVGGSGWYVGVFPEGVSFQHLA

SEQ ID NO: 133702 - protein, 57 aa, Glycine max
  Coding DNA Sequence Number=SeqID_16924
MAHAPNREYDLGGNWLGALLLPMKAPCGKCENPMISLKNGPDIDASDAYQAIRYSSF

SEQ ID NO: 133703 - protein, 345 aa, Glycine max
  Coding DNA Sequence Number=SeqID_16925
  Gene Ontology: Cellular component=nucleus
  Homolog annotation: Hit_ID=Q10QQ8; Match level="QueryCoverage=74%, HitCoverage=35%, E-value=6e-70, Identity=53%"; Hit description =Expressed protein
MGSCSWMEGGGEDQNFNLIFQIAVLIYILNYKCTWETYMTGISRESLMMSNSMLEILVASLISSIIIASILWKLNGFSRKLDLRSGSKRSLADPPKQVLALKSCDISSTRPHLLLVGGSDAFARLYDRRMLPPLSSCWKRMSPPPCVNYFCPMHLSDHGHPSLHLTHVTFSPDGHEVLLSYSGEHVYLMNVNHAGVNEMQYTSGDNSKLMTYSPTINGTEMQPCVSNVFPNGFPIKKNIAAKLDKCRKLIKYAKKSLDNGTPYYGIDACNEVLNGYSHIIGPALKHECLCTRAALLVKRKWKNDAHMVIRDCYAAREIDNSSYKALYYMSEALSQFLRLIKPHSK

SEQ ID NO: 133704 - protein, 496 aa, Glycine max
  Coding DNA Sequence Number=SeqID_16926
  Gene Ontology: Mol. function=protein serine/threonine kinase activity; Cellular component=integral to membrane; Biological process=protein amino acid phosphorylation
  Homolog annotation: Hit_ID=Q9SV05; Match level="QueryCoverage=68%, HitCoverage=95%, E-value=1e-75, Identity=46%"; Hit description =Putative serine/threonine protein kinase
  Pfam annotation: Domain name=APH; Domain location=49-249; Score=-7.1; E_value=0.018; Accession=PF01636.13; Description=Phosphotransferase enzyme family
  Pfam annotation: Domain name=Pkinase; Domain location=57-339; Score =108.8; E_value=1.6e-29; Accession=PF00069.15; Description=Protein kinase domain
  Pfam annotation: Domain name=Pkinase_Tyr; Domain location=57-339; Score=99.5; E_value=9.8e-27; Accession=PF07714.7; Description =Protein tyrosine kinase
  Pfam module annotation: Pfam domain module=APH::Pkinase::Pkinase_Tyr; Domain location=49-249::57-339::57-339
MGFGAPCVPSPIPILMGYLSCNAHSSIATCHPHHKPLAATPIRHFPYADIVAAANGFSSDTFLGRGSHGRVYRATLDAGKLLAAVKTTKLVATSTSKNHATKCTGCGNCTSPAENEIEILSQIPSPRLVNLIGFSTDPNGNKLLVVEYMPNGSLHDLLHSVKKPPGWNRRVRFALQVAKAVRELHSSNPPVIHRDVKSSNVLIDQEWNARLGDFGLALRGHVEDVRVKCTPPAGTLGYLDPCYLAPEDLSAKSDVFSFGILLLEIISGRNAIDVNFSPPSVVDWAVPLIKIGDFAGICDRRIGPPPDPAVVRQLAVLAARCVRSTAEKRPSMAEVVECLNLARKRIRASPIWNSLRRRVARVESALPVFDGNDCDGSEEFVRMVNKGGSGSKRNGKVSSVSRVGYGSEASNNNKVMRSKSIGSGSLKGSWVKMQPHQTENEGFGRRKVKLKRSKSMGVLQGSLLIHYGSENDVVLRSGMVKLVVKDKLEKPLVKSR

SEQ ID NO: 133705 - protein, 196 aa, Glycine max
  Coding DNA Sequence Number=SeqID_16927
  Gene Ontology: Mol. function=DNA binding; Cellular component =chromosome; Biological process=chromosome organization and biogenesis (sensu Eukaryota)
  Homolog annotation: Hit_ID=Q9C944; Match level="QueryCoverage=68%, HitCoverage=100%, E-value=9e-51, Identity=79%"; Hit description =Probable histone H2A variant 3
  Pfam annotation: Domain name=CBFD_NFYB_HMF; Domain location=97-162; Score=12.2; E_value=0.012; Accession=PF00808.13; Description=Histone- like transcription factor (CBFNF-Y) and archaeal histone
  Pfam annotation: Domain name=Histone; Domain location=91-165; Score =92.7; E_value=1.1e-24; Accession=PF00125.14; Description=Core histone H2AH2BH3H4
  Pfam module annotation: Pfam domain module=CBFD_NFYB_HMF::Histone; Domain location=97-162::91-165
MGYEDEEEDDDNNNTNNNDDDHDDGGGGGGGDDDDDDNGGDHVPQQQHTITRERILEQEELEMSGKGAKGLITAKNPSSSKDKDKKKPISRSSRAGLQFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 133706 - protein, 289 aa, Glycine max
  Coding DNA Sequence Number=SeqID_16928
  Gene Ontology: Mol. function=RNA-directed DNA polymerase activity; Cellular component=chromatin; Biological process=chromatin assembly or disassembly
  Pfam annotation: Domain name=Chromo; Domain location=239-289; Score =9.2; E_value=0.079; Accession=PF00385.14; Description='chromo' (CHRromatin Organisation MOdifier
  Pfam annotation: Domain name=rve; Domain location=61-180; Score=31.5; E_value=3e-06; Accession=PF00665.16; Description=Integrase core domain
  Pfam module annotation: Pfam domain module=Chromo::rve; Domain location=239-289::61-180
MAADALSRLDSLELMALQMKNVVYWKGMSKAVKFFVFQCATCQRSKYNTAASPDLLQPLPIPEHVWQHITMDFIEGPPFSFGKEVIFIVVDRLSKAHFMALSHPYTVANVAQCFLDKVFKLHGFPDTITSDRDPVFVSHFWKEFMSLLGIQWSKWLPFAEWWYNSTYHNTIKASPYEIVYGQAPPVHLPYLPGESKIALVDRMRARTNAKLAPKYYDPFLVEDKIGAVAYKLKLPIGSMEPAVIIDKMTVKRGNRVVTKVLVQWKHQLPEDATLKFFYDLKQKFPHFNP

SEQ ID NO: 133707 - protein, 706 aa, Glycine max
  Coding DNA Sequence Number=SeqID_16929
  Gene Ontology: Mol. function=RNA-directed DNA polymerase activity; Cellular component=exocyst; Biological process=RNA-dependent DNA replication
MEICQRGGVGENSIKEFNEWIKDMEIEEAPWVGRKFTWFGPNGEARSKLNRFMVSPDWLAKWPGCTQHPLDRNFSDHCPVLFRSKCIDWDPKPFRILDCWLMDKSFKSIVKECWTSNHQRGWGGYVLKEKIKRLKEKLKLWNREQYGDTFQKYKKIEKELNNLEVSTSDRQLSPQEVMTKKQLQEDLWVVAQNHESLLRQKARSRWVKKGDCNSHYFHLLVNASRRSNSLNGVWIEDPTRVKEEARSFFFHRFQETDQNRPRLDGIRFQTIGHHQNDMLTGRFQEQEIKDAVWGCGSDKSPVPDEINFKFIKQLWHIIKPDVLRFMDEFYVNEIFPRGCNASFIVLIPKEKNPQALGEYRHVSLIGCMYKIVAKILANRLKKIMPCIIDERQSTFIEDKHLLQSALIANEVVDEANRTQRPCIVFKVYYEKAYDFVSWDFLFYMLRRLGFCSKWIKWIEGCLKSASISVLVNDSPSSEFIPQKGLRQRDPLAPFLFNIIAEALNGLMREVEKQNLFREFQVGSNNVDISILQYADATIFFGEGSMDNVKAIKAILRTFEMVSGFKINFAKSCFGAFGMSDRWKREAGIPIRANPRRIPKKVVEKLVYIQRRFLWGGGIDQNKIAWVKWETVCLPKDKGGMGIKDINTFNIALLGKWRSNLFQHEGQLWARILESKYGGWMGLDEAHRDNHESIWWRDLKMVVQNSQ

SEQ ID NO: 133708 - protein, 486 aa, Glycine max
  Coding DNA Sequence Number=SeqID_16930
  Gene Ontology: Mol. function=endonuclease activity
  Homolog annotation: Hit_ID=Q5ZE24; Match level="QueryCoverage=52%, HitCoverage=29%, E-value=2e-24, Identity=31%"; Hit description =Endonuclease/exonuclease/phosphatase family protein-like
MDNNGREGDEFKIRREFCGAVWCRGSFAKGGCECKEHNSVKNTNKNEQIHAWKEICECVGTGTETCGCQKMPGLATILVSCGSQVGSKQSLTGSSKVVVCNIHVLYNPNRGEIKLGQVRVLLDKAKAVYKLWNDTPVVICGDFNCTPKSPLYNFISEQKIGISEISANGSVQATSTEGDIEVIEQNNSRLDTRDLDTKCHSLANQLGSIKEPNPSYSEGRLHIDHVNGEIHDITPVTSSAPEEVHNDATWIGSNEHIPDAVSTSNKESNLHVPEGNKHVEFDCAATSLQEDDQSSKVRIDLESIDLDNVEISSMEPSSQSSVSCVFEDGDSPSHEEIANDQNNCSSTSYLVDKSHHLSNIDFPPDVKEKAFFDETDKTVIGVESEDDIRLISSLHNAEEVALDLGPSMKSYLEKPYQSEELDSASNDLLLPVESNEMEHDLSPRQISKSINSEQATYNPALWTPMEINRNCNRKCRMHLLGAPFTA

SEQ ID NO: 133709 - protein, 44 aa, Glycine max
  Coding DNA Sequence Number=SeqID_16931
EKVIENYEWAFHAANSYTVCLLRRRSQCCRSDMQTFSDFDNTAP

SEQ ID NO: 133710 - protein, 89 aa, Glycine max
  Coding DNA Sequence Number=SeqID_16932
  Gene Ontology: Mol. function=nucleic acid binding
  Homolog annotation: Hit_ID=Q53KJ4; Match level="QueryCoverage=95%, HitCoverage=12%, E-value=2e-11, Identity=44%"; Hit description =Transposable element protein, putative
MATFIEICKTIKIASVPDEAIRLSLFSFSLAGEAKRWLHSFKGNSLKTREEVVEKFLKKYFPKSKTAEGKAAISSFDQFPDESLSEALE

SEQ ID NO: 133711 - protein, 76 aa, Glycine max
  Coding DNA Sequence Number=SeqID_16933
MHRSPTGNLVPLDLEIEATLRRNRAKMRRKLLQDRTVASIIEEETYFSDLLSPDSPSSRESATQLLEVITMAEELD

SEQ ID NO: 133712 - protein, 140 aa, Glycine max
  Coding DNA Sequence Number=SeqID_16934
MGEVEEVQKQMKADMEAMKEQMATMMEAMMSMKKIMEANVVVVAATSAVAKYEWPLLCANSKQHAFPPYGLPPNYTPPNVAYTPSEDVNNSAPILIESRQPQTDHAHVSQPMGETHEMPHHNLADFERCLGYDTKGQAVG

SEQ ID NO: 133713 - protein, 95 aa, Glycine max
  Coding DNA Sequence Number=SeqID_16935
MHLSLPKCLERVEFYSLETSFMPKIDCLGDSMGLPRSYIKRAKSKSIIGFTGSLHLSLRLKVLKQGNEAYGGTQRPCLSATFYALKRGESKAEEF

SEQ ID NO: 133714 - protein, 113 aa, Glycine max
  Coding DNA Sequence Number=SeqID_16936
  Gene Ontology: Mol. function=catalytic activity
  Homolog annotation: Hit_ID=Q1SDE5; Match level="QueryCoverage=56%, HitCoverage=19%, E-value=8e-26, Identity=87%"; Hit description =Spermine synthase
VVPYSAHIPSYADIWGWVMASDSPLDLSAEELDLRMRHRIKEENGYLDGKTFTSVSTLSKTVRNSDQPVLEWADFYIGCPNNRCRMSEIYNGCSTVIVGQRVSTSPATTMRDN

SEQ ID NO: 133715 - protein, 50 aa, Glycine max
  Coding DNA Sequence Number=SeqID_16937
MPPSLRKKDSMSACSILIKKNLRRKIIALGDNFWPWPWLHVNMSRLKDRC

SEQ ID NO: 133716 - protein, 106 aa, Glycine max
  Coding DNA Sequence Number=SeqID_16938
MSMNHDRSTHVVYPDNETREFAEAIRSHLDPSLTSSNSIQGGCQSHQPTIVSMNLICWNYKGVGMKRFKGLMSDLIKEHDVGLLCLLETHSSGDKETKFVQGFLIG

SEQ ID NO: 133717 - protein, 68 aa, Glycine max
  Coding DNA Sequence Number=SeqID_16939
MGCDGVVKVEDKDGVGLMNEESFGRSDVGKTMRMGQRGGFLRKDFTLNVGFESRYKITQKKWSGKPTM

SEQ ID NO: 133718 - protein, 84 aa, Glycine max
  Coding DNA Sequence Number=SeqID_16940
MTRSPSLCEVLYLFEKIALRSSLARERKKGRGGEGRALSSLQIIFDSDVWHNLQLRQPAKLVVAVCAEAGTLSLVRTRYVEVRT

SEQ ID NO: 133719 - protein, 285 aa, Glycine max
  Coding DNA Sequence Number=SeqID_16941
  Gene Ontology: Mol. function=nucleic acid binding; Cellular component= proton-transporting two-sector ATPase complex; Biological process=DNA integration
MASNGSFPSNLPILTGKNFNRWSVQMKALLGFQDLIDVIENGIEIPKEGASDSQKIEFKDLKKKDCKALVILHQCVDDSHFEKIANAKSAKEAWDILNKAYAGADKIKKVRLQTLRRQFELLQMEETESIGDYFGRLQVLANSITSCGDTITNLTLVEKVLKTLNPRFDHIVVAIEESKDLESLSVDELQGSLEAHEQRLQEEQMIRLQNRPCKHSISQEMVVLIITEARKEEGDSRTREVEEVTPKIKVNLNLIKEVVVLVLVEEEAKRNGIKEMLNASIVEKE

SEQ ID NO: 133720 - protein, 272 aa, Glycine max
  Coding DNA Sequence Number=SeqID_16942
MNHPMCGKRTSKESRWHREEKKLKRRRENNQTAQGRGMYRTREQCWMYRTEEPDSNFQEKLKEGRLGIPDFQEDDVYGWLIQIQQHFDMKKGGKLQLDSGIVQVSTKNEDILDIIGELRNQIAIFKRELKEGRLGIPDFQEDDVYGWLIQIQLHFNMKKRGKLQSVVKVLEGHAYDWYKQWEVSNPKVSWEEFQRTVLKKFQARYDLNLPVRVQEREGKSWEQDKRENEGLKIENQNCSKGGETENSEEKKYYARYGGEEPGQTILKKEQRQ

SEQ ID NO: 133721 - protein, 150 aa, Glycine max
  Coding DNA Sequence Number=SeqID_16943
  Homolog annotation: Hit_ID=Q6PQ37; Match level="QueryCoverage=31%, HitCoverage=32%, E-value=2e-18, Identity=89%"; Hit description =Ubiquitin-conjugating enzyme family protein
MIILLGHIDSDVMQITNFLKPQAIRYSDKKAYGQSKLANILHTNELFCRLKVWYKFSVPRNFRLLEELQRGEKGIGDDTGSYGMDDGDDIYMHSWTGTIIGPHNDNRCRIGGYSTSIIRKINVGYLPWGDILRRFTATNDVELRTFYIGY

SEQ ID NO: 133722 - protein, 1234 aa, Glycine max
  Coding DNA Sequence Number=SeqID_16944
  Homolog annotation: Hit_ID=Q9LTX3; Match level="QueryCoverage=36%, HitCoverage=84%, E-value=1e-173, Identity=67%"; Hit description =Similarity to pyridoxamine 5-phosphate oxidase
  Pfam annotation: Domain name=Pyridox_oxidase; Domain location=1056 -1151; Score=17.4; E_value=0.0027; Accession=PF01243.10; Description =Pyridoxamine 5'-phosphate oxidase
  Pfam annotation: Domain name=YjeF_N; Domain location=801-979; Score =223.1; E_value=6e-64; Accession=PF03853.5; Description=YjeF-related protein N-terminus
  Pfam module annotation: Pfam domain module=Pyridox_oxidase::YjeF_N; Domain location=1056-1151::801-979
LASIWRSQLAAAPPKNPCCCWGTMSKSPRRDLQVFDFNEEDEVASDKHHNFLARDSEVNKVGIKSVASIHCVDVAGAMFNLEKDCSDPSPDTVEDIYDSKENSSVLEADKESNLISHESRHHFKIDIHNHNKLEKMDTSGEVSSPETSQNESIDVNSEADDSMDESAPTSPASDFPENGVSLNGCGLNGTDNSDMDDTNTEVVLHPDYVIYQDNYYLGPKLTFSPCFVKINVSTTCIKQEAFDLEWTVDDLIDINCQLFQSSGTVVIKLRVISSNASQSKHVSDASDSNLSLLLIKCMSIHMLGIEELEIAVADYNWSLRHRQITSLNLKYLASWNMALRASPGAAVKLCLGDLLVMGSNPETASLHMQGNFQLNVDWFLPAEAFLKRTLIQKLIFELVENHGSHEISSSDCSGDDECLENNDNRTGIDHPEVNKEPTTSHAGQGIEITLLSGSSSLDPQSFNNSGLVLKELFDPGATAGAMLGQCQSFDQRSSDYRSIFSMEEDTDLGDQFMYLATDPNYQQVAGITPQTCSLPYLPRDCGDEKCHRPQISLLVDRDVVQPSLDASNSVLDDSEDITVCKNCLVVNEPGSSNEPEQGEKTCSAMEKAEHVIDISNSVVGNSLDSITKCDDNKNGDLHSSGQETTTISVQQFPDALDDEEAPTIPLQQVSDAVDDEEAPTTPLKQVSDAVDDEAGCDDGQMIDGMEPDNCEEQAAKRRRLMPLSTVVIGEVNSGEMQKGNYQTDAFIGAEGKQQKHDMSAPTPTASSSAFAQSMANFDADSVTYLKQRDAAEIDETLMGPLGFSVDQLMELAGLSVATSISEVYKPSEYSRVLTICGPGNNGGDGLVAARHLHHFGYKPFVCYPKRTPKPLYAGLVTQLEALSIPFFSVEELPSDLSNGFDVVIDAMFGFSFHGSPRPPFDDLIQRLVSLHNNNNQIGQKRSVIVSVDIPSGWHVEEGDVDGTGIKPDMLVSLTAPKLGAKKFGGPHHFLGGRFVPPAIAEKYKLILPPYPGTSMCVRIGKPPRIDISALRENYISPEFLEEQVEADPFNQFHKWFNDALAAGLKEPNAMSLSTVGKDGKPTAVAMLFGKCLFVFTYCNCFAQVTIAYILSSHIFRLTYSYMELMKLIFHAKEYHAFLKTYGPVQKVSDEESEQYFHSRPRGSQIGAIVSKQSTVVPGRHVLYQEYKELEEKYSDGSLIPKPKNWGGYRLTPQLFEFWQGQKSRLHDRWLLPRL

SEQ ID NO: 133723 - protein, 263 aa, Glycine max
  Coding DNA Sequence Number=SeqID_16945
  Gene Ontology: Mol. function=nucleic acid binding; Cellular component= nucleus; Biological process=proteolysis
  Homolog annotation: Hit_ID=Q1S6A6; Match level="QueryCoverage=68%, HitCoverage=30%, E-value=6e-44, Identity=48%"; Hit description=FAR1
  Pfam annotation: Domain name=FAR1; Domain location=1-169; Score= -59.8; E_value=0.027; Accession=PF03101.5; Description=FAR1 family
MVDRKGDHRPMTRTKCPGRLHVLLDYKIFMWRVSIFDETHNHELTPVNHVHRMVRYHVMSNLDKAQVDSLHSFGVRIYCIMGYLLGQRGSYDSIGFLRSDLYNHLHQKKRLIIKEGDVCVALSYFEGKDVIDPMFYSKIETSTDEKLNHLFLADGCSRSNFQCFGDIFAFDATYKKNRCNKPLEFALDREATVDHVIRLYQRKCMINVDLLQKEPYAPTSLPPIKDRGGVDSTTSAMKHLGGTMIVGSDEGVDSDGMKCSGVS

SEQ ID NO: 133724 - protein, 61 aa, Glycine max
  Coding DNA Sequence Number=SeqID_16946
MMPYYFQIPLGAILAIVDPVIIAVSNWMSTIILGTFRNNWEAYFNDPRPLEPERLKALRIQ

SEQ ID NO: 133725 - protein, 68 aa, Glycine max
  Coding DNA Sequence Number=SeqID_16947
MATSTVVLHRAGSQRVAPSVVDLVNFVFEDEEKDMSIEEDPSIDEEELVTESKSMEKDSSQDSSDGSF

SEQ ID NO: 133726 - protein, 84 aa, Glycine max
  Coding DNA Sequence Number=SeqID_16948
MCSCTRRVIMFCFPGVVAGEEIEDGAAGANDAGAAAGGGSGAGAGLGASERMSMRISMKRPRLARVVLTVALAHNGSRWLFMRE

SEQ ID NO: 133727 - protein, 70 aa, Glycine max
  Coding DNA Sequence Number=SeqID_16949
  Homolog annotation: Hit_ID=Q9FMJ2; Match level="QueryCoverage=38%, HitCoverage=3%, E-value=1e-07, Identity=92%"; Hit description =Ankyrin-like protein
MKSSRSTKSTVMAWHRRELNAVFSAVSALELSMSKELHRFHCARCRVPWHIEGGKLLLELNRVLSCGQPN

SEQ ID NO: 133728 - protein, 123 aa, Glycine max
  Coding DNA Sequence Number=SeqID_16950
  Gene Ontology: Mol. function=cysteine-type endopeptidase activity; Cellular component=vacuole; Biological process=proteolysis
  Homolog annotation: Hit_ID=Q9LLQ5; Match level="QueryCoverage=95%, HitCoverage=29%, E-value=4e-41, Identity=60%"; Hit description=Seed maturation protein PM40
  Pfam annotation: Domain name=Peptidase_C13; Domain location=3-123; Score=-201.1; E_value=2.8e-06; Accession=PF01650.8; Description =Peptidase C13 family
MVDYTDENVSVQNLIVVILGDKNKVKGGSGKVINSKLEDKIFISTLIMEVREFLVIYAEACDIRGSMFEGMMPKDLKIYATTASNAQENSWGTYCLGMDPSPPPEYIICLGDLYSVAWMEDKY

SEQ ID NO: 133729 - protein, 103 aa, Glycine max
  Coding DNA Sequence Number=SeqID_16951
MESVAIVGGATNIWIMLIFVGFVIIMKVYVFGFVIVSPSMSLPLMSVTLALTQWCWIILELALTDKLECRRRRSSTWWRHTIVILCKELKRVVCERIVLRLKH

SEQ ID NO: 133730 - protein, 64 aa, Glycine max
  Coding DNA Sequence Number=SeqID_16952
  Gene Ontology: Mol. function=aminoacyl-tRNA ligase activity; Biological process=tRNA aminoacylation for protein translation
  Homolog annotation: Hit_ID=P93363; Match level="QueryCoverage=95%, HitCoverage=14%, E-value=9e-09, Identity=47%"; Hit description =Tyrosyl-tRNA synthetase
MEQPPTKAVESLSVSDLEIPQSSNSNPTHLLAPDEKFQIVRSVGKECIQEDKLFNLLTKKPEPI

SEQ ID NO: 133731 - protein, 79 aa, Glycine max
  Coding DNA Sequence Number=SeqID_16953
MRTRWCWVHNGVRGVIVLGRSGYGGFMAGIFWERQGHRMSGEGQKIQPIVQSNALPLSLLFWRKYAIPFIATEEFCCTC

SEQ ID NO: 133732 - protein, 353 aa, Glycine max
  Coding DNA Sequence Number=SeqID_16954
  Homolog annotation: Hit_ID=Q9ZW35; Match level="QueryCoverage=43%, HitCoverage=61%, E-value=1e-34, Identity=57%"; Hit description =Proliferating cell nuclear antigen 2
  Pfam annotation: Domain name=Sigma70_r1_1; Domain location=262-336; Score=-9.0; E_value=0.066; Accession=PF03979.4; Description=Sigma-70 factor, region 1.1
MVTCVKEMCTVDFLDKKLTLVHKGVRLSEFIGAKAVKECCENPETSKLEINSRIEKNAKERGNILGISNMKVTVLLPLSALMVMISSLPAHGDVAVAAVVLKALKSEEERDEGNMVGVHGLEGEPYGGAVEVCIVHELLDGLQNLLQEGALHEMEFQHLDDDDQRLNEKIHLFLPLMFVLLTKRKSCKLSFFQDFFYLGSIFTNGRKNNRTKSNECEATNESMIKEDKINRQFNILGCYIFFIFSQKCFNLTTVPDIVSTSGKAAASGAVSKDALIAELKDTCKVLEATIKATTEKKMELERLIKRLSDSGIDVGEAAEAEEEAAEEEEEAAEEEEDAAEDTESDDDDSEATP

SEQ ID NO: 133733 - protein, 112 aa, Glycine max
  Coding DNA Sequence Number=SeqID_16955
  Gene Ontology: Mol. function=protein serine/threonine kinase activity; Cellular component=oxygen evolving complex; Biological process=protein amino acid phosphorylation
  Homolog annotation: Hit_ID=Q1SS72; Match level="QueryCoverage=99%, HitCoverage=9%, E-value=9e-25, Identity=47%"; Hit description =Integrase, catalytic region
  Subcellular localization annotation: CTP_CleavageSite=26; ConfidenceScore=5.05e-01
MELPKGYNSIDKNLVCKLNKSLYGLRQASRQWFCKFSTTLIANGFSQSKNNYSLFTIGKGASLAKLQALFKLKILGPLKYFLGLEIAKSSKGIILTQRKYAFSLLEDTDFLG

SEQ ID NO: 133734 - protein, 270 aa, Glycine max
  Coding DNA Sequence Number=SeqID_16956
  Gene Ontology: Mol. function=nucleic acid binding; Cellular component= beta-galactosidase complex; Biological process=DNA integration
  Pfam annotation: Domain name=rve; Domain location=1-122; Score=56.9; E_value=6.5e-14; Accession=PF00665.16; Description=Integrase core domain
MVFLLKNKSEAPTVIMRFFAMLKTQFATSIKCLRSDNAKELALTDFLASQGTLHQFSCVERPQQNSVVERKHQHLLNVARALFFQSKVPISFWGECVVTAVFLINRLHSPLLKQNTPFQVLHGSAPDYSILRSFGCLAFAATLASERNKFSPRAVLSVFVGYPQGVKGYRLYNLHTRKFYVSRDLVFHKSIFPFQTLPNSSQEPGFLNELAISLPIPESITSNIQPRAIEPNTSEPDHLISSTQIICLFSYMILQLIIPLVHHLHCLLLH

SEQ ID NO: 133735 - protein, 228 aa, Glycine max
  Coding DNA Sequence Number=SeqID_16957
  Gene Ontology: Mol. function=enzyme inhibitor activity; Cellular component=cell wall; Biological process=cell wall modification
  Homolog annotation: Hit_ID=Q9FHN2; Match level="QueryCoverage=82%, HitCoverage=96%, E-value=1e-26, Identity=34%"; Hit description =Ripening-related protein-like
  Pfam annotation: Domain name=PMEI; Domain location=65-222; Score =148.2; E_value=2.2e-41; Accession=PF04043.6; Description=Plant invertasepectin methylesterase inhibitor
MEANTLKLASYKVFTIVAFILLAKFNIISACENSPIPTNSTLTKIDYTATNYGNTTIPSESNYTQTFKSYIKASCNSTTYPSICYKTLFPYATKIEADPLKLCNVSLSLALKAAKSASSTISKILKKNNLTKIAEQVVQDCFGNVKDSIGELKDSLDAMGHLDGVDRKFQISNIKTWVSASITNDQTCSDGFDEMNVDSTLTDKIRKIVLDVARKTSNALYFINNNVY

SEQ ID NO: 133736 - protein, 240 aa, Glycine max
  Coding DNA Sequence Number=SeqID_16958
  Homolog annotation: Hit_ID=Q1T4P3; Match level="QueryCoverage=46%, HitCoverage=16%, E-value=5e-08, Identity=33%"; Hit description=IMP dehydrogenase/GMP reductase
DAGFMHKLQILTPYRGVRYPLKEYSARGQKIPKELFNRRHASLGNVSVLMVVGHHKVIQTVHALNKAGYTDITKSRVKNRLKTLKDRWREVHDLFNGLTGFAWNPVTNKFEAEEEVWAELIKDALSPSKILGSMIRENLMIDLNDVMNDSTVNDAGMGNFEGTSTSRGTKRKAPMIEALDAQMEKLSTSFHLVADTINSSNTLSEKLTNVAERKVTIVEQQVVIAQRSMLALEKRNDIMY

SEQ ID NO: 133737 - protein, 175 aa, Glycine max
  Coding DNA Sequence Number=SeqID_16959
  Gene Ontology: Mol. function=sequence-specific DNA binding; Cellular component=nucleus; Biological process=regulation of transcription, DNA-dependent
  Homolog annotation: Hit_ID=Q537G9; Match level="QueryCoverage=37%, HitCoverage=26%, E-value=1e-22, Identity=80%"; Hit description=MPP3
  Pfam annotation: Domain name=SRF-TF; Domain location=9-59; Score =102.6; E_value=1.2e-27; Accession=PF00319.9; Description=SRF-type transcription factor (DNA-binding and dimerisation domain)
MTRAKIKIKKIDNITARQVTFSKRRRGLFKKAEELSVLCDAEVGLIVFSSTGKLFDYSNARIHDVGYNVQDILPENTGVAESIEVAGSTMSDTMSRTSCPKILELLKALKLQDPRCRIRCPGHLARKYWTYKSVISLTDYCAIFRKNDRSHPAQDVAAQISTLLYNHGGCTSFEP

SEQ ID NO: 133738 - protein, 68 aa, Glycine max
  Coding DNA Sequence Number=SeqID_16960
MAIEGFTMRGGVKERKGVNETPRRGGSVVVQTWAWAFVVSLSAKPRAQRHVALSACPALSALLDLGCF

SEQ ID NO: 133739 - protein, 142 aa, Glycine max
  Coding DNA Sequence Number=SeqID_16961
  Pfam annotation: Domain name=zf-CCHC; Domain location=43-60; Score =23.9; E_value=0.00011; Accession=PF00098.13; Description=Zinc knuckle
MEAQTKMINAFISRKMWKKRGGLDWKGSKKPHRERKDKDKRSNICYECKKPGHFKSECLDLDKSTPKKGYEKNLKLSNDKLEQYKVLQKQPQGVITLHQEIEFLRETLSKFFRSTKKLYPNAQLTNLEMDIKERSMIMMRKP

SEQ ID NO: 133740 - protein, 69 aa, Glycine max
  Coding DNA Sequence Number=SeqID_16962
  Subcellular localization annotation: CTP_CleavageSite=52; ConfidenceScore=5.31e-01
MKFVQFQLISGVKRASIAKRSFSAPEESGRVSISRSCAKRKISALSSNPLTRAKCEGGAKRNIAGSEPI

SEQ ID NO: 133741 - protein, 93 aa, Glycine max
  Coding DNA Sequence Number=SeqID_16963
MAEIKEGSSTKPHSHCFTKAQVFSPITSRKDHQPTFAFHLMSYNNKHTKLNPKDFLGCDAILPPMVFDRKIQEDWARATKEGSRVLMNLRVDF

SEQ ID NO: 133742 - protein, 184 aa, Glycine max
  Coding DNA Sequence Number=SeqID_16964
  Gene Ontology: Cellular component=integral to membrane; Biological process=transport
  Homolog annotation: Hit_ID=P0AA70; Match level="QueryCoverage=91%, HitCoverage=55%, E-value=7e-76, Identity=83%"; Hit description=Inner membrane transport protein yedA
  Pfam annotation: Domain name=DUF6; Domain location=59-184; Score =64.6; E_value=3.2e-16; Accession=PF00892.11; Description=Integral membrane protein DUF6
MVATVPLFTLCFSRFFGIATRKLEWFGIAIGLAGIVMLNSGGNLSGNPWGALLILIGSLSWAFGSVYGSRIELPTGMMAGAIEMLAAGIVLSAASWFSGEKLTQMPSWSGIFAVAYLAIFGSLIAINAYMYLIRNVTPAVATSYAYVNPVVAVLLGTGFGGESLSFIEWLALAVIIFAVVLVTL

SEQ ID NO: 133743 - protein, 81 aa, Glycine max
  Coding DNA Sequence Number=SeqID_16965
MGLRIRFDGGGCMNSARQSIRGAPDSMAINSWGSRLDGGGCMNGNKFIGLRLRFDGGGCMNSARQSIRWAPDAILPRKGIG

SEQ ID NO: 133744 - protein, 189 aa, Glycine max
  Coding DNA Sequence Number=SeqID_16966
  Gene Ontology: Cellular component=membrane
  Pfam annotation: Domain name=MS_channel; Domain location=13-183; Score=-33.1; E_value=0.0005; Accession=PF00924.9; Description =Mechanosensitive ion channel
MTPVMKEIIFDFSNFVRVTLQGIAIAIAIINQIFTNFLSSIMIHATRPFVVNERIQTKIKGYEVTGKVEHVSWWSPTIVRVSDCEAVHIPNHNLSVNVVRNLSKKSHWGIKTHLAISHLDVNKINSIIAYMRKVLAKNPQVEQKKLHIRVFLENIDPENQALMVDDISFLFIGFFKIHPEMLLEAWCLE

SEQ ID NO: 133745 - protein, 250 aa, Glycine max
  Coding DNA Sequence Number=SeqID_16967
  Gene Ontology: Mol. function=nucleotide binding
  Homolog annotation: Hit_ID=Q949J8; Match level="QueryCoverage=84%, HitCoverage=44%, E-value=2e-95, Identity=78%"; Hit description =Putative auxin growth promotor protein
  Pfam annotation: Domain name=DUF246; Domain location=1-214; Score =126.5; E_value=7.4e-35; Accession=PF03138.5; Description=Plant protein family
MAQQSRVVYLELARRTREDLAIHRDSRHAAGVEIKLGGLDMAAHSACDFGGGKAEKLALVKYRQVLWQGRVLNSQFTDEELRNQGRCPLTPEEIGLLLAALGFNNRTRLYLASHKVYGGEARLATLSKLFPLMEDKKSLVSTEEMAKVKGKASLLAAVDYYVSMQSDIFISASPGNMHNALAANRAYMNLKTIRPSMGLLGQLFQNKSIGWSEFQRAILDGHKNRQGQIRLRKEKQSIYTYPAPDCMCRA

SEQ ID NO: 133746 - protein, 199 aa, Glycine max
  Coding DNA Sequence Number=SeqID_16968
  Gene Ontology: Mol. function=peptidyl-prolyl cis-trans isomerase activity; Cellular component=membrane; Biological process=protein folding
  Homolog annotation: Hit_ID=O49605; Match level="QueryCoverage=63%, HitCoverage=56%, E-value=5e-59, Identity=84%"; Hit description =Peptidyl-prolyl cis-trans isomerase
  Pfam annotation: Domain name=Pro_isomerase; Domain location=40-181; Score=220.3; E_value=4.3e-63; Accession=PF00160.11; Description =Cyclophilin type peptidyl-prolyl cis-
MVSEPSGLVLHYSAIELLLRTLVVEIIEEKPEEEPEITHRVFLDIDIDKQRLGRIVIGLYGKVVPKTVENFRALCTGEKGKSENGIKLHYKGTPFHRIISGFVIQGGDIVHHDGKGSESIYGGTFPDDNFKIKHSHAGVVSMANSGPDSNGSQFFFTTVKARWLNITYFRRKVIILRKHRLHNNNIKMENESNNNASKS

SEQ ID NO: 133747 - protein, 79 aa, Glycine max
  Coding DNA Sequence Number=SeqID_16969
MLMEDNRTGRFSLLTTPHSTLCVHKMLPQKSRPYQSWGLINICIDRDLAKGYVMMVLSVDLIIFLYQPVKQREAFCGVI

SEQ ID NO: 133748 - protein, 481 aa, Glycine max
  Coding DNA Sequence Number=SeqID_16970
  Homolog annotation: Hit_ID=Q011H5; Match level="QueryCoverage=48%, HitCoverage=26%, E-value=2e-32, Identity=31%"; Hit description=[I] KOG1362 Choline transporter-like protein
  Pfam annotation: Domain name=C4dic_mal_tran; Domain location=111-321; Score=-77.7; E_value=0.013; Accession=PF03595.8; Description=C4 -dicarboxylate transportermalic acid transport protein
  Pfam annotation: Domain name=DUF580; Domain location=206-481; Score =52.0; E_value=2e-12; Accession=PF04515.3; Description=Protein of unknown function, DUF580
  Pfam module annotation: Pfam domain module=C4dic_mal_tran::DUF580; Domain location=111-321::206-481
MGSSEDPNNKVDFPYESPASQPFLSKPSYPSSSSSAVEEESESNQQFHHITYNSGPRSFKDLPFLILFLLFVLSSFAFGIFAIIHRNNSYPSLSSFTYDPTTTSCVLNPSNSSSSSSVSTLSLVDTTSSVSPKLVKGLIWTLVITFVLSVPLCWALLLLLKHYTKQIVYAAIPLFIAIPVFLNVYWFVACTLGASCSNAFPLAYRVLILVFLFLVIGIIVWILVVNWHRVELTVSIIGVASHALSRNMALFGVLPCLSVGLVLYFVPIVVFMVFARFNGKIVVKNLKSGYDCEWKEDSWVPAYYALAVLTMLWSAAAMVEAQVYVISGTIANWYFSKEHQTPKRSIRTPLRNVFGPSSGTICLSGLLVCVVRMVRSAVDSARQEDTPGIVNLVLRCCVNALLTAVDFLNKFTINFAAITGEAYCSSARMTYELLRRNLLSAVFVETISSRILAGIVFVFSASYTIVVRGVSMTLFNACTLH

SEQ ID NO: 133749 - protein, 101 aa, Glycine max
  Coding DNA Sequence Number=SeqID_16971
MVQFVQWEQKFWGASSGGSFHLVSERALVRYPIVDSSYGGGLLLAVLKLDNIQALVRTVKLNQLGIEGSIEFVDAYGSNMHGPVWKWSRRDGSDLGVGSGG

SEQ ID NO: 133750 - protein, 71 aa, Glycine max
  Coding DNA Sequence Number=SeqID_16972
MESVFCQRRNYRKTTFPLTMLTFYLLFFLEHRIYEEFSSSNMRTLQHFGGMAVESSSSLGMEIRKMVNSNL

SEQ ID NO: 133751 - protein, 101 aa, Glycine max
  Coding DNA Sequence Number=SeqID_16973
MSYINKKSINGVGRKSPKKIDKTNAFVVELWGLYEEYQWWERGSVAGGHLIQEIQNLLKIGMRYSLKHIYREANACADALANMTTGLEVVFVMFEQQPFLN

SEQ ID NO: 133752 - protein, 244 aa, Glycine max
  Coding DNA Sequence Number=SeqID_16974
  Homolog annotation: Hit_ID=Q1T1F7; Match level="QueryCoverage=36%, HitCoverage=24%, E-value=1e-10, Identity=36%"; Hit description=IMP dehydrogenase/GMP reductase
  Pfam annotation: Domain name=DUF1723; Domain location=70-119; Score =27.9; E_value=3.7e-05; Accession=PF08330.1; Description=Protein of unknown function (DUF1723)
STTSARRQRAIAAVAVDVYRVDHATDKGFIGEPHDTSVLTSYVDHVAARVWAEEEHTELKLASYGRKEEKFGRSALEIEGIRWHKETSSFHLPIRELTITLDEVACLLHLPITGAFHTLDAIVVDEAVNLLVELLEHFPTIASIIADEDYHERKPHACHWKSRKALPMTTYHKSLDKLTPDFVCWIPYAYYMEWFYRISHPFMSPTQLGDPPRHPHVVHHDTFIVPDPPQELIHAAAMSQPPAP

SEQ ID NO: 133753 - protein, 515 aa, Glycine max
  Coding DNA Sequence Number=SeqID_16975
  Gene Ontology: Mol. function=microtubule motor activity; Cellular component=microtubule associated complex; Biological process =microtubule-based movement
  Homolog annotation: Hit_ID=Q9FME7; Match level="QueryCoverage=98%, HitCoverage=39%, E-value=0.0, Identity=73%"; Hit description=Kinesin- like protein
  Pfam annotation: Domain name=Kinesin; Domain location=11-343; Score =506.0; E_value=4.2e-149; Accession=PF00225.13; Description=Kinesin motor domain
MESECVRVAVNIRPLITSELLLGCTDCISVVPGEPQVQIGSHSFTFDNVYGSTGLPSSAIYDDCVAPLVDALFHGYNATVLAYGQTGSGKTYTMGTNYNGDGSSDGIIPKVLETIFNKVKATNDSTEFLIRVSFIEIFKEEVFDLLDPNSSKGEVMAKVAAPARVPIQIRENVNGGITLAGVTEADVKTKEEMASYLSSGSLSRATGSTNMNSQSSRSHAIFTITMEQKKGDGILCAKLHLVDLAGSERVKRTGADGLRLKEGIHINKGLLALGNVISALGDEKKRKEGGHVPYRDSKLTRLLQDSLGGNSKTVMIACVSPADTNAEETLNTLKYANRARNIQNKAVINRDPVAAQVQTMKNQIEQLQAELLFYKGDTSGPIEELQILKHKISLLEASNSELQHELKRRQVTSESLAQCALDAQVEKDQLILKIESIRNGKSWDEIDSNSNQDYDLLKSYVSKIQNLEGELLCLKTSNATNPSRFVDCAGSDDDGYGSKHALFARGNDGYGSKIF

SEQ ID NO: 133754 - protein, 204 aa, Glycine max
  Coding DNA Sequence Number=SeqID_16976
  Homolog annotation: Hit_ID=Q2PGX7; Match level="QueryCoverage=40%, HitCoverage=25%, E-value=2e-21, Identity=55%"; Hit description =Putative fasciclin-like arabinogalactan protein
MSHSDWTINKCVILTKCDPIRGENLTDLDYEVVIRVDDANEVGGSRGGADGLVHCGGEGSVVGDLVELLGTEVVVEEDVEGEGVFDSVDGKVLREKGEVVVEGGELRVLCEDVGDVVRIEGGGEEEQRRREQCLKELHYGSYQQPQVIQWNAPPEEQFKLNCDGAVDNNGIAAAVEGAELCVVVIGVNLDVLMGSGFFIHVLVD

SEQ ID NO: 133755 - protein, 81 aa, Glycine max
  Coding DNA Sequence Number=SeqID_16977
MDFLHACTIRIGFNKVKKQTQTGLMTRRRVGMKDECKKNNGGDGWTRGASRRGRKHQWCHGVAGEKEVYGSSTANSHVEPC

SEQ ID NO: 133756 - protein, 760 aa, Glycine max
  Coding DNA Sequence Number=SeqID_16978
  Gene Ontology: Mol. function=microtubule motor activity; Cellular component=microtubule associated complex; Biological process =microtubule-based movement
  Homolog annotation: Hit_ID=Q9FME7; Match level="QueryCoverage=97%, HitCoverage=57%, E-value=1e-143, Identity=42%"; Hit description =Kinesin-like protein
MFDTSVNYNGTVLTNGKLLKLATTSQAEMKLYSNSDASVLRHHYEKKLLEMEQEKKMLQKEIEELKSILANISSTSDDGALKLKQDYLQKLNALEAQVSELKKKQDAQAQLMRQKHKSDEFAKGLQDEIQRIKAQKVQLQNKIKQESEQFRLWKASREKEVLQLKKEGRRNEYEMRKLLALNQRQKMVLQRKTEEASLATKRLKELLESRKASSRETMGVGGGNGPGVQAFMKAIENEIEVNVRVHEVRSECERQKEVRAKMAEEMMRLKEEAQMVNQNSTSDCPTSMSPGARNSRIFALQNMLSTSSATLVSMLSQLSEAEELERVFSGKGRWNQVRSLADAKNVMNYLFNIASSSRCSLRDKEVICREKDTEIRDLKEKVVGLSYSLRQLDMIKAELTHKLKLQSEALKRYSEYVGDSEYSDLNVGVHKYDLRKSEYHRSTHLLEDMDISKTESDDYDLTDDEWEESGKLRVRKRKSKTRRTGMENNQSNINNSEYFQKKSGDILVDTPGETASDICCSCSRTSSCKTTKCKCKAMGNSCGSSCSCLSTKCANRASISNESQEPTQSASIEETDLLVTQGAELIQGALVDRLDEINSDRGHRKPLSDIGNTQAKSNAKNGNPKKKTATVIIVPNPPPSSQAENTEVPIPIHNRKFKFRKENNNSETSVAVNKPRHKRSKSRPENAASAPRAEGNFVDPDEPLKMPGAFRRAASSNSSGVPFWNRNAAGNNNSDEPEVFETRNPLRQKRTLDEKENNRR

SEQ ID NO: 133757 - protein, 584 aa, Glycine max
  Coding DNA Sequence Number=SeqID_16979
  Gene Ontology: Mol. function=phosphotransferase activity, alcohol group as acceptor; Cellular component=phosphoinositide 3-kinase complex; Biological process=protein amino acid phosphorylation
  Homolog annotation: Hit_ID=P42347; Match level="QueryCoverage=96%, HitCoverage=76%, E-value=0.0, Identity=97%"; Hit description =Phosphatidylinositol 3-kinase, root isoform
  Pfam annotation: Domain name=PI3K_C2; Domain location=48-190; Score =220.8; E_value=3.1e-63; Accession=PF00792.14; Description=C2 domain
  Pfam annotation: Domain name=PI3Ka; Domain location=275-459; Score =352.5; E_value=7.1e-103; Accession=PF00613.10; Description =Phosphoinositide 3-kinase family, accessory domain (PIK domain)
  Pfam module annotation: Pfam domain module=PI3K_C2::PI3Ka; Domain location=48-190::275-459
MTGNEFRFFLSCDISVPVTFRVERLEGNLPLPNPKSPDLETNAPTENRTKELFVECALYIDGAPFGLPMRTRLESSGPSYCWNELITLTTKYRDLTAQSQLTFTVWDLSHGEGLIGGATILLFNNKKQLKTGKQKLRLWAGKEADGTFPTSTPGKVPRHERGELERLEKLVNKYERGQIQRVDWLDRLTFKTMERIKERESLKNGSSHLYLVVDFCSFEHRVVFQESGANFLFPSPIASTNDIVVVWDPEVGKINPSEHKQLKLARSLTRGVIDRDLKPSSNERKSIQRILKYPPTRTLSGDERQLLWKFRFSLMSEKRALTKFLRCVEWSDVQEAKQALELMGKWEMIDVCDALELLSPVFESEEVRAYAVSVLERADDEELQCYLLQLVQALRFERSDKSRLSHFLVQRALRNIELASFLRWYVAVELYDPAYAKRFYCTYEILEENMMKIAAGVNGEEDGFKQWQSLVRQTELTAQLCSITREVRNVRGNTQKKIEKLRQLLSGLLSELTYFDEVVQMVSLMDRLLKLENLDLHLTPYKVLATGQDEGMLEFIPSRSLAQLRELGREEEIEKINIIQPNCN

SEQ ID NO: 133758 - protein, 149 aa, Glycine max
  Coding DNA Sequence Number=SeqID_16980
  Homolog annotation: Hit_ID=Q1S4N1; Match level="QueryCoverage=32%, HitCoverage=3%, E-value=4e-09, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
IVGEQKCLTKDAGDKDILKVKMKGKSFVLNPLEDEQIAFSVKKNNTKLWDKKPKVDEDQPSSEIAALTSWNGAAEARLPPAKGQEKSALEKVAIVQKHTNKKTQLSEKAAKIEHNEKCLKFLTKNLNAENVKAQSHEKEAIVFQHCKSA

SEQ ID NO: 133759 - protein, 208 aa, Glycine max
  Coding DNA Sequence Number=SeqID_16981
  Gene Ontology: Mol. function=metal ion binding; Cellular component =nucleus; Biological process=multicellular organismal development
  Homolog annotation: Hit_ID=Q9LDT3; Match level="QueryCoverage=99%, HitCoverage=81%, E-value=5e-42, Identity=49%"; Hit description=Axial regulator YABBY4
  Pfam annotation: Domain name=YABBY; Domain location=1-160; Score =150.6; E_value=4.2e-42; Accession=PF04690.4; Description=YABBY protein
MVVTVRCGHCTSLFSVNMSKASFIPFHLLASLSHLEVMGYYLAISIFISFGILSQNAFVTVSTLQPKESSPEEDANKTLNSHSASMMTYSDCEEEDVIPMSHHVVNKPPEKRQRTPSAYNCFIKKEIKRLKAENPDMAHKEAFSTAAKNWANFPQTQWCRGDEESCSQTDQLVNSQVDPPDAEVNEEGQGFRGRKVPRNSILERTQFE

SEQ ID NO: 133760 - protein, 982 aa, Glycine max
  Coding DNA Sequence Number=SeqID_16982
  Gene Ontology: Mol. function=kinase activity
  Homolog annotation: Hit_ID=Q94CG5; Match level="QueryCoverage=98%, HitCoverage=99%, E-value=1e-151, Identity=35%"; Hit description =Kinase interacting protein 1
  Pfam annotation: Domain name=KIP1; Domain location=11-84; Score =140.0; E_value=6.2e-39; Accession=PF07765.3; Description=KIP1-like protein
MLGRAATNAYSWWWASHIRTKQSKWLEQSLRDMEDVMAETLNIIHNEGESFSQRAEMYYRKRPQLVGYVEEVFRSYRALAERYDLLSKELQSANHTIAIVFPEQVHYRIDEDDAEESFPGTNSSSQDPNNQTPKPGIPKAPNFPNKDFRSPSMLLSRKGPLRRVSSPAKSPPTSPSSGLSKAEALAEVDKLQKEILALQTEKEFVRSLYENSYEKHWEIEDQITQMQKRVCSLQDEFGINTFIEDNDARALMAATALKSCKETLAKLQEAQAQSSEEAKESYQMVKEAHSKFETLRDLFISKHKSQQDQVTEPKSIEEEDMSSLEEEIYEHDVGRLQDTIKEKLEGDSVSSLTMTEMAEKIDELVNKVVTLETTVSSQTGLVKRLRSEADELQKKLLSLEEDKEVLIEDSEGTKKKLEEVEEELKRVKTLNQSVKRQDNSLQTQFTEASCDLKHLSGKLNDVKLDEEGENLQLHKNKSAHDGELKEESEKPGDNTETMKDIETTKEEKEDCSVNLSDVENEDNKSNSKENVDFRTEEIPEQMLQNKDDLSEARSNLDTESLDQETGEEENQSNRSQMIASGFDDREKILKEFTSVLKNYEDVKDELNDVVKKNQDSIFQLALQKLYTRHYITSSPQNVDLHLQVRELKDTVETKDQEINILQQKLTCSETNPDESPCTPVTDYKYTPQEALLGTAAQGTDPQDPENPSSNTDAIAVSTSYAGKHQQYVENKGRIGILVKVRPNQLDKSHSLSTLEKKFRSNIDDLLEENLEFWLRFSTSVHQVQKFQSSIEDLKFELKRIRDNMFQENSSSIQSEIKPIFRHLREIRTDLSLWLEHSEVLHEELQGRHPSLCTLQDEIARTANPNPASNNMAKLSGYQAAKFQGEVLNMKQESNKVSSELQGCVSFVKELKGQVEKMLEELSQEIGVNNHDHMKHSTSSSRIPLKSFLFGIKLKKQKQSFLSCVTPTKRQHRNLAAAEDAPI

SEQ ID NO: 133761 - protein, 157 aa, Glycine max
  Coding DNA Sequence Number=SeqID_16983
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=62%, HitCoverage=28%, E-value=8e-49, Identity=94%"; Hit description =Photosystem II D2 protein (Photosystem Q(A) protein)
MVTANRFWSQIFGVAFSNKRWLHVVMLFVPVTGLWMSALGVVDLALNLRAYDFVSQEIRAAEDPEFETFYINNILLNEGIRAWMAAQDQPHENLIFPEEDVFLVLNLMILIGIGWLEPHGTGFSSDDDVETDEEDNNFAVLVPCYGCNHGAMVEKDI

SEQ ID NO: 133762 - protein, 85 aa, Glycine max
  Coding DNA Sequence Number=SeqID_16984
MLSVPSSNSKLYGCAKNRGADTTKFKEGHHKALLPQRLCIRKKGRKEDDLEAAGVLHDDTTGVLHDTTNLERQSLRAQQYSGSAG

SEQ ID NO: 133763 - protein, 59 aa, Glycine max
  Coding DNA Sequence Number=SeqID_16985
MMQSYPGGALDRRLQEDWARDARDGPRILMSLRTKKLCKLDPSSAPTFASWLLPYLTLT

SEQ ID NO: 133764 - protein, 69 aa, Glycine max
  Coding DNA Sequence Number=SeqID_16986
  Gene Ontology: Mol. function=structural constituent of ribosome; Cellular component=ribonucleoprotein complex; Biological process =translation
  Homolog annotation: Hit_ID=Q3BAP2; Match level="QueryCoverage=58%, HitCoverage=41%, E-value=1e-14, Identity=87%"; Hit description =Ribosomal protein S14
  Pfam annotation: Domain name=Ribosomal_S14; Domain location=5-55; Score=48.2; E_value=2.8e-11; Accession=PF00253.11; Description =Ribosomal protein S14pS29e
MENSWKIRITPRNSAPIRLHRRCFSTGRPRANYRDFGLSGHILREMSNLVARKAHNLEVTGSNPVSATF

SEQ ID NO: 133765 - protein, 301 aa, Glycine max
  Coding DNA Sequence Number=SeqID_16987
  Gene Ontology: Cellular component=nucleus
  Homolog annotation: Hit_ID=Q9FLH0; Match level="QueryCoverage=82%, HitCoverage=27%, E-value=2e-50, Identity=39%"; Hit description =Putative nuclear matrix constituent protein 1-like protein
MEEKSEGYNHYSTDGGGVTGVAGVETGCGLVSTNAGYVTEEAELAARKTNFEVEPQIQLKLVENEIEIQRWAWELKEVDLTQREKQLQEREHELEILLTTLDKEEINKTKLDVQMSLVSLENNLSQFDNANERHEALKSETNDLSVLEVKLKEEIDGVQSQKLETVAEADKLKVEKPKFEAQWELLHEKKEELWKEAEYIAEEKKAVLAFIKKDCDKLRQEKENMCDQYKRDLESLTCEREEFMNKMAHEHDDWFGNMQQERANFLRDVEMQNRNMNILIDKRREEIEKPIWFLDSATHLV

SEQ ID NO: 133766 - protein, 66 aa, Glycine max
  Coding DNA Sequence Number=SeqID_16988
  Homolog annotation: Hit_ID=Q1SE16; Match level="QueryCoverage=68%, HitCoverage=9%, E-value=3e-13, Identity=80%"; Hit description=Amino acid/polyamine transporter II
MFGEAILSQFTLNMPKELVATKIVVWTTVVNPFTKYPLYIRACMSLYIPWKMSFNIRNDFVSILHL

SEQ ID NO: 133767 - protein, 158 aa, Glycine max
  Coding DNA Sequence Number=SeqID_16989
  Homolog annotation: Hit_ID=Q9FNT0; Match level="QueryCoverage=23%, HitCoverage=14%, E-value=8e-09, Identity=75%"; Hit description=Alpha- expansin
SNFYGCVDRGRPHMTDKCPNFKLPTSWCHIEACHSSAITGGDLKREGFSIELRVDLTVDQTQKVFDRILTKLGRTAPPVLGTTTKVMFYDTISKAPNQVVPKIWRACVGAAVHMEHASPSHYLSPLIRGATRRVTAEAMARASTVQTSSSSVTRVLFR

SEQ ID NO: 133768 - protein, 133 aa, Glycine max
  Coding DNA Sequence Number=SeqID_16990
MTLRSHFQGPVRPGLKDLRAHLLLLPLLLLHQLPYHHQYQLLLAPPLRSIHALAQHWPIMSMEEFSAQVAWQGVQPSSFGGGEASTAQEPQPEPEVAAQEADPEAASAAQEDIAEATPQASPVTTPVLELSTP

SEQ ID NO: 133769 - protein, 102 aa, Glycine max
  Coding DNA Sequence Number=SeqID_16991
MRLSLLRDQGQSLKRVRLIYLRNHGEKLEGAAAGVSLSEGYALNEYHLLSETSARLASKKNLEENLPRKHALSAPSARPASHLSLPALCAPGSLSQKSLTRA

SEQ ID NO: 133770 - protein, 83 aa, Glycine max
  Coding DNA Sequence Number=SeqID_16992
MVLFIGEKLEGAAAGVSLSNGHALSEYHPLSETSACLACKKNLEENLSCKHALSTPSARPASHLSLPALSVLDSPSQKSLTRA

SEQ ID NO: 133771 - protein, 168 aa, Glycine max
  Coding DNA Sequence Number=SeqID_16993
MEALSSSKTQPKTKEKSGIEENTKMKKKEWKRRKQIGGEMTQMKEVGLKLDLQGKASVLQVEELKNSEVQEIPSFHKLQYTFMSMERVVTHWFYIWGQKNPDLDCESFSTTLIKRFKDSYGSHVFERLTTLKQEEQIETETHIEERETSTLFLKERTNDVPELKKMLQ

SEQ ID NO: 133772 - protein, 134 aa, Glycine max
  Coding DNA Sequence Number=SeqID_16994
  Homolog annotation: Hit_ID=Q03091; Match level="QueryCoverage=36%, HitCoverage=16%, E-value=8e-11, Identity=63%"; Hit description =Extracellular ribonuclease precursor
MGLLSTLLKWIEVDPPSRDEKLRNERICKFYQHNRNPFVDHPEYANLIWKQPIFLKTVSLIGWTGYEEHAAALAEGQPAPALCSSGDVRDLNMEDFKYAHQQGVAYDISVIQICHHEQVRATTGFEEVFLSFFT

SEQ ID NO: 133773 - protein, 140 aa, Glycine max
  Coding DNA Sequence Number=SeqID_16995
MTGRLLAGSLTFDCRIMHYIIIRILLPRSSNLAQASEEGLILMWAFLTGRSIDWDHLVRYRMHKALWANAPLPYPQLVTLFLRHFQIPLDDEPFVQVKRSFAIGAGAVTSFGYRKDRDGQWLKKDALPPQDERTPSPPPQ

SEQ ID NO: 133774 - protein, 72 aa, Glycine max
  Coding DNA Sequence Number=SeqID_16996
  Gene Ontology: Mol. function=intracellular transporter activity; Cellular component=endoplasmic reticulum; Biological process =intracellular protein transport
  Homolog annotation: Hit_ID=Q9SPE5; Match level="QueryCoverage=89%, HitCoverage=22%, E-value=5e-21, Identity=72%"; Hit description=Gamma- soluble NSF attachment protein
MAASDPDKLMVKADKLTRLSLTRWSADWKSATVLYEQAANGFRVAKDYENAKIAYEKASKGQEMLSSYPYMI

SEQ ID NO: 133775 - protein, 186 aa, Glycine max
  Coding DNA Sequence Number=SeqID_16997
  Gene Ontology: Mol. function=nucleic acid binding
  Homolog annotation: Hit_ID=Q1T6D0; Match level="QueryCoverage=80%, HitCoverage=28%, E-value=2e-22, Identity=37%"; Hit description=Zinc finger, CCHC-type; Lipocalin
MVKGSNNETLDGGGGNKVSFRDKGMQGKILYGSRPMVDLFKQNLAKIEYKDGNPHTPKVHIHDSVFEGLHAPWQDALVIKLLGKSIAYPILRDKLDRTRKLKVGFDMFDIHNGYFMLNFDHEEDRKKVVTANVISDKVDVYGNVLHAAMHHWIDSKVDTRARYSTSVKERAMAFCLKDFQEIGLPP

SEQ ID NO: 133776 - protein, 248 aa, Glycine max
  Coding DNA Sequence Number=SeqID_16998
  Gene Ontology: Mol. function=DNA binding; Cellular component =mitochondrion; Biological process=DNA integration
  Homolog annotation: Hit_ID=Q2HSG0; Match level="QueryCoverage=99%, HitCoverage=41%, E-value=4e-60, Identity=46%"; Hit description=IMP dehydrogenase/GMP reductase
MAGNNDQAIHRCISTLATVFSIKDLGFIHFFLGVKAIPTTQGLFLSQHKYIHDLLDRTQMADAKKHHRSPSVFVNNKARHSLHSQQARTIHAEPILHTLHNIEKTPSVPKSHTIFHGLHLKHSSSNTFHAFSDVDWAGNRDDYTSTFAHITFYGGNPISWKSFKQKAMARSFTEVEYRALVSASTEVLWLSSFLFELHVCIPTTPAIYCDNLGATYLAVNPVVHSRMKHIAIDIHFVRDHVRSNNLLV

SEQ ID NO: 133777 - protein, 87 aa, Glycine max
  Coding DNA Sequence Number=SeqID_16999
  Gene Ontology: Mol. function=intracellular transporter activity; Cellular component=endoplasmic reticulum; Biological process=ER to Golgi vesicle-mediated transport
  Homolog annotation: Hit_ID=Q9SPE5; Match level="QueryCoverage=72%, HitCoverage=21%, E-value=4e-18, Identity=65%"; Hit description=Gamma- soluble NSF attachment protein
MGINACGVSRIDAFLRSDQNRCASNLLAAYTDGDVEEIKRIAQSSVISHLDHVIIKLARKLPTGDVSSLKANKAEDEEEPLDENDLT

SEQ ID NO: 133778 - protein, 121 aa, Glycine max
  Coding DNA Sequence Number=SeqID_17000
MALCKFGYNLVESVNGGLPCVMFWHGDSRDKGHYRARASCNHQQFPLIDLLAKYPNKIVNAISEWQNVVARLDRKSGIVLADDSVPCHYLDRRNYTKSLRYLGLVEYLLGLLGSRLLSGPV

SEQ ID NO: 133779 - protein, 149 aa, Glycine max
  Coding DNA Sequence Number=SeqID_17001
MTKKFGETINVNFNNGGHNINGDQTVTYPDLNTIIEQQPLQGRYIARDSCNHQQFPLTDLSAKYPNKIVNAITEWQNAAARLDRKSVSLGSIGLKIAIITSIWEKDLVLKVIGGRKIPFPIHYGQCLDDGVISHGKWRSDPGRVGVGPH

SEQ ID NO: 133780 - protein, 528 aa, Glycine max
  Coding DNA Sequence Number=SeqID_17002
  Gene Ontology: Mol. function=nucleic acid binding; Biological process= DNA integration
  Homolog annotation: Hit_ID=Q1T010; Match level="QueryCoverage=99%, HitCoverage=95%, E-value=4e-50, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKAISCFRDVSDIIKSGVQELGAAPTEVQKVAYQENNKKDGKALFIIRQSVDANILEKILDANNAKKVWDILVKSYEVANKFKKYFTRMLTLTNQMKNYGDRIEDAMIVDKILRTLTPRFDHIVVAIEQGTDLEGMKVEELQGILEAQEIRLNERNSLRSSNQALQAQTYKGNSSDQDKNKKGKGNWKKGKNQSEGLNSAPKQQQNSKDNNKNCKDKKVPRNVDETQLAQDEDSNSNNVLLMATTNIKNKNVNLWYLDTGCSNHMTGHKEWYVSIDNKALISDVLYVPNMRNNLLNLGQLLEKGISIQMEDNHMKLFDQSASTAVYILNKIPTKKLQGCTPEEAWSGHKPPPRAWNLRIDNFLVQQKYTKCTIEHGIYIRNRRNDVLIICLYVDDLLITGSNIEDMVEFKKRIMQEFDMTNLDILGRFNISECNPAITPVEIGISLQLEGDEKEVDLTLYKQIVGSLRKQGVVALSTCEVEYIVAAMATCEVVWLEAVMKELNLKMTKFHFLRDHVNKEKFELEFCRS

SEQ ID NO: 133781 - protein, 76 aa, Glycine max
  Coding DNA Sequence Number=SeqID_17003
MTAIKKRERKDKKKPAKADKREGSSKRLKSVPITNGLDTCPSTKGSSVHSSLPKSRVCEYSAERREISTKGTSMLK

SEQ ID NO: 133782 - protein, 366 aa, Glycine max
  Coding DNA Sequence Number=SeqID_17004
  Gene Ontology: Mol. function=protein kinase activity; Cellular component=membrane; Biological process=protein amino acid phosphorylation
  Homolog annotation: Hit_ID=Q1ST94; Match level="QueryCoverage=93%, HitCoverage=73%, E-value=1e-151, Identity=79%"; Hit description =Protein kinase
  Pfam annotation: Domain name=Pkinase; Domain location=67-339; Score =117.2; E_value=4.6e-32; Accession=PF00069.15; Description=Protein kinase domain
  Pfam annotation: Domain name=Pkinase_Tyr; Domain location=67-339; Score=97.5; E_value=4e-26; Accession=PF07714.7; Description=Protein tyrosine kinase
  Pfam module annotation: Pfam domain module=Pkinase::Pkinase_Tyr; Domain location=67-339::67-339
KNGTCEEDSRELHDTSSRLITSTTLNSSPDVKSGCLHGGNLSRTPAPKFRGVQVFTYRELEIATDGFSEANVIGSNGIIGGHGLIYRGVLSDGTLAAIKLLRTEGKQGERAFRIEVDLLSRLHSPHLVELLGYCADQHHRLLIFEYMPNGTLHYHLHTPNDQYQLLDWWARMRIALDCARALEFLHEHAVSPVIHRDFKSNNVLLDQNFRAKVSDFGLAKMGSEKRNGRVLGTTGYLAPEYATGKLTTKSDVYSYGVVLLELLTGRVPVDIKRAPGEHVLVSWALPRLTNREKVIEMVDPALRGQYSKKDLIQIAAIAAMCIQPEADYRPLMTDVVQSLIPLVRNQSSLSSSSSLRFQKQTPSPTH

SEQ ID NO: 133783 - protein, 393 aa, Glycine max
  Coding DNA Sequence Number=SeqID_17005
  Gene Ontology: Mol. function=sequence-specific DNA binding; Cellular component=intracellular; Biological process=DNA repair
  Homolog annotation: Hit_ID=Q1RUW7; Match level="QueryCoverage=95%, HitCoverage=96%, E-value=1e-159, Identity=74%"; Hit description=DNA repair protein rad10, putative
  Pfam annotation: Domain name=HHH; Domain location=261-290; Score =21.6; E_value=0.0029; Accession=PF00633.13; Description=Helix -hairpin-helix motif
  Pfam annotation: Domain name=Rad10; Domain location=101-168; Score =153.0; E_value=7.8e-43; Accession=PF03834.4; Description=DNA repair protein rad10
  Pfam module annotation: Pfam domain module=HHH::Rad10; Domain location=261-290::101-168
MEKQNEEEEEQKKKKKSSVVIRIPSYQEVVESSQAKSTPSSLFVPSQTFSEAFAFVKSSDFYSPPPKSRETGQSDAPSSTSTPSPATAAASSTIPSSQNRNSILVSHRQKGNPLLKHIRNVRWAFADVVCDYMLGQSSCALYLSLRYHLLHPDYLYYRIRELQKNFKLRVVLCHVDVEDVIKPLLEVTKTAMLHDCTLLCGWSLEECGRYLETIKVYENKPADIIQGQMDTDYLSRLTHSLTTVRHVNKTDVVTLGTTFGSLSNIMGASMEDLARCPGIGERKVKRLFDTFHEPFKRVESSRQAIPETSVQNKPASPESSIRNKAESSSLIEDKQEDTEDVSKRRKKEPEVTVKSALSAAFAKYSGRVGKRKSTSQVEEKEESIISKESEAET

SEQ ID NO: 133784 - protein, 316 aa, Glycine max
  Coding DNA Sequence Number=SeqID_17006
  Subcellular localization annotation: CTP_CleavageSite=24; ConfidenceScore=5.12e-01
MVAVKPSTSVKNQAQIRNTTEKVSSSLVPPQQPSQQALLGSSDLHAKSKLADEKPVLKGNLISDHVVKSATATLGTRVDPLSNTISQIKVAQVKNATDTKPAVSSLTKPSISTNLPSDPKNKHVTSLADKGAQVKHAVDTKPAVSSLIKPSISTNLPSDPKNKHVTPLADKVPLKQVVNPTKELKVSDPSTTPKEKVQENEPPKVTTGSQVDSSLEKGRFEKGLETSTPLVKISCGEEVSKDKANPVVVCEEQGSVKKATENNNIDKGSQNLDHDKKIDSINQSSNDQNANDKHVNLPVQDELSLSAKVVKSDGEC

SEQ ID NO: 133785 - protein, 96 aa, Glycine max
  Coding DNA Sequence Number=SeqID_17007
MEPQRSHYREITKIILEFMTAGEFSCEVGTDGKVLISGVTTTGENTVSRSCHEREMYMMAKFCPIRVLPFIPPPPGTNEGYYKLMQNVKWIWFCFD

SEQ ID NO: 133786 - protein, 264 aa, Glycine max
  Coding DNA Sequence Number=SeqID_17008
  Gene Ontology: Mol. function=sequence-specific DNA binding; Cellular component=intracellular; Biological process=regulation of transcription, DNA-dependent
  Homolog annotation: Hit_ID=Q1ST82; Match level="QueryCoverage=85%, HitCoverage=92%, E-value=4e-86, Identity=72%"; Hit description =Transcription factor CBF/NF-Y/archaeal histone
  Pfam annotation: Domain name=CBFD_NFYB_HMF; Domain location=104-168; Score=92.7; E_value=1.2e-24; Accession=PF00808.13; Description =Histone-like transcription factor (CBFNF-Y) and archaeal histone
  Pfam annotation: Domain name=Histone; Domain location=98-171; Score =51.8; E_value=2.3e-12; Accession=PF00125.14; Description=Core histone H2AH2BH3H4
  Pfam module annotation: Pfam domain module=CBFD_NFYB_HMF::Histone; Domain location=104-168::98-171
  Subcellular localization annotation: CTP_CleavageSite=45; ConfidenceScore=5.32e-01
MDHQGHGHGHGQNPSMGVVGNGPQFPYGSNPYQASHMTGSPGMVVASPGTIQSTGQPPSTQLGQHQLAYQHMHQQQQQQLRQRLQAFWANQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASMPRGDVPVTGPPEALPYCYMPPQQVGAAGVMMGNKPVMDPYAQQTHPYNMAPQLWPQPPPPPEQQQSSPDQ

SEQ ID NO: 133787 - protein, 146 aa, Glycine max
  Coding DNA Sequence Number=SeqID_17009
  Gene Ontology: Mol. function=signal peptidase activity; Cellular component=signal peptidase complex; Biological process=signal peptide processing
  Homolog annotation: Hit_ID=Q2HTM7; Match level="QueryCoverage=99%, HitCoverage=100%, E-value=5e-65, Identity=71%"; Hit description =Signal peptidase 22 kDa subunit
  Pfam annotation: Domain name=SPC22; Domain location=1-146; Score =197.6; E_value=3e-56; Accession=PF04573.3; Description=Signal peptidase subunit
MHSYGYRVNALLTFAITILAVMSAMASLSDNLNSPTPFVHAQVTNINWFQKQPNGDDEVFVFLAAEYETPKKPLNQISLWDGIIPSKDHAKFWIHTSNKYRFIDQGSNLRGKEFNLTMHWHVMPKTGKMFADKIVMPGYKLPEEYR

SEQ ID NO: 133788 - protein, 589 aa, Glycine max
  Coding DNA Sequence Number=SeqID_17010
  Homolog annotation: Hit_ID=Q1ST83; Match level="QueryCoverage=26%, HitCoverage=25%, E-value=6e-46, Identity=64%"; Hit description=Heavy metal transport/detoxification protein
  Pfam annotation: Domain name=HMA; Domain location=12-73; Score=55.0; E_value=2.4e-13; Accession=PF00403.16; Description=Heavy-metal -associated domain
MSKQDTMKIQNYLLKVNIHCDGCEEKVKKILQKIDGVYSVNIDAERGKVMVSGHVDPAKLLKKLKRSGKHAELWGGQRGMMYNQNYPTYPQFKNMHIDNTKGGSKDNKSQNHKGGAQKGGGGGGGGGGGGQLAHFQNANGGSKVPPKNQKSVNFNLSEDELDESDFDEFDDDYDEFEDDLEEEEEEEEYGNGYGHGGHGHGHGHGHGQQGQGHPMQHNKMMAMMGQVGNGRGPHGMNGPAMNGHKGNGGVNYGGVKKGEVIDLPIQIKGKGGNFNEGKNGKKGNGDGGQKNKGGKQKGGGDNNHHNNGNKKKNSKDKNGGGGFLVRFLGLGKKKKAGGGGGSADTATNKNKNNKGKKDGGGGGGGGGKFDKIDFDFQDFDIPPTKGKNGKGGNNGKNNNDKGHGSNNGNVGHHMGPMGQMGPMVQRGPMNQMGPMDHMRNMNINMPAVQGLPAATAAAAMNGGYYQGMQMQMQQPNPYNMQQQQQQQQLMAMMMNQQQQQQQQANMNMYPPHMMYGRPHPHQHQHPSMNYFPPPPMPSHPMADPITHVFSDENTESCSIITTEVPTTLLKLSPSIYGRAKGFVGPQSTR

SEQ ID NO: 133789 - protein, 78 aa, Glycine max
  Coding DNA Sequence Number=SeqID_17011
MTSIGPVFAYCIGPVIVLDALALVFVPNALATVFVQDALERELSWEENTLQENVLIWNSEKMKRFKRNKENAVGTAKK

SEQ ID NO: 133790 - protein, 322 aa, Glycine max
  Coding DNA Sequence Number=SeqID_17012
MKQSWNCLNLTGLCAPRSDEPVVEDGNWWPGNRGCLVCQEHTCGSGCVHFGDAFGADEKIRGRHSSGYWLTQYSLEKWLANGGCQKTTDSRQQRSEKSLEKLKKLPEKWGLWALRHIDPQSSATVGTEFLKMIPTFDGKEAYFWFGQYFEAIRAYEEEKLSEAVKALRGDALNWARNKYKKATRIGRNPTTSWTKNQKTELKTKFLISRIMVAEMTKMGLFGVAKRRKHGTSWRKRTYHCEPQPSTNLEIKNHDPGGGERSNSEETKETENNNHFDNGRDKKIDQLREKRCDSAEKEATENKRSTDLNMEEEETDWPITERE

SEQ ID NO: 133791 - protein, 94 aa, Glycine max
  Coding DNA Sequence Number=SeqID_17013
  Gene Ontology: Mol. function=DNA binding; Biological process=DNA integration
MEKQTQLHPALLKELDVPFSTPILLYDNQSAVAIAHNPVFHSQTKHIAVQATVYHIPALDQWADVLTKPLSPNRFEFLRGELNVEDFTCRNPPP

SEQ ID NO: 133792 - protein, 253 aa, Glycine max
  Coding DNA Sequence Number=SeqID_17014
  Gene Ontology: Mol. function=DNA binding; Cellular component=nucleus; Biological process=regulation of transcription
  Homolog annotation: Hit_ID=Q6R0D2; Match level="QueryCoverage=95%, HitCoverage=37%, E-value=2e-52, Identity=51%"; Hit description=MYB transcription factor
MPEKKNKKVSFTEEDAVTLMQRYDATTVFTLLQEVAHYPHPKIDWCELVKKSATEISNAREYQMLWRHLAYRHSLPEIFEDGDEPLPHFQDDDSDLECELEAFPPVSVECASEAAACVKVMIASRTLSESAPSSSTIEAPLTINVPVCHSSRTPIENSQPSNLMQGTSIIFPVTVQRQTLPTISSTDGIETKGIVGGNMASKRKRKAWSEEEDMQLRAAVQRWGEGNWATMAKGDDFPIKRSATQLAQVVFKS

SEQ ID NO: 133793 - protein, 223 aa, Glycine max
  Coding DNA Sequence Number=SeqID_17015
MGPPNLQIRNTYFTGPPNLQSFLRKDINSKKRIATKDAESQNLQEKVSSEMIPEEGSSEKSLRGRAFSLIHCLLGAPTILLGARSNSQDTFVAIYLEQTTSSWDMLGAPSNLVNGPFFHLCKNLKKRYSSRKNHALLPAASFLLPVPGTSSSPRDPRARLLRSDAFCLRDAEKNGKSGVVTVACSGRTVKASSETSERRVIRKNLSSGNLPEEGFFRMTFEYS

SEQ ID NO: 133794 - protein, 500 aa, Glycine max
  Coding DNA Sequence Number=SeqID_17016
  Gene Ontology: Mol. function=signal transducer activity; Cellular component=membrane; Biological process=response to light stimulus
  Homolog annotation: Hit_ID=Q1ST79; Match level="QueryCoverage=99%, HitCoverage=88%, E-value=0.0, Identity=67%"; Hit description =BTB/POZ; NPH3
  Pfam annotation: Domain name=BTB; Domain location=47-163; Score=23.3; E_value=3.1e-05; Accession=PF00651.21; Description=BTBPOZ domain
  Pfam annotation: Domain name=NPH3; Domain location=232-470; Score =201.9; E_value=1.5e-57; Accession=PF03000.5; Description=NPH3 family
  Pfam module annotation: Pfam domain module=BTB::NPH3; Domain location= 47-163::232-470
MMKGFQFAGLDKATIGCKTLDCESPFGAKPNRRVLLPSNVPILAHSLEHTQRNWIAWSNSPSDLIIQIGDSSFHLHKLAIASRSEYLNRLVFQRGSNREKAGDSLIIQIKNLPGGKKAFELIVKFCYGRKIDITAANIVPLYCAAHFLEMSEDLEEGNLISKTEAFLTFQLLSSWKDTFRILKSSESISPWAKDLHIVKRCSEAIAWKVFTNLNASSFTFENETPLSNNSVDNWWFKDVSCLRIDHFIEVIQSIRKRGTKPELVGSCIEHWTRKWFSQVTSGLDKETPMPITLQLHRISTEGLINILPSEENSVTCNFLLHLLKAGVMLKINPELLCVLERRVALMLEKCRVPDLLVKNQGYKDSLYDVSVVLRVLRFYVCGMSSNSSAKPHSVGRLVDGYLTQVARDENLTMESFKSLVEALPQKARHCDDNLYRAIDMYLKAHPNLAEENRTDVCRVLEYHRLSHEARQHVMQNDRLPLKLTTEFVLLEQVNMATSMT

SEQ ID NO: 133795 - protein, 649 aa, Glycine max
  Coding DNA Sequence Number=SeqID_17017
  Gene Ontology: Mol. function=protein binding; Biological process =ubiquitin cycle
  Homolog annotation: Hit_ID=Q2HTR2; Match level="QueryCoverage=99%, HitCoverage=64%, E-value=1e-58, Identity=40%"; Hit description =Cyclin-like F-box
  Pfam annotation: Domain name=F-box; Domain location=332-378; Score =25.8; E_value=0.00015; Accession=PF00646.23; Description=F-box domain
  Pfam annotation: Domain name=F-box; Domain location=5-51; Score=22.1; E_value=0.002; Accession=PF00646.23; Description=F-box domain
  Pfam annotation: Domain name=LRR_2; Domain location=196-221; Score =17.1; E_value=0.063; Accession=PF07723.3; Description=Leucine Rich Repeat
  Pfam annotation: Domain name=LRR_2; Domain location=601-625; Score =6.4; E_value=2.1; Accession=PF07723.3; Description=Leucine Rich Repeat
  Pfam module annotation: Pfam domain module=F-box::F-box::LRR_2::LRR _2; Domain location=332-378::5-51::196-221::601-625
MGKAVSIDEIPDECLGCIFQLFSPGERKMFSLVCSRWLKIEGQTYQRLSLTADGLLSIPCTFSRFSSLTELTLINSLSKSIGDEALTLLTHRCCPNLTFFTLHSSIHSDACLENFAMNHKGLKKFSAVSCIFTYKGLKAFMDHCVSLEELRLKYLNSNPNIANADEDGFVTSSSLKALYLEGVDFSILKAISKRSSLEVLHLEMIGMCSDEGLVAVLEGCNLLRELRIRRSYCWEANLMGDKVLIAIVECCPNLQELVLDGLNPSTKASLEMLAFKCRSIGRLALRGKSSISYSDLASILAKLFQSDGYMQSADAMGFFGVRKELQYSNIITRIDDIPDNCLASIFQLFPPVDHKNFSLVCRRCLKVQGQTHHRLCLTLPYSKFLASIFTRFDSVTELTLQCLNLMSMCDGNLVVISDLCPNLSYVGLEVLARSCERLKKFSCTSCTFGLNAIDALIHHCSSLEELSMEHSSVKTDGAEFVNFYPLIRAKNLTTVKIVQSSVEEYWDRFFHSLASQVTSLLEVRLDGFGVSDNGLKAISKFPNLETLHLVKTPKCTDAGLVEVAEGCNKSLRKLGIEESLQKGPNKIGNNGLRAVAKCCANLQELVLIGMNPSKANLEILVSNCQSLKHLGLWGSNKFGDTEIRCIAGK

SEQ ID NO: 133796 - protein, 691 aa, Glycine max
  Coding DNA Sequence Number=SeqID_17018
  Gene Ontology: Mol. function=protein prenyltransferase activity; Biological process=protein amino acid prenylation
  Homolog annotation: Hit_ID=Q9M0L4; Match level="QueryCoverage=96%, HitCoverage=100%, E-value=1e-174, Identity=49%"; Hit description=Rab geranylgeranyl transferase like protein
  Pfam annotation: Domain name=LRR_1; Domain location=547-567; Score =5.7; E_value=25; Accession=PF00560.23; Description=Leucine Rich Repeat
  Pfam annotation: Domain name=LRR_1; Domain location=569-592; Score =3.4; E_value=65; Accession=PF00560.23; Description=Leucine Rich Repeat
  Pfam annotation: Domain name=LRR_1; Domain location=594-616; Score =8.3; E_value=8; Accession=PF00560.23; Description=Leucine Rich Repeat
  Pfam annotation: Domain name=LRR_1; Domain location=655-679; Score =3.1; E_value=76; Accession=PF00560.23; Description=Leucine Rich Repeat
  Pfam annotation: Domain name=PPTA; Domain location=121-151; Score =38.4; E_value=2.5e-08; Accession=PF01239.12; Description=Protein prenyltransferase alpha subunit repeat
  Pfam annotation: Domain name=PPTA; Domain location=156-186; Score =44.2; E_value=4.5e-10; Accession=PF01239.12; Description=Protein prenyltransferase alpha subunit repeat
  Pfam annotation: Domain name=PPTA; Domain location=202-232; Score =23.9; E_value=0.00058; Accession=PF01239.12; Description=Protein prenyltransferase alpha subunit repeat
  Pfam annotation: Domain name=PPTA; Domain location=43-73; Score=36.1; E_value=1.2e-07; Accession=PF01239.12; Description=Protein prenyltransferase alpha subunit repeat
  Pfam annotation: Domain name=PPTA; Domain location=86-116; Score =42.8; E_value=1.2e-09; Accession=PF01239.12; Description=Protein prenyltransferase alpha subunit repeat
  Pfam module annotation: Pfam domain module=LRR_1::LRR_1::LRR_1::LRR _1::PPTA::PPTA::PPTA::PPTA::PPTA; Domain location=547-567::569 -592::594-616::655-679::121-151::156-186::202-232::43-73::86-116
MHGRPRKALKQEDEAASAAKAEKLRSLQAQFLANHHNHIYSKEALDVSAKLLEVNPECYTAWNYRKLAVQHLLSNSDSDPHSIFDDELKLVEIALRKNFKSYGAWHHRKWVLSKGHSSIDNEMRLLNGFQKMDPRNFHAWNYRRFVAELMKRSDEDELKYTEEVIGTNFSNYSAWHNRSVLLSNLLKRKAEGYFPKEKVLEGEFEHVHNAIFTDPDDQSGWFYHLWLIDQTVKTDAPLLVSSWPSHGSNITLIGDNDLRGCGLSLLNGTLSDTETLPIILYFNQAVEGINSSTVAIKSELLKEELVWKPLSMKILNTAQVWVVYLNLGNMELQPSKTYSVEINIGHSKGVVSSNGNHYGDPSQISFEVFVQTASTEPTEGQGGKRTTWKDTNFQKIDHFQESDSILPADQNPHIPTTSNWCTEEIGEEITKFQDLLSEYDCKIGKLTLARLLTALDLLSSQHDGRKSNTEEVLQLYTDLMKLDPTHSLYYKDEHSLISLKRITSTRDSLLPYCHYYKDATETITGYFCLKLQNLSLSRMGSIENLLWVQMLDLSHNELQSIEGLEAMQLLSCLNLSHNKFGSFTALGPVRLLKSLKVLNISYNELGSHSIDTTRYLCSSPVSHTEEFAWDRFEILTGSINATKFWEAFLIFGSLTLTELNITGNAVADENFRSFLVKVLPTLRWLDDEELS

SEQ ID NO: 133797 - protein, 179 aa, Glycine max
  Coding DNA Sequence Number=SeqID_17019
  Gene Ontology: Biological process=ubiquitin cycle
  Homolog annotation: Hit_ID=Q2HTR2; Match level="QueryCoverage=76%, HitCoverage=27%, E-value=6e-13, Identity=36%"; Hit description =Cyclin-like F-box
MDVTATVDNIPDECLGSIFRLLPTADDRNNCSLPHLVFFGPNIVDALIHHFGALEELSMEHSHVTTDRAGFVHSYSSIHAKNLTILKIVQCFAAEYSWDRFFHSLAIQNVTSLVEVHHLDSVKISDFGLIAISKFSNLEILHLVRTPNCPDAVLVEVEEGCNKSLRKLILCHLGGGPTK

SEQ ID NO: 133798 - protein, 343 aa, Glycine max
  Coding DNA Sequence Number=SeqID_17020
  Gene Ontology: Mol. function=transcription regulator activity; Cellular component=nucleus; Biological process=regulation of transcription
  Homolog annotation: Hit_ID=Q2R581; Match level="QueryCoverage=59%, HitCoverage=75%, E-value=4e-28, Identity=37%"; Hit description =Expressed protein
  Subcellular localization annotation: CTP_CleavageSite=27; ConfidenceScore=5.23e-01
MASPVNQSGKGKEKVQQTLRTICTSPNSSTPSKWVYAVFWRILPRNFPPPRWELGGTALDLSKGNKRNWILVWEDGFCDFNECEQRKSGSGYLNGRFGAELFFKMSHEVYNYGEGLVGKVAADNSHKWVYNESHNECESSYVASWNASVEPQPKAWEFQFNSGIQSIVIIAVREGVVQLGSFNKIAEDLNLVISIQRQFSYLQSIPGVFGIQRPYLRLQHPYIVKPSFIASNAMPLYDMGWNTPQNGAPGPSLCSGSPSLPLPTMPCNFGALLSKLPSGIPSHNSTQVPNAGTQSIIERVKIEDCEFHPTHDDDHKVKSLVMDDPMMVKEGWGWRLEYRGGDG

SEQ ID NO: 133799 - protein, 268 aa, Glycine max
  Coding DNA Sequence Number=SeqID_17021
  Homolog annotation: Hit_ID=Q39048; Match level="QueryCoverage=88%, HitCoverage=59%, E-value=2e-36, Identity=38%"; Hit description=Cer2 protein
MVNRSRLSISSGVPLMFTWFKCGGLSVGLSWAHVLGDAFSAFNFISKWSQILSGQAPPKSLHTPNLPQPKTSPNSIVENPLISIKKTNIVGEYWLATNDNDVATYSFHITSKKLHHLCIANIRGQHFGPNVVTICTSESNRAENEFPTNGFLVLSKVEADFSTGKFEISELVKLIAENKMVENHVMEELVEGDEGREDFIAYGVNLTFVNLEEANIYDGVKLNEQKPIMANCTFRGVSDQGVVLVKHQKLRNMMVMEGLLQFLYLMKN

SEQ ID NO: 133800 - protein, 190 aa, Glycine max
  Coding DNA Sequence Number=SeqID_17022
MVCTLEAMPESAPLSFYLSGWDAFLSDDLASSGQIIATASTSATTFADLKVHRPQLPTFATANSSATLAGRSCSPMVVLSRSERGRIVVVHRRDGACCGFAVSGLRWLVGGGFSGTSWWFRRGRGFTAVIALLGFLRLAVLVVTVVSAAVAALGGDDEDNTLLNDKDVTEMLNYYEGEKRANNVFLVDFV

SEQ ID NO: 133801 - protein, 664 aa, Glycine max
  Coding DNA Sequence Number=SeqID_17023
  Gene Ontology: Mol. function=protein serine/threonine kinase activity; Cellular component=membrane; Biological process=protein amino acid phosphorylation
  Homolog annotation: Hit_ID=Q8W231; Match level="QueryCoverage=64%, HitCoverage=80%, E-value=1e-157, Identity=66%"; Hit description =Putative serine/threonine-specific protein kinase
  Pfam annotation: Domain name=Pkinase; Domain location=394-648; Score =228.2; E_value=1.8e-65; Accession=PF00069.15; Description=Protein kinase domain
  Pfam annotation: Domain name=Pkinase_Tyr; Domain location=394-648; Score=242.8; E_value=7.3e-70; Accession=PF07714.7; Description =Protein tyrosine kinase
  Pfam module annotation: Pfam domain module=Pkinase::Pkinase_Tyr; Domain location=394-648::394-648
MNPYLWVMCNDVEEGRRIPTLMALKAVEPSDTCMEVVLVDRREDSRLKLLQDKAQELYCASENTLLLVEQLGKLVAIYMGGMFPVEQGDLHKRWKLVSKKLRNFHKCVVLPIGSLSSGLCRHRAVLFKRLADYIGLPCRIARGCKYCVADHRSSCLVKIKDDKQLSREYVVDLVGEPGNVHGPDSSINGAYVSSMPSPFQISHLKESQSPYMDDTASSISSNHRPVNPESLPYSGSEQNDQQLNETDLLKSHKGSIYASVDQICEGTEPSLIPFGLEGNDEECAVLSSVLPTIHEDVSKSLHPAIEASLHEYPRLSEDVVQETSHNEIIVNGSSVVKSTFQQSMLGSSCQSELKQVGIRIENQGCLPAAGNIPRYVNLEPSLAMDWLEISWDDLRIKERVGAGSFGTVYRAEWHGSDVAVKVLTVQDFHDDQLKEFLREVAIMKRVRHPNVVLFMGSVTKRPHLSIVTEYLPRGSLYRLIHRPASGEILDKRRRLRMALDVAKGINYLHCLKPPIVHWDLKSPNLLVDKNWTAKVCDFGLSRFKANTFIPSKSVAGTPEWMAPEFLRGEPSNEKSDVFSFGVILWELVTMQQPWNGLSPAQVVGAVAFQNRRLAIPPNISPALASLMESCWADDPSERPSFGSIVDSLKKLVKSPAEVIKMADS

SEQ ID NO: 133802 - protein, 728 aa, Glycine max
  Coding DNA Sequence Number=SeqID_17024
  Gene Ontology: Mol. function=protein kinase activity; Cellular component=integral to membrane; Biological process=protein amino acid phosphorylation
  Homolog annotation: Hit_ID=Q2LJM1; Match level="QueryCoverage=84%, HitCoverage=95%, E-value=0.0, Identity=58%"; Hit description =Putative receptor kinase
  Pfam annotation: Domain name=LRR_1; Domain location=120-142; Score =17.3; E_value=0.057; Accession=PF00560.23; Description=Leucine Rich Repeat
  Pfam annotation: Domain name=LRR_1; Domain location=144-166; Score =16.0; E_value=0.13; Accession=PF00560.23; Description=Leucine Rich Repeat
  Pfam annotation: Domain name=LRR_1; Domain location=168-189; Score =12.8; E_value=1.1; Accession=PF00560.23; Description=Leucine Rich Repeat
  Pfam annotation: Domain name=LRR_1; Domain location=190-211; Score =9.4; E_value=4.9; Accession=PF00560.23; Description=Leucine Rich Repeat
  Pfam annotation: Domain name=LRR_1; Domain location=97-118; Score =17.9; E_value=0.036; Accession=PF00560.23; Description=Leucine Rich Repeat
  Pfam annotation: Domain name=Pkinase; Domain location=374-628; Score =58.3; E_value=2.6e-14; Accession=PF00069.15; Description=Protein kinase domain
  Pfam annotation: Domain name=Pkinase_Tyr; Domain location=368-628; Score=16.6; E_value=1.7e-13; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=120-142::144 -166::168-189::190-211::97-118::374-628::368-628
MPIHPHLLLLLLLLLASSNAHCSKLPTLVFTDATALLAFKLKADVNDHLHFSPLTRGLRFCAWQGVECNGPKVVRLVLQNLDLGGAWAPNTLSRLDQLRVLSLQNNSLTGPLPDLTGLFNLKSLFLDNNYFTGSLPPSLFSLHRLRNLDFSHNNFSGPISAAFTSLDRLHSLRLSFNSFNGSIPPFNQSSLKVFEVSGNNLSGAVPVTPTLFRFPPSSFAFNPSLCGEIIRVQCRPAQPFFGPAAPPTAALGQSAQVHGVNGIIRQPYEKKRHDRRALIIGFSAGIFVLVCSLVCFAAAVRKQRSRSKKDGRSGIMAADEAATAEAAAVMRMEMERELEEKVKRAEVAKSGSLVFCAGEAQVYTLDQLMKGSAELLGRGCLGTTYKAVLDSRLMVTVKRLDAGKMASHATKEVFERHMESVGGLRHPNLVPLRAYFQAKHERLIIYDFQPNGSLFSLIHGSRSSRARPLHWTSCLKIAEDVAQGLAFIHQAWRLVHGNLKSSNVLLGPDFEACITDYCLSVLTHPSIFDEDGDSAAYRAPETRNPNHHPTHKSDVYAYGILLLELLTGKFPSELPFMVPGDMSSWVRSIRDDNGSEDNQMDMLLQVATTCSLTSPEQRPTMWQVLKMLQEIKEIVLLEDSSELDIRSSLGERITSLFWALYIAAWVGKFKENIVILGCLNFIQLLLFSAESYRLWGGQVAREIHCIPFSSSVQLAERVTTEFCIRANE

SEQ ID NO: 133803 - protein, 88 aa, Glycine max
  Coding DNA Sequence Number=SeqID_17025
MASRRPGLIALFDVDGTLTAPRKVSRQWERRDPMLPMEEAGPFTLASIASATDGTLPRQHCIAVDNDHSYFLAIIIDGFHTKVTPLHK

SEQ ID NO: 133804 - protein, 875 aa, Glycine max
  Coding DNA Sequence Number=SeqID_17026
  Gene Ontology: Mol. function=microtubule motor activity; Cellular component=microtubule associated complex; Biological process =microtubule-based movement
  Homolog annotation: Hit_ID=Q8GS71; Match level="QueryCoverage=92%, HitCoverage=78%, E-value=0.0, Identity=66%"; Hit description=Kinesin- like protein
  Pfam annotation: Domain name=Kinesin; Domain location=2-204; Score =95.7; E_value=1.4e-25; Accession=PF00225.13; Description=Kinesin motor domain
MDLLSLQECLQFGKTTNHFCYEASSNLLAGTNPLLKSFASNCCYCLFCWRSITYSSSFMCPTSRSHAIFTITLEQMRKLNIPGDSCSNDTMNEEYLCAKLHLVDLAGSERAKRTGSDGLRFKEGVHINKGLLALGNVISALGDEKKRKEGVHVPYRDSKLTRLLQDSLGGNSRTFMIACISPADINAEETLNTLKYANRARNIKNKPVINRDPMSNEMLKMRQQLEYLQAELCARAGGSSEEVQVLKERIAWLEAANEDLCRELHEYRSRCSIVEQSEREAYDGSTYIVKTDAVKRSLPITEAEYPISETVGDSREIEEVAKEWEHTLLQNSMDRELHELNKRLQQKESEMKLFGISDAEVLKQHFGRKITELEDEKRVVQRERDCLLAEVENLAANTDGHTQKLEDIHAQKLKALEAQKKQESQVQLLKQKQKSDEAAKRLQDEIQCIKAQKVQLQQRIKQEAEQFRQWKASREKELLQVLQRKTEEAAMATKRLKELLEARKTSSRETLVTMNGSGTNGQSNEKSLQRWLDHELEVMVKEHEVRFEYEKQSQVRAALAEELAMLKQVNEFAAKGRGPPRKNGFARASSMSPNARMARIASLENMLSISSNSLVAMASQLSEAEERERAFSNRGRWNQLRSMGEAKNLLQYMFNSVADARCQLWEKDMEIREMKDQIKELVGLLRQSEMKRKEVEKELKVREQAVGTTLATPPSNQIQAPDQVEEKNISLVGVEEINLGRAPKGDSPNPSKQYAEDMKGLLSPVSMPVPKQLKYTPGVANGLVRESAAFVDQGRRMVPIGQLSMKKLAIVGQASGKLWRWKRSHHQWLLQFKWKWQKPWRLSEWIRHSDETIMRTKPRSQALSRIRALGAGNKQ

SEQ ID NO: 133805 - protein, 370 aa, Glycine max
  Coding DNA Sequence Number=SeqID_17027
MTSEVHDELKALSKFQSKLQLDKLFDWFWTSADSVIAEVYIDFIILIPPRCFVNDQGLYWGLFVYTHDLTVAATRDFEPLKCLPIKYIRETPLVDKDLGHHEISDDYGDDHGVILVDEVDAFEISVVDVNISDGVEMMLLGLAGKPSIRKSARNVTPLSSSILCSVPSSISISAPRMVVLGPTVFSILAMVAMDLQCLVLSNSGLGELVHVVIRFFAPNISKLVRSQGQQHEVQGCRCNAMRLASRILGTKAFDKGVKVDDGLGREPSIPHQCYPLKGCGKDSIQDHVVVGVKINLNEECIQMFVCRPSFLTIILHEPPTLCGRPSIFSIPLHSGVPSLRCGPKCVLTMNAGGYGVLPRWAPQSLIWDLQ

SEQ ID NO: 133806 - protein, 312 aa, Glycine max
  Coding DNA Sequence Number=SeqID_17028
  Gene Ontology: Mol. function=RNA-directed DNA polymerase activity; Cellular component=mitochondrion; Biological process=RNA-dependent DNA replication
MDSASNKKRNEVGIILEAPNNVALKYYHAVKIFVEDFDCFEMYHIPRESNTRVDLLSKLASTKKTRRLKTIIQEALQAPTIDTKEGMAEEKEEQIGGPRGGLTTPLLKCLNNQQAHYVMQELHEGICDLHIGGCSLATKIVHTDYYWPTLKVDALDFTRRMDILGPLPKASGQVKFLLVAIDYFTKWIETMPLQEISASKVGTANRVILKALCTRLDKYKGLWKEELPNIFWAYHCSLGREEEEGIVEARQGTVIITPTLSNDIIVEERETKTRTDKEVDATREVEEGVGISSIYGEGGKEELETFVEATTT

SEQ ID NO: 133807 - protein, 171 aa, Glycine max
  Coding DNA Sequence Number=SeqID_17029
  Gene Ontology: Mol. function=RNA-directed DNA polymerase activity; Cellular component=intracellular; Biological process=RNA-dependent DNA replication
MVVKSHSVAKHVIDLEEMFGEICKYDMCLNPEKCTFGVGGGKFLGFMITHSGIEANPDKCKVILEMHSPTNVIEVQKLNGRLASLSRPFYKLFWKTELFLWEEACEQAFLAFKKTIATSSVLSRPMPGAPLLLYLLVAEEAISSALVQEDGKHQIPIYFIIHVLHDAKKRY

SEQ ID NO: 133808 - protein, 368 aa, Glycine max
  Coding DNA Sequence Number=SeqID_17030
MGASDSGGSIHQTLVEWEVIPIGNSSSEEVRHEASNSGSSSFERLMDLCHADEGSSRPCERVRPSTAPLDKKPILVTIILPSSLLVATGKSDDGDVRVSPHNKRSHNAGTPSSHSFIVGYEWVKDDVLKYCSSITSSIGVGALWCQLGIAKVGDSHKMTIQACGKDEFSFLHAAFDCPPFFYVYRCLFKVLNLTFSLNTFQCALLRCLIHFIPTTGQCWQGRLVGWMSLNSVYKKMFEFDSSVFCRFKDHFFKLNPTRFKSFDEHLMSIEERANKDILERLPVLLDAQAILSLPSSSDPLIVLDGKAFCLSLFHVSTAGDDMPPAPVIIPESSGGERGQVRVDLPQASEAGEDEFFDVTLDMLPPSVT

SEQ ID NO: 133809 - protein, 133 aa, Glycine max
  Coding DNA Sequence Number=SeqID_17031
MNRLQRQQRYQDSWSGGGVIVGGGDVDDGSNRGVGGDEDDISGGGSGDDGNRGGNNDDNGVILVLVMATSDDHGGWDKVGGGCNSSDGGGIVRNGGDNDSSHDDGINGVGDDNNGASGGTTNAGDDGDISRTS

SEQ ID NO: 133810 - protein, 268 aa, Glycine max
  Coding DNA Sequence Number=SeqID_17032
  Homolog annotation: Hit_ID=Q655H7; Match level="QueryCoverage=75%, HitCoverage=42%, E-value=2e-27, Identity=33%"; Hit description=LvsC -like
MRLLHVFIKQFVIAYKDWEPVNSGILLESTSVESLSSADDVVVGCSAGHPVEVIRVLIEEVTQLSSLVTELNTDMGQSSTDLSGASAKLFITSEGFFILDALKIITRSLYNCRVFGYYGGIQKLTALMKGAVVELKTISGALSADESSNIDKKDELFCSLVGFISHADAPIISSNSSKVLSTEARLHWRQKAIVSVMEAGGLNWLVGKRKMSTVEIGTALPNSDSSNHGETQKQKLERFCFFFDTVVKKREESESRGRDNWVGGGIHG

SEQ ID NO: 133811 - protein, 136 aa, Glycine max
  Coding DNA Sequence Number=SeqID_17033
DQDGVEDTVCDKYGINKEKWAQFCQTRRDPSWEDVRMKAQAIQKQNTAPHVLSRGGYDYLEQKLLAEKTKKKMQEAAQSGSVDGVIDPSSPIRHHVKWKMARTKKTGEMTTEAAKEIAEKIDLFKEQATQGSFYEH

SEQ ID NO: 133812 - protein, 1157 aa, Glycine max
  Coding DNA Sequence Number=SeqID_17034
  Gene Ontology: Mol. function=protein binding; Cellular component =membrane; Biological process=defense response
  Homolog annotation: Hit_ID=Q8GZF0; Match level="QueryCoverage=99%, HitCoverage=99%, E-value=0.0, Identity=81%"; Hit description =Resistance protein KR4
  Pfam annotation: Domain name=LRR_1; Domain location=1095-1118; Score =14.3; E_value=0.45; Accession=PF00560.23; Description=Leucine Rich Repeat
  Pfam annotation: Domain name=LRR_1; Domain location=543-565; Score =10.7; E_value=2.8; Accession=PF00560.23; Description=Leucine Rich Repeat
  Pfam annotation: Domain name=LRR_1; Domain location=567-588; Score =13.0; E_value=1; Accession=PF00560.23; Description=Leucine Rich Repeat
  Pfam annotation: Domain name=LRR_1; Domain location=590-612; Score =14.1; E_value=0.5; Accession=PF00560.23; Description=Leucine Rich Repeat
  Pfam annotation: Domain name=LRR_1; Domain location=614-635; Score =7.9; E_value=9.5; Accession=PF00560.23; Description=Leucine Rich Repeat
  Pfam annotation: Domain name=LRR_1; Domain location=751-772; Score =6.6; E_value=17; Accession=PF00560.23; Description=Leucine Rich Repeat
  Pfam annotation: Domain name=LRR_1; Domain location=774-796; Score =0.7; E_value=2.1e+02; Accession=PF00560.23; Description=Leucine Rich Repeat
  Pfam annotation: Domain name=LRR_1; Domain location=829-852; Score =11.6; E_value=1.9; Accession=PF00560.23; Description=Leucine Rich Repeat
  Pfam annotation: Domain name=LRR_1; Domain location=908-930; Score =4.7; E_value=38; Accession=PF00560.23; Description=Leucine Rich Repeat
  Pfam annotation: Domain name=LRR_1; Domain location=973-992; Score =8.0; E_value=9; Accession=PF00560.23; Description=Leucine Rich Repeat
  Pfam annotation: Domain name=LRR_1; Domain location=998-1021; Score =13.2; E_value=0.94; Accession=PF00560.23; Description=Leucine Rich Repeat
  Pfam annotation: Domain name=NACHT; Domain location=199-350; Score= -37.2; E_value=0.046; Accession=PF05729.3; Description=NACHT domain
  Pfam annotation: Domain name=NB-ARC; Domain location=160-457; Score =324.9; E_value=1.4e-94; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NACHT::NB-ARC; Domain location=1095-1118::543-565::567-588::590-612::614-635::751 -772::774-796::...
  Pfam module annotation: Domain location=829-852::908-930::973 -992::998-1021::199-350::160-457
MALECVGGAVLSSFLGALFQKLASPQVLDFFRGTKIDQMLRKDLENKLLSIQAVLDDAEQKQFGNMPVRDWLIKLKVAMLDVEDVLDEIQHSRLQVQPQSESQTCTCKVPNFFKSSPVTSFNKEINSSMKNVLDDLDDLASRMDNLGLKKPSDLVVGSGSGGKVPQSTSLVVESDICGRDGDKEIIINWLTSNTDNKPSILSIVGMGGLGKTTLAQLVYNDPRIVSKFDVKAWICVSEEFDVFNVSRAILDTITDSTDHGRELEIVQRRLKEKLADKKFLLVLDDVWNESRPKWEAVQNALVCGAQGSRILVTTRSEEVASTMRSEKHMLGQLQEDDCWQLFAKHAFRDDNLPRDPVCTDIGMKIVKKCKRLPLALKSMGSLLHNKPSAWEWESVLKSQIWELKDSDILPALALSYHHLPPHLRTCFAYCALFPKDYEFDRECLIQLWMAENFLNCHQCSTSPEEVGQQYFNDLLSRSFFQQSSIYKKGFVMHDLLNDLAKYVCGDIYFRLRVDQAECWSLDEYHTSWNCKMSIHELFSKLKFLHVLSLSHCLDIEELPDSVCNFKHLRSLDLSHTGIKKLPESTCSLYNLQILKLNYCRSLKELPSNLHELTNLHRLEFVNTEIIKVPPHLGKLKNLQVSMSSFNVGKRSEFTIQKFGELNLLHEILSFRELQNIENPSDALAADLKNKTRLVELEFKWNLHRNPDDSAKERDVIVIENLQPSKHLEKLSIRNYGGKQFPNWLSDNSLSNVVSLELNNCQSCQHLPSLGLLPFLKNLGISSLDGIVSIGADFHGNSSSSFPSLERLKFYDMEAWEKWECEAVTGAFPCLQYLDISKCPKLKGDLPEQLLPLRRLGIRKCKQLEASAPRALELELQDFGKLQLDWATLKKLSMGGHSMEALLLEKSDTLEELEIFCCPLLSEMFVIFCNCRMRDYGCDSLKTFPLDFFPTLRTLHLSGFRNLRMITQDHTHNHLEFLKIRKCPQLESLPGSMHMQLPSLKELRIDDCPRVESFPEGGLPSNLKEMRLYKCSSGLMASLKGALGDNPSLETLSIREQDAESFPDEGLLPLSLTCLTISGFRNLKKLDYKGLCQLSSLKKLILENCPNLQQLPEEGLPGSISYFTIGYSCPKLKQRCQNPGGEDWPKIAHIPTLHISTG

SEQ ID NO: 133813 - protein, 281 aa, Glycine max
  Coding DNA Sequence Number=SeqID_17035
  Gene Ontology: Mol. function=zinc ion binding; Cellular component =integral to membrane
  Homolog annotation: Hit_ID=Q1ST74; Match level="QueryCoverage=88%, HitCoverage=93%, E-value=1e-108, Identity=75%"; Hit description=Zinc finger, RING-type; RINGv
  Pfam annotation: Domain name=zf-C3HC4; Domain location=29-77; Score =35.9; E_value=1.4e-07; Accession=PF00097.15; Description=Zinc finger, C3HC4 type (RING finger)
MEDDAAIEVRNHVSPEPEPESEEDSSCCCPICLGPFLQLSYLDKCFHKFCFNCILRWTKVVAGKHRSPPSSVKCPLCKTENFSIIYGVDGSCFQRHYVNQDFEDSFILSRAHRYRLQCYYTEQGFLDDIFNISQYWRSLKYNQPNCWLENWLRREIQALIQEEDVDIILHHILAVVKAALWTRREQKSHMNAPEKKQEEFKMSVSEAARPFLAARTDRFVYEIQLFLASGMNIEAYDAAYIQRLGWSSPGVNTEVSHSELVDRSTVIPYMHLFDGDFDENE

SEQ ID NO: 133814 - protein, 354 aa, Glycine max
  Coding DNA Sequence Number=SeqID_17036
  Gene Ontology: Mol. function=protein dimerization activity; Cellular component=nucleus; Biological process=regulation of transcription, DNA-dependent
  Homolog annotation: Hit_ID=Q84MG6; Match level="QueryCoverage=65%, HitCoverage=41%, E-value=5e-37, Identity=35%"; Hit description =Putative Tam3-transposase
MEKKTLKNLLESVSKTSLTTHTWKCSHQVVEYMVITRHFTDARWNLQKRVLSFVKVPTPRRVQDGLSTIKDIIFNIRESVKYINHNDARLKAFCDVVEQKRLKERKLVIDCPTRWNSTFNMLSTALKFKTAFASYKEREPHYNYAPSLEEWNQVEKVCKLLEVFNLATHVISGSEYPIVNLYLAEVWKVKQILDKEIEDEDLFMREMVGPMKKKFDKYWGGMCKFHMVSICFPLIYSKEVVDENIKKVKSSFEELYDEYVGLCLQESTSSVVNLDDNISSSSQFNTPVVTGFDKIMSMLREKEVVSPIKSESQDYLDEGIYVPNTNSFSALDWWRNNSMKYKILSKMVADILAF

SEQ ID NO: 133815 - protein, 64 aa, Glycine max
  Coding DNA Sequence Number=SeqID_17037
MASKRNKQQLGSWRGENAEAHGRGKKSRSKKKRRQNGSFDKLLGAPAILLGAPSISHVSYANVA

SEQ ID NO: 133816 - protein, 262 aa, Glycine max
  Coding DNA Sequence Number=SeqID_17038
  Gene Ontology: Mol. function=amidase activity
  Homolog annotation: Hit_ID=Q9FR37; Match level="QueryCoverage=91%, HitCoverage=43%, E-value=4e-40, Identity=43%"; Hit description =Amidase
MMYGDVLKPEILGDYVKTNVPSLKHFMSKDNTDQIYNIPSLAALSSAMRLLQRFEFKNNHGEWISAVKPDLGPGISERVSDALRTTGENIDICYSIKRELHDALSALLGILSLVFIKGNLPSFRPWRNNVQTCLLLHRSILLLKKLFETLLAPGLYIHFSKPFHLSKDFGVLMIPTVPGPPPKLQTNTSDLEIFRARAFSLLSIAGVSGFCQVSIPLGMYNNLPLSISLVARHGADKFLLHLVESLYDSIEDRKQHIIEHKL

SEQ ID NO: 133817 - protein, 78 aa, Glycine max
  Coding DNA Sequence Number=SeqID_17039
MKQEAGHSGSAPPSSRLSTLNEKLEMVLATLPTCIRWMCLSIEQVLMLNLQKLPNKVQKRQKRRKLMLLLLILLVGCK

SEQ ID NO: 133818 - protein, 227 aa, Glycine max
  Coding DNA Sequence Number=SeqID_17040
MNELKNVRNLASLVSEQQHRKNEAEEEQQNDVVAAGARRRRASVPVGANGVADGKVWRRRRGNAVGEEGVVEEGRDSVDSEGRGGEEVGVGEGDVVEGEVVGGVVSDGDGFSGEEGGEAGAVGEEEEVGEGEALRDHVSVALRGRIVAFAEERIETHVVKSDAPMSASMMLLSCWAGGDDGGVGVVGPTIVRKRRRRGIMWSWWWLCMVLSFFLGFHFLGGGWFLTT

SEQ ID NO: 133819 - protein, 184 aa, Glycine max
  Coding DNA Sequence Number=SeqID_17041
  Gene Ontology: Mol. function=GPI anchor binding; Cellular component =membrane
  Homolog annotation: Hit_ID=Q84MC0; Match level="QueryCoverage=81%, HitCoverage=75%, E-value=6e-30, Identity=43%"; Hit description =Putative GPI-anchored protein At3g06035 precursor
MFLIYSPLHACVVSLADEEDLLHDINVYRKVLNLAVLDENEKASCLAEEIAEDLENTKCEDFRDYYPLPSYTSRIPSFQKSVNKCKININTTKDGVIMPVCVPKLDSDALFSNYTKSNRFSKYLNNSKYKIAGIGSEDDWMVLIISTNTSSGDFSSATSLLSGALKGHYLMMAFFLSTFIVLLN

SEQ ID NO: 133820 - protein, 45 aa, Glycine max
  Coding DNA Sequence Number=SeqID_17042
MAEKSYLRKKRLNFRTLNPTPTSSLIRRGFHMMRGVGCQYMDSLK

SEQ ID NO: 133821 - protein, 304 aa, Glycine max
  Coding DNA Sequence Number=SeqID_17043
  Gene Ontology: Cellular component=nucleus
  Homolog annotation: Hit_ID=Q1S3S7; Match level="QueryCoverage=83%, HitCoverage=88%, E-value=4e-68, Identity=57%"; Hit description =Eukaryotic rRNA processing protein EBP2
  Pfam annotation: Domain name=Ebp2; Domain location=3-285; Score =277.8; E_value=2.2e-80; Accession=PF05890.2; Description=Eukaryotic rRNA processing protein EBP2
MAMPVNDDTLVEAETEDQREEMSSSESEQDEDVKLTEPSKNAVYNRDALLDKLGDISWPENVEWIHKLSVDVDQEQEVDVNDDLARELAFYTQALEGTKEAFEKFQSMGLPFLRPADYYAEMVKTDGHMVKVKGRLLAEKRKMEEADERRKAREAKRLAKEIQAQKLKERAKQKKEDIESVKKWRKQRQQSGYADNGKDADMGFDFEDGKVFERSNKKRPGVSPGDRSGGKAKLAFGKGKKQKKRDGKNSKFGFGGKKGMKKQNTADTTDDFGKYNKGAVSGNKRKSCFMLSIAHKVYVVVRVA

SEQ ID NO: 133822 - protein, 718 aa, Glycine max
  Coding DNA Sequence Number=SeqID_17044
  Gene Ontology: Mol. function=GTP binding; Cellular component =intracellular; Biological process=small GTPase mediated signal transduction
  Homolog annotation: Hit_ID=Q6ATR5; Match level="QueryCoverage=95%, HitCoverage=95%, E-value=0.0, Identity=60%"; Hit description =Expressed protein
  Pfam annotation: Domain name=Dynamin_N; Domain location=501-618; Score=-43.5; E_value=0.058; Accession=PF00350.13; Description =Dynamin family
  Pfam annotation: Domain name=EF_assoc_1; Domain location=424-494; Score=126.6; E_value=7e-35; Accession=PF08355.2; Description=EF hand associated
  Pfam annotation: Domain name=EF_assoc_2; Domain location=283-371; Score=192.0; E_value=1.5e-54; Accession=PF08356.2; Description=EF hand associated
  Pfam annotation: Domain name=MMR_HSR1; Domain location=499-619; Score= -6.6; E_value=0.004; Accession=PF01926.13; Description=GTPase of unknown function
  Pfam annotation: Domain name=Miro; Domain location=18-183; Score =93.2; E_value=7.8e-25; Accession=PF08477.3; Description=Miro-like protein
  Pfam annotation: Domain name=Miro; Domain location=500-619; Score =42.8; E_value=1.1e-09; Accession=PF08477.3; Description=Miro-like protein
  Pfam annotation: Domain name=Ras; Domain location=18-234; Score= -55.1; E_value=3.8e-05; Accession=PF00071.12; Description=Ras family
  Pfam annotation: Domain name=efhand; Domain location=254-282; Score =12.3; E_value=0.59; Accession=PF00036.22; Description=EF hand
  Pfam annotation: Domain name=efhand; Domain location=373-401; Score =19.8; E_value=0.01; Accession=PF00036.22; Description=EF hand
  Pfam module annotation: Pfam domain module=Dynamin_N::EF_assoc_1::EF _assoc_2::MMR_HSR1::Miro::Miro::Ras::efhand::efhand; Domain location =501-618::424-494::283-371::499-619::18-183::500-619::18-234::254 -282::373-401
MAKATSGTVNPHSRTGVRIVVAGDQGTGKSSLIITAAAENFPVNVPPVLPPTRLPEDLYPDRVPITIIDTSSRNAILCLYIDSVYFETCWSWVRIRKQPLCICKGKAAYNIPPPYLRIAKSLWAMGAEDSDKVAEELQRADTVVLTYACDRPETLENLSIFWLPHLRKLEVKVPVIVVGCKLDLRDENQQVSLEQVMSPIMQQFREIETCIECSASRHIQVPEVFYYAQKAVLHPTAPLFDQESQTLKPRCVRALKRIFILCDHDRDGALSDAELNDFQVKCFNAPLQPSEIVGVKKVVQEKLSEGVNERGLTLTGFLFLHALFIEKGRLETTWTVLRKFGYNDDIKLADDLIPPIKRAPDQSVELTNEAIEFLRAIFDAFDSDGDGMLRPREIEELFSTAPERYKRLQSELLFNQQRVKIGSPWTGIPYEDAAEKNAFGGLSLEAFLSEWALMTLLNPTFSVENLIYIGYPGDPSSAIRVTRRRRMDRKKQHSDRNVLQCFVFGPRKAGKSALLNSFIGRPYSESYNPTTEDHYAVNVVDISMENKKYLVLREIPEDGVRKLLSNKESLASCDIAVFVHDRSDESSWRTSSELLVEIASHGEDTGFEVPCLIVAAKDDLDSFPMAIQESTRVSQDMGVEAPIPISVKLGDFNSLFRKIVTAADHPHLSIPETEAGRSRKQYHRLINRSLMAVSVGAAVVVVGLAAYRVYAARKNASG

SEQ ID NO: 133823 - protein, 140 aa, Glycine max
  Coding DNA Sequence Number=SeqID_17045
MEEKWIGQSSGNGFSLHTGFFVFLSVLVPLLVDIFLHAERDTRAECMSNLIKWPRVKPQDAYLLETTVFQFVLLRLWKVFSDDKERPDRYLLAKEFESRPDADDIELLFADEDQKSEQGQGLLDKAAGIFSSISRMMKSI

SEQ ID NO: 133824 - protein, 989 aa, Glycine max
  Coding DNA Sequence Number=SeqID_17046
  Gene Ontology: Mol. function=hydrolase activity, hydrolyzing O -glycosyl compounds; Cellular component=lysosome; Biological process =carbohydrate metabolic process
  Homolog annotation: Hit_ID=Q84XI2; Match level="QueryCoverage=98%, HitCoverage=98%, E-value=0.0, Identity=76%"; Hit description =Glycosyl hydrolase
  Pfam annotation: Domain name=Glyco_hydro_2; Domain location=207-340; Score=-12.2; E_value=0.014; Accession=PF00703.11; Description =Glycosyl hydrolases family 2, immunoglobulin-like beta-sandwich domain
  Pfam annotation: Domain name=Glyco_hydro_2_C; Domain location=348 -584; Score=-131.3; E_value=0.011; Accession=PF02836.7; Description =Glycosyl hydrolases family 2, TIM barrel domain
  Pfam annotation: Domain name=Glyco_hydro_2_N; Domain location=50-160; Score=-30.7; E_value=0.00033; Accession=PF02837.8; Description =Glycosyl hydrolases family 2, sugar binding domain
  Pfam module annotation: Pfam domain module=Glyco_hydro_2::Glyco_hydro_ 2_C::Glyco_hydro_2_N; Domain location=207-340::348-584::50-160
MMAKTTLDSGWLAARSTEVHFTGTQLTTTHPPSASTQPWMEAIVPGTVLATLVKNKAVPDPFYGLGNEAILDIADSGREYYTFWFFTTFQCKLSGNQHCDLNFRGINYSADVYLNGHEMVLPKGMFRRHSLDVTNIIHSDSSNLLAVLVHPPDHPGSIPPQGGQGGDHEIGKDVATQYVQGWDWMAPIRDRNTGIWDEVSISITGPVKIIDPHLVSSFFDNYKRVYLHATTELENRSSLIAECSLSIHVTTELEGNIHLVEQLQTQNLSIPARSRVQYTFPESYLFLSSAKDLYWQLFFYKPNLWWPNGMGKQSLYNVIITIDVKGHGESDSWNHHFGFRKIESHIDVATGGRLFKVNGEPIFIRGGNWILSDGLLRLSKKRYETDIKFHADMNFNMIRCWGGGLAERPEFYRCCDYYGLLVWQEFWITGDVDGRGIPVSNPNGPLDHDLFLFCARDTVKLLRNHPSLALWVGGNEQTPPDDLNVALKNDLKLHPYFGHAEEKEKPVGDLSPRLGDPSQYLDGTRIYIQGSLWDGFADGEGDFSDGPYEIQNPEDFFTDSFYNHGFNPEVGSVGMPVASTIRAIMPSEGWQIPLFNKLPNGYVEEVPNPIWKYHKYIPYSNPTKKVHDQIQLYGDVKDLDDFCLKAQLVNYIQYRALLEGWTSRMWKKYTGVLIWKTQNPWTGLRGQFYDHLLDQTAGFYGCRCAAEPIHVQLNLATYFIEVVNTTSEELSNLAMEVSVWDLEGTCPHYKVHENLTALPKKVTPIVDMKYLKSKNPKPVYFLLLKLYKMSDNTILSRNFYWLHLPGGDYKLLEPYRKKKIPLKITSEVFIEGSTYILQMHVQNTSKKPDSKSLTMVHSSTARQSSGCFVTDSLETVDSGTGKEHEVGWFKGIHKCFAGKSHGLKVSEINGQDTGVAFFLHFSVHASNKDHKEGEDTRILPIHYSDNYFSLVPGETMTIKISFEVPSGVSPCVTLRGWNYQGQTIHEALY

SEQ ID NO: 133825 - protein, 573 aa, Glycine max
  Coding DNA Sequence Number=SeqID_17047
  Gene Ontology: Mol. function=transferase activity, transferring hexosyl groups; Biological process=carbohydrate biosynthetic process
  Homolog annotation: Hit_ID=UPI000034F48F; Match level="QueryCoverage =73%, HitCoverage=97%, E-value=1e-121, Identity=51%"; Hit description= transferase, transferring glycosyl groups
  Pfam annotation: Domain name=Glyco_transf_8; Domain location=272-488; Score=171.6; E_value=2e-48; Accession=PF01501.10; Description =Glycosyl transferase family 8
  Subcellular localization annotation: CTP_CleavageSite=38; ConfidenceScore=5.46e-01
MASKSSSSSHLSKQKAFLILSLFSIGLLLSLLSMKPKRVSNVTNKFEVDKRKPSWFEVIEKNYASKRINVGLVNVDTRVDGGLYEQLHALHPQVEIVSVDFDHVDESLKWKDFFPVWIDEDKKWGGPKCPDLPMPTWEEYRDLNVVVATVPCGKRDVFKLQVNLVVANLAVDSGWVNNLDAYEPVYVVFIGSCDPMMDIFKCDDLLLHQPGEYWVYKPDLFSLRNKMLMPVGSCQIAPGYAETGKEEIRRGYMSQSPATLNYNYTISKLAYVTVLHSSEAYVCGAIALAQSILQHNNNNNNNNNNNYTKLDLLLLADESIGYKSIRGLKAAGWKIKRIKRILNPYAQKGSYNEWNYSRLRIWQLTMYDKIIFLDADLLVLKSIDGLFAYPQLSASPNDFSLFKSGLMVIEPSTCMFEDLMKKSLEVKSYNGGDQGLVNEVFTWWHRLPTKVNYLKSFEEREGNDVKEEIPEDLYVMHYLGLKPWMCYRDYDCNWDMNELHVFASDLAHHMWWQVYDAMPKELKSYCGLTEKMDERIVQRRRRARSANLSDGHWKIEVKDPRRTHYEDLNYSRE

SEQ ID NO: 133826 - protein, 286 aa, Glycine max
  Coding DNA Sequence Number=SeqID_17048
  Gene Ontology: Cellular component=integral to membrane
  Homolog annotation: Hit_ID=Q9AX74; Match level="QueryCoverage=89%, HitCoverage=93%, E-value=1e-103, Identity=66%"; Hit description =Putative integral membrane Yip1 family protein
  Pfam annotation: Domain name=Yip1; Domain location=88-253; Score =205.4; E_value=1.3e-58; Accession=PF04893.7; Description=Yip1 domain
  Subcellular localization annotation: CTP_CleavageSite=77; ConfidenceScore=5.31e-01
MMSGNYTSIDSQKVSGSVPAVDPPPFQFSDSNLQTFPPSGAQGKIGGGSRHPRDVDDTFSKPVSGSDEPQQQSGWFKAFSLASYKPYFDVDTIDVLDRIKDSLYPFNGTFNEKTASHPDLYGPFWICTTLIFVAASIGTFVTYIAHKLKDQEWNYDINLVTWSAGLFYGYVTIVPLCLYVILKYFSVPSGFVQLLCLYGYSLFVFIPALCMSVVPLEIFRWMVAGVAGFMSATFVALNLRAHIMSAGERWVLIVASIFVLQLALAVALKVKCGYQIKLSFNSFMAI

SEQ ID NO: 133827 - protein, 111 aa, Glycine max
  Coding DNA Sequence Number=SeqID_17049
MSRFAFSQCGIGRAKPKEKDPEGLEENKGLVDGVIGINGREGRGGNLGRGGNPGSENGGGLRKPPIGCGKDGIGGRVGNKGLGTKFGFGNFGAKEASFHGISTWYLTYGSF

SEQ ID NO: 133828 - protein, 109 aa, Glycine max
  Coding DNA Sequence Number=SeqID_17050
MANLATKLNSMGMVMNESFLVQFIMNSLPIEFGHQVNYNTIKEKWKFQEIKAMLIQEEERLKKMKDNLIHLTTHDGASISKSKSSKKDNRNAHLMVKKGISFDPNHRRN

SEQ ID NO: 133829 - protein, 43 aa, Glycine max
  Coding DNA Sequence Number=SeqID_17051
MALSTTSRSFRIGKCIASLEPDKTGLSYRMSGHGVRLSSTRGI

SEQ ID NO: 133830 - protein, 257 aa, Glycine max
  Coding DNA Sequence Number=SeqID_17052
MLTHLASPCAKRVIRNCQWLPQVRVRGHLIKFDVDSLNTFLETPVVVEQGESLPSYSRFARLRPDPQELAARLCIPGRGFVLNAEGLPWKLLRKDLTTLAQTWSVLSYSNLAPTSHTSDLNLDRAKLVYGLVMKMNMNLGSLISGQISLIAQSNSSRLGFPALITTLCKKNCWNLDDLSVTFPRTQKSKARRSEAPSPSAAPAPPTSAPSTSALPSPPAALVLPSPSTQSSELFMSMLQSLHQGQLLIMQSLQDVVQ

SEQ ID NO: 133831 - protein, 160 aa, Glycine max
  Coding DNA Sequence Number=SeqID_17053
  Gene Ontology: Mol. function=transferase activity; Biological process= DNA integration
MEHTPYASMVGSLMYAQTYYTMLFAGEAVSWKSAKQYVITTSIMEAKFVACFDAIIQALWLWNFTSEFGIVENIAKPLRIYCENFVVVFFSKNEKYSKGAKHMDLKHLSVKEEVQKHRVSIEHIGTKLMIVDPLTKGLPPKTFIGHVERMGVMDKSLLTM

SEQ ID NO: 133832 - protein, 675 aa, Glycine max
  Coding DNA Sequence Number=SeqID_17054
  Homolog annotation: Hit_ID=Q6H7S8; Match level="QueryCoverage=38%, HitCoverage=9%, E-value=1e-59, Identity=49%"; Hit description =Putative LvsC
MGVKLRKRGRERNKEWVGERNKKNVSDRPCLNYARKENVQHGATATTTRWGKGRSKNWRDAPDILSFYFTKFPNDMGEKVLWIEFKKWSDVRELHVNIPMHGREWNPIETVNKKHQEKEEVAIEKVEERDKGKGKGTAEHMTPNTGLQQQNPQREATFRSYPNVVAADSMHVVKRWTLKYAQASIKPKYIGGDMVLLMWLNDTRAEELCREGVESGLSMFHTLEKWSPSLRPGFRLVWVMCLGILLHAWDAENIARIAEGIGEVVDVDEDVDDLWRLDRARVLIKTPWPLTINHTVTASINGVDYVVTIVEELMDILSEEAQVGGELPGTNTAAGVEGDEPDRIIGLQQFPVGYYTNFVTTVNNDARRSYSPNGDPTLFGLGEERTEQKADEISALGGNTCACIRELSALLDALEHSACNPEIACVLVGSLVRILQLSPERTIASFKNLNAVSRVLQVACVQAQESRRPGSMEPSNENSGMEALVSVQDQNTCNSPKIIQSCFNCMKMCMEFFAKFIAAAEDTRSLILHSFTCIDCLFDLFWVEGLRDDVLRHILDLMKIMPFSEEDKKAKLQLCSKYLEMFTQLKEREKSFVDLSVDLLVGMRDMLQANQAYYQTLFRDGECFLHVVSLLNSNLDEANGEKLVLNVLQTLTCLLASNDTSKLFFDCGKPITAKT

SEQ ID NO: 133833 - protein, 210 aa, Glycine max
  Coding DNA Sequence Number=SeqID_17055
  Homolog annotation: Hit_ID=Q6H7S8; Match level="QueryCoverage=87%, HitCoverage=6%, E-value=4e-52, Identity=59%"; Hit description =Putative LvsC
MIKSKFCLWIQRAAFRALAGKGYQTLQSLLLDFCQLHSSEILLDALLDMLVDGKFNVKMSPMIKNEDVIILYLIVLQKSSESLQHHGLDIFQQLLRDSISNRASCVRAGMLDFLLNWFSQEDNDSVIFQIAQLIQAIGGHSISGKDIRKIFALLRSEKVGMRRQYCSVLLTSLLSMLHEKGPTAFFDLDGIDSVSPEAIIDISLELHVLL

SEQ ID NO: 133834 - protein, 889 aa, Glycine max
  Coding DNA Sequence Number=SeqID_17056
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=83-275; Score=-9.1; E_value=0.046; Accession=PF03372.13; Description =EndonucleaseExonucleasephosphatase family
  Pfam module annotation: Pfam domain module=Exo_endo_phos::RVT_1; Domain location=83-275::492-713
MDEANPISSPMVGGCKLTKLGFEDFSDPTLYRSIVGVLQYATITRPEISFSVNKACQFMSKPSEQHWLSVKRILRYLKGTVNQKTMNNLQKVFGAWGVKWPAIRRMVKEHHIDLLCLQETKKEIIDKSLCQALWGDSEIGWEAYPSVNSAGGILCIRNEREFKVESRFIGAGFILLSGKRGDFNNIRTSTEIIGSSQRGQMDGTKAEFNDWIDDMEVEEAPWVGKRFTWFRPNGIAKSKLDRFMVSPDWHSKWPGSTQSTLVKNFSDHCPVLLSSKSVNWGPKPFRILDCWLSDKSFKKVVFDSWSSNPQSGWGGFVLKEKIKALKQKIKVWNKEQFGDTFRKFKKIEEDLNKMEEESTDRQLEDNERALRKQLQQELWEAAQAHESLLRQKARSRWIKEGDCNSRYFHLMINSKRRSNCLNGVLVDGSWKDEPEIVKEEEVRRAVWSCSSDKSSGPNGINFKFIKKFWDVIKPDFLRFFDEFYANGVIPRGLNASFIALIPKGADPQVLNEYMPISLIGCTYKILVKVLANRLKKVVEEAKRRQKPCIVFKVDYEKAYDSVSWEFLIYMMRRMGFCSKWILWILGCLKSASISVLVNGSPSSEFLPHKGLRQGDPLSPLLFNIVAEGLSGLMSKAIERRLYKGFLVGIDKVEVSLLQYADDTIFLGLLGCRISGPMEHPSGSSEQNKIAWIRWDTGKTWARVLQSKYGGWRNLDGAQRTSSDSMWWSDLKKEDKWTGGDRQLAEKYPRLYNISDQQHQFVQQLGVFNEAGWEWQFQWRRPLFDSEIKMAVAFIQVDGHKIRFDIEDQWVWAAESSGSYSARSAYRVIREAIPEEEQDGEFKELWKLKVPMKVAMFAWRLLKDRLPTRDNWRRKRVELHEYVSFMQING

SEQ ID NO: 133835 - protein, 1049 aa, Glycine max
  Coding DNA Sequence Number=SeqID_17057
  Gene Ontology: Mol. function=DNA binding; Cellular component=nucleus; Biological process=regulation of transcription
  Homolog annotation: Hit_ID=UPI00000529F6; Match level="QueryCoverage =97%, HitCoverage=93%, E-value=1e-174, Identity=46%"; Hit description= transcription factor
  Pfam annotation: Domain name=FYRC; Domain location=874-969; Score =78.3; E_value=2.3e-20; Accession=PF05965.4; Description=FY rich C -terminus
  Pfam annotation: Domain name=FYRN; Domain location=819-871; Score =57.6; E_value=4e-14; Accession=PF05964.4; Description=FY-rich N -terminus
  Pfam annotation: Domain name=JmjC; Domain location=298-415; Score =239.3; E_value=8.1e-69; Accession=PF02373.13; Description=JmjC domain
  Pfam annotation: Domain name=JmjN; Domain location=57-101; Score =83.6; E_value=6.1e-22; Accession=PF02375.7; Description=jmjN domain
  Pfam annotation: Domain name=zf-C5HC2; Domain location=521-574; Score= 76.5; E_value=8.3e-20; Accession=PF02928.6; Description=C5HC2 zinc finger
  Pfam module annotation: Pfam domain module=FYRC::FYRN::JmjC::JmjN::zf- C5HC2; Domain location=874-969::819-871::298-415::57-101::521-574
MEQLKLAADSEAKEDKSLGHKPKNNNALESSDSLRNKKISARWDPVEACRPIIEEAPVFYPTIEEFEDTLSYIGKIRPLAEPHGICRIVPPACWAPPCPLKEKDLWENTEFPTRIQQIDLLQNREPMRKKSRGRKRKRRKHSKTGTCRRKPANAASEAKNASESEEKFGFQSGSDFTLKDFQQYANFFKECYFGLRDANGDRIVSESDHQKRWEPSEEEIEGEYWRIIEQPTDEVEVYYGADLETGALGSGFPKAASLTKSESDQYAQSGWNLNNFARLPGSVLSYEGSDISGVLVPWLYVGMCFSSFCWHVEDHHLYSLNYLHWGDPKVWYGVPGSHAAALEKVMRKHLPDLFEEQPNLLNDLQVTQFSPSILKSEGVPVYRTVQHSGEFVITFPRAYHAGFNCGFNCAEAVNVAPIDWLMHGQNAVELYRLQCRKTSLSHDKLLFGSALEAVRALAELALGKETPKSLKWGSVCGKDGDLTKAVKARIKMEEERLDCLPNHLKLLKMNSDFDLYKERECFSCFYDLHLSAMGCECSPDRYSCLKHANLFCLCGLEKRFVLLRYTISELNKLLEALEGESHAIEVWANKNFGMISANANEVCLDKPDLEKDMYKIKNCEEMESSTGFAGTKDRSNLNAPSSPNSHITSEIVQSEAHPVTSSAAYESIDSHNDNNNDKKLITDNKDKVDQAGSLDLNLDVISGENENHLLHIAGKHHSKGVLVEEKVCCSETKQEEDNMELCGEGNLSNSFSVLKTDFSSCSRGVRNYCTFDGGKIEMDLQMDSDSGNQHNNLFERKAIDTTHTSISLTDESCLVQMFGTSVKLVSLGSAVYGKLWCSKHTLYPKGFKTRVNFFSILDPTRICTYISEVIDAGFLGPLFKVTMEECPSEAFTDTSADNCWESVLKRLHHEIMRQRSLGELELPLLELLKSINGHRMFGFLLPSIIQAIEAQDPSHLCVEYWNHKVAPSGSVVDNFTYGSSGIIINTKNFGIDLIKQEKEDILEEMKLILQRASPDELSTMHKLLSSDAQCCEWRVALIALMDEIRNARQ

SEQ ID NO: 133836 - protein, 171 aa, Glycine max
  Coding DNA Sequence Number=SeqID_17058
  Subcellular localization annotation: CTP_CleavageSite=71; ConfidenceScore=5.21e-01
MGPLRFLSHTFFLGDDASWLDLGAPTGGARGPSNVSNGAGAVCFLLFFVFFFDLGAETSVLGATTGVGVVGVSAGGELTGTSAGGELTGVTAGGVAAGGVVAGGVVTGGVVARAGAAALDRGDATMGDETRGFAIAALGDEAGGDEVGEATGAVDFGLEGVVVGNAINTFF

SEQ ID NO: 133837 - protein, 223 aa, Glycine max
  Coding DNA Sequence Number=SeqID_17059
  Pfam annotation: Domain name=DUF761; Domain location=5-220; Score= -111.2; E_value=0.0013; Accession=PF05553.2; Description=Cotton fibre expressed protein
  Subcellular localization annotation: CTP_CleavageSite=21; ConfidenceScore=5.13e-01
MWIAKLVLMSMGVISTLVLLKVTIVPYTFHRLLSTLPQFCVSVTSWLRLSFLYIIFNFIIITIAASFDFHPKTFSDSPPTSDPKHTTTIILDTANHPTESENQTNAPKEEEKELEQQQLIEESGLTYDKFMIHPSLESCTNDYFLLDSDGDDTLEAMWRAILEGQGKTMKPQLKNSDTWGAIQRTALKRECQFFCYVSRNPEVKAPFILLFPTSLILPKFVLD

SEQ ID NO: 133838 - protein, 63 aa, Glycine max
  Coding DNA Sequence Number=SeqID_17060
MKANHPRNETSKHAARQTRRKQNIGHKRTDARRQRTRNNNHVSATCIHKRYKDGYRDKTVFVW

SEQ ID NO: 133839 - protein, 174 aa, Glycine max
  Coding DNA Sequence Number=SeqID_17061
  Gene Ontology: Mol. function=zinc ion binding; Cellular component =mitochondrial outer membrane translocase complex; Biological process= intracellular protein transport
  Homolog annotation: Hit_ID=Q9LIQ6; Match level="QueryCoverage=70%, HitCoverage=42%, E-value=8e-23, Identity=50%"; Hit description =Arabidopsis thaliana genomic DNA, chromosome 3, BAC clone:F14O13
MNFDIQRQNEQRCEQEIEDIRRGVRSGNITPDTSVIRFSDEALDEQNHSIRVADEKVALAVQAYDLLDQGSNFHDSAICIFFLSNFLYTQVDTHIQHLDQYLKRFGEEIRRERENAAITGVPASGSEGNTKSGRGNESGTGRGGRKKARLEYRQCFILTRSFLLQNTRNNNLIP

SEQ ID NO: 133840 - protein, 186 aa, Glycine max
  Coding DNA Sequence Number=SeqID_17062
  Gene Ontology: Mol. function=sequence-specific DNA binding; Cellular component=nucleus; Biological process=regulation of transcription, DNA-dependent
  Homolog annotation: Hit_ID=Q6J3Q5; Match level="QueryCoverage=77%, HitCoverage=45%, E-value=2e-14, Identity=30%"; Hit description=Male -specific transcription factor M88B7.2
MFGSINQIVSAEDTDGPVSDHHIHYSSHTIEDDGAASDHHIHYSSHTIEEDGAASDHHIHYSSHTIEDDGAAVEDVSAVPGPEISIDNSSQLTLSFRGQVQAVLLLLGGNELTSGSQCAELSSRNQTGEEEYPAKCSLPHRAASLNRFRQKRKERCFDKKVRYSFYCVKNSDHSTMYILKDWVDEE

SEQ ID NO: 133841 - protein, 244 aa, Glycine max
  Coding DNA Sequence Number=SeqID_17063
MEEAQAKGELPAFVGEDPIGWIASLWIKRLRDRYGNHFFKRFSILMQEEQTETEICIEEGGTSTMFLKERTNDVPKPKKMLQQLVKKQEIKPEQDGSWKEKAFQKEEPKSYGLHHHSCKVSISELKHGLLKSSEKVLEGINLEAKGVEEIRVEEDKNLQQKMQEQNSGFAIVIKEFHSWVVNVIEVEGDNGFFMKPTAMEIVIIWRWIAPTPPPDPLDANSNTILNGLSSASHNLPWRGMGLLC

SEQ ID NO: 133842 - protein, 190 aa, Glycine max
  Coding DNA Sequence Number=SeqID_17064
MSAKPRDTNPLASKSLSGMLRETESLWVGTTEMHHSSTNLFLEKEKGTKVKFTFCMVDLIMDVMGQDECGDSTTVCGFYNAVSVELVTVEEKHKSTLRPLDIHGKQNRHETSTETNEPRFTREVSSQNRNGFIPLNLDDCVADYMLKEQRWKEIAASHMEVQIIQNLLPSRPPPEPQNSTPHAGEWMIPS

SEQ ID NO: 133843 - protein, 72 aa, Glycine max
  Coding DNA Sequence Number=SeqID_17065
MERYEGGLQREGIKILMQRYLHREGTLSLSSPSFLHLLVGSSMAGAEGYKPVEALKTALEGTYAIIGDERCK

SEQ ID NO: 133844 - protein, 114 aa, Glycine max
  Coding DNA Sequence Number=SeqID_17066
  Gene Ontology: Mol. function=cysteine protease inhibitor activity; Biological process=defense response
  Homolog annotation: Hit_ID=Q9FQ13; Match level="QueryCoverage=83%, HitCoverage=81%, E-value=1e-24, Identity=54%"; Hit description =Cystatin-like protein
  Pfam annotation: Domain name=Cystatin; Domain location=26-113; Score =61.5; E_value=2.7e-15; Accession=PF00031.11; Description=Cystatin domain
MRHHCLLLLSLVLVSYAARRSESALGGWSPIKDVNDSHVAEIANYAVSEYDKRSGAKLTLVKVSKGETQVVAGTNYRLVLKVKNGSTTASYQATVLEKPWLHFRNLTSFKPLRS

SEQ ID NO: 133845 - protein, 392 aa, Glycine max
  Coding DNA Sequence Number=SeqID_17067
  Gene Ontology: Mol. function=nucleic acid binding; Cellular component= mitochondrion; Biological process=DNA integration
  Homolog annotation: Hit_ID=Q1SRN1; Match level="QueryCoverage=94%, HitCoverage=32%, E-value=1e-101, Identity=45%"; Hit description =Integrase, catalytic region
MQSEFDALVKNGTWTLVELPPNKMAIGCKWVFRLKHNLDGFVNKYKARLVAKGFHQRIGHDYNETFSPVTERIILTLVISNNCSLQQLDVNNAFLNGVLEKEVYIQQPSGFEKSDKQLVFIGNDFKLIRTLVTRLNGVFSLNDLGDLDYFLGIEVTYHPDCSLTLTQSKYLRDLLTKTKRDEANPIAFPMHWQAVKRILRYLNRTLTLGLRLQPSKLSNFSVQACCDADWASDLDDMLSTSRAEICLGPNLVFWWSKKQKVFARSSTEAGYRSLALASTEVTWIQTLLFELKVRHTTPVIFCDNMSTVSQAHNPVLHSRTKHMELDLFFVKEKFMEKSLQVIHVPTVDQYANILTKSLSPSNFIVFRDKLIVVHKTFVNEGPHELVRDIRVG

SEQ ID NO: 133846 - protein, 105 aa, Glycine max
  Coding DNA Sequence Number=SeqID_17068
  Homolog annotation: Hit_ID=Q1RT00; Match level="QueryCoverage=43%, HitCoverage=8%, E-value=2e-10, Identity=65%"; Hit description=Cyclin- like F-box
  Subcellular localization annotation: CTP_CleavageSite=87; ConfidenceScore=5.09e-01
MEIVLSKVDCHLSNETPDVSLKWRMRLGRRFKRSFHRVDKTQVLTPCLAFRNVSMWRRTQSFLLWPLLRFLRFILGESNTVSCDRLRAFGEESKRERNREMETRN

SEQ ID NO: 133847 - protein, 69 aa, Glycine max
  Coding DNA Sequence Number=SeqID_17069
MAWERVVALRRSAGKRLPFGFVKSVSHQVSSKSVGFDRIIPSQMHERSNSKIGTIRSSNIDWTGPNRVL

SEQ ID NO: 133848 - protein, 215 aa, Glycine max
  Coding DNA Sequence Number=SeqID_17070
MKCYFWQHVGNISEAKKQNLHGWLHGWLWCGQFGAKLKGFDYPLYAWSVDIDVASCMEHLSDSESVIDIDADKWSFFEAIGILKEDFGYGDQPMRLWWKGGDGEYKETTMDNHALEPSNYIISNNCEVEFFVECVGGNEGVADDNFYGVASDNAGASVFVHNDDDKTNNQCVRVELIYVFDYYISQEEKLPSKVGSDAHFKPKDKAGWGKKIVGG

SEQ ID NO: 133849 - protein, 66 aa, Glycine max
  Coding DNA Sequence Number=SeqID_17071
MVAFLVLSRAPPPTTLLGFLCVRKKEEERNRTCFCKSYSGLKEVKGRLLHQVLQGNDPNGDAPTMT

SEQ ID NO: 133850 - protein, 137 aa, Glycine max
  Coding DNA Sequence Number=SeqID_17072
MVMRLGGDGAVWGEVNDATRSRTRRTCGAGETVPILVVPVGKYLQSSNRLAVANILFKLIYKAVIYYHQNHIGEYILCDTSRAYIYLDCNTEKKRGYISCGSVPVEGTSTWLLKENKGGYILCGDYAGPISPRRELR

SEQ ID NO: 133851 - protein, 52 aa, Glycine max
  Coding DNA Sequence Number=SeqID_17073
MEIYHVYIEYTGIEFWRKNARETKYKGMTRLLSPEKIENRRRRKVTVGFGKR

SEQ ID NO: 133852 - protein, 121 aa, Glycine max
  Coding DNA Sequence Number=SeqID_17074
MVCNENANMTGQLLADDEPFVKVKCSFAIGAAIVASFGYRKDMDGQWVRKQDLPPTAPDERTPSPLPQRDPSSSLLHDVLSELWDLWAFVGDRFDVMDSRITHLEDDMNFIHQCFDPPTDP

SEQ ID NO: 133853 - protein, 248 aa, Glycine max
  Coding DNA Sequence Number=SeqID_17075
GYDINGYCFHTKSHDARSSMQNSGVSVDGQADHFNSVFDNNLIHESMPYYGVIEDIWERNYDLEKGGYNDNLFIMAVQARQVFYVQDPSDSRWSVFVQGRKFSMSDYSDGSSVDVSDMPIACQQMPIINGIDHDDVVHATRNDHHKVNVNPATRRGSGPHKEKFHSYLRVVARDKTSIAHLSWNDVLETLKNLIWGDILAKFNIPEGDNAKKKIMSMVATRWRQFKSSLTTKYVYGNSDGQAKDDPSV

SEQ ID NO: 133854 - protein, 130 aa, Glycine max
  Coding DNA Sequence Number=SeqID_17076
  Gene Ontology: Mol. function=transferase activity, transferring nitrogenous groups; Biological process=biosynthetic process
  Homolog annotation: Hit_ID=Q1RSX0; Match level="QueryCoverage=62%, HitCoverage=26%, E-value=2e-25, Identity=54%"; Hit description =Aminotransferases class-I pyridoxal-phosphate-binding site
MEIGLKKGSPSFNEARGAGFTEENGILADICQSILSSDVVLLFISDAAEIGRRRSAHLLKYPDAKVISLGIGDTNKPIPVVITNAMSKDHIFVSDGAKCDISRLQIVFGSNVKMVVQDPSYPVIVCSVIV

SEQ ID NO: 133855 - protein, 105 aa, Glycine max
  Coding DNA Sequence Number=SeqID_17077
  Homolog annotation: Hit_ID=Q1S0I1; Match level="QueryCoverage=49%, HitCoverage=7%, E-value=1e-12, Identity=70%"; Hit description=Lipid -binding START; Homeodomain-related
MAGFSSYTKIHPCSTVRDYSSLLKHTTFQMHAEVQLLSLVLPVRQDMPNGYSKLASGTTFTLGLLVMTRKNVDDPSEPLRIVFNVATSVWMPVSWQRLFDFLRDE

SEQ ID NO: 133856 - protein, 201 aa, Glycine max
  Coding DNA Sequence Number=SeqID_17078
  Gene Ontology: Biological process=response to brassinosteroid stimulus
  Homolog annotation: Hit_ID=Q9FI10; Match level="QueryCoverage=83%, HitCoverage=85%, E-value=3e-50, Identity=55%"; Hit description =Arabidopsis thaliana genomic DNA, chromosome 5, P1 clone:MFC16
  Pfam annotation: Domain name=DUF588; Domain location=22-178; Score =157.1; E_value=4.5e-44; Accession=PF04535.3; Description=Domain of unknown function (DUF588)
MASENGEKVEIGLNAVPQETHKPKKDWVLLSLRMVAFFATASATLVMTFNKQTKSFVVATVGSTPITATLAAKFNQTPAFVFFVIANGNASLHNLVMIVMEVLGPRYDYKGLRLALIAILDMMTMALASAGDGAATFMSELGKNGNSHARWDKICDKFETYCNRGGAALIVSFVGFILLFIISVMSVIKLLKSNRINHASP

SEQ ID NO: 133857 - protein, 530 aa, Glycine max
  Coding DNA Sequence Number=SeqID_17079
  Gene Ontology: Mol. function=DNA binding; Cellular component=nuclear pore; Biological process=DNA integration
  Pfam annotation: Domain name=rve; Domain location=10-130; Score=-1.9; E_value=0.0085; Accession=PF00665.16; Description=Integrase core domain
  Pfam module annotation: Pfam domain module=RVT_2::rve; Domain location=219-314::10-130
MAKEEGDSCLWHKRLGHLNCNNLTLLSQKNMVYGLPTIEKKNGVYEGCMLGKHHCQPFPKEGARRAKELTIGYTPQENGVSERKNQTVTKMAKSMLFEKGIPKEFWHEAVNIVVYLLNGFPTKAVFAMLKFPKKRGQNLKKQVEEKTIPAIILKQSLASSENEQQIPSTPSSPTSSSSSPSLSPIKVRSLSDIYTMCNYCSVEPENFEEAVKEDAWRKAMQEEIDALEKNKTWKLVEKPKDKIGVKWVYKPNVDYEETLAPVACLDTIRALISLAAQNGWKLYQLDVKRKYAAKILKNFEMFGCNPIDTPLVVNEKLKKEDGGRKVDASNYKSLIAKRVLKYIQGTLNYGIKYDKKVEANVIGFCDSDWAGCMDEIESTFGYVFSLGLGEFSWCSKKQQTVAQSFAKAEYISAGLATQQAIWLKRIFEDFGEKQGTMTIHCDNKFAIAITKNPSNDQVADIFTKALPREKFQKLREALGVQEQHIKGKNGAGRSRVLLWKVAKGVLATNEARCEGGFPESWSCPMCENEK

SEQ ID NO: 133858 - protein, 136 aa, Glycine max
  Coding DNA Sequence Number=SeqID_17080
  Gene Ontology: Mol. function=RNA-directed DNA polymerase activity; Biological process=RNA-dependent DNA replication
DLVLFAETSLDQVENISACLDIFSDSSGEKYISQAIGFQCTDDLGKYLGIKLHHKRVTIRKYSFNIDYLRHSTSVLKPMLNSKSMPRAVCDKLDQTCWNFILGDTESTKKVHWVARKDLCKPKEKGEYWTAFGEAC

SEQ ID NO: 133859 - protein, 85 aa, Glycine max
  Coding DNA Sequence Number=SeqID_17081
  Gene Ontology: Mol. function=ribonuclease H activity
  Homolog annotation: Hit_ID=Q1S4N4; Match level="QueryCoverage=95%, HitCoverage=23%, E-value=4e-09, Identity=39%"; Hit description =Ribonuclease H
MGIIMMLNCNGAKMRNKNNSSWDGIIQNNNGVFMGGFSCNLGSVSVLHAEIWTMFHGLQLERERGIYNIELQSDSVEAIALMVDD

SEQ ID NO: 133860 - protein, 70 aa, Glycine max
  Coding DNA Sequence Number=SeqID_17082
MSHPIRALCPDVLQHKGDQSWLQCFARMLQPCGIGTSLKEHLNQVTPKAYTPKSLSGPLPPDLGPTQKTF

SEQ ID NO: 133861 - protein, 122 aa, Glycine max
  Coding DNA Sequence Number=SeqID_17083
MPTIVDGVSNIWVWKECIYGEFSIKSAYRYLTSSTQSLEDEVMYDRGILEDLRCPKCGEETKDILHCMIISHDMSVENLPESFPTDMESVSVGHLPADHLSVGHLLGPGDGPDAVGEVVVID

SEQ ID NO: 133862 - protein, 120 aa, Glycine max
  Coding DNA Sequence Number=SeqID_17084
MRNHFHAKTKAKSRYLHTELTIGQTIFVQEQIDVILEGLPSEYESLVTAINKELCTAYCIGKSQRLPSHPSEFVYCAPLELIFEEAMPSKIILMMLKTQVKNQESSKFQESKNCSIKIQD

SEQ ID NO: 133863 - protein, 97 aa, Glycine max
  Coding DNA Sequence Number=SeqID_17085
MCKKFKEQSGTTQSTLNTEGKPEAARKTEVARKNQRRNRKQGPICAGKETDAALCSNGGACGNNKEKTQKNYSFVKPGVRFREIGEVINRHASMSDY

SEQ ID NO: 133864 - protein, 158 aa, Glycine max
  Coding DNA Sequence Number=SeqID_17086
MGVMALKHKKNGEIFGNYSQDDLPSSNSIPNSFSIERSCTPRNGSQGFVPAQHAYPYYILGFFNHVILIKSFNNQSNNNPCSGTKKALIGNWKMTTYEFTNDALVDKDGNNNVEDANKRKVATMPSALLGATGTVTQRGIFHWSQTKTSTKKKKKRNE

SEQ ID NO: 133865 - protein, 99 aa, Glycine max
  Coding DNA Sequence Number=SeqID_17087
MLHFYKSIYVSTFLVKIFELYSVDSQEMESSIVDALVASRKPRRDEREEEELEQAFFIIVSVATMLLSAMTWYHGKYSVRERAQNLELKRHSFLNRQYK

SEQ ID NO: 133866 - protein, 46 aa, Glycine max
  Coding DNA Sequence Number=SeqID_17088
MDTLEPYTGAMRGIVHEPQVPCYKVMTKDNDWYLKALHWGNEGHRA

SEQ ID NO: 133867 - protein, 250 aa, Glycine max
  Coding DNA Sequence Number=SeqID_17089
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=3e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=25; ConfidenceScore=5.71e-01
MATMYSPLMLSTCTPLKVRVCNPTKASACSPLKGRMCTPLKARASSPRKARLCSPLKVRTCSPVKARACSPLKGRSCCPLKGRTCSPLKARTCSPLMVTMYSPLKLSMCTALKVRVCNPTKARACSPLKGRMCTPLKARASSPRKARLCNPLKVRTCSPLKVRTCNPLKVRACSPQKVKPCSPRKARTCSPPKGRTCSPLMWRTCSPLKWSTCSSLKAMTCSPLKAWTCSPLKARTCSPLKGRTCRPLKG

SEQ ID NO: 133868 - protein, 418 aa, Glycine max
  Coding DNA Sequence Number=SeqID_17090
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q59385; Match level="QueryCoverage=50%, HitCoverage=25%, E-value=3e-55, Identity=53%"; Hit description =Copper-transporting P-type ATPase
  Pfam annotation: Domain name=HMA; Domain location=207-255; Score=3.9; E_value=0.72; Accession=PF00403.16; Description=Heavy-metal -associated domain
  Pfam annotation: Domain name=HMA; Domain location=292-353; Score =57.8; E_value=3.6e-14; Accession=PF00403.16; Description=Heavy-metal- associated domain
  Pfam module annotation: Pfam domain module=HMA::HMA; Domain location =207-255::292-353
SANRDADGADCASALVLAHAGWFTAGCGDARHQRLPAVERRGGGAGHVVRRPDAAVRVFLVSLDALSRKCAAAQYAQSARQPADWPAPDLARAGAGRFAGGHAGDRDRRVRHHAADSAAFAALPMTAARQVIDDGTFGTVIARAGCSQFQQTRAHRVQLFNMRRDLIRLLQGARFNIGTVARRVIKQRDQFAALLEREAHLPRLAQKIELVQMALEQRSDVEQAEVTQQEARVTGAASVSDLIATVEQAGYHATLKNEASSPKPDPLPAQEPQPEALTTESQPAEENLAVHHLLIGGMSCASCVSRVEQALQKVPGVSQARVNLGERSALVLGDAIPSALVSAVDEAGYSAEVIEDEQTRRERQQVSAQQAMRRFSWQAALALIVGVPMMIWGMLGDHMMLNDSNQTLWRVLGAVTLA

SEQ ID NO: 133869 - protein, 119 aa, Glycine max
  Coding DNA Sequence Number=SeqID_17091
MMVCPLVGHVSDTREEPHERVGSNMGNVGYGSNVDVNHLLSQIEELKRKVVVNEEKVCLYKEQIMELKKMLAKEEHQSQASYEVVVELRKKIAKQHTKINTEQKMVKVLGCIVAFLGVY

SEQ ID NO: 133870 - protein, 76 aa, Glycine max
  Coding DNA Sequence Number=SeqID_17092
RIAARLLWWHWRMVLSENAEELPLADMEKSKPTRKKMEWGEKKDRVRGTNKTKEKHTHLRLHHVRIKRREALETLI

SEQ ID NO: 133871 - protein, 133 aa, Glycine max
  Coding DNA Sequence Number=SeqID_17093
MEDNDNSSTLVPNNSTKELSRIQIEQHADVDYHVCPSLEAPKEDIGEDRMNSSAGFGDASADGRSVSPTKESPSCSMLDAEKPYSSSNRVMSAFPEANTQRVGKFETDLMAPPPMGLSPEVDDLSMGDFISET

SEQ ID NO: 133872 - protein, 170 aa, Glycine max
  Coding DNA Sequence Number=SeqID_17094
  Homolog annotation: Hit_ID=Q10GG7; Match level="QueryCoverage=66%, HitCoverage=23%, E-value=5e-16, Identity=44%"; Hit description=H1flk, putative, expressed
MGWHGSGKSTVLKNILDDKSLFRSDALNVAVVEADALKEGSPRARIFHFCIISLLVTALNEGLDVILDTTSSWEPYVTQTIAMAREVHKHSFCGRIKVIPITAVDPEAIKFLESFCGGIKVIPTKAVDPEAIKFLERLGTLNAEADSIYELHKEPSPIIESGIEYSTGLS

SEQ ID NO: 133873 - protein, 72 aa, Glycine max
  Coding DNA Sequence Number=SeqID_17095
  Homolog annotation: Hit_ID=P94077; Match level="QueryCoverage=50%, HitCoverage=19%, E-value=3e-10, Identity=72%"; Hit description=Zinc -finger protein Lsd1
MQRLKISGQGIYLVMNSLFYGFGIGIVLWEANLCVMGVGTSWFTLEEQPMFAVHCATPLPLFLLLFHSSHLD

SEQ ID NO: 133874 - protein, 151 aa, Glycine max
  Coding DNA Sequence Number=SeqID_17096
  Gene Ontology: Mol. function=nucleic acid binding
MLLQVLAVDWNTMQAPMFDRRLLPSDFVHPYYHVDTYINCYASILEPINREDMWQQTGLPTVLPPQVRVSIGRPKKARRRENDEAPKPHKLKRTNTSLRCGGCGAMRGAVPCEVWVRCSAMRGVVRCEVQVQGVMRVPYGAKTHLSVLHAS

SEQ ID NO: 133875 - protein, 483 aa, Glycine max
  Coding DNA Sequence Number=SeqID_17097
  Gene Ontology: Mol. function=nucleic acid binding
GYKGSVQIFYRQLGIRLDKDLVKVWNDDGAREIVKIAMDLIQKHVEVYIDHTSHMTEGVLLAIDEGGKPMVEGDSGNDVIDGKDSDREVDKFELDDRDKETDEDKGDDDNYEENDNYDGDDLDAEYDTDKLESDIASEEDYDCYALTMAAINGEDISIKPVSRRFQPHEMGRDFKFEVGMDFDSINQFKASIKEYANMHGFGLKFKKNDNVRCRVICQDSCEWMAYVSKVGGSTIYSMKTYNGKHTCAWSGGGNLATISESYCVKISSKKAYWARRIAKEKPSAYGSGEEFMRFYMCLNDVKQGFLQACRPIIGLDSCFLKTPFGGILLVAMGQDPNDQYYPLTVAIVESENKDSWKWFLQKLLSDIGHEHKWVFISNQQKELLPVFEHRVCVRHVYANMKKYFGGGVVLRDKMLAACKATYIGDWEQKMIMLKHEVHDWLMQLDPRFWSKAHMSEYSRCDMIMNNISEAFNGRILEAREQPI

SEQ ID NO: 133876 - protein, 94 aa, Glycine max
  Coding DNA Sequence Number=SeqID_17098
MGHEDEEDDDDNNNNDDDNDGGNHGTSHRIARHLTRHRMAPRTTPRTAPHTASHDTSHRTIARPAPRMTPHDTSHGTAPHLAIFVVVKYYFLLQ

SEQ ID NO: 133877 - protein, 304 aa, Glycine max
  Coding DNA Sequence Number=SeqID_17099
  Subcellular localization annotation: CTP_CleavageSite=47; ConfidenceScore=5.72e-01
MATPPNSPPPPLESTTPSPSTSKKTRKATRLKSLATRPARVERPVVHVNPVTGRGDGPHRKKLRKYWWIVTHDMVDVTFDNWKQVPIAQKDLIWEDIQGEDDKVCEKYDISKEKWTQFCQSRRDPSWEEASQSGSTNAVVDPLSPIRGHMKWKMARRKKLGQVTFEATKEITNKIDSLKEQASQGSFIAHVSWDATVFGVHNDNFPLYIKHEDLSEIAHGGQCLSISDNVVIWFCSLHNRPNNYLKGIINRNSTTINKVNPRLLLDGDAILPRKGPVTRAMSKRLQEDWARVDKEGLRVLMNLR

SEQ ID NO: 133878 - protein, 148 aa, Glycine max
  Coding DNA Sequence Number=SeqID_17100
MAFSTYPKSPTLMAFLADIKSPILLLFSMYTDLPSEKEQGKADPSWCRQANQRFYSAWPKRQCRACSKEHPHGKCFKTALNGEIVCKRTPFGEICQLMIVSRWWWFVEVYSGVNQGSDSSFLDLLEVFVGEVEVVHGDTICALEKTKE

SEQ ID NO: 133879 - protein, 115 aa, Glycine max
  Coding DNA Sequence Number=SeqID_17101
  Homolog annotation: Hit_ID=Q1SP37; Match level="QueryCoverage=49%, HitCoverage=17%, E-value=1e-11, Identity=57%"; Hit description =Bacterial adhesion
MDPNIDLDEFLDQMIDEEFEDNTNEEIIRLTLKSQQQLHGNTTRHSQRRKVVHRNREEDVLNNHDEYFQLRVDTLRRKGLSPLQKYTTAIHILAYGSPADSVDEYILIGETTALE

SEQ ID NO: 133880 - protein, 167 aa, Glycine max
  Coding DNA Sequence Number=SeqID_17102
MGNLTCSLLLLFSTIVIVTDHIVGANGDAALIEVVKKHIEIGIGLEALPLVEEEPPNKNNSQSNYNVDANEFPSEGLHHSLPLEKDLTSNPEVLETLGFFPQHLDEDALIPHDVAPYGAYTPWIFFMNDVLCFLKFMAAEWRMKKDNWRHHFKEKMSQEEAHHHRKP

SEQ ID NO: 133881 - protein, 64 aa, Glycine max
  Coding DNA Sequence Number=SeqID_17103
  Subcellular localization annotation: CTP_CleavageSite=35; ConfidenceScore=5.40e-01
MVVVVVVDDSFKMVVVCGGSDSSFLNRKCSLVKSRFSMVTQSAHWRRLRSETNGLAVVRFRIKG

SEQ ID NO: 133882 - protein, 202 aa, Glycine max
  Coding DNA Sequence Number=SeqID_17104
  Homolog annotation: Hit_ID=Q2HUH8; Match level="QueryCoverage=98%, HitCoverage=64%, E-value=2e-17, Identity=29%"; Hit description =Histidine triad (HIT) protein; Homeodomain-like
MIKNAYNNDNVRQSGQFCEKNWTQLKSRWNRIYPPVQKFNGCYKQADKHKRSGSSENDAMADAHMIYSQDTGKIFKCSKRTKVSASGNYSSSSNPKTLVEVEEYDTPSPISLPIGQKAAKRKSKGKESSNTLDLSGIESVMKDKNVNTSKLIQLKEAQERCLQEQERRMEYGILMKDTSNMSEQQRKDHAKYFDHIRKKLGY

SEQ ID NO: 133883 - protein, 56 aa, Glycine max
  Coding DNA Sequence Number=SeqID_17105
  Gene Ontology: Mol. function=nucleotide binding; Biological process =protein transport
  Homolog annotation: Hit_ID=Q6ASS4; Match level="QueryCoverage=70%, HitCoverage=17%, E-value=2e-09, Identity=80%"; Hit description=SNF7 family protein
MAVATRGIEREITSLQMEEKKLVAEIKREAKTGNEVDTDIGNCWKVALVEVTLGLP

SEQ ID NO: 133884 - protein, 54 aa, Glycine max
  Coding DNA Sequence Number=SeqID_17106
MASSLRNGHVAGKPPVVMATWPQVELATSTGEEREVATPIGELGQKDQPFQMAI

SEQ ID NO: 133885 - protein, 249 aa, Glycine max
  Coding DNA Sequence Number=SeqID_17107
MIDEPIYWIPTLKFLASCRGWQPTISPPEDDPHAEHHMTLAKFNIILGFEIDASILTEDYCWAKLGAYEGYTGANTWMKITCQGGYKAQHSKASQIRYPILRAIQKWLSGFLHCRKNSDGHIIIGAFIAKLAHYLGYDPDTDDTPPVPMFVIRRATFLSIGCIRQEENGYVLIEHAPQQQPPEGAPHKDEDMQDSLSTIQSSAASVLIRWKSASNLTMLLWQLTSMACRSGWTLIGRWFRHSWMPMTPD

SEQ ID NO: 133886 - protein, 132 aa, Glycine max
  Coding DNA Sequence Number=SeqID_17108
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=76%, HitCoverage=8%, E-value=1e-43, Identity=86%"; Hit description =Kinesin motor domain, putative
  Pfam annotation: Domain name=Kinesin; Domain location=2-131; Score= -94.4; E_value=2.5e-08; Accession=PF00225.13; Description=Kinesin motor domain
MDRVFRNDSPTKQVYEEAAKEVALSVLSGINSSIFAYGQTSSGKTYTMSGITDFAIADIFNYIEKRTEREFVLKFSTLEIYNESVRDLLSVDGTPLRLLDDPKGFGGEEGRMGVEEECGVEGGGGTGKKMKR

SEQ ID NO: 133887 - protein, 112 aa, Glycine max
  Coding DNA Sequence Number=SeqID_17109
MTSGFPATWPFHSELVIDNGGLLCNPCMNLHRALGRVLGRSLGRQIIGDEEEAPQRRRLTTSARRQQAIIVVAKDIDHVDHVADEVHEEPHEPIMDHECSKLKLSSHGRKVH

SEQ ID NO: 133888 - protein, 334 aa, Glycine max
  Coding DNA Sequence Number=SeqID_17110
  Gene Ontology: Mol. function=nucleic acid binding; Cellular component= nuclear pore; Biological process=DNA integration
  Homolog annotation: Hit_ID=Q1T4S3; Match level="QueryCoverage=48%, HitCoverage=13%, E-value=1e-29, Identity=42%"; Hit description=Zinc finger, CCHC-type
  Pfam annotation: Domain name=zf-CCHC; Domain location=120-137; Score =15.0; E_value=0.0034; Accession=PF00098.13; Description=Zinc knuckle
MSSSSINAVLVTGGPEQIDVILEGLPSEYESLVTAISTKAEDTDSESAPQVQFPQHNDGGRSPNSRGRGGRSGYGYRGDRNYGTNDNRNYGNNDSRNFGNGNHMNYGNAANYGNTDRYKIQCQVCYKFGHSAADCYHRFNPNYRPNSQPQQNAQAPQAYLANANPAQQAQNWYIDSEATHHVTASPQNLMNEVPTSGNEHVFLGNGQGLPIISTGSAIFQSPFASNVKLTLNNLLHVPHITKNLVSVDGSILPRGALSQDGLYVFSNLLNSSVKSTVGGASASVHMSSFSALSSHCNNVSTTEINNSNSSLVSLWHNRLGHPSSAVVTHVLKDS

SEQ ID NO: 133889 - protein, 89 aa, Glycine max
  Coding DNA Sequence Number=SeqID_17111
MAPPTDLRVIASEGFDLIDRFYGPSAQSRPKRNGVFPSRQGPWVVQVPNDELEEPMSVINSRDAAARYGGITIVNYPKPQTRLARSFKP

SEQ ID NO: 133890 - protein, 93 aa, Glycine max
  Coding DNA Sequence Number=SeqID_17112
  Gene Ontology: Mol. function=molecular_function; Cellular component =membrane; Biological process=auxin mediated signaling pathway
  Homolog annotation: Hit_ID=Q69PB3; Match level="QueryCoverage=98%, HitCoverage=27%, E-value=9e-17, Identity=45%"; Hit description =Putative MtN21
MANLVPAVTFIIAACAGMEKVNIRSTRSLAKIIGTVICVSGAVSMALLKGPKLLNAEILPSKSIMASGGDHWLLGCLFLTGCCCAWSVWLILM

SEQ ID NO: 133891 - protein, 53 aa, Glycine max
  Coding DNA Sequence Number=SeqID_17113
MEKKEAQEVVHEVVNELDNIPNFNGALRHRAINWLTGNPIKFEIIKALPLEKI

SEQ ID NO: 133892 - protein, 332 aa, Glycine max
  Coding DNA Sequence Number=SeqID_17114
  Gene Ontology: Mol. function=sequence-specific DNA binding; Cellular component=chloroplast thylakoid membrane
  Homolog annotation: Hit_ID=Q00ZC0; Match level="QueryCoverage=72%, HitCoverage=40%, E-value=1e-13, Identity=27%"; Hit description=[K] KOG1657 CCAAT-binding factor
  Subcellular localization annotation: CTP_CleavageSite=63; ConfidenceScore=5.93e-01
MFTASKLAFTLTPPRPCTAPLTPISSLSSSSSSSSASASGINFIQFNGRHLCLRRRLFLLSPKATADQQGKVEEFEDDSNVVDSKILPYCSIDKKEKKSIGELEQEFLQALQAFYYEGKAIMSNEEFDNLKEELMWEGSSVVMLSSDEQKFLEASMAYVSGNPIMSDKEFDELKLRLKKEGSEIVAEGPRCSLRSKKVYSDLSVDYLKMFLLNVPATVIALGLFFFLDDLTGFEITYLLELPEPFSFIFTWFAAVPLIVWIALSLTNAIVKDFVILKGPCPNCGTENTSFFGTILSISNGGSTNTVKCSNCGTAMEYDSTSRLITLPEGSNA

SEQ ID NO: 133893 - protein, 133 aa, Glycine max
  Coding DNA Sequence Number=SeqID_17115
HLSHSRVPSSSPRLLRCDTERVEGAGGALTSSQCHSVSLFLLTLTPHTVPKSLANSYIVCALAPNNHKICTVAEIGLNDACRRESATLWLKRKGTGAAGRKQSKKAAKEGKNPEEYESDKLKFEVNDDEVDGY

SEQ ID NO: 133894 - protein, 756 aa, Glycine max
  Coding DNA Sequence Number=SeqID_17116
  Gene Ontology: Mol. function=identical protein binding; Cellular component=cytoplasm; Biological process=negative regulation of enzyme activity
  Homolog annotation: Hit_ID=O82007; Match level="QueryCoverage=94%, HitCoverage=96%, E-value=0.0, Identity=55%"; Hit description=Serine protease
  Pfam annotation: Domain name=PA; Domain location=377-476; Score=96.7; E_value=7e-26; Accession=PF02225.12; Description=PA domain
  Pfam annotation: Domain name=Peptidase_S8; Domain location=139-605; Score=90.8; E_value=4.1e-24; Accession=PF00082.12; Description =Subtilase family
  Pfam annotation: Domain name=Subtilisin_N; Domain location=50-132; Score=58.1; E_value=2.9e-14; Accession=PF05922.7; Description =Subtilisin N-terminal Region
  Pfam module annotation: Pfam domain module=PA::Peptidase _S8::Subtilisin_N; Domain location=377-476::139-605::50-132
HIEPKNLCLSFFSIQQNMDSFFFIALHFVLSFHIHFAHGNELPSAASSSKTYIIHVEGPQGKNLAQSEDLESWYHSFMPPTIMSSEEQPRMIYSYRNVMSGFAARLTEEELRAVQKKNGFIYAQPERILHRQTTHTPQFLGLQQDMGFWKESNFGKGVIVGVVDSGITPGHPSFSDAGMPPPPPKWKGKCELNATACNNKLIGARSFNLAATAMKGADSPIDEDGHGTHTASTAAGAFVDHAELLGNAKGTAAGIAPHAHLAMYRVCFGEDCPESDILAALDAAVEDGVDVISISLGLSEPPPFFHDSTAIGAFAAMQKGIFVSCAAGNSGPFHGSLINGAPWVLTVGASNIDRSIAATAKLGNGQEFDGESVFQPSDFSPTLLPLAYAGKNGKQEAAFCANGSLNDSDFRGKVVLCERGGGIGRIPKGEEVKRVGGAAMILMNDESNGFSVLADVHVLPATHLSYDSGLKIKAYINSTAIPTATILFKGTIIGNSLAPAVTSFSSRGPNLPSPGILKPDIIGPGVNILAAWPFPLNNDTDSKSTFNIMSGTSMSCPHLSGVAALLKSSHPHWSPAAIKSAIMTSADIINFEHKLIVDETLYPADVFATGSGHVNPSRANDPGLVYDIQPDDYIPYLCGLGYGDTEVGIIAHKTITCSETSSIPEGELNYPSFSVVLGSPQTFTRTVTNVGEANSSYVVMVMAPEGVEVKVRPNNLTFSEANQKETYSVSFSRIESGNETAEYAQGFLQWVSAKHT

SEQ ID NO: 133895 - protein, 87 aa, Glycine max
  Coding DNA Sequence Number=SeqID_17117
MVVNFFLTHLLLEVASPIIFLPSSFASIKLQEAKNSIDEEHLRPTSSTWSYIMWYQKHLRLGDVLLLPLSFCSVLSFFIHNLLVLNL

SEQ ID NO: 133896 - protein, 720 aa, Glycine max
  Coding DNA Sequence Number=SeqID_17118
  Gene Ontology: Mol. function=identical protein binding; Cellular component=cytoplasm; Biological process=negative regulation of enzyme activity
  Homolog annotation: Hit_ID=O82007; Match level="QueryCoverage=95%, HitCoverage=93%, E-value=0.0, Identity=55%"; Hit description=Serine protease
  Pfam annotation: Domain name=PA; Domain location=352-451; Score=98.7; E_value=1.8e-26; Accession=PF02225.12; Description=PA domain
  Pfam annotation: Domain name=Peptidase_S8; Domain location=114-580; Score=91.6; E_value=2.3e-24; Accession=PF00082.12; Description =Subtilase family
  Pfam annotation: Domain name=Subtilisin_N; Domain location=25-107; Score=49.9; E_value=8.3e-12; Accession=PF05922.7; Description =Subtilisin N-terminal Region
  Pfam module annotation: Pfam domain module=PA::Peptidase _S8::Subtilisin_N; Domain location=352-451::114-580::25-107
MDAFLFILTFLLSFHKLSSAASSSKTYIIHVEGPQDKTLDQTEDLESWYHSFMPPTTMSSEEQPRMIYSYRNVMSGFAARLTEEELRTMEKKNGFISARPERMLHCLTTNTPQFLGLQKQTGLWKESNFGKGIIIGVLDSGITPGHPSFSDAGMPPPPPKWKGRCEINVTACNNKLIGVRAFNLAEKLAKGAEAAIDEDGHGTHTASTAAGAFVDHAELLGNAKGTAAGIAPYAHLAIYRVCFGKDCHESDILAAMDAAVEDGVDVISISLGSHTPKSIFDDSTAIGAFAAMQKGIFVSCAAGNSGPFHGSLINGAPWVLTVGASNIDRSIAATAKLGNGQEFDGESVFQPSDFSPTLLPLAYAGKNGKQEAAFCANGSLNDSDFRGKVVLCERGGGIGRIPKGEEVKRVGGAAMILANDESNGFSLSADVHVLPATHVSYDAGLKIKAYINSTAIPIATILFKGTIIGNSLAPAVTSFSSRGPNLPSPGILKPDIIGPGVNILAAWPFPLNNDTDSKSTFNFMSGTSMSCPHLSGIAALLKSSHPHWSPAAIKSAIMTSADIINFERKLIVDETLHPADVFATGSGHVNPSRANDPGLVYDIQPDDYIPYLCGLGYSDTQVGIIAHKTIKCSETSSIPEGELNYPSFSVVLGSPQTFTRTVTNVGEANSSYVVMVMAPEGVEVRVQPNKLYFSEANQKDTYSVTFSRIKSGNETVKYVQ

SEQ ID NO: 133897 - protein, 476 aa, Glycine max
  Coding DNA Sequence Number=SeqID_17119
  Gene Ontology: Mol. function=protein binding; Biological process =retrograde transport, endosome to Golgi
  Homolog annotation: Hit_ID=Q5KJA8; Match level="QueryCoverage=54%, HitCoverage=15%, E-value=9e-23, Identity=29%"; Hit description =Retrograde transport, endosome to Golgi-related protein, putative
  Pfam annotation: Domain name=Vps54; Domain location=408-475; Score= -28.1; E_value=0.0071; Accession=PF07928.3; Description=Vps54-like protein
MKSAIKTAVAELLPVLASRGSESEFFSGDRAVDADGGGASLASKLRSLSSDCFVHLLSAIFLIVQGGMFLGEVLVCPPTLKQFVLQRFEVFVKMGGNIVWQCSVPAHLVRAAEVKKAIEWILSNRDGHYAADSVVAAIAHGAAAAETSQESESHGTTFLPYSAQRSVAKGSSFQGKAIDSMSSSNMSKNFRADILRENAEAVFAACDAAHGRWAKLLGVRAILHPRLKLLEFLTIYNITQEFITATEKIGGRLGYSIRGTLQSQAKAFVDFQHESRMSKIKAVLDQETWVEIDVPDEFQSIISLLFTSDNLTSENLNETEDDISTSYNCVVTNNDVLPMADSSESTAEQQIMQSNSIESSMNNETPDRSKSPVDSTEPNKAHGRISSAHSNNTEKDHKKSTSQALYYKGVGYHMMLSEYIDMNNLLPTLSSEVVHRIVEILKFFNTRTCQLVLGAGAMQPLSYPCSSTLTFPFVMH

SEQ ID NO: 133898 - protein, 217 aa, Glycine max
  Coding DNA Sequence Number=SeqID_17120
  Gene Ontology: Mol. function=nucleic acid binding; Cellular component= mitochondrion; Biological process=DNA integration
  Homolog annotation: Hit_ID=Q1T4S3; Match level="QueryCoverage=99%, HitCoverage=17%, E-value=5e-59, Identity=49%"; Hit description=Zinc finger, CCHC-type
MLTIALTHHWSIQQIDVNNAFLNGYLEEVYMTQPPRFADSDKSMVCKLKKAIYGLKQAPRAWVISCSYSKLNYQTTCCFALKQLGNLDYFLGIEVKHLSNGSLLLSQAKYICDQLEKAKMVDAILTPMPSDLKLTKHGTIKLVSVPVADATLYRSVVGALQYITVTRPELSYSVNKEHWKAFKCILRYLKGTIDYGLSLKSAPQGEPYTSEAFCDAD

SEQ ID NO: 133899 - protein, 73 aa, Glycine max
  Coding DNA Sequence Number=SeqID_17121
MKYRYVTCKIEYNAPRFQHLTSIAPPQADLRKIGAEGFTLIDKFYGPARRNSANDAFHGRRGEHCWVVYNICV

SEQ ID NO: 133900 - protein, 88 aa, Glycine max
  Coding DNA Sequence Number=SeqID_17122
MAPPQADLRKIGAEGFALIDKFYGPARRNSVNDAFHGRRGDRCWVVYNVSNDVMEDSAAIGMEATTGHFAAKSAMNYPKAVSETNLYS

SEQ ID NO: 133901 - protein, 124 aa, Glycine max
  Coding DNA Sequence Number=SeqID_17123
  Gene Ontology: Mol. function=transferase activity, transferring nitrogenous groups; Biological process=ethylene biosynthetic process
  Homolog annotation: Hit_ID=Q9AVH0; Match level="QueryCoverage=40%, HitCoverage=10%, E-value=1e-15, Identity=78%"; Hit description=ACC synthase
MQSHRQTIEWVHLSLSSRRIFEYPFLKAAICKHIQLVKFIRVVANFMSEVRGGRVRFDPDRILMSGGATGANQLIMFCLANDGDAFLVPSPYYPAYVPSLSSRLVSFNESHYFTPIKTLKVNTN

SEQ ID NO: 133902 - protein, 971 aa, Glycine max
  Coding DNA Sequence Number=SeqID_17124
  Homolog annotation: Hit_ID=Q9FJ23; Match level="QueryCoverage=90%, HitCoverage=96%, E-value=0.0, Identity=54%"; Hit description =Arabidopsis thaliana genomic DNA, chromosome 5, TAC clone:K21P3
  Pfam annotation: Domain name=Filamin; Domain location=371-471; Score=- 20.2; E_value=0.08; Accession=PF00630.9; Description=FilaminABP280 repeat
MYPSLCVASWKGVRHEFEAGSKATIMVLLKDAFGNSISQTAEVSYLPDFKLYVLHENGSVASAPDISNIGWNEFDYVVIEFVVTIAGKFSLSLEGGNQTLNGSPLPLKLDFSLPQITGTIDVSNCIAKWNIESHAWQLASKMEIFIHQLDQYGNLVSGLYPFDSEVVERDTNLSIPISDLHFEEVDAGIQLFSFSNLEPGNFLLTIYDSKHDKSISNMPYVYTVFIGYCDGVKSVVNGSGLNDSVAGVKAEFSVYLNDIYQYPSPIEANILQVQILRENDSYSASPIIYPMLNNNASTIASRVRYDGISHMEAAPSPSIELGNNPNGSESFVMASAFHVKYILEKSGFYDINIHCGNILLNEGHSFRKEVKAGEVNVSLSSVVRFSSKVPKLSKNEIVVQLVDSYLNPVLSQQSRLKLEIAASTNSSGFLTSDIKDNKDGSYSCSYMAEDVGTYEICASFDGKRFLSCPFSINVYSSEYFPKANNDTISLWEDQSIALDALANDYFAGDKASIVEFSKPDHGSLMQNGRIFRYTPYKGYYGNDSFWYTISDINGNLATAFMYISVLNVPPQFVSVPNQLQATEDLISPRFGGFTGFELTYSNPKENISVNLSAQSGCILLSPVAMQFGQVMWSKLTIYSGNETTTSLIIEGSVEVINFALQSIQYLGNENFYGGDTIQVSARNKNGVNSLGVPIFVDPINDPPFIRVPYFIILKSNEDETLIFDQEKDKFDFFIGDPDLLTFPGGQAHFFVTFSMEVNDGFLVTNLPVHLINTTELKHRYNYQWQPLQTYVTISKHFIVKAHGIRFLGTVNDCNSVMQQLFYHGGERGAVLTLTLNDMGNYGCYPDCAEGMSMPLYTEAIVNLMRKQPMSSFLAHRKKKPREKVFRAIYCTKFPQRNCKSTNIADELQFAHSNMTMILFIVFSALRKLLKRSIQLYWHRYILHNKGVFGNTLNGRIACSNAKIRRTQTHTK

SEQ ID NO: 133903 - protein, 276 aa, Glycine max
  Coding DNA Sequence Number=SeqID_17125
  Homolog annotation: Hit_ID=Q337F4; Match level="QueryCoverage=70%, HitCoverage=71%, E-value=2e-19, Identity=25%"; Hit description=F-box domain containing protein, expressed
  Pfam annotation: Domain name=F-box; Domain location=13-60; Score =25.6; E_value=0.00018; Accession=PF00646.23; Description=F-box domain
MDNSKSAAMKGVWRNDLWSTEILITIFMSVNIVDLAVASLVCKMWNTACRDPSLWGKIDLSTLNNSYFFNIPNNQPGAYKRTSGKITQFLKTPNLKQLVLPRKGDFSRKAVHMAMKSWGGLESINISSGVPTDYIFPAIHEYCKSVNGIKFHCEFEEKHAEALIESTPNLKVFSIRSTVVSMKALRSVLTSVEHLEAVNIYHSFIVDMSHDEFSIFAIQDLHKYLPPSKERGVPVSSSMRFFIVINLFICSPEHKFKIITGSKHNNTQGVSYYIPS

SEQ ID NO: 133904 - protein, 97 aa, Glycine max
  Coding DNA Sequence Number=SeqID_17126
MAPQQDLVEIGLEGFELIDRFYGAPIRRPANNNVGKQRQGRWGVQATHQSHKEEPVVINSKEAASKFGGIMVVNYYPKTKPQNRWALVNIKSVITAE

SEQ ID NO: 133905 - protein, 54 aa, Glycine max
  Coding DNA Sequence Number=SeqID_17127
MVVFPWNWNILQAILMKELSHLRNMFESYADSVNNNPVFGGSQNRVLLGAPSIL

SEQ ID NO: 133906 - protein, 75 aa, Glycine max
  Coding DNA Sequence Number=SeqID_17128
  Homolog annotation: Hit_ID=O82290; Match level="QueryCoverage=65%, HitCoverage=12%, E-value=6e-10, Identity=64%"; Hit description =Expressed protein
MWDLKLFFSLFFQTFTHCLLYSNNPDLRWLDIMESSESLTVGSPQLLQGTPTYIVGDSTEINQKGAQKLATDLGY

SEQ ID NO: 133907 - protein, 105 aa, Glycine max
  Coding DNA Sequence Number=SeqID_17129
MDELISSLKLNVSQKAKTKHYFKTLNLVSNFDVENSDDELSEEEEEEEEKEELAFTTERVQNCSKGEKEQEGTTSKETSNKEKPLGKSNALNTTSLAISSLSFLS

SEQ ID NO: 133908 - protein, 104 aa, Glycine max
  Coding DNA Sequence Number=SeqID_17130
  Subcellular localization annotation: CTP_CleavageSite=88; ConfidenceScore=5.25e-01
MLLVTPLIIDFSMPLTLGHYTQHPCWSESSIGLNPSQVTHSKTFTTSSDTAQLLSRSLTVPTYQHDTFQRALSLLTHFLGNFPEGHLSRNYSKSSKLNCEILKW

SEQ ID NO: 133909 - protein, 139 aa, Glycine max
  Coding DNA Sequence Number=SeqID_17131
MKMRDYKPSTKLQMACQYLRVVKERIKEIFNEKQRHLKLESEMKVSICRSITCLGKRRANVTHSNGRVSPFNTCVFFLVAGGSFMAVPETPEWWLVTPMWGVCLQPSMLPLSKQHVLRNNMVRQRFGFRVRVVPEEEGQ

SEQ ID NO: 133910 - protein, 99 aa, Glycine max; identical to SEQ ID NO: 117973
  Coding DNA Sequence Number=SeqID_17132
  Homolog annotation: Hit_ID=UPI000044A741; Match level="QueryCoverage =46%, HitCoverage=11%, E-value=3e-09, Identity=69%"; Hit description =PREDICTED: similar to Ac1147, partial

SEQ ID NO: 133911 - protein, 315 aa, Glycine max
  Coding DNA Sequence Number=SeqID_17133
  Gene Ontology: Mol. function=DNA binding; Cellular component=nucleus; Biological process=regulation of transcription, DNA-dependent
  Homolog annotation: Hit_ID=Q9SEC4; Match level="QueryCoverage=77%, HitCoverage=89%, E-value=2e-76, Identity=59%"; Hit description=Myb -related transcription factor
  Pfam annotation: Domain name=Myb_DNA-binding; Domain location=14-61; Score=46.6; E_value=8.6e-11; Accession=PF00249.21; Description=Myb -like DNA-binding domain
  Pfam annotation: Domain name=Myb_DNA-binding; Domain location=67-112; Score=45.6; E_value=1.7e-10; Accession=PF00249.21; Description=Myb -like DNA-binding domain
  Pfam module annotation: Pfam domain module=Myb_DNA-binding::Myb_DNA -binding; Domain location=14-61::67-112
MGRQPCCDKLGVKKGPWTAEEDKKLINFILTNGQCCWRAVPKLAGLKRCGKSCRLRWTNYLRPDLKRGLLTEAEEQLVIDLHARLGNRWSKIAARLPGRTDNEIKNHWNTHIKKKLLKIGIDPVTHEPLKKQAAASSQDSSSSPAEHLPQPGNNLDDQVKETEGILLNSEENSSSSQAENSSGDDSLLLDSICSDDSLLNSMWLDETPLVEALWDTTPNLENTSNNMGLLPSWEDNCAWLLDCQDFVFYKNVSLGRWKVNVSSCEVPRQPKHKIDSKAKPNHHQNGTGHNKWEMSSECRNILYKEVYFENNEIDR

SEQ ID NO: 133912 - protein, 470 aa, Glycine max
  Coding DNA Sequence Number=SeqID_17134
  Gene Ontology: Mol. function=monooxygenase activity; Cellular component=membrane; Biological process=electron transport
  Homolog annotation: Hit_ID=Q0H212; Match level="QueryCoverage=84%, HitCoverage=78%, E-value=1e-162, Identity=73%"; Hit description =Abscisic acid 8'-hydroxylase
  Pfam annotation: Domain name=p450; Domain location=2-443; Score=33.9; E_value=1.6e-12; Accession=PF00067.12; Description=Cytochrome P450
MGWPYIGETFRMYSQDPTIFFATKIKRYGSMFKSHILGYPCVMISDSEAAKFILNKDQLFKPTYPASKERMLGKQAIFFHQGAYHANLRRLVLRTVMPETIKDLVSDIESIAQSCLKSCEGKLITTFLEMKTYTLNVALLTIFGRDENLCGEDLKRCYYTIERGYNSMPINLPGTLFHMAMKARKELAQIFTQIISTRRNMKQDHNDLLGLFMSEKSGLTDEQIIDNIVGVIFAARDTTASILTWILKYLDENPCVLEAVTLAIMIKFDGKFSCKLHHELCVVATSIANRDQSFAEEQESILRAKEESGEKMDLNWSDTKNMLITTRVIQETLRIASILSFTFREAIEDVEFQGHLIPKGWKVLPLFRIIHHSPDNFKEPEKFDPSRFEAITGDDIFANPHSFADRRASEWGRSPRLWNVSKKEGNNAEREKLSKKKERERCVKRGNDGDGASVVNILFHGAHTHFQFST

SEQ ID NO: 133913 - protein, 140 aa, Glycine max
  Coding DNA Sequence Number=SeqID_17135
MGEFTIQISNDLVNQLVDDMVPKKKTRKTRRKVARETEKPQSNETIKPDSAVTPGWPVQFPLFLPTTLPVQPSHSELEGIQSMLQESERVLQRLQKQEENMLQEVTQKAKDLHDKEYKLPNPKPEPCMAKRLTRNISRTP

SEQ ID NO: 133914 - protein, 345 aa, Glycine max
  Coding DNA Sequence Number=SeqID_17136
  Gene Ontology: Mol. function=oxidoreductase activity; Cellular component=membrane; Biological process=electron transport
  Homolog annotation: Hit_ID=Q9STI1; Match level="QueryCoverage=71%, HitCoverage=48%, E-value=3e-79, Identity=58%"; Hit description =Flavonoid 3', 5'-hydroxylase-like protein
  Pfam annotation: Domain name=p450; Domain location=48-344; Score= -92.6; E_value=9.3e-07; Accession=PF00067.12; Description=Cytochrome P450
MLPFSTLFQTPLTTEYWYNHPTTTLLAFLLISLVTCYAWLKPKAQRLPPGPSGLPFFGNLLSLDPDLHTYFAVLAQIHGPIFKLQLGSKLCIVLTSPPMARAVLKENDTVFANRDVPAAGRAASYGGSDIVWTPYGPEWRMLRKVCVAKMLSHATLDTVYDLRREEVRKTVSYLHDRVGSAVNIGEQVFLTVINVITNMLWGGVVEGAERESMGAEFRELVAEMTQLLGKPNVSDFFPGLARFDLQGVEKQMNALVPRFDGIFERMIGERKKVELEGAERMDFLQFLLKLKEEGGDAKTPLTITHVKALLMVRFLSQLLNFTFQFYLCSMGLWDTLALHFRIRRQ

SEQ ID NO: 133915 - protein, 68 aa, Glycine max
  Coding DNA Sequence Number=SeqID_17137
MEAEMVEDGDMVVVETCDDVGVTDMKERGTSMPLRISAEVWNTNYGGKSLMVLAISAKDFTMNVKGKE

SEQ ID NO: 133916 - protein, 119 aa, Glycine max
  Coding DNA Sequence Number=SeqID_17138
MMIRLQQVAANSTLLVTRNPISLKDTGKFEKKRNTEREREKELSIHSCILHQVDLAELFFHGAEEDGDKNGSGGKKFDGVESSFGGSAGMHQQEDAWRWNSETMMQDILGRLEALQPRG

SEQ ID NO: 133917 - protein, 334 aa, Glycine max
  Coding DNA Sequence Number=SeqID_17139
  Homolog annotation: Hit_ID=O24366; Match level="QueryCoverage=35%, HitCoverage=35%, E-value=3e-52, Identity=85%"; Hit description =Hypothetical protein sam2B
  Pfam annotation: Domain name=TPR_1; Domain location=152-185; Score =14.2; E_value=0.11; Accession=PF00515.18; Description=Tetratricopepti de repeat
  Pfam annotation: Domain name=TPR_1; Domain location=190-223; Score =3.1; E_value=2.3; Accession=PF00515.18; Description=Tetratricopeptide repeat
  Pfam annotation: Domain name=TPR_2; Domain location=152-185; Score =19.8; E_value=0.01; Accession=PF07719.7; Description=Tetratricopeptid e repeat
  Pfam annotation: Domain name=TPR_2; Domain location=190-223; Score =13.7; E_value=0.67; Accession=PF07719.7; Description=Tetratricopeptid e repeat
  Pfam module annotation: Pfam domain module=TPR_1::TPR_1::TPR_2::TPR _2; Domain location=152-185::190-223::152-185::190-223
MAVNLGNLALLLDLTSPRSVILERKARPAGSDVVLCAPPSKRDYPSSSSYAVVARGKSNSEKNGVDFDSDEEEEEEEEGGGGGGGFVDWETEMRQRVREFEERRELEKKAEELQSRVGEEGEEEETEEEKRMRVRKELEKVAKEQAERRATAQLMFDLGQKAYGKGSYGRAIEFLEAALTIIPGPTLFGGEIQIWLAMAYEAHNRHKDCIALYRQLEKTHPSVSIRRQAAELRYILQAPKLKISQEEMVTIPLIGSTYDRLFHPATYAIVLLELAFLPIAPRHVEATAYILCLQVKLSCSSSKYLFGTFLISVKCLSLGNFHASLNSGLQSPTL

SEQ ID NO: 133918 - protein, 430 aa, Glycine max
  Coding DNA Sequence Number=SeqID_17140
  Gene Ontology: Mol. function=racemase and epimerase activity, acting on carbohydrates and derivatives; Cellular component=integral to membrane; Biological process=carbohydrate metabolic process
  Homolog annotation: Hit_ID=Q9STI6; Match level="QueryCoverage=98%, HitCoverage=99%, E-value=1e-152, Identity=64%"; Hit description =Nucleotide sugar epimerase-like protein
  Pfam annotation: Domain name=3Beta_HSD; Domain location=96-381; Score= -75.9; E_value=2.1e-07; Accession=PF01073.9; Description=3-beta hydroxysteroid dehydrogenaseisomerase family
  Pfam annotation: Domain name=Epimerase; Domain location=95-352; Score= 223.3; E_value=5.3e-64; Accession=PF01370.11; Description=NAD dependent epimerasedehydratase family
  Pfam annotation: Domain name=NAD_binding_4; Domain location=97-323; Score=-59.1; E_value=8.2e-05; Accession=PF07993.2; Description=Male sterility protein
  Pfam annotation: Domain name=Polysacc_synt_2; Domain location=95-399; Score=-188.1; E_value=0.029; Accession=PF02719.6; Description =Polysaccharide biosynthesis protein
  Pfam annotation: Domain name=RmlD_sub_bind; Domain location=94-422; Score=-151.6; E_value=0.00039; Accession=PF04321.7; Description=RmlD substrate binding domain
  Pfam annotation: Domain name=adh_short; Domain location=93-263; Score= -31.3; E_value=0.00063; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=96-381::95-352::97-323::95-399::94-422::93-263
  Subcellular localization annotation: CTP_CleavageSite=58; ConfidenceScore=5.15e-01
MSQVNEHHHHAPSTPGKLKPEKSPYNRLRIHSSLSKLTLWSSFFLAFILFLFILSPPSPSASPRRRSLGDSWGGSHWEKRVAKSARRSSPSSLSVLVTGAAGFVGSHVSLSLKRRGDGVVGLDNFNRYYDPALKRARQRLLDRAGVFVVDADLNDSALLRKLFDVVPFTHVMHLAAQAGVRYAMQNPQSYIHSNIAGFVNLLEASKSANPQPSIVWASSSSVYGLNSKVPFSEKDRTDQPASLYAATKKAGEEIAHSYNHIYGLSITGLRFFTVYGPWGRPDMAYFFFTKDILKGKQITIFESLDGGTVARDFTYIDDIVKGCLGALDTAKKSTGSGGKKKGPAQFRVFNLGNTSPVPVSELVAILEKLLKVKAKKKVLPMPTNGDVKFTHANISLAHRDLGYRPTTDLETGLRKFVKWYLEFYSKKSSW

SEQ ID NO: 133919 - protein, 61 aa, Glycine max
  Coding DNA Sequence Number=SeqID_17141
MVRSTSPSLVIGVERVNKNPFECKNFELLRIVAPMALLPDEGIRKIKLKPAAPPPTVLAHL

SEQ ID NO: 133920 - protein, 364 aa, Glycine max
  Coding DNA Sequence Number=SeqID_17142
  Gene Ontology: Mol. function=CD4 receptor binding; Cellular component= trans-Golgi network transport vesicle; Biological process=antigen receptor-mediated signaling pathway
  Homolog annotation: Hit_ID=Q8S747; Match level="QueryCoverage=80%, HitCoverage=86%, E-value=1e-102, Identity=63%"; Hit description =Putative acid cluster protein 33
MKGVFSAPGDYVHFKSQVPLHKIPIGTKQWRYYDFGPKAVPPLICLPGTAGTADVYYKQIMSLSMKRGEEWWVRNGFIERADRGREDSVQGYRVISVDIPRVWNNTEWIQAFEKFLDAIDVHHRYVLTGIRDGPHEPFIADSVDFVVSQVETLSREDLASRLSLTTDAASVGPLLLSVSFITIMDTNDYCAIPQQLKDQLGERYPEARRAYLKTGGDFPFLSRPDEVNLHLQLHLRRVGVEPRPDLVHNIPKGDIGGSPSKENNEDDSDESHKDNGGGSENPPAEYEINPTSPESSGSGNLDKQPLDSSECCHLFPGGFPREKHIVPPGTPLHFVWEYIVFFHLLHIRSLCIIWNYSLEFRQFV

SEQ ID NO: 133921 - protein, 177 aa, Glycine max
  Coding DNA Sequence Number=SeqID_17143
  Gene Ontology: Mol. function=structural constituent of ribosome; Cellular component=ribonucleoprotein complex; Biological process =translation
  Homolog annotation: Hit_ID=Q6L4B2; Match level="QueryCoverage=74%, HitCoverage=80%, E-value=7e-67, Identity=94%"; Hit description=40S ribosomal protein S13, putative
  Pfam annotation: Domain name=Ribosomal_S13_N; Domain location=24-79; Score=113.6; E_value=5.5e-31; Accession=PF08069.3; Description =Ribosomal S13S15 N-terminal domain
  Pfam annotation: Domain name=Ribosomal_S15; Domain location=84-170; Score=87.1; E_value=5.5e-23; Accession=PF00312.12; Description =Ribosomal protein S15
  Pfam module annotation: Pfam domain module=Ribosomal_S13_N::Ribosomal_ S15; Domain location=24-79::84-170
  Subcellular localization annotation: CTP_CleavageSite=31; ConfidenceScore=5.27e-01
RPSRNPNKKNHSFKRVTSTSHGSYAQPRGISSSALPYKRTPPSWLKISSQDVEENICKFAKKGLTPSQIGVILRDSHGIAQVNSVTGSKILRILKAHGLAPEIPEDLYHLIKKAVSIRKHLERNRKDKDSKFRLILVESRIHRLARYYKKTKKLPPVWKLSEMAVVFGFNNIIVEKI

SEQ ID NO: 133922 - protein, 97 aa, Glycine max
  Coding DNA Sequence Number=SeqID_17144
VEENPSGWKNKIVKYLKHKALPIDKRKSKKLRMQASRLTMCFKNYMKVSAACILGENNGHKSVEGRVLLTNFEDRLFKLCREMAPMPKAWEFDTSAD

SEQ ID NO: 133923 - protein, 80 aa, Glycine max
  Coding DNA Sequence Number=SeqID_17145
  Gene Ontology: Mol. function=calcium ion binding; Cellular component =plasma membrane; Biological process=G-protein coupled receptor protein signaling pathway
  Homolog annotation: Hit_ID=Q84U32; Match level="QueryCoverage=99%, HitCoverage=54%, E-value=1e-27, Identity=75%"; Hit description =Putative serine/threonine kinase
MAEENLTEPFDFSRFLDLMGKHLKVEPFDGPLHDAFKVHDKESTGHVSVTTLRHILTNIGEKLEPSEFDEWIKEANVVSD

SEQ ID NO: 133924 - protein, 519 aa, Glycine max
  Coding DNA Sequence Number=SeqID_17146
  Pfam annotation: Domain name=zf-CCHC; Domain location=216-233; Score =9.2; E_value=0.031; Accession=PF00098.13; Description=Zinc knuckle
MEFLINNILPHSAKSFLLTINTSKVGFYNKVVGGAVSCDMWMCRARNEEHWLRPMRGESYELVRGEAGGGGLSGFFLSGGYEGLCQRPSSYSFVGLLPFSAMDKDMALAVLIDDDLVIMIPETLVHNSDDQQGETWEVGPIETFNAKAFKMTMAYAWRVKGGACPFSDEKEEIRFGSFFRIWVLLDVSKPLHLGTRVKVGEKDARWIPLKYKRLANFCYVYGRIDHLLRDCEEGGVEGEENDTQCLPIGIDLRSTFMRPNIVAWTQHDVSFGSLKKLNIMNKESSIVLHVLRDIGDNEGGGPQNVNEEESSITKVAYLENLNLIHSEGPKVSLILDSVERQMLQGGSASPKKSHPKGSSRFGVPYGNLKEACGDRHLSWNLLGNLKLEWNMPWFWIGDFNVVLSQEQKVGRDIVDLNQTRQFNSALVDCKLSDIGINERWRRKWPNIIVSTLSRYRSDHNPILTECCDLSSGRGRRKKISKVYKFEQMWLERWEEFESIVFHSWILRQNLKRMGANFEA

SEQ ID NO: 133925 - protein, 305 aa, Glycine max
  Coding DNA Sequence Number=SeqID_17147
  Gene Ontology: Mol. function=oxidoreductase activity; Cellular component=membrane; Biological process=electron transport
  Homolog annotation: Hit_ID=Q2LAK3; Match level="QueryCoverage=99%, HitCoverage=87%, E-value=1e-105, Identity=61%"; Hit description =Cytochrome P450 monooxygenase CYP89H3
  Pfam annotation: Domain name=p450; Domain location=1-303; Score= -41.2; E_value=4.2e-09; Accession=PF00067.12; Description=Cytochrome P450
MFTLLVFMCFGGEVQKEKIEDIEHVQRCLMSELSRFGVLNLLPGVVTRVLLRKRWQELLDLRQAQKDVFTQLIKTIKNVSDGDGGVICYVDTLLKLQLPEENRKLDEGEVVALCSEFLTAGTDTTCMALEWVMANIVKYTHVQKRVVEEIKEVLGDRKDKEVKEEDLNKLPYLKDVILEVTEDVVLNDYLVPKNVTVNFMVAEMGRDPRVWEDPMEFKPERFLSSGFEAFDIIGSKKVKMMPFGAGRRACPPYNLAMFHLEYFVAKLVWNFEWKASSGGNVDLSRKQEFTMVMKHPLHAQIYPRF

SEQ ID NO: 133926 - protein, 188 aa, Glycine max
  Coding DNA Sequence Number=SeqID_17148
  Homolog annotation: Hit_ID=Q69VA2; Match level="QueryCoverage=70%, HitCoverage=7%, E-value=2e-52, Identity=74%"; Hit description =Putative leucine rich repeat protein
MGVGLFPSNPILVDPTTTTFNPWKNRIHKVKIAHNRGKTGIAFLLVIEREQLKSQEPDVLKEVKQNLELGSVKFEVLCDKDQTSKKISSVGTYERRILEINRKRVKVVKPATKTSFPATEIRGSYAPPFHVELFRNDQHRLRIVVDSENEADLMVHSRHIRDVIVLVIRGLAQRFNSTSLNSLLKIEA

SEQ ID NO: 133927 - protein, 68 aa, Glycine max
  Coding DNA Sequence Number=SeqID_17149
MYNKVVKLESLTYTGGGFVDSTYWLPSNEALAAFSQPSKKPSCHVCHPDHRDGLKHVSGCLEERLVLP

SEQ ID NO: 133928 - protein, 671 aa, Glycine max
  Coding DNA Sequence Number=SeqID_17150
  Gene Ontology: Mol. function=nucleic acid binding; Cellular component= oxygen evolving complex; Biological process=DNA integration
  Homolog annotation: Hit_ID=Q0KIN0; Match level="QueryCoverage=33%, HitCoverage=16%, E-value=7e-63, Identity=54%"; Hit description =Integrase core domain containing protein
MEKSIRIICDHNVHTKLKGNQKLILPLFQSVTDGISDQSETDTVPVQSSDTEQTDSPVTDNAVIPYLSVPSSSNINTTEPSSSNTPPSPPRPANTRPIRTRSKSSIHLPRINPSLLLTPCEPKSVKLALTDPNWLSAMQLEYEALMKNHTWDSVPLPSNRKAIGCKWVFRVKENADGSINKNQGILAQLDVNNVFLNDLLNETVYMSQPPGFQQSNPSMAEISYSVNKVCQSFRFPLDYSEKNPKILERVECKVFDSKFECVWMKNEDDNNGVQVRLKNEAPPFRVVVTLNTTSSTTSTTTTSSTVKGVRDKGKGIPKVPPIVPMPTVAPNPPPLQVYYRRTQAPLTTPPSDPPTSSPTTNALLPLLPTHKYPIALCKSIWFTRNDNPKYAFTLKCDHLTPSYFSFISSLDFVPIPKSQVKPWLTTIGNRDVGRNGCFGCQQHMGAPAIRHCSLHQLDIKNVFLHGDLQEKVYMDQSPDFTVSSDSRLVCRLRHSLYGLKQSPRAWFGCFSSTLLEFVVYVDGIFITGDESDDILCHKFHLHSQFQTKNLGPLRYFLGIKVVQSSSGIVISQQKYVVDILIETSMLDCRSSNTPMDPNVKLLQSQREPLKDPKRYCRLVSKLNYLTITKPDITFAVSVAMSKLFAILMLIGQDHHQIGSPLLDIVFSLEKT

SEQ ID NO: 133929 - protein, 271 aa, Glycine max
  Coding DNA Sequence Number=SeqID_17151
  Gene Ontology: Mol. function=protein kinase activity; Cellular component=membrane; Biological process=protein amino acid phosphorylation
  Homolog annotation: Hit_ID=Q1T053; Match level="QueryCoverage=80%, HitCoverage=63%, E-value=1e-100, Identity=82%"; Hit description =Protein kinase
  Pfam annotation: Domain name=Pkinase; Domain location=8-270; Score =99.1; E_value=1.3e-26; Accession=PF00069.15; Description=Protein kinase domain
  Pfam annotation: Domain name=Pkinase_Tyr; Domain location=8-254; Score=74.9; E_value=2.6e-19; Accession=PF07714.7; Description =Protein tyrosine kinase
  Pfam module annotation: Pfam domain module=Pkinase::Pkinase_Tyr; Domain location=8-270::8-254
MEQATFSFSDDNLLGKGGFGRVYRGTLKSGEVVAIKKMELPAIKAAEGEREFRVEVDLLSRLDHPNLVSLIGYCADGKNRFLVYEYMHNGIGERKMDWPLRLKVALGAAKGLAYLHSSSCLGIPIVHRDFKSTNVLLDAKFEAKISDFGLAKLMPEGQETHVTARVLGTFGYFDPEYTSTGKLTLQSDVYAFGVVLLELLTGRRAVDLNQCPNDQNLVLQKNVGLGIVGMVLNGWRSRIVADPQFPFEVLMEELDFVFSTLVVGSILNFIL

SEQ ID NO: 133930 - protein, 123 aa, Glycine max
  Coding DNA Sequence Number=SeqID_17152
  Gene Ontology: Mol. function=RNA-directed DNA polymerase activity; Biological process=RNA-dependent DNA replication
  Homolog annotation: Hit_ID=Q1T5Q8; Match level="QueryCoverage=97%, HitCoverage=17%, E-value=8e-24, Identity=45%"; Hit description=RNA -directed DNA polymerase
MREALDKRLFSSFMVGKNNEPVNILQYADDTILFGEANMHNVKTIKAVLRSFELVSGLKINYAKSCVGAIGKSELWQREAADYLNCNMLSMPFMYLGIPIGANPRRSEVWGPIVRKCERKLAR

SEQ ID NO: 133931 - protein, 143 aa, Glycine max
  Coding DNA Sequence Number=SeqID_17153
TMPPFNALIRRLTLNALGAVISTPYLVVKLLNDDLKVVTIRASGKLILIPGMWEILIVDLDCGIKLSVGKPLSSNGMKNVRQLFRSKRDFVVTIGTHKTEANLLCMEHAPRSQAQIPKSGEDGLCFDYISKTVKVVLLVTSDS

SEQ ID NO: 133932 - protein, 147 aa, Glycine max
  Coding DNA Sequence Number=SeqID_17154
MDLGKTVLEGKSDTVRVSICITQVIENRVLGIPYELTPRMLALKLKPPNLSQKNDDLGLVHRWIVVKFGHHVHNPIKSILTIGNFDIMSELREIPLALEKNKSHGDSTSGGFNPFSVSLTFRNSIRAARGKKLEESQRTARDAAIAG

SEQ ID NO: 133933 - protein, 269 aa, Glycine max
  Coding DNA Sequence Number=SeqID_17155
  Gene Ontology: Mol. function=protein binding
  Homolog annotation: Hit_ID=Q00NU6; Match level="QueryCoverage=59%, HitCoverage=10%, E-value=6e-55, Identity=63%"; Hit description=AIR9 protein
  Pfam annotation: Domain name=LRR_1; Domain location=178-198; Score =10.0; E_value=3.9; Accession=PF00560.23; Description=Leucine Rich Repeat
  Pfam annotation: Domain name=LRR_1; Domain location=200-222; Score =8.6; E_value=7; Accession=PF00560.23; Description=Leucine Rich Repeat
  Pfam annotation: Domain name=LRR_1; Domain location=245-265; Score =4.8; E_value=36; Accession=PF00560.23; Description=Leucine Rich Repeat
  Pfam module annotation: Pfam domain module=LRR_1::LRR_1::LRR_1; Domain location=178-198::200-222::245-265
  Subcellular localization annotation: CTP_CleavageSite=51; ConfidenceScore=5.59e-01
AGARSGASSGSEPVRRSLPELRRSSVTSSRVAVKPAVASPAAPASASRTSVASKVEVAKKPVSKPALSALTSASSLSRRIGSSSVDSTASSSGSARRTVSRVSSPTVSSGLKAGYLSTSQDRTSAMSGRRKGSTADSRDSRFIVLPQVEIKANDDLRLDLRGHRVRSLNASGLNLSSNLEFVYLRDNLLSTLEGVEVLTRVKVLDLSFNEFKGPGFEPLENCKVLQFLSVAQNKLKSLTMASQPRLQVLAASKNKISTLKGFPYLPVLE

SEQ ID NO: 133934 - protein, 95 aa, Glycine max
  Coding DNA Sequence Number=SeqID_17156
MEVSSEKSGEDVAPEMLQSSPKKNVPEASRRAAKTVADGPVSAKRKVEPRTGSVTAATKRSGSIGGSASAGSAPRRNSTGGLSQKASISDGRRKT

SEQ ID NO: 133935 - protein, 132 aa, Glycine max
  Coding DNA Sequence Number=SeqID_17157
MGVECAQCCLDLGKGGAEWCDAMQCNAVWWQSVLQHKSRGASLSTLRDTNLMGLGCWCDMVAEEDGSWISWVSVAEGGGWLWVVLEMVNLDSSTMRGRRRGDAGLTGASSMGGGCAESPPTFIQGKRRKNRK

SEQ ID NO: 133936 - protein, 58 aa, Glycine max
  Coding DNA Sequence Number=SeqID_17158
MERKDYFYDEYLNINFDDILNYWSRYVGLWSSPEVEPTETEIARKKNRVQYQLNPKTH

SEQ ID NO: 133937 - protein, 94 aa, Glycine max
  Coding DNA Sequence Number=SeqID_17159
MIDSPQGVVATWLEWCVMWTLSKTSQKSLCELKVVCSQKDIEANTAEGEIKIPVACTCNLGSGFFNISCTICGKAVVEMGPIVTHLASLRGISG

SEQ ID NO: 133938 - protein, 56 aa, Glycine max
  Coding DNA Sequence Number=SeqID_17160
MGFPLPAVIYPAENLSGQKIFCSLSCIRYSLSLKEILLSFSSGERMRILFMGQGSK

SEQ ID NO: 133939 - protein, 654 aa, Glycine max
  Coding DNA Sequence Number=SeqID_17161
  Gene Ontology: Mol. function=protein-tyrosine kinase activity; Cellular component=integral to membrane; Biological process=protein amino acid phosphorylation
  Homolog annotation: Hit_ID=O49654; Match level="QueryCoverage=98%, HitCoverage=95%, E-value=0.0, Identity=52%"; Hit description=Leucine rich repeat receptor kinase-like protein
  Pfam annotation: Domain name=LRRNT_2; Domain location=1-34; Score =12.7; E_value=0.04; Accession=PF08263.3; Description=Leucine rich repeat N-terminal domain
  Pfam annotation: Domain name=LRR_1; Domain location=110-132; Score =16.3; E_value=0.11; Accession=PF00560.23; Description=Leucine Rich Repeat
  Pfam annotation: Domain name=LRR_1; Domain location=134-156; Score =10.4; E_value=3.2; Accession=PF00560.23; Description=Leucine Rich Repeat
  Pfam annotation: Domain name=LRR_1; Domain location=158-180; Score =14.3; E_value=0.45; Accession=PF00560.23; Description=Leucine Rich Repeat
  Pfam annotation: Domain name=LRR_1; Domain location=182-204; Score =18.5; E_value=0.024; Accession=PF00560.23; Description=Leucine Rich Repeat
  Pfam annotation: Domain name=LRR_1; Domain location=62-84; Score =10.2; E_value=3.5; Accession=PF00560.23; Description=Leucine Rich Repeat
  Pfam annotation: Domain name=LRR_1; Domain location=86-108; Score =13.0; E_value=1; Accession=PF00560.23; Description=Leucine Rich Repeat
  Pfam annotation: Domain name=Pkinase; Domain location=378-643; Score =2.1; E_value=1.1e-08; Accession=PF00069.15; Description=Protein kinase domain
  Pfam annotation: Domain name=Pkinase_Tyr; Domain location=378-643; Score=-0.1; E_value=1.8e-12; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=1 -34::110-132::134-156::158-180::182-204::62-84::86-108::378-643::378 -643
MDLKSSLDPQDKLLGSWISDGDPCSGSFLGVVCNEHNKVANISLPGRGLSGVVSPAVAELKCLSGLYLHYNYLSGDIPREIVNLKELLDLYLNFNNLSGTIPPDIANMTSLQVLQLGYNQLEGNIPEELGSLKQLNDISLQHNKLAGQIPQSLGSLEKLRRLYLSYNNFNGTIPAALADIANLEILDIQNNSLSGTVPSALQRLREGFQGANNQGLCGDGFSTLKACNKDTIFGVSQISAPNISINRIPPITFPKPVNTHLHCNQTPCSKSRSFLHLVIAASVTTTVITLISSGLFIFVRYRRQRQRVRNTSDYSEGQRSPYQPKEFYRSSSPLVNLEYYYDGWDSLADGQNESGLSLEYLNRFRFNIDEIESATQHLSEANLLSKSKFSAVYKGVHRDGSLVAIISISVTCCKTEEGEFLKGLSLLTSLRHENIVKMRGFCYSRSRGEWFFVYDFATRGNLSQYLDKEDGSDHVIEWSKRVSIIKGIAKGIGYLHNNEASKPIIVHQNISVEKVILDHEFNPLITDAGLPKLLADDVVFSALKASAAMGYLAPEYITTGRFTEKSDIYAFGVIVLQVLSGKALIGGSIREAVEAFRFEDFVDTNLKGAYSKSEAAILSKLAIQCTLEVPEQRPTMVEVIQELTMLPNPSSHSS

SEQ ID NO: 133940 - protein, 305 aa, Glycine max
  Coding DNA Sequence Number=SeqID_17162
  Gene Ontology: Mol. function=metallopeptidase activity; Cellular component=extracellular region; Biological process=proteolysis
  Homolog annotation: Hit_ID=Q6D6B0; Match level="QueryCoverage=80%, HitCoverage=50%, E-value=6e-53, Identity=47%"; Hit description =Putative iron-regulated membrane protein
  Pfam annotation: Domain name=PepSY_TM; Domain location=156-182; Score= 20.3; E_value=0.0068; Accession=PF03929.6; Description=PepSY -associated TM helix
  Pfam annotation: Domain name=PepSY_TM; Domain location=201-227; Score= 13.5; E_value=0.78; Accession=PF03929.6; Description=PepSY-associated TM helix
  Pfam annotation: Domain name=PepSY_TM; Domain location=21-47; Score =20.8; E_value=0.0049; Accession=PF03929.6; Description=PepSY -associated TM helix
  Pfam module annotation: Pfam domain module=PepSY_TM::PepSY_TM::PepSY _TM; Domain location=156-182::201-227::21-47
RKTALSAVHSAAPRGAVLNLLRRLHFYIGLFVAPFIFVAALSGTLYVLTPQLENLIYADALTAQPQGNAQPLSAQIAAARAYAGENQHIYAVRPAPAARDTTRVQFSDATLGPSQSRAVFIDPYSLKVTGDMTVYGTSGVLPLRTTLDLLHSSLLLGDFGRNYSELAASWLWVAALGGVLLWLGTRPKRRLKTVRKGFAFTRHWHITLGLTLMLGLLFFSVTGLTWSQWAGGNIDKMRTELNWLTPQVNTALSGDAPAAPADPHADHRSMPDMDMTSMPMSSMAKPAAQPAKSLPANAADADWDR

SEQ ID NO: 133941 - protein, 445 aa, Glycine max
  Coding DNA Sequence Number=SeqID_17163
  Gene Ontology: Mol. function=protein binding; Cellular component =mitochondrion; Biological process=vesicle docking during exocytosis
  Homolog annotation: Hit_ID=Q1RVB0; Match level="QueryCoverage=99%, HitCoverage=64%, E-value=0.0, Identity=87%"; Hit description=Sec1 -like protein
  Pfam annotation: Domain name=Sec1; Domain location=1-429; Score= -163.9; E_value=4.8e-05; Accession=PF00995.13; Description=Sec1 family
MQGFITNNERALVELFGDEENNRKAVACLNVMATRIATLFASLREFPFVRFRAAKSLDATTMTTFHDLIPTKLAAGVWDCLMKYKKTIPNFPQTETCELLIIDRTIDQIAPVIHEWTYDAMCRDLLNMEGNKYVHEVPSKTGGPPERKEVLLDDHDPIWLELRHAHIADASERLHEKMTNFISKNKAAQIQHGSRGSGEMSTRDLQKMVQALPQYSEQIDKLSLHVEGIPLTEINPLGTVTIETRKINRIIRESGLRELGQLEQDLVFGDAGMKDVIKFFTTNEDTTRENKLRLLMILASIYPEKFEAEKGLNLMKVAKLTDEDAIAINNLRMLGGEPDTKTTSTSSFALKFDMHKKKRAARKDRSGEEDTWQLSRFYPIIEELIEKVSKNELSKLDYPCLNDPSPTFHGTTYAVPVTHNPPAHSMRSRRTPTWARPRGSDDGYS

SEQ ID NO: 133942 - protein, 46 aa, Glycine max
  Coding DNA Sequence Number=SeqID_17164
MVKPVQPVNYSVGINELEIDVVATCQAIVQPSKSNCTTSIVFHKLA

SEQ ID NO: 133943 - protein, 383 aa, Glycine max
  Coding DNA Sequence Number=SeqID_17165
  Gene Ontology: Mol. function=zinc ion binding
  Homolog annotation: Hit_ID=Q6ZJ59; Match level="QueryCoverage=80%, HitCoverage=82%, E-value=8e-50, Identity=40%"; Hit description =Putative glycine-rich protein
  Subcellular localization annotation: CTP_CleavageSite=68; ConfidenceScore=5.55e-01
MQGPGGGRDPFFDFGGFGGFGSFGPPRSLISSFFGGRDPFSDPFFAQPFGGMFESSPFGGPTGFPFPTGMNPSGFLEHPAPGLDPSGFLEHPGMHPSGFLARQNPEPSRQRRGPIIQELDSDEENDDTAEKKENPRKHGRSDGEPSVEHPDDEIEGKKIRQAGNESRINIIGPQPQSHSFCFQSSTVSYGGPNGLYYTSSRTRRSGSDGVTFEERKEADSSTMQASHLISRGIHGKGHSLSRNLNSDGRVDTRQTLLNINEVLPRVAAAPWMPGALHLAVAPGMAIPEGFGCDFVDELAGFEEQWKEKGQKYLPGWTASVEASGSNGQAEQARSGGWALPSSEYSHTVGTISEARDEVGSSRSQERGVADTKALMFLKYPTPN

SEQ ID NO: 133944 - protein, 798 aa, Glycine max
  Coding DNA Sequence Number=SeqID_17166
  Gene Ontology: Mol. function=RNA-directed DNA polymerase activity; Cellular component=mitochondrial respiratory chain; Biological process=RNA-dependent DNA replication
  Homolog annotation: Hit_ID=Q9CA78; Match level="QueryCoverage=90%, HitCoverage=95%, E-value=0.0, Identity=60%"; Hit description =Putative type II intron maturase; 7603-5342
  Pfam annotation: Domain name=Intron_maturas2; Domain location=572 -726; Score=15.6; E_value=7e-07; Accession=PF01348.12; Description =Type II intron maturase
  Pfam module annotation: Pfam domain module=Intron_maturas2::RVT_1; Domain location=572-726::156-417
MRIVTTANLFKSLHNLQFIRLTSSLPLLLKFSDKHHVETPPHGATYSPDNEHVGKSTLAMDLASLLEEPPLKPKPKSRMEQKRFLELRIKKRVKEQHFNGKFHDLMKTVISNAETLRDAYNCIRINANTHDAASSHDGASFLDDLAEELGKRDFDVCANTSSFSTRRGSANKEVLVLPNLKLRVVQEAMRIALEVVYKPYFSKISHGCRSGRGRAAALKYVCKGVLSPDWWFTMLVVKKLDAAVLEKMISIMEDKIEDPCLYDFIRSMFDARVLNLEFGGFPKGHGLPQEGVLSPILMNIYLDLFDSEFCRLSMKYEGICNGGGLNDGDRSGSMLRGWFRRQLDGNDVVKSSGVKVYSCRHMDEMFFAVSGSKDAAVSFMSEVRSYLKSSLLLDVRDQPDVFPCEGPHGIRFLGTLVKRTVRESSAVKAVHKLKEKVELFTLQKVEAWNYGTVRIGKKWLGHGLKKVKESEIKHLADSSSLLNKVSSFRKSGMETDHWYKHLLKIWMQDVQAKNAKSEESILSKCVAEPALPQELNDSFYEFIKQAELYISAEADSILKLLPNNNSSIEHPLAKTEIIAPIHAIKMRLLRYGLTTSKGFPRSANLLIMLDTTEIIDWFSGISCRWLKWHENCANFDEIKLLISNHVRKSCIRTLAAKYRVHETEIEKQFDVELSRIPSTQDIEKEMINEALDAQAFDNDEALMYGIAYSGLCLLSLARIVTQARPCNCFVIGCSSSAPRVYTLHVMERQKSPSWKTGFSTCIHPSLNKRRVGLCKQHLRDLYLGHISLQSIDFRAWKS

SEQ ID NO: 133945 - protein, 212 aa, Glycine max
  Coding DNA Sequence Number=SeqID_17167
  Gene Ontology: Mol. function=translation release factor activity; Biological process=translational termination
  Homolog annotation: Hit_ID=Q10P29; Match level="QueryCoverage=76%, HitCoverage=66%, E-value=9e-42, Identity=59%"; Hit description =Immature colon carcinoma transcript 1 protein, putative, expressed
  Pfam annotation: Domain name=RF-1; Domain location=85-172; Score= -25.3; E_value=0.0059; Accession=PF00472.11; Description=Peptidyl -tRNA hydrolase domain
  Subcellular localization annotation: CTP_CleavageSite=51; ConfidenceScore=5.52e-01
MASGTTRMLVKEMLQLSSSTLHFSSSALRGLSPPLPFSIQLRRSRGRPAIRCASSSSDSDASNKVSSRLSQVQHLLQQAEHRALSADQGPPPKITLDHVTVSFARSGGPGGQNVNKVNTKVDMRFNVKNAYWLSDRIRDKILQTEKNRINKDGELVISSTKTRTQKFVSPLLYYLFSLPLGNIEDALAKLQVFTCEKCEALHLKEVATGDRD

SEQ ID NO: 133946 - protein, 757 aa, Glycine max
  Coding DNA Sequence Number=SeqID_17168
  Homolog annotation: Hit_ID=Q1RVB7; Match level="QueryCoverage=96%, HitCoverage=96%, E-value=0.0, Identity=76%"; Hit description=Zinc finger, BED-type predicted
MAATNAGVAAADSAASSDEAAAKTAQKRYEGLLMVRNKAIKGKGAWYWTHLEPLLVHNTETGLPKAVKLRCTLCDAVFSASNPSRTASEHLKRGTCPNFNSAAKPISSVSPVLVSSSTSPPSASPFNNRKRTTTSPSASGSGSGSLYHAPSRFGIGLIPHQQQQHLKLSGGKEDLGALAMLEDSVKKLKSPKTSPGPTLSKAQIDSAIKFLGDWVYESCGAVSFSSLEHPKFRAFLAQVGLPPVFPREFTGTRLDARFEEAKVESEARIRDAMFFQIASDGWKWKRERESYYDYDDSNSGLVNLSVNLPNGTSLYRRALFVTASAPSKYAEEVMWETITGICGNLVQQCVGIVADRFKAKALKNLENQNHWMVNLTCQYQGFNTLIKDFAKELPLFRTVVQNCLKLANLFNYTSQVRNSFHKYQLQEYGHTWLLRVPAHEFEFGLPVCAMMEDTLSSVRALQLVLMDEPFKMVAIEDQGAREVGDMIRDVGFWNDLEAVHGLVKLVKDMAQEIEAERPLVGQCLPLWDELRAKVKDWCSKFHIAEGVVEKLVERRFKKNYHPAWAAAYILDPLYLVRDTSGKYLPPFKYLTPEQEKDVDRLITRLVARDEAHIALMELMKWRTEGLDPVYAQAVQMKERDPVTGKMRIVNPQSSRLVWETYLTEFKSLGKVAVRLIFLHATSCGFKCNWSLWRWVCAQGHHSRNALNKVQKLIFIAAHSKLERRDFSSDQDKDAELFTLANGEDDVLNDVLVDTSSV

SEQ ID NO: 133947 - protein, 160 aa, Glycine max
  Coding DNA Sequence Number=SeqID_17169
MEYTLKLEDLLKGCLESTRPRVSHLPPINCDFCGGEHFTNNCHVYSMKNSWWEQELHPYNQYEEERTSNLENVFMVFMEYHASSKANQNSMQNQEIQVGKNYSMENCQWEQESQPYNQYEEERISNLDNLLMQLKETYESTQHVFKNLEIQVSKLAKESG

SEQ ID NO: 133948 - protein, 187 aa, Glycine max
  Coding DNA Sequence Number=SeqID_17170
MVIDQSLFYDLTQFSSEGVPFEGTLDDDWKFYFSVHDARRLVCTNQADMTGRLLASSLALESRILHYLIVHILLPRSSNLAQRSFLIGVGVVASFGYHKECDGSWVKMGAQPNDDEGHFPVEGDPSLLQSILDRFDGLQTYVGERFDSLERQVDTRFEVMNSRIAKVEEDVTIIRDCFDLPPPPPSV

SEQ ID NO: 133949 - protein, 49 aa, Glycine max
  Coding DNA Sequence Number=SeqID_17171
MVCKLLIKGRKERGEYAGQLGVYQWKRKSGHWKYNVPQPSFRLLFSKLG

SEQ ID NO: 133950 - protein, 120 aa, Glycine max
  Coding DNA Sequence Number=SeqID_17172
MKSTDEKHQIEGLEKETRSKRWTITLTHQQLTFTKKLKVEGEKKKIGSRPSQVRALSVRHALSGSGSTSAKQGVKLEDAESITHAKRGARAKRAIQQKHTLSMQHALSARSECTKHGVSR

SEQ ID NO: 133951 - protein, 137 aa, Glycine max
  Coding DNA Sequence Number=SeqID_17173
  Gene Ontology: Mol. function=catalytic activity; Biological process =metabolic process
  Homolog annotation: Hit_ID=Q1RVC0; Match level="QueryCoverage=80%, HitCoverage=36%, E-value=8e-32, Identity=62%"; Hit description =Sterol desaturase
MVMVTVRGTNLDGRVRDELEGADDEEEHAHDVFVALEGFGQGQADFWLDLVGRDEGEALEFEEDEGEGDEGEDEEEEQNVVAVEEVIGLGGGVVEPEGLREGEVAAQRRHGLRDGSVGEHRHRKPRIAGGGGLFFCL

SEQ ID NO: 133952 - protein, 82 aa, Glycine max
  Coding DNA Sequence Number=SeqID_17174
MEGANNINQVRGDSFEKKDKSIENSNMIGKTIGLAKWRRRRVERRHQSLGDKPWKKELHHQECALDKKLGEDASMEEKKRER

SEQ ID NO: 133953 - protein, 130 aa, Glycine max
  Coding DNA Sequence Number=SeqID_17175
MQRKHDEKMIFLQQQAPTAPRDDGLQKSHQYNHDHQHHQYFVKKDRETESWRAMVGGYFFEFGGCVWVLIQVRWWRVGRPFTVGADVDHYKTTLTTALAVLPVASSLNNEEEKELNREKYSKDWHTFMSM

SEQ ID NO: 133954 - protein, 86 aa, Glycine max
  Coding DNA Sequence Number=SeqID_17176
SCGKVYAIIVFMVVYDCIVVKPKMVPSKEVVHLAELGAARWDQQQIGSDVAQHMCRNLPFGGRATRDSRDACSTKGIRAESPPTFI

SEQ ID NO: 133955 - protein, 42 aa, Glycine max
  Coding DNA Sequence Number=SeqID_17177
  Homolog annotation: Hit_ID=Q1SC10; Match level="QueryCoverage=93%, HitCoverage=5%, E-value=3e-08, Identity=62%"; Hit description =Ubiquitin-activating enzyme, E1; Transposase, IS4
MCLGASDGAYTKLNVPQVDKARYQTEKGDIATHALRVCSQDQ

SEQ ID NO: 133956 - protein, 164 aa, Glycine max
  Coding DNA Sequence Number=SeqID_17178
  Gene Ontology: Mol. function=RNA-directed DNA polymerase activity
  Pfam annotation: Domain name=zf-CCHC; Domain location=68-85; Score =11.8; E_value=0.011; Accession=PF00098.13; Description=Zinc knuckle
MMHQAKKVEKQLEMKHSYKKTYHYDSSSGKDKSEKEGSSPPKQQGSKFPSGKHVPNPSTSSTSRSSSIKCFKYLGKGHIALHCPNKKTKVLRDNEIVTNDGLMMCRRLLGIQCKDRDEIQKNNIFQTRCLVLGNVCSLIIDGGSCIMCPTQAPIEACHILLGKP

SEQ ID NO: 133957 - protein, 191 aa, Glycine max
  Coding DNA Sequence Number=SeqID_17179
  Homolog annotation: Hit_ID=Q2QM92; Match level="QueryCoverage=30%, HitCoverage=10%, E-value=2e-07, Identity=52%"; Hit description=Amino acid permease family protein
MGRHSQGSHREIQNFVVDESVLMNFIDSDNGRNVNTMNADGRTMLLFVVGLSLEPCVKLMVEGLRWLISLLKGGAIRLCGLYSHGKHPSESTTPKTRPSLIIDSMVNMVIIAFIVIMGLINAKPKNYTPFAPFGARGNTMVLLVSVVGQARYLTHMIPPWFSLVDEHIWTIVNVTIAMVVASVVIAFFIEL

SEQ ID NO: 133958 - protein, 453 aa, Glycine max
  Coding DNA Sequence Number=SeqID_17180
  Homolog annotation: Hit_ID=Q0GPH0; Match level="QueryCoverage=51%, HitCoverage=58%, E-value=3e-33, Identity=33%"; Hit description=BZIP transcription factor bZIP80
MWRTMHESHKAQALISQHLSNLSDNHNMILNSEYHHQATIQFETEASYWYNSFCKLVKFQREYVRTLYEWIKLAESLKDSNECSNHSSILAICDQWERGLNESPDKETSEAIKSLVSCIRSITGQQIQEDNILKRLEKLDRKFQKCLNSLAEMQQRIDGDMADTSPRHPIHLKKTETEALKKQVESAKANYLDAVQYSRAMTLDHLQKTLPPLFQSLMEFSNASAQAIEAINTTGKPVEFFSVNPKNSSSSKSYSNSLQTSEEDSKTVHVKLMLECVVILASRTHESHALVLKVKAPPPPPPLQSNVVLSLRAPLDLVTLLDVGGNMTSPKFEVGQAVVADKVAVAIKDLDHDVVDAILEAEEKVAKADIDINGDDGEAEAGKGEADVGSGSGLAHAALAGGDDGNTRDEGFRGENRGGGGMWSWERWWHWGESGERALGMREREAEEEEEDE

SEQ ID NO: 133959 - protein, 109 aa, Glycine max
  Coding DNA Sequence Number=SeqID_17181
MVVLTEKVSGAEETAATRKQEETNALRIGTHRIERGGAFGTKRERELETREREKGSIQRNKKSGTKTIAEREKNSSYSNTYERSTWLKFPAWKDGCVVDKSKITNLLSM

SEQ ID NO: 133960 - protein, 166 aa, Glycine max
  Coding DNA Sequence Number=SeqID_17182
MGLGRNGDGTENLVKFIENRGRFSLGYKPTHVDKRRVALERKERSLAHLQGQGPQMERKKPTKISQVGCSRAPRDSDVDFEQLVNQAEEEENEDWGLPPDLRRMVEQEEREDMPGLSSEIVQHKLPLNPECSPEEVKKQFDVGFLAIAWYPEWVANIVPVPKKDGK

SEQ ID NO: 133961 - protein, 192 aa, Glycine max
  Coding DNA Sequence Number=SeqID_17183
MAMASLARRKGYTAILSLSIALQKRFLHYIKVAKGQVPDSNNKKIHKSREYSSRMIFPYSPLQRHYQKDTTPTTYFMCWGFKPLLPKNNIGIPRFIPGNCTWFSNCAECNGHCWKRVSGHGSPTRRNSAEELGEGHGGANEIGQMKNRPRKRVRPSCGLRLYGYQRRKWWRRWRWRCRGWRRWHGRECGARG

SEQ ID NO: 133962 - protein, 122 aa, Glycine max
  Coding DNA Sequence Number=SeqID_17184
MEVVMSQGHDLELMFCSPTTTKGMSLSLWSRFHSVNLTTSINEMGDLLHIPFCFLEQDEGLDANNEDQIFNGTSVATKINDRDSNMGLQEVRGFARSKKHETQKAGNNMWLAMTHAAWITRT

SEQ ID NO: 133963 - protein, 57 aa, Glycine max
  Coding DNA Sequence Number=SeqID_17185
MKDIFEVVLTTMLKDEAKNWWKDTMERMMTLEILVIWENFKITFLDKYFSLQCQNPK

SEQ ID NO: 133964 - protein, 105 aa, Glycine max
  Coding DNA Sequence Number=SeqID_17186
  Gene Ontology: Mol. function=RNA-directed DNA polymerase activity; Cellular component=chromatin; Biological process=RNA-dependent DNA replication
MALKDMEKTTFITLWGTFCYKVMSFGLKNAGATYQRAMVTLFHDMMHKEIEVYVDDMIAKSRMEEEHLVNLRKLLGRLRKYMLRLNPAKCTFGVKSGKLLGFVVS

SEQ ID NO: 133965 - protein, 42 aa, Glycine max
  Coding DNA Sequence Number=SeqID_17187
MMHMVFEIKPERINDFNNKSHVNSFDILDDKVKVYAIVMDDT

SEQ ID NO: 133966 - protein, 235 aa, Glycine max
  Coding DNA Sequence Number=SeqID_17188
  Gene Ontology: Mol. function=3-deoxy-manno-octulosonate cytidylyltransferase activity; Cellular component=mitochondrion; Biological process=lipopolysaccharide biosynthetic process
  Homolog annotation: Hit_ID=Q9C920; Match level="QueryCoverage=99%, HitCoverage=74%, E-value=1e-102, Identity=86%"; Hit description =Putative deoxyoctulonosic acid synthetase; 116195-114393
  Pfam annotation: Domain name=CTP_transf_3; Domain location=3-206; Score=115.4; E_value=1.6e-31; Accession=PF02348.9; Description =Cytidylyltransferase
MGKGKAGSYIGSYWEILVNSAYMSSGASNSRKSIVATDDEKIADCCRQFGADVIMTSESCRNGTERCNEALQKLGKKYDIVVNIQGDEPLIEPEIIDGVVKALQAAPDAVFSTAVTSLKPEDAHDPNRVKCVVDNRGYAIYFSRGLIPFNKSGMVNQQFPYLLHLGIQSYDAKFLNIYPDLQPTPLQLEEDLEQLKVLENGYKMKVIKVDHEAHGVDTPEDVGKIESLMRERNLS

SEQ ID NO: 133967 - protein, 124 aa, Glycine max
  Coding DNA Sequence Number=SeqID_17189
MEFTDKEEVVIEEKVERWEEEDTEGMPYGQWLKALPSRPNVVVEVKQQVIYGKVKHTSLFDDKEKEKEKPMSNHKKDKKEIVEVMGEKSEMQGVDLGEPQKEAEIVVRGKRQVEGHASGYNEGR

SEQ ID NO: 133968 - protein, 77 aa, Glycine max
  Coding DNA Sequence Number=SeqID_17190
MGDLDHGLAKDLNERLPWKREEANRAAIATPATMPWMIHAFAVLEEPKDDVEEEDDDDDDESEEQIAMTQTRGISEG

SEQ ID NO: 133969 - protein, 201 aa, Glycine max
  Coding DNA Sequence Number=SeqID_17191
  Gene Ontology: Mol. function=protein kinase activity; Cellular component=cytosol; Biological process=protein amino acid phosphorylation
  Homolog annotation: Hit_ID=Q60DP4; Match level="QueryCoverage=95%, HitCoverage=16%, E-value=2e-61, Identity=60%"; Hit description =Calcium binding EGF domain containing protein
MESALIFLGTGSSGSVPCMRCLIDPSDPPCPVCAYSLSFPPHLNPNYRCNSSLLIDYYCRSDATHKYILIDAGKTFRETALRWFVFHHIPRVDSVKLDLIVLTHEHADAVLGLDDVLAVQPFSPTNDIDPIPVYLTQHSMDSVEKRFPYLVQKKHKEGQEMRRVALLCWNIIADDCNRPFFASGLKLIPLPVNHCKPCHWW

SEQ ID NO: 133970 - protein, 103 aa, Glycine max
  Coding DNA Sequence Number=SeqID_17192
  Subcellular localization annotation: CTP_CleavageSite=57; ConfidenceScore=5.11e-01
MILGDTLRLSAPPFAIQTQSCSMASRDQVWSFCTHDTRRYLTVIRPPPLPFRHSRVRWQAETKFGHSAHMIRGDTLRLSAPLCHSDTVVFDGKQRPSLVILHP

SEQ ID NO: 133971 - protein, 86 aa, Glycine max
  Coding DNA Sequence Number=SeqID_17193
MVGYTSSSFTDLVFASKKIKVGLKRGKFNHPAWTNEKTGANEEGEDEGETHAVTTIPVRPSFPPTQQCHYSTLLLTYCPFIHKSHP

SEQ ID NO: 133972 - protein, 101 aa, Glycine max
  Coding DNA Sequence Number=SeqID_17194
QNPQEFKILEIGPGHPESGPPPYLSDGKIGESERATTSLDKESERSTASLVGDSGGAVASPDGESEMIIKGGDGGTTSSSGEEGGFTTRDCGSAGTGSTRA

SEQ ID NO: 133973 - protein, 74 aa, Glycine max
  Coding DNA Sequence Number=SeqID_17195
MAMMMVMMMIMVMIMFFNNNGQLHVNILKQEEVEVIEQEDNKYRKIRFNKMRDRDTYLEELVVGHRLIISLTNM

SEQ ID NO: 133974 - protein, 223 aa, Glycine max
  Coding DNA Sequence Number=SeqID_17196
  Homolog annotation: Hit_ID=Q01DW1; Match level="QueryCoverage=28%, HitCoverage=53%, E-value=9e-08, Identity=40%"; Hit description=[S] KOG3410 Conserved alpha-helical protein
  Pfam annotation: Domain name=DUF1754; Domain location=3-223; Score =135.8; E_value=1.2e-37; Accession=PF08555.1; Description=Eukaryotic family of unknown function (DUF17
MSAYDNVVGGKLKLKGKALDVAGGVKKKKKKNKRNQEQLLQVAEDEVSADGFPVVERNHEKTYEFWKNTTVVKVGNNSSNLNRGNPSNLCELSSMEALTGHWIPDPDKFQHLQTHLVHFPTDKKRDFLLSKMIRGKGGSKEQAKDSNDEDINDVSELSGEGKTAHYDDHLTPVERRYIEQREQLDVHRLAKISNKSHRDRIQDFNQYLANMSEHYDIPKVGPG

SEQ ID NO: 133975 - protein, 188 aa, Glycine max
  Coding DNA Sequence Number=SeqID_17197
  Gene Ontology: Mol. function=7-dehydrocholesterol reductase activity; Cellular component=membrane; Biological process=cholesterol biosynthetic process
  Homolog annotation: Hit_ID=Q2QCX7; Match level="QueryCoverage=68%, HitCoverage=27%, E-value=5e-40, Identity=68%"; Hit description =Sterol delta-7 reductase DWF5
MEVERVEDSFDSIEEKRIEDSFDSIDDDAESGLQDDKIMEETPGDICLKERVEDSFERMELALSILVAGILCIYINYDCDRQRQEFRRTNGKGTVWGKAPSKIEATYTTTSGETKRSLLLTSGCFLLDSPSSLQSCKGPFLFVQVEVWRRMLSSIFFHLQFLPYFYVIFLTILLFDRAKRDDDRCRSK

SEQ ID NO: 133976 - protein, 497 aa, Glycine max
  Coding DNA Sequence Number=SeqID_17198
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=99%, HitCoverage=100%, E-value=1e-120, Identity=47%"; Hit description =Pentaxin
MGSRFPSHQLSNGLYVSGRPEQPKEKTPTMSSVAMPYTGGDIKKSGELGKMFDIPMDGSKSRKSGPINNAPSRTGSFAGAASHSGPIMQNAAARSVYITSGNVSAGGMSASASMKKTNSGPLNKHGEPVKKSSGPQSGGVTRQNSGPIPPVLPTTGLITSGPLNSSGAPRKVSGQLDSTGSMKSLSSFVAHNPAVTTLSLDDEYSFRKNFPKPILWSVILIFVMGFIAGGFILGAVHNAILLIVVVILFGAVAALFTWNSCFGRKAIVGFISRYPDAELRTAKNGQFVKVSGVVTCGNVPLESSFQKVPRCVYTSTSLYEYRGWDSKAANPKHRRFTWGLRAAEVGGPVNYPSLKPKAFLLEERHVVDFYISDFQSGLRALVKTGYGARVTPYVDDSIVIDVNPANKDMSPEFLRWLGERKLSSDDRIMQLKEGYIKEGSTVSVMGVVQRNDNVLMIVPPPEPLSTGCQWAKCIFPASLEGIVLRCEDTSKIDVIPV

SEQ ID NO: 133977 - protein, 692 aa, Glycine max
  Coding DNA Sequence Number=SeqID_17199
  Gene Ontology: Mol. function=nucleoside-triphosphatase activity; Cellular component=cytoplasm; Biological process=protein catabolic process
  Homolog annotation: Hit_ID=Q9C5U3; Match level="QueryCoverage=60%, HitCoverage=99%, E-value=0.0, Identity=87%"; Hit description=AtSUG1 protein
  Pfam annotation: Domain name=AAA; Domain location=196-384; Score =310.1; E_value=3.9e-90; Accession=PF00004.19; Description=ATPase family associated with various cellular activities (AAA)
  Pfam annotation: Domain name=AAA_2; Domain location=193-325; Score= -26.0; E_value=0.00085; Accession=PF07724.4; Description=ATPase family associated with various
  Pfam annotation: Domain name=AAA_3; Domain location=196-328; Score= -12.7; E_value=0.008; Accession=PF07726.2; Description=ATPase family associated with various
  Pfam annotation: Domain name=AAA_5; Domain location=196-332; Score= -0.4; E_value=0.0019; Accession=PF07728.4; Description=ATPase family associated with various
  Pfam annotation: Domain name=PAP_fibrillin; Domain location=500-686; Score=68.7; E_value=1.9e-17; Accession=PF04755.3; Description=PAP _fibrillin
  Pfam module annotation: Pfam domain module=AAA::AAA_2::AAA_3::AAA _5::PAP_fibrillin; Domain location=196-384::193-325::196-328::196 -332::500-686
MALVGVELKHAAEGVPEANCSAKPTKQGEGLRHYYSLNIHEHQLLLRQKTHNLNRLEAQRNDLNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWNGVEGESATGTEQLTINKNKNISREDIVMDMVLHSALYPPSLSCSSSTTGTRWPNSRVGVSLSWRSLSLVPCALKAYYDSELENKKHLLLTSVQDTQRGLLTTPDQRSCIEEALVSLEGCNIGSHPINLSNLDGTWRLQYTSASDVLILLQAAATLPFFQVGQIFQKFECRDQSNGGVIRNVVRWSIPNLLEEQEGATLLVSAKFNVVSVRNIYLQFQEILQFLRTFKAQIPVRDPGRQSVGGLYYLSYLDDNMLLGRAVGGGGVFVFTRAQSLY

SEQ ID NO: 133978 - protein, 354 aa, Glycine max
  Coding DNA Sequence Number=SeqID_17200
  Gene Ontology: Mol. function=transporter activity; Cellular component= mitochondrial inner membrane; Biological process=transport
  Homolog annotation: Hit_ID=Q9LJX5; Match level="QueryCoverage=90%, HitCoverage=93%, E-value=1e-117, Identity=64%"; Hit description =Similarity to membrane carrier/translocators
  Pfam annotation: Domain name=Mito_carr; Domain location=165-253; Score=79.4; E_value=1.1e-20; Accession=PF00153.17; Description =Mitochondrial carrier protein
  Pfam annotation: Domain name=Mito_carr; Domain location=259-350; Score=79.4; E_value=1.1e-20; Accession=PF00153.17; Description =Mitochondrial carrier protein
  Pfam annotation: Domain name=Mito_carr; Domain location=58-141; Score= 80.7; E_value=4.5e-21; Accession=PF00153.17; Description =Mitochondrial carrier protein
  Pfam module annotation: Pfam domain module=Mito_carr::Mito_carr::Mito_ carr; Domain location=165-253::259-350::58-141
MALESQPQKNKYGHGVFGDVSSIIKEMEIDHPNSTFDFQFQFPPIAFQNFLGSREVREFISGALAGAMAKAILAPLETIRTRMVVGVGSKNIAGSFIDVIEQQGWQGLWAGNMINMLRIVPTQAIELGTFECVKRAMTSLHEKWEHNEYPKLQIGSINFNLSLSWISPVAIAGAAAGIASTVVCHPLEVLKDRLTVSPETYPNLGIAIRNIYKDGGVGAFYAGISPTLVGMLPYSTCFYFMYDTIKESYCRTRNKKSLSRPEMILIGAFAGFTASTISFPLEVARKRLMVGALQGKCPPNMAAALSEVIREEGLKGLYRGWGASCLKVMPSSGITRMFYEAWKDILLVQNGNPL

SEQ ID NO: 133979 - protein, 69 aa, Glycine max
  Coding DNA Sequence Number=SeqID_17201
MDMPSHTTITHIRTARETIIPPHTSTPNIYFVMNAAAPLHASTTQIHFAMKTIVIWCGVYFGHNPVKLF

SEQ ID NO: 133980 - protein, 381 aa, Glycine max
  Coding DNA Sequence Number=SeqID_17202
  Gene Ontology: Mol. function=binding
  Homolog annotation: Hit_ID=Q112G1; Match level="QueryCoverage=53%, HitCoverage=68%, E-value=1e-15, Identity=30%"; Hit description =Tetratricopeptide TPR_2
  Pfam annotation: Domain name=TPR_1; Domain location=190-223; Score =0.4; E_value=4.8; Accession=PF00515.18; Description=Tetratricopeptide repeat
  Pfam annotation: Domain name=TPR_1; Domain location=224-257; Score =10.9; E_value=0.27; Accession=PF00515.18; Description=Tetratricopepti de repeat
  Pfam annotation: Domain name=TPR_1; Domain location=304-337; Score =10.0; E_value=0.34; Accession=PF00515.18; Description=Tetratricopepti de repeat
  Pfam annotation: Domain name=TPR_1; Domain location=338-371; Score =5.0; E_value=1.3; Accession=PF00515.18; Description=Tetratricopeptide repeat
  Pfam annotation: Domain name=TPR_2; Domain location=190-223; Score =16.3; E_value=0.11; Accession=PF07719.7; Description=Tetratricopeptid e repeat
  Pfam annotation: Domain name=TPR_2; Domain location=224-257; Score =14.1; E_value=0.51; Accession=PF07719.7; Description=Tetratricopeptid e repeat
  Pfam annotation: Domain name=TPR_2; Domain location=259-292; Score =8.7; E_value=3.2; Accession=PF07719.7; Description=Tetratricopeptide repeat
  Pfam annotation: Domain name=TPR_2; Domain location=304-337; Score =7.8; E_value=4; Accession=PF07719.7; Description=Tetratricopeptide repeat
  Pfam annotation: Domain name=TPR_2; Domain location=338-371; Score =6.5; E_value=5.7; Accession=PF07719.7; Description=Tetratricopeptide repeat
  Pfam annotation: Domain name=TPR_4; Domain location=190-215; Score =14.6; E_value=0.37; Accession=PF07721.5; Description=Tetratricopeptid e repeat
  Pfam annotation: Domain name=TPR_4; Domain location=304-329; Score =4.6; E_value=11; Accession=PF07721.5; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_4::TPR_4; Domain location =190-223::224-257::304-337::338-371::190-223::224-257::259-292::304 -337::338-371::190-215::304-329
  Subcellular localization annotation: CTP_CleavageSite=90; ConfidenceScore=5.44e-01
MSIRSSAFFCFQINCSDSKQGRGFGENTNSNRIKTNKSDKGLVSQQSKGSANKQSRPLSSQAPRLSSQLDGKSRNDFLDVDFEERLKAVRRSALEQKKAEEEKEFGAIDYDAPIPSDNTTIGVGTKIGVGVAVAVFGLVFAFGDFLPSGSVSPTEDSAVVNSKLSEEDKATLQSRLKEFEATLSNSSRDPTALEGAAITLAELGEYARAASLLDDLTKEKPNDADVFRLLGEVKYELKDYEGSVAAYKSSARVSKDIQFEVLRGLSNSLLAAKKPEEAVQLLLAYREHLSSDSNPTDSQKLDPVQVELLLGKAYSDWGHVRDAVAVYDQLISTHPNDFRGYLAKGIILKENKNIGDAERMFIQARFFAPDKAKALVDRYSR

SEQ ID NO: 133981 - protein, 198 aa, Glycine max
  Coding DNA Sequence Number=SeqID_17203
  Gene Ontology: Mol. function=endonuclease activity
  Homolog annotation: Hit_ID=Q6ETZ9; Match level="QueryCoverage=61%, HitCoverage=26%, E-value=1e-15, Identity=39%"; Hit description=TRNA -splicing endonuclease positive effector-like
MSLPRNMVRTNDKKEEVPVVAVFAVSKKLLYCGCNDDRDVVADSRKTVIYVVVACGCGLIFKTMESSKCRTLTCAPTNVAVLEVAKRVLVQVKKYYQPLGYGGYGLGDIVLFGNGKRMNIDGHVELHDVFLDYRVCALEKCLGAWKHSLASMISLLENPQKRFLQYLNKTNEDVSVDCHSQNKETRRTVQNLGHERNL

SEQ ID NO: 133982 - protein, 76 aa, Glycine max
  Coding DNA Sequence Number=SeqID_17204
MEIFVVGSFIRINTHFEEGRDKQGSEIMLKLKILMCRELGHDPILNGNTPFNIYSQVPMQPSFMLLIMKEERGFIK

SEQ ID NO: 133983 - protein, 96 aa, Glycine max
  Coding DNA Sequence Number=SeqID_17205
  Homolog annotation: Hit_ID=Q6EU00; Match level="QueryCoverage=48%, HitCoverage=12%, E-value=5e-09, Identity=61%"; Hit description=TRNA -splicing endonuclease positive effector-like
MAPIELLVIDEATQLKKCEAAIPLQLCGVRCSILIGDESQLPTMVQSKEATTASMVPETVGRLQLRLIFEESSSTDRRKGQQGHQDGIIAYSRAKH

SEQ ID NO: 133984 - protein, 69 aa, Glycine max
  Coding DNA Sequence Number=SeqID_17206
MPKAFEPSKTLPSKSSIDIEVNGDAEKPVRKKIPSPLKLGSRSSSSEGEKPLLDSSSSKHELLGHARLT

SEQ ID NO: 133985 - protein, 144 aa, Glycine max
  Coding DNA Sequence Number=SeqID_17207
MSSISPNPPYFIDVIETRWKHDDTLVVDCFFRFLYCHCAPINISGYKSCIVDFYVWWTQPTLLYYRFVVPMLEVVIPSESHSPPVDDVMSSSRSDTSSLDIETISPTMMSHELILPKSWVPLRIDLVNHVLKEEGEDLGGGHVF

SEQ ID NO: 133986 - protein, 535 aa, Glycine max
  Coding DNA Sequence Number=SeqID_17208
  Gene Ontology: Mol. function=protein serine/threonine kinase activity; Cellular component=ubiquitin ligase complex; Biological process=protein amino acid phosphorylation
  Homolog annotation: Hit_ID=Q1PF03; Match level="QueryCoverage=91%, HitCoverage=62%, E-value=1e-117, Identity=48%"; Hit description =Protein kinase family protein
  Pfam annotation: Domain name=Pkinase; Domain location=217-489; Score =107.1; E_value=5e-29; Accession=PF00069.15; Description=Protein kinase domain
  Pfam annotation: Domain name=Pkinase_Tyr; Domain location=217-483; Score=71.0; E_value=3.8e-18; Accession=PF07714.7; Description =Protein tyrosine kinase
  Pfam module annotation: Pfam domain module=Pkinase::Pkinase_Tyr; Domain location=217-489::217-483
  Subcellular localization annotation: CTP_CleavageSite=72; ConfidenceScore=5.24e-01
MDFPESDSDISFVSSERPSSVRSSSVFYDYFDLHARNPRTSTSSDHSLGSTRMRPKFSDLSSTDISFSEDSRRSSVSSSLLNVDEAEADMRSLKLELKHTLEIYTTACRETLAAQQKLGELQNWKIEEEKKMEEMQLSQEAAEASVEQEKARSKAARETAKAAKRIARVESSKRESVKVKALKEAEEMRKQLDNLTQNDKRYRRYTIEEIERATDMFSEARKIGEGGYGPVYKCYLDHTQVAVKVLRQDSAQGEAQFQQEVNILGCIRHPNMVLLIGACAEHGILVYEYMAKGSLEDCMFGKKKEKEGKMRSWKVRFGIAAEIATGLLFLHQTKPEPLVHRDLKPGNILLDQNYVSKISDVGLAKLVPAATAGNGTQCCMTAAAGTFCYIDPEYQQTGMLGVKSDVYSLGIILLQLLTGRPAMGLAHQVEESIKKDRFGEMLDPSVPDWPLEQALCLANLALQCAQLRRKDRPDLATLVLPRLQILRDFASLHSSTSSDQGIQLTYCIYSLTPQGCIFLTTCFFFSQGPMITNLF

SEQ ID NO: 133987 - protein, 98 aa, Glycine max
  Coding DNA Sequence Number=SeqID_17209
  Gene Ontology: Mol. function=signal transducer activity; Cellular component=membrane; Biological process=response to light stimulus
  Homolog annotation: Hit_ID=Q1EPH5; Match level="QueryCoverage=99%, HitCoverage=14%, E-value=3e-35, Identity=73%"; Hit description =Nonphototropic hypocotyl 3 (NPH3) family protein
  Pfam annotation: Domain name=BTB; Domain location=3-98; Score=-1.7; E_ value=0.0059; Accession=PF00651.21; Description=BTBPOZ domain
FCTTGLPSDIVVEVGEMSFHLHKFPLLSRSGVLEKMIAKASESEEECVISLGDIPGGAKTFELVAKFCYGVKLELTASNVVYLWCAAESLEMTEEYGE

SEQ ID NO: 133988 - protein, 367 aa, Glycine max
  Coding DNA Sequence Number=SeqID_17210
  Gene Ontology: Mol. function=signal transducer activity; Cellular component=membrane; Biological process=response to light stimulus
  Homolog annotation: Hit_ID=Q6AST7; Match level="QueryCoverage=94%, HitCoverage=53%, E-value=1e-144, Identity=75%"; Hit description=NPH3 family protein
  Pfam annotation: Domain name=NPH3; Domain location=2-202; Score =269.4; E_value=7.4e-78; Accession=PF03000.5; Description=NPH3 family
MGSPLSEDNQKILLEEIDGLLPMQKGLVQTKLLFGLLRTAMILRVSPSCISNLEKRIGLQLDQATLEDLLMPNFSYSMETLYNVDCVQRILDHFLAMDQVTGGASPCSIDDGQLIGSPSLTPITTVAKLIDGYLAEVAPDINLKLPKFQTLAAAVPEYARPLDDGLYRAIDIYFKSHPWLVESEREQLCRLMDCQKLSLEACTHAAQNERLPIRIIVQVLFFEQLQLRTSIAGCFLVSDNLDGSRQLRSGFVGSTEGGWASAVKENQVLKVGMDNMRMRVSELEKECSNMRQEIEKLGRVKGSSAWGTVSKKLGFKLKSQMCSAQEGSVSNQNNANNTVEKLKERHVKHKRSSSISDKASVSSIVHS

SEQ ID NO: 133989 - protein, 76 aa, Glycine max
  Coding DNA Sequence Number=SeqID_17211
  Homolog annotation: Hit_ID=Q2UVJ5; Match level="QueryCoverage=72%, HitCoverage=5%, E-value=1e-15, Identity=78%"; Hit description=Cation chloride cotransporter
KVNTSVNGSSDAKEENLSHEQKPNGSRQQESKLELFGFDSLVNILGLKSMTGEHVTQPSSPRDGEDISITAGLPKR

SEQ ID NO: 133990 - protein, 129 aa, Glycine max
  Coding DNA Sequence Number=SeqID_17212
MSSGGHKLLGVFHQHEVIFDYLSKNNLFDEYRDYSLNWLCGHLSWIQQVLSPEYAKDFYDTLIPHYDKYSKKEVQNYLAGKFYDRKSLELIVAVIRKNRDAFVKAMTGKKLSDIERVVETGFILAESKK

SEQ ID NO: 133991 - protein, 59 aa, Glycine max
  Coding DNA Sequence Number=SeqID_17213
  Homolog annotation: Hit_ID=Q1SYR3; Match level="QueryCoverage=98%, HitCoverage=3%, E-value=1e-10, Identity=48%"; Hit description=RNase H, putative
MLATHSRYSATAKKPDISDFILRSFFLTGEHSGFRGNHCCTTLGLKPGISWYDQAKMYW

SEQ ID NO: 133992 - protein, 360 aa, Glycine max
  Coding DNA Sequence Number=SeqID_17214
  Gene Ontology: Mol. function=protein kinase activity; Cellular component=integral to membrane; Biological process=protein amino acid phosphorylation
  Homolog annotation: Hit_ID=Q1SG69; Match level="QueryCoverage=80%, HitCoverage=44%, E-value=1e-64, Identity=48%"; Hit description =Protein kinase
  Pfam annotation: Domain name=LRRNT_2; Domain location=29-70; Score =37.6; E_value=4.2e-08; Accession=PF08263.3; Description=Leucine rich repeat N-terminal domain
  Pfam annotation: Domain name=LRR_1; Domain location=121-143; Score =6.1; E_value=20; Accession=PF00560.23; Description=Leucine Rich Repeat
  Pfam annotation: Domain name=LRR_1; Domain location=166-189; Score =9.0; E_value=5.9; Accession=PF00560.23; Description=Leucine Rich Repeat
  Pfam annotation: Domain name=LRR_1; Domain location=209-231; Score =4.6; E_value=40; Accession=PF00560.23; Description=Leucine Rich Repeat
  Pfam annotation: Domain name=LRR_1; Domain location=73-98; Score=3.8; E_value=55; Accession=PF00560.23; Description=Leucine Rich Repeat
  Pfam module annotation: Pfam domain module=LRRNT_2::LRR_1::LRR_1::LRR_ 1::LRR_1; Domain location=29-70::121-143::166-189::209-231::73-98
  Subcellular localization annotation: CTP_CleavageSite=70; ConfidenceScore=5.12e-01
MHHNHNLNLARLWIALLAVSTTVVHCKTASQDVSALNVMYTSLNSPSKLSGWKSSGGVPCGDSWEGIKCSGSSVTEINLSDMGLSGSMVLPVVQLKISYRLYSDLSNNNQKGDIPYRLPPNARYINLAHNQLKNQLGDMFGKLSNLKQLKPTPESQIAQKPQQVVRTRSLSLSGNNICTHLHSKLLFVLIQAPTKQHFTGSVNVLANLPLEDLNVENNKFTGWVPKELKDINSLQTGGNSWSSGPAPPPPPGTPPIKHSEKKNDKSVISGVAIAGIAFGVLAVIIIVVALSKRSSKPASHFIDEERRSQHRSFTTLASEELSKDSDVISAKTTKKLRFREYYISNKGSSVPYSKGESSGD

SEQ ID NO: 133993 - protein, 65 aa, Glycine max
  Coding DNA Sequence Number=SeqID_17215
MKGKELLYYEKMGFQMPMSLILFKSFMRLLEELDSLLFHASRNDPEASVKSMKAKINSALGALDR

SEQ ID NO: 133994 - protein, 135 aa, Glycine max
  Coding DNA Sequence Number=SeqID_17216
  Gene Ontology: Mol. function=protein kinase activity; Biological process=protein amino acid phosphorylation
  Homolog annotation: Hit_ID=Q1SG69; Match level="QueryCoverage=63%, HitCoverage=12%, E-value=4e-25, Identity=67%"; Hit description =Protein kinase
  Subcellular localization annotation: CTP_CleavageSite=48; ConfidenceScore=5.61e-01
MDSTSIDVKASQNSPSIGVRSSVSDCVQSFNDNEFANRLNSRRSSSIRVTTFTQAELQSATANFASGRLLGEGSIGCVYRAKYADGKDDPEMMNGSARMTGERFVVVWIAQYRGAIIVGSHEGVGSDGMKSGGIQ

SEQ ID NO: 133995 - protein, 117 aa, Glycine max
  Coding DNA Sequence Number=SeqID_17217
MKKIHMELHHGQGSLKCLNCLSNANTTLKATLKGTRILILDQLLVDILGVLDDSSRKIPLSLPHLIINHMIKAMKPNKSTFSVPYGLLMTLVFRHFKVIMEDKARDEEVLTWGRRML

SEQ ID NO: 133996 - protein, 74 aa, Glycine max
  Coding DNA Sequence Number=SeqID_17218
MEELKRFFMFFVTSRMNHIGMRGIQRMYSPSLKNSIVKGVWLRAIIGLVNNPESSQAVSELVVDVSERVIYGRF

SEQ ID NO: 133997 - protein, 123 aa, Glycine max
  Coding DNA Sequence Number=SeqID_17219
MARTKTMGVKNPSYSLTSKSETSHSYSPKTHQDKGKDKAIEVSSWSDSKTTMTITPPRAKVIVIGSSKKKSFVKAEKSRKKMKRSEYEVVTLFNDKKLKEKFDKIWANKKVVYDKYIDLLEIK

SEQ ID NO: 133998 - protein, 483 aa, Glycine max
  Coding DNA Sequence Number=SeqID_17220
  Gene Ontology: Mol. function=cation:chloride symporter activity; Cellular component=membrane; Biological process=transport
  Homolog annotation: Hit_ID=Q1SN47; Match level="QueryCoverage=99%, HitCoverage=76%, E-value=0.0, Identity=77%"; Hit description=Amino acid permease-associated region; Amino acid/polyamine transporter I; Interleukin-6/G-CSF/MGF
MGAALQSLTGAPRLLAAIANDDILPILNYFKVGDGGEPHVATFFTAFLCIGVTLKLDSVVILTYAVIMFLISWSFTVVSLLLASLIYKYVSIKGKAGDWGDGFKSAYFQLALRSLRSLGASQVHPKNWYPIPLVFCRPWGKLPENVPCHPKLADFANCMKKKGRGMSIFVSILDGDYHECAEDAKTACKQLSTYIDYKNCEGVAEIVVAPNMSEGFRGIIQTMGLGNLKPNIVVMRYPEIWRRENLIEIPATFVGIINDCIVANKAVVIVKGLDEWPNEYQRQYGTIDLYWIVRDGGLMLLLSQLLLTKESFENCKIQVFCIAEEDADAEGLKADVKKFLYDLRMQAEVFVITMKWDAQMDGGGSPAQDESMDAFTSAQQRIDDYLTQMKATAKREGTPLMADGKPVVVNEKQVEKFLYTTLKLNSTILRYSRMAAVVLVSLPPPPVSHPAYFYMEYMDLLLEKIPRILIVRGYRRDVVTLFT

SEQ ID NO: 133999 - protein, 51 aa, Glycine max
  Coding DNA Sequence Number=SeqID_17221
MGSRSLVSDLQVSSTGLTRGVPVKGTPTLKQKGANLKKCQSGCRAKRGLCA

SEQ ID NO: 134000 - protein, 384 aa, Glycine max
  Coding DNA Sequence Number=SeqID_17222
  Gene Ontology: Mol. function=RNA-directed DNA polymerase activity; Cellular component=chromatin; Biological process=chromatin assembly or disassembly
MPEKVLPPLLNGGGNGEQFSDIAPMPIADASVSTVKGNQKSGRARTGADVKAVFKVSKAVCAAEVERRGERLGDPNIPPEVIADGDTVDEDIVKEDDDKASKDERHNFELKVPMVGSESCLGNVLQLHAYLVIPLQQVQFGEVTRTSELIQELINVHAEPPGVVGLLHQQHRILVWENIDWGGIWTQVDLMISLSFRRQRCRVLKKNGKLMKKLLDLKHRNVEANAIGLISADTAELRGGDDWEDIKIDGERMMLNVDCGGVTSGMALQMLVVANEDLQWSGGPLGDAGNVTDEPQGLRGKVACKGVAANVGWGLGYLNWAGSRGRTDAPYGTSRRKRSRGRARGGRLAPPGSDGGPWVAVTVMDAEAKARVEEGARRGERQRS

SEQ ID NO: 134001 - protein, 1132 aa, Glycine max
  Coding DNA Sequence Number=SeqID_17223
  Gene Ontology: Mol. function=protein binding; Cellular component =integral to membrane; Biological process=defense response to fungus
  Homolog annotation: Hit_ID=Q949G9; Match level="QueryCoverage=96%, HitCoverage=94%, E-value=0.0, Identity=33%"; Hit description=HcrVf1 protein
  Pfam annotation: Domain name=LRRNT_2; Domain location=15-55; Score =47.6; E_value=4.3e-11; Accession=PF08263.3; Description=Leucine rich repeat N-terminal domain
  Pfam annotation: Domain name=LRR_1; Domain location=1020-1041; Score =8.5; E_value=7.5; Accession=PF00560.23; Description=Leucine Rich Repeat
  Pfam annotation: Domain name=LRR_1; Domain location=114-139; Score =10.1; E_value=3.7; Accession=PF00560.23; Description=Leucine Rich Repeat
  Pfam annotation: Domain name=LRR_1; Domain location=141-163; Score =14.4; E_value=0.42; Accession=PF00560.23; Description=Leucine Rich Repeat
  Pfam annotation: Domain name=LRR_1; Domain location=165-187; Score =1.2; E_value=1.7e+02; Accession=PF00560.23; Description=Leucine Rich Repeat
  Pfam annotation: Domain name=LRR_1; Domain location=189-212; Score =13.7; E_value=0.68; Accession=PF00560.23; Description=Leucine Rich Repeat
  Pfam annotation: Domain name=LRR_1; Domain location=214-236; Score =14.1; E_value=0.52; Accession=PF00560.23; Description=Leucine Rich Repeat
  Pfam annotation: Domain name=LRR_1; Domain location=261-282; Score =11.4; E_value=2.1; Accession=PF00560.23; Description=Leucine Rich Repeat
  Pfam annotation: Domain name=LRR_1; Domain location=287-309; Score =8.5; E_value=7.4; Accession=PF00560.23; Description=Leucine Rich Repeat
  Pfam annotation: Domain name=LRR_1; Domain location=311-336; Score =6.6; E_value=17; Accession=PF00560.23; Description=Leucine Rich Repeat
  Pfam annotation: Domain name=LRR_1; Domain location=338-361; Score =12.5; E_value=1.3; Accession=PF00560.23; Description=Leucine Rich Repeat
  Pfam annotation: Domain name=LRR_1; Domain location=363-385; Score =13.2; E_value=0.97; Accession=PF00560.23; Description=Leucine Rich Repeat
  Pfam annotation: Domain name=LRR_1; Domain location=387-409; Score =14.1; E_value=0.5; Accession=PF00560.23; Description=Leucine Rich Repeat
  Pfam annotation: Domain name=LRR_1; Domain location=411-433; Score =17.4; E_value=0.05; Accession=PF00560.23; Description=Leucine Rich Repeat
  Pfam annotation: Domain name=LRR_1; Domain location=435-457; Score =17.8; E_value=0.039; Accession=PF00560.23; Description=Leucine Rich Repeat
  Pfam annotation: Domain name=LRR_1; Domain location=459-481; Score =18.0; E_value=0.035; Accession=PF00560.23; Description=Leucine Rich Repeat
  Pfam annotation: Domain name=LRR_1; Domain location=483-505; Score =2.2; E_value=1.1e+02; Accession=PF00560.23; Description=Leucine Rich Repeat
  Pfam annotation: Domain name=LRR_1; Domain location=512-534; Score =1.5; E_value=1.5e+02; Accession=PF00560.23; Description=Leucine Rich Repeat
  Pfam annotation: Domain name=LRR_1; Domain location=536-558; Score =10.4; E_value=3.2; Accession=PF00560.23; Description=Leucine Rich Repeat
  Pfam annotation: Domain name=LRR_1; Domain location=560-582; Score =12.2; E_value=1.5; Accession=PF00560.23; Description=Leucine Rich Repeat
  Pfam annotation: Domain name=LRR_1; Domain location=584-607; Score =6.1; E_value=20; Accession=PF00560.23; Description=Leucine Rich Repeat
  Pfam annotation: Domain name=LRR_1; Domain location=609-632; Score =2.5; E_value=98; Accession=PF00560.23; Description=Leucine Rich Repeat
  Pfam annotation: Domain name=LRR_1; Domain location=657-680; Score =6.9; E_value=14; Accession=PF00560.23; Description=Leucine Rich Repeat
  Pfam annotation: Domain name=LRR_1; Domain location=682-704; Score =6.8; E_value=15; Accession=PF00560.23; Description=Leucine Rich Repeat
  Pfam annotation: Domain name=LRR_1; Domain location=706-725; Score =7.3; E_value=12; Accession=PF00560.23; Description=Leucine Rich Repeat
  Pfam annotation: Domain name=LRR_1; Domain location=727-748; Score =3.8; E_value=55; Accession=PF00560.23; Description=Leucine Rich Repeat
  Pfam annotation: Domain name=LRR_1; Domain location=755-776; Score =9.3; E_value=5.1; Accession=PF00560.23; Description=Leucine Rich Repeat
  Pfam annotation: Domain name=LRR_1; Domain location=779-801; Score =5.0; E_value=33; Accession=PF00560.23; Description=Leucine Rich Repeat
  Pfam annotation: Domain name=LRR_1; Domain location=803-825; Score =10.5; E_value=3.2; Accession=PF00560.23; Description=Leucine Rich Repeat
  Pfam annotation: Domain name=LRR_1; Domain location=827-850; Score =13.3; E_value=0.88; Accession=PF00560.23; Description=Leucine Rich Repeat
  Pfam annotation: Domain name=LRR_1; Domain location=852-874; Score =9.1; E_value=5.6; Accession=PF00560.23; Description=Leucine Rich Repeat
  Pfam annotation: Domain name=LRR_1; Domain location=876-898; Score =13.7; E_value=0.68; Accession=PF00560.23; Description=Leucine Rich Repeat
  Pfam annotation: Domain name=LRR_1; Domain location=948-970; Score =8.2; E_value=8.4; Accession=PF00560.23; Description=Leucine Rich Repeat
  Pfam annotation: Domain name=LRR_1; Domain location=972-994; Score =13.2; E_value=0.94; Accession=PF00560.23; Description=Leucine Rich Repeat
  Pfam annotation: Domain name=LRR_1; Domain location=996-1018; Score =15.8; E_value=0.16; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1::LRR_1; Domain location=15 -55::1020-1041::114-139::141-163::165-187::189-212::214-236::261 -282::287-309::311-336::...
  Pfam module annotation: Domain location=338-361::363-385::387 -409::411-433::435-457::459-481::483-505::512-534::536-558::560 -582::584-607::609-632::657-680::682-704::706-725::727-748::755 -776::779-801::803-825::827-850::...
  Pfam module annotation: Domain location=852-874::876-898::948 -970::972-994::996-1018
MENLEIDLMVESVCIPSERETLLKIKNNLIDPSNRLWSWNHNNTNCCHWYGVLCHNVTSHLLQLHLNTTVPAFEYDDGYEYDYYDEVFRGLNEEAYRRRSFGGEISPCLADLKHLNYLDLSGNEFLGEGMSIPSFLGTMTSLTHLNLSHTGFRGKIPPQIGNLSNLVYLDLSYVVANGTVPSQIGNLSKLRYLDLSDNDFEGMAIPSFLCAMTSLTHLDLSYSRFMGKIPSQIGNLSNLLYLGLGGNYHAENVEWVSSMWKLEYLDLSSANLSKAFHWLHTLQSLPSLTHLYLSGCKLPHYNEPSLLNFSSLQTLDLSDTSYSPAISFVPKWIFKLKKLVSLQLSDNYEIQGPIPCGIRNLTHLQNLDLSFNSFSSSIPNCLYGLHRLKFLNLRYNNLHGTISDALGNLTSLVELDLSVNQLEGTIPTSFGNLTSLVELDLSLNQLEGTIPISLGNLTSLVELDLSANQLEGNIPTSLGNLCNLRVIDLSYLKLNQQVNELLEILAPCISHGLTRLAVQSSRLSGNLTDHIGAFKNIEQLRFYNNSIGGALPRSFGKLSSLRYLDLSINKFSGNPFESLRSLSKLLSLHIDGNLFHGVVKEDDLANLTSLTGFVASGNNFTLKVGPNWIPNFQLTYLEVTSWQLGPSFPLWIQSQNKLKYVGLSNTGIFDSIPTQMWEALSQVLYLNLSRNHIHGEIGTTLKNPISIRTIDLSSNHLCGKLPYLSSDVHQLDLSSNSFSESMNDFLCNDQDKPILLEFLNLASNNLSGEIPDCWMNWTFLADVNLQSNHFVGNLPQSMGSLADLQSLQIRNNTLSGIFPTSLKKNNQLISLDLGENNLSGTIPTWVGENLLNVKILRLRSNRFGGHIPNEICQMSLLQVLDLAQNNLSGNIPSCFSNLSAMTLKNQSTDPRIYSQGKYIVSYSATESIVSVLLWLKGRGDEYRNILGLVTSIDLSSNKLFGEIPREITYLNGLNFLNMSHNQLIGHIPQGIGNMRSLQSIDFSRNQLFGEIPPSIANLSFLSMLDLSYNHLKGNIPTGTQLQTFDASSFIGNNLCGPPLPINCSSNGKTHSYEGSDGHGVNWFFVSMTVGFIVGFWIVIAPLLICRSWRGRVAERNEGKDRRCGEMELRITK

SEQ ID NO: 134002 - protein, 73 aa, Glycine max
  Coding DNA Sequence Number=SeqID_17224
MGWYKGPCGSQHAQQCKFPDLVKKARKEFVITTESKSSVTFGNMPIFLLGIRTYPRAIQKDYAPCPKSVKREG

SEQ ID NO: 134003 - protein, 1160 aa, Glycine max
  Coding DNA Sequence Number=SeqID_17225
  Gene Ontology: Mol. function=protein binding; Cellular component =integral to membrane; Biological process=defense response to fungus
  Homolog annotation: Hit_ID=Q949G9; Match level="QueryCoverage=84%, HitCoverage=95%, E-value=0.0, Identity=40%"; Hit description=HcrVf1 protein
  Pfam annotation: Domain name=DUF821; Domain location=932-1154; Score=- 10.4; E_value=8.8e-19; Accession=PF05686.3; Description=Arabidopsis thaliana protein of unknown function (DUF821)
  Pfam annotation: Domain name=LRRNT_2; Domain location=10-50; Score =37.4; E_value=4.8e-08; Accession=PF08263.3; Description=Leucine rich repeat N-terminal domain
  Pfam annotation: Domain name=LRR_1; Domain location=126-148; Score =11.2; E_value=2.3; Accession=PF00560.23; Description=Leucine Rich Repeat
  Pfam annotation: Domain name=LRR_1; Domain location=177-198; Score =10.0; E_value=3.8; Accession=PF00560.23; Description=Leucine Rich Repeat
  Pfam annotation: Domain name=LRR_1; Domain location=203-225; Score =8.7; E_value=6.6; Accession=PF00560.23; Description=Leucine Rich Repeat
  Pfam annotation: Domain name=LRR_1; Domain location=227-252; Score =3.4; E_value=65; Accession=PF00560.23; Description=Leucine Rich Repeat
  Pfam annotation: Domain name=LRR_1; Domain location=254-276; Score =13.2; E_value=0.97; Accession=PF00560.23; Description=Leucine Rich Repeat
  Pfam annotation: Domain name=LRR_1; Domain location=278-300; Score =10.6; E_value=2.9; Accession=PF00560.23; Description=Leucine Rich Repeat
  Pfam annotation: Domain name=LRR_1; Domain location=302-324; Score =13.8; E_value=0.62; Accession=PF00560.23; Description=Leucine Rich Repeat
  Pfam annotation: Domain name=LRR_1; Domain location=326-348; Score =20.9; E_value=0.0047; Accession=PF00560.23; Description=Leucine Rich Repeat
  Pfam annotation: Domain name=LRR_1; Domain location=379-401; Score =0.4; E_value=2.4e+02; Accession=PF00560.23; Description=Leucine Rich Repeat
  Pfam annotation: Domain name=LRR_1; Domain location=403-425; Score =11.4; E_value=2.1; Accession=PF00560.23; Description=Leucine Rich Repeat
  Pfam annotation: Domain name=LRR_1; Domain location=427-449; Score =12.1; E_value=1.5; Accession=PF00560.23; Description=Leucine Rich Repeat
  Pfam annotation: Domain name=LRR_1; Domain location=451-474; Score =7.9; E_value=9.7; Accession=PF00560.23; Description=Leucine Rich Repeat
  Pfam annotation: Domain name=LRR_1; Domain location=476-499; Score =5.5; E_value=26; Accession=PF00560.23; Description=Leucine Rich Repeat
  Pfam annotation: Domain name=LRR_1; Domain location=524-547; Score =10.1; E_value=3.7; Accession=PF00560.23; Description=Leucine Rich Repeat
  Pfam annotation: Domain name=LRR_1; Domain location=549-582; Score =5.2; E_value=30; Accession=PF00560.23; Description=Leucine Rich Repeat
  Pfam annotation: Domain name=LRR_1; Domain location=594-615; Score =3.6; E_value=60; Accession=PF00560.23; Description=Leucine Rich Repeat
  Pfam annotation: Domain name=LRR_1; Domain location=622-643; Score =12.2; E_value=1.5; Accession=PF00560.23; Description=Leucine Rich Repeat
  Pfam annotation: Domain name=LRR_1; Domain location=646-668; Score =3.1; E_value=75; Accession=PF00560.23; Description=Leucine Rich Repeat
  Pfam annotation: Domain name=LRR_1; Domain location=670-692; Score =10.9; E_value=2.6; Accession=PF00560.23; Description=Leucine Rich Repeat
  Pfam annotation: Domain name=LRR_1; Domain location=694-717; Score =11.5; E_value=2; Accession=PF00560.23; Description=Leucine Rich Repeat
  Pfam annotation: Domain name=LRR_1; Domain location=719-741; Score =9.5; E_value=4.7; Accession=PF00560.23; Description=Leucine Rich Repeat
  Pfam annotation: Domain name=LRR_1; Domain location=743-765; Score =16.3; E_value=0.11; Accession=PF00560.23; Description=Leucine Rich Repeat
  Pfam annotation: Domain name=LRR_1; Domain location=816-838; Score =5.1; E_value=32; Accession=PF00560.23; Description=Leucine Rich Repeat
  Pfam annotation: Domain name=LRR_1; Domain location=840-862; Score =15.0; E_value=0.28; Accession=PF00560.23; Description=Leucine Rich Repeat
  Pfam annotation: Domain name=LRR_1; Domain location=864-886; Score =15.3; E_value=0.22; Accession=PF00560.23; Description=Leucine Rich Repeat
  Pfam annotation: Domain name=LRR_1; Domain location=888-909; Score =8.5; E_value=7.5; Accession=PF00560.23; Description=Leucine Rich Repeat
  Pfam annotation: Domain name=LRR_1; Domain location=99-124; Score =8.2; E_value=8.2; Accession=PF00560.23; Description=Leucine Rich Repeat
  Pfam module annotation: Pfam domain module=DUF821::LRRNT_2::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1:...
  Pfam module annotation: Pfam domain module=:LRR_1::LRR_1::LRR_1::LRR _1; Domain location=932-1154::10-50::126-148::177-198::203-225::227 -252::254-276::278-300::302-324::326-348::379-401::403-425::427 -449::451-474::...
  Pfam module annotation: Domain location=476-499::524-547::549 -582::594-615::622-643::646-668::670-692::694-717::719-741::743 -765::816-838::840-862::864-886::888-909::99-124
MKNLEMDLMVSAMRETLLKIKNNLNDPSNRLWSWNHNHTNCCHWYGVLCHNVTSHVLQLHLNTTFSAAFYDGYYHFDEEAYEKSQFGGEISPCLADLKHLNHLNLSGNYFLGAGMAIPSFLGTMTSLTHLDLSLTGFMGKIPSQIGNLSNLVYLDLGGYSVEPMLAENVEWVSSMWKLEYLHLSYANLSKAFHWLHTLQSLPSLTHLDLSGCTLPHYNEPSLLNFSSLQTLHLSFTSYSPAISFVPKWIFKLKKLVSLQLWGNEIQGPIPGGIRNLTLLQNLYLSGNSFSSSIPDCLYGLHRLKFLNLGDNHLHGTISDALGNLTSLVELDLSGNQLEGNIPTSLGNLCNLRDIDFSNLKLNQQVNELLEILAPCISHGLTRLAVQSSRLSGHLTDYIGAFKNIERLDFSNNSIGGALPRSFGKHSSLRYLDLSTNKFSGNPFESLGSLSKLSSLYIGGNLFQTVVKEDDLANLTSLMEIHASGNNFTLKVGPNWLPNFQLFHLDVRSWQLGPSFPSWIKSQNKLEYLDMSNAGIIDSIPTQMWEALPQVLYLNLSHNHIHGESGTTLKNPISIPVIDLSSNHLCGKLPYLSSDVSQLDLSSNSFSESMNDFLCNDQDEPMQLQFLNLASNNLSGEIPDCWMNWTFLGNVNLQSNHFVGNLPQSMGSLAELQSLQIRNNTFSGIFPSSLKKNNQLISLDLGENNLSGCIPTWVGEKLLKVKILRLRSNSFAGHIPNEICQMSHLQVLDLAENNLSGNIPSCFCNLSAMTLKNQSTYPRIYSEEQYAGSSYSFNYGIVSVLLWLKGRGDEYKNFLGLVTDIDLSSNKLLGKIPREITYLNGLNFLNLSHNQLIGHIPQGIGNMRSIQTIDFSRNQLSGEIPPTISNLSFLSMLDLSYNHLKGNIPTGTQLQTFDASSFIGNNLCGPPLPINCSSNGKTHSYEGSDGHGVNWFFVSATIGFVVGFWIVIAPLLICRSWRAEINIKPWHILLGGLKEGTTRIPWLNREPYAYWKGNPAVAETRQDLIKCNVSENQDWNARLFAQVLLGQSVKNTFCHVTLPLYVYGYMFHLLNSYAKLFRYKPSISANATELCVESMVCGAEGSVKKFMMESLVKVPANTDPCTMPAPFDPPTLYATLERKESSIQQVESWERSYWDNQTITS

SEQ ID NO: 134004 - protein, 76 aa, Glycine max
  Coding DNA Sequence Number=SeqID_17226
MKAGYTGFQWEESEKLLSIEGMEQWQIHLRALHHQKFFISKSQVRQDHIDASEQCELGLYDGYDNEELSLVTSYYY

SEQ ID NO: 134005 - protein, 141 aa, Glycine max
  Coding DNA Sequence Number=SeqID_17227
MGGRIASVTPSHNFQRERGPYGRDRERLFFQRSREGFTLSQSLKLPSPMLLKSVNLSKEENPLLEASWGNFSNEESPMGTTSRSTKDSWMEPPESLPPKPRGKKPNDSRELQPRVAMIAEVVTRNCRDKGKECSSLKMTKT

SEQ ID NO: 134006 - protein, 180 aa, Glycine max
  Coding DNA Sequence Number=SeqID_17228
  Gene Ontology: Mol. function=RNA-directed DNA polymerase activity; Cellular component=chromatin; Biological process=RNA-dependent DNA replication
MAEPSNDRIEAALARLTSRIEDLLQHVTPSASPSFPPRSPIPAHSHRMKLDVPRFDGTDPLGWIFKITQFFEYHGTPDHNRITIAAFYMEGRALAWFQWMSSNGQFTFWPVFLQALQNRFAPSQYEDPSGSLFKLTQRTTVTEYLSEFEELANRVVGLPAPFLLSCFVSGLAPEIRREVM

SEQ ID NO: 134007 - protein, 132 aa, Glycine max
  Coding DNA Sequence Number=SeqID_17229
  Subcellular localization annotation: CTP_CleavageSite=55; ConfidenceScore=5.51e-01
MFPVESLKAHQTQGPPLVNLTKASSPNPRSAPGESIKTQDKHVSSRISKGSSSPRSTLGESHKTQGEHVLGRISKGSSNPKSTLGESCQTKYECVPSQIFKGSSNPRSVLDKTLYAYGLSYTGILETQTHSW

SEQ ID NO: 134008 - protein, 178 aa, Glycine max
  Coding DNA Sequence Number=SeqID_17230
  Homolog annotation: Hit_ID=Q1RWP6; Match level="QueryCoverage=49%, HitCoverage=7%, E-value=5e-11, Identity=40%"; Hit description=Zinc finger, CCHC-type; Polynucleotidyl transferase, Ribonuclease H fold
MGSEIYPKVHENPRTFFSRSSPILLESSIQYPWREVFVALEAWENPIGYKKLHDILFDFESYLKRYDNNNNDLLPVASAHAGHRGKPSYHKKQYMSTYRQSSSTPPKVFCQYYGKPRHIAKDLKTKVPFLKGRHNHRLYQTHISITTPPQSTCHYFQSSSLLVTPQIAFSNISLPFIK

SEQ ID NO: 134009 - protein, 1116 aa, Glycine max
  Coding DNA Sequence Number=SeqID_17231
  Gene Ontology: Mol. function=protein binding; Cellular component =integral to membrane; Biological process=defense response to fungus
  Homolog annotation: Hit_ID=Q949G8; Match level="QueryCoverage=96%, HitCoverage=95%, E-value=0.0, Identity=37%"; Hit description=HcrVf2 protein
  Pfam annotation: Domain name=LRRNT_2; Domain location=27-67; Score =48.5; E_value=2.2e-11; Accession=PF08263.3; Description=Leucine rich repeat N-terminal domain
  Pfam annotation: Domain name=LRR_1; Domain location=1003-1024; Score =8.5; E_value=7.5; Accession=PF00560.23; Description=Leucine Rich Repeat
  Pfam annotation: Domain name=LRR_1; Domain location=112-137; Score =9.4; E_value=5.1; Accession=PF00560.23; Description=Leucine Rich Repeat
  Pfam annotation: Domain name=LRR_1; Domain location=139-161; Score =9.7; E_value=4.4; Accession=PF00560.23; Description=Leucine Rich Repeat
  Pfam annotation: Domain name=LRR_1; Domain location=163-187; Score =8.3; E_value=8; Accession=PF00560.23; Description=Leucine Rich Repeat
  Pfam annotation: Domain name=LRR_1; Domain location=190-212; Score =15.9; E_value=0.15; Accession=PF00560.23; Description=Leucine Rich Repeat
  Pfam annotation: Domain name=LRR_1; Domain location=214-236; Score =1.2; E_value=1.7e+02; Accession=PF00560.23; Description=Leucine Rich Repeat
  Pfam annotation: Domain name=LRR_1; Domain location=238-263; Score =11.9; E_value=1.7; Accession=PF00560.23; Description=Leucine Rich Repeat
  Pfam annotation: Domain name=LRR_1; Domain location=265-287; Score =17.4; E_value=0.051; Accession=PF00560.23; Description=Leucine Rich Repeat
  Pfam annotation: Domain name=LRR_1; Domain location=317-338; Score =11.0; E_value=2.5; Accession=PF00560.23; Description=Leucine Rich Repeat
  Pfam annotation: Domain name=LRR_1; Domain location=343-365; Score =8.7; E_value=6.6; Accession=PF00560.23; Description=Leucine Rich Repeat
  Pfam annotation: Domain name=LRR_1; Domain location=367-392; Score =4.3; E_value=45; Accession=PF00560.23; Description=Leucine Rich Repeat
  Pfam annotation: Domain name=LRR_1; Domain location=394-416; Score =15.4; E_value=0.2; Accession=PF00560.23; Description=Leucine Rich Repeat
  Pfam annotation: Domain name=LRR_1; Domain location=418-440; Score =10.0; E_value=3.8; Accession=PF00560.23; Description=Leucine Rich Repeat
  Pfam annotation: Domain name=LRR_1; Domain location=442-464; Score =12.1; E_value=1.5; Accession=PF00560.23; Description=Leucine Rich Repeat
  Pfam annotation: Domain name=LRR_1; Domain location=466-488; Score =21.4; E_value=0.0031; Accession=PF00560.23; Description=Leucine Rich Repeat
  Pfam annotation: Domain name=LRR_1; Domain location=490-512; Score =17.4; E_value=0.052; Accession=PF00560.23; Description=Leucine Rich Repeat
  Pfam annotation: Domain name=LRR_1; Domain location=514-536; Score =16.5; E_value=0.098; Accession=PF00560.23; Description=Leucine Rich Repeat
  Pfam annotation: Domain name=LRR_1; Domain location=543-565; Score =7.8; E_value=9.8; Accession=PF00560.23; Description=Leucine Rich Repeat
  Pfam annotation: Domain name=LRR_1; Domain location=567-590; Score =10.9; E_value=2.6; Accession=PF00560.23; Description=Leucine Rich Repeat
  Pfam annotation: Domain name=LRR_1; Domain location=592-615; Score =5.5; E_value=26; Accession=PF00560.23; Description=Leucine Rich Repeat
  Pfam annotation: Domain name=LRR_1; Domain location=640-662; Score =6.1; E_value=21; Accession=PF00560.23; Description=Leucine Rich Repeat
  Pfam annotation: Domain name=LRR_1; Domain location=665-687; Score =5.4; E_value=27; Accession=PF00560.23; Description=Leucine Rich Repeat
  Pfam annotation: Domain name=LRR_1; Domain location=689-708; Score =3.6; E_value=61; Accession=PF00560.23; Description=Leucine Rich Repeat
  Pfam annotation: Domain name=LRR_1; Domain location=710-732; Score =2.9; E_value=82; Accession=PF00560.23; Description=Leucine Rich Repeat
  Pfam annotation: Domain name=LRR_1; Domain location=738-757; Score =11.6; E_value=1.9; Accession=PF00560.23; Description=Leucine Rich Repeat
  Pfam annotation: Domain name=LRR_1; Domain location=762-784; Score =8.1; E_value=8.6; Accession=PF00560.23; Description=Leucine Rich Repeat
  Pfam annotation: Domain name=LRR_1; Domain location=786-808; Score =10.5; E_value=3.1; Accession=PF00560.23; Description=Leucine Rich Repeat
  Pfam annotation: Domain name=LRR_1; Domain location=810-833; Score =11.5; E_value=2; Accession=PF00560.23; Description=Leucine Rich Repeat
  Pfam annotation: Domain name=LRR_1; Domain location=835-857; Score =11.2; E_value=2.2; Accession=PF00560.23; Description=Leucine Rich Repeat
  Pfam annotation: Domain name=LRR_1; Domain location=859-881; Score =16.0; E_value=0.14; Accession=PF00560.23; Description=Leucine Rich Repeat
  Pfam annotation: Domain name=LRR_1; Domain location=931-953; Score =5.4; E_value=28; Accession=PF00560.23; Description=Leucine Rich Repeat
  Pfam annotation: Domain name=LRR_1; Domain location=955-977; Score =15.1; E_value=0.25; Accession=PF00560.23; Description=Leucine Rich Repeat
  Pfam annotation: Domain name=LRR_1; Domain location=979-1001; Score =16.6; E_value=0.091; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1; Domain location=27-67::1003 -1024::112-137::139-161::163-187::190-212::214-236::238-263::265 -287::317-338::343-365:...
  Pfam module annotation: Domain location=:367-392::394-416::418 -440::442-464::466-488::490-512::514-536::543-565::567-590::592 -615::640-662::665-687::689-708::710-732::738-757::762-784::786 -808::810-833::835-857::859-881:...
  Pfam module annotation: Domain location=:931-953::955-977::979-1001
MNSSSIYILVFVQLWLLSLPCRESVCIPSERETLFKFKNNLNDPSNRLWSWNHNHTNCCHWYGVLCHSVTSHVLQLHLNSSHSPFNDDHDWESYRRWSFGGEISPCLADLKHLNYLDLSGNIFFGAGMSIPSFLGTMTSLTHLDLALTGFMGKIPPQIGNLSKLRYLDLSFNDLLGEGMAISSFLCAMSSLTHLDLSDTGIHGKIPPQIGNLSNLVYLDLSYVVANGTVPSQIGNLSKLRYLDLSGNEFLGEGMSIPSFLCAMTSLTHLDLSGNGFMGKIPSQIGNLSNLVYLGLGGHSVVEPLFAENVEWVSSMWKLEYLHLSNANLSKAFHWLHTLQSLPSLTHLYLSHCKLPHYNEPSLLNFSSLQTLHLSYTSYSPAISFVPKWIFKLKKLVSLQLSGNEINGPIPGGIRNLTLLQNLDLSFNSFSSSIPDCLYGLHRLKFLNLMGNNLHGTISDALGNLTSLVELDLSGNQLEGTIPTSLGNLTSLVELLLSYNQLEGTIPTSLGNLTSLVELVLSYNQLEGTIPTFLGNLRNSRETDLTYLDLSMNKFSGNPFESLGSLSKLSLLHIDGNNFQGVVNEDDLANLTSLEEFGASGNNFTLKVGPNWIPNFQLTYLDVTSWQIGPNFPSWIQSQNKLQYVGLSNTGILDSIPTWFWKAHSQVLYLNLSHNHIHGELVTTIKNPISIQTVDLSTNHLCGKLPYLSNDVYELDLSTNSFSESMQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKILRLRSNSFSGHIPNEICQMSHLQVLDLAKNNLSGNIPSCFNNLSAMTLVNRSTDPRIYSSAPNYAKYSSNYDIVSVLLWLKGRGDEYKNILGLVTSIDLSSNKLLGEIPREITDINGLNFLNLSHNQLIGPIPEGIGNMGSLQSIDFSRNQLSGEIPPTIANLSFLSMLDLSYNHLKGNIPTGTQLQTFDASSFIGNNLCGPPLPINCSSNGKTHSYEGSDGHGVNWFFVSMAIGFIVGFWIVIAPLLICRSWRYAYFHFLDQVWFKLQSFCSSSISV

SEQ ID NO: 134010 - protein, 455 aa, Glycine max
  Coding DNA Sequence Number=SeqID_17232
  Gene Ontology: Mol. function=nuclease activity; Cellular component =chromatin; Biological process=chromatin assembly or disassembly
  Homolog annotation: Hit_ID=Q1SPC1; Match level="QueryCoverage=99%, HitCoverage=76%, E-value=0.0, Identity=73%"; Hit description=Chromo; Helix-hairpin-helix motif, class 2
  Pfam annotation: Domain name=Chromo; Domain location=243-294; Score =11.8; E_value=0.039; Accession=PF00385.14; Description='chromo' (CHRromatin Organisation MOdifier
  Pfam annotation: Domain name=XPG_I; Domain location=17-106; Score =57.0; E_value=6.1e-14; Accession=PF00867.9; Description=XPG I-region
  Pfam module annotation: Pfam domain module=Chromo::XPG_I; Domain location=243-294::17-106
MGSEFSCMIKEAKVLGMALGISCLNGIEEAEAQCALLNFESLCDGCFSSDSDIFLFGARTVYRDICLGDGGYVVCYEMTDIERKLGFGRDSLIALSLLLGSDYYQGVHGLGPESACQIVKSIGDKYILKKFASEGLGWVKKRKGGKNDLRPDDNILQVINAYMKPKCHQADSDIVHKALAQYPFQRTKLQQICVGFFEWPSEKTDGYILPNIAERNLRRFANLRLTSSEVGLNLPLHEIPVKCPVSEIIKSRRVQGRECYEVSWEGMDGLETSIVPADLIESACREKILEFEERKAQRKKQNIQKRKPKKKETNSSVAELDLKLQNLLLDINLRDEANFNASDSSGRISRITTDMAEADLNTTDLLPLSHDIEHTGLIQNTSSEVVSSIDKNEIIDLLSPSPPKKSNLFSKCQQSSDQHIEVINLSDSENDMSVERKQKAKELRLFLASIRNEIH

SEQ ID NO: 134011 - protein, 243 aa, Glycine max
  Coding DNA Sequence Number=SeqID_17233
  Gene Ontology: Mol. function=DNA binding
  Homolog annotation: Hit_ID=Q9LTJ8; Match level="QueryCoverage=32%, HitCoverage=10%, E-value=5e-13, Identity=50%"; Hit description =Arabidopsis thaliana genomic DNA, chromosome 5, BAC clone:F17P19
  Pfam annotation: Domain name=MBD; Domain location=95-164; Score=11.8; E_value=0.0022; Accession=PF01429.10; Description=Methyl-CpG binding domain
MEEPNSDCWLPPGWTVEVRVRKNGKRDKVSENFKGGFGLWRSFFNSGKNETRHCEMERGHSRSSESESHLSAFPPIIYYFPPSSGLKFNSKVEVIVEKAIAEGLPPGWVKKTRITTNGDSVRRDTFYIDPVNGYTFCSIKDVDCYLESGEIGSYEFKSKDNDGTDMELKADKSPSTSVTVKPTLSISMGQSSDMDMIANDQQIPRSASSEEYMSVPISECVVGAKLTSSVLSLAKSSDKKQGK

SEQ ID NO: 134012 - protein, 94 aa, Glycine max
  Coding DNA Sequence Number=SeqID_17234
MAPKHKPKSVYFEPSSVVEVRINDDGFRGSGFSGTIFRFVAAKIFNSSGHCLCWKAVRVSLACAWTVRTMFRFRDMEVIGEGKRNGGRDGGENE

SEQ ID NO: 134013 - protein, 195 aa, Glycine max
  Coding DNA Sequence Number=SeqID_17235
VSPAKPPQKLDPEVDDLLYLMTLTIPELFLRPYQVTWDATVFGVFNPNFLLYIKHEDLSEIALGGQCLSISVLQLWILHLTETSMRAGNSDIYGFLEPQSIQRSGHSQFETESYIKSWKKSSKRDVYLRAYLNRSDNYLKGIINRQKGSTKCGYYVMHWMFTIILGSFRNNWEATITAREIKGTADPVGTVLSLS

SEQ ID NO: 134014 - protein, 38 aa, Glycine max
  Coding DNA Sequence Number=SeqID_17236
MVKTPLGHFTEHLVGALWGTNNKGMGAMWLTPSLQNTT

SEQ ID NO: 134015 - protein, 70 aa, Glycine max
  Coding DNA Sequence Number=SeqID_17237
MVSEQVLPGGVDSAASLRFFMSSPDSRCLWKKTLALMDLAGSQIQAGITICEERRGFRTIVQVIDSTAEM

SEQ ID NO: 134016 - protein, 519 aa, Glycine max
  Coding DNA Sequence Number=SeqID_17238
  Gene Ontology: Mol. function=3-deoxy-7-phosphoheptulonate synthase activity; Cellular component=chloroplast; Biological process =aromatic amino acid family biosynthetic process
  Homolog annotation: Hit_ID=Q30D02; Match level="QueryCoverage=91%, HitCoverage=87%, E-value=0.0, Identity=80%"; Hit description =Putative 3-deoxy-D-arabino-heptulosonate 7-phosphate synthase 3
  Pfam annotation: Domain name=DAHP_synth_2; Domain location=61-501; Score=1044.5; E_value=0; Accession=PF01474.7; Description=Class-II DAHP synthetase family
  Subcellular localization annotation: CTP_CleavageSite=57; ConfidenceScore=5.70e-01
MAATASNSLLCTKTLVPTLPSSSNNLNNSNLCSSFPRPRPRPIQALNNSVTVITDKKCEAKWVVDSWKSKKALQLPEYPEQEKLQSVLKSLEAFPPIVFAGEARNLEERLAQASMGNAFLLQGGDCAESFKEFHANNIRDTFRLLLQMSVVTMFGAQVPVIKVGRMAGQFAKPRSEAFEEKDGVKLPSYRGDNVNGDAFEEKTRIPDPERMIRSYSQSAATLNLLRAFATGGYAAMQRVSQWNLDFTQHSEQGDRYLELARRIDETLGFMAAAGLTMDHPIMKTTEFWTSHECLLLPYEQSLTRLDSTSGLYYDCSAHMLWVGERTRQLDGAHVEFLRGIANPLGIKVSDKIDPKELIRLIEILNPQNKPGRITVITRMGAENTRAKLPHLIRGVRNAGLIVCWVSDPMHGNTIKAPCGLKTRPFHSIMISKEEVKSFFDVHEQEGSHPGGVHLEMTGQNVTECIGGSKMVTFDDLSSRYNTHCDPRLNASQSLELAFIISERLKKNRIGSNLNNVFSL

SEQ ID NO: 134017 - protein, 145 aa, Glycine max
  Coding DNA Sequence Number=SeqID_17239
EKVKMTASQRQMLEDEQEKVSALQIEREAREGAVADIYYAPDEVHGLFDYYPHMARTMSEIEEVQEQMKADMEASKDQMTTMIEAMMSMRKMMEVNVAPVATTSATAEEDPTHSSSINQVNRLVPDMVGQGGEALGSTGGPHFVQ

SEQ ID NO: 134018 - protein, 66 aa, Glycine max
  Coding DNA Sequence Number=SeqID_17240
NVRGYFTEWSDRSSMGRSVNNPLAQVLGDTQLGAQKAEAETEPLWKRQRKKKISQKREVEGSHPDG

SEQ ID NO: 134019 - protein, 68 aa, Glycine max
  Coding DNA Sequence Number=SeqID_17241
MTIADSIKTTLPETDNAKEFMRLVRERSQPADKSLARTSMSTLITMKFDGSWIPHNSNHKAQMRSSSS

SEQ ID NO: 134020 - protein, 319 aa, Glycine max
  Coding DNA Sequence Number=SeqID_17242
  Gene Ontology: Cellular component=cellulose and pectin-containing cell wall
  Homolog annotation: Hit_ID=Q7Y0S8; Match level="QueryCoverage=89%, HitCoverage=91%, E-value=9e-97, Identity=61%"; Hit description=Erg-1
  Pfam annotation: Domain name=Phi_1; Domain location=44-319; Score =514.3; E_value=1.3e-151; Accession=PF04674.3; Description=Phosphate -induced protein 1 conserved region
MIILRLALVVASLVVLVQSHVPNIWEAKPFHQMLSLVQPDPVVLNYHKGPLLKGNVTVHIHWYGNFTPTHRSIIVDFIQSLGSIPHSRHHPSPFLWWRITARYRGGPCTLTVGNQTLDNTYSLGKSLKTSDLLALASKNSLTTTTIPISTHNESMHVLLTSADVAVDGFCMSRCGTHGSGRVQKKRFAFAWVGNPATQCPGECAWPFHQQVYGPQTPPLVPPNGDVGVDGMVISLATVLAGAVTNPFGNGYYQGSATAPLEAVSACAGIFGKGAYPGYTGNVLVDNVTGASYNALDVHGRKFLLPAMWDPVTSTCKTLV

SEQ ID NO: 134021 - protein, 339 aa, Glycine max
  Coding DNA Sequence Number=SeqID_17243
  Gene Ontology: Mol. function=protein binding; Biological process =ubiquitin cycle
  Homolog annotation: Hit_ID=Q6Z7V6; Match level="QueryCoverage=98%, HitCoverage=97%, E-value=3e-80, Identity=47%"; Hit description=F-box protein-like
  Pfam annotation: Domain name=F-box; Domain location=8-56; Score=23.3; E_value=0.00088; Accession=PF00646.23; Description=F-box domain
MEEACEFRSWAELIPDALGVIFTNLSLQERVTVIPRVCKSWANAVTGPYCWQEIDIKDWSNRCQPDQLDRLLEMLITRSCGTLRKLSVSGLQTESIFTFIAENWILLAIFSYTKSFYSFASACSLHTLRLPRSSMNDSIVEQIAGRLSMISFLDVSYCIKIGPYALEMIGKNCKLLEGLCRNMHPLDTAEKPHQDDEAYAIASTMPKLKHLEMAYHLISTSGVLQILANCPKLEFLDQRGCWGVTLDHMFLKQKFPKLKVLGPLVLDTYESDGWDDFSDVSDSSEYLAWDFVAGGMGEYYVDDSDSYDGMWDDEARLDELQFGFYEGIEDAGMYWPPSP

SEQ ID NO: 134022 - protein, 115 aa, Glycine max
  Coding DNA Sequence Number=SeqID_17244
  Homolog annotation: Hit_ID=Q9C6E4; Match level="QueryCoverage=29%, HitCoverage=11%, E-value=1e-07, Identity=70%"; Hit description =Phosphate-induced (Phi-1) protein, putative
MARWEGLKLPYQMRLTEILPLRRGPLWYWNCNCCCWSFSLRILAAAPKWSAEIMRKRCKRTLEDTREAIDDLCREGNWKIEKESVRKEPYIVGSQMKVESQAWSERCQLENALLF

SEQ ID NO: 134023 - protein, 107 aa, Glycine max
  Coding DNA Sequence Number=SeqID_17245
  Homolog annotation: Hit_ID=O82161; Match level="QueryCoverage=49%, HitCoverage=15%, E-value=1e-07, Identity=56%"; Hit description=Phi-1 protein
MPARRGSCWLVTSPARNPRRETDRPVIEKEKKQPSCSWDSGGSTSPWFSTTWQQMAGCSETMGMTEKGREGVYIGPMEGMKERKRVKDTRGRRERDGIEKERRDLWK

SEQ ID NO: 134024 - protein, 75 aa, Glycine max
  Coding DNA Sequence Number=SeqID_17246
MSLSAKLGSDQALSKGECITTSIEIVFATIGSLGHYYVFLRLNSDLSSMFTMTELESIPFWYLAERGLDLADARE

SEQ ID NO: 134025 - protein, 160 aa, Glycine max
  Coding DNA Sequence Number=SeqID_17247
  Gene Ontology: Mol. function=nucleic acid binding; Cellular component= nucleus; Biological process=type I hypersensitivity
  Homolog annotation: Hit_ID=Q1SXU5; Match level="QueryCoverage=59%, HitCoverage=33%, E-value=8e-39, Identity=78%"; Hit description=RNA -binding region RNP-1
  Pfam annotation: Domain name=RRM_1; Domain location=40-110; Score =69.1; E_value=1.4e-17; Accession=PF00076.12; Description=RNA recognition motif. (a.k.a. RRM, R
MSETASLHAPTRTPISSLDAMAHHHPHYRSPFGDTTFTKLFVGGLAWETPTEEMRKYFEQFGDILEAVIITDKNTGKSKGYGFVTFCGQESARRACADPNPIIDGRRANCNIASLGRTRPSPPSGRNTVQGGVGTAQGVPGAGPAPSLPPPPPVLYPPYG

SEQ ID NO: 134026 - protein, 139 aa, Glycine max
  Coding DNA Sequence Number=SeqID_17248
MKKCRDADFSSCYTTYTPDYGYHQATMYNPQIQQPQYYQQLYEASSSTMGTPYYYGYSVQAPRNTFSSPQANRLSPGPSYLYYPTPIEVSFSGYRPPQQSPMRQTFPSPKDSQSQPRTSSETTARVAITSERSNSQGKN

SEQ ID NO: 134027 - protein, 310 aa, Glycine max
  Coding DNA Sequence Number=SeqID_17249
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=98%, HitCoverage=63%, E-value=1e-124, Identity=68%"; Hit description =Glucosyltransferase-10
  Pfam annotation: Domain name=UDPGT; Domain location=3-305; Score= -164.8; E_value=0.025; Accession=PF00201.9; Description=UDP -glucoronosyl and UDP-glucosyl transferase
MTNGYLETAIDWLPGIKEILLRDFPSFFRTIDPHDIMLQVLQEECGRAKHASAIILNTFEALEHDVLEALSSMLPPVYPIGPLTLLLNHVTDEDLKTIGSNLWKEDRECLKWLDTNEPKSVIYVNFGSITVMTNHQLIEFAWGLANSGKTFLWVIRPDLVDENTILPYEFVLETKDRGQLSGWCPQEEVLAHPAIGGFLTHSGWNSTIESLCNGVPMICWPFFAEQPTNCRFCCKEWGVGMQIEGDVTRDRVERLVRELMEGQKGKELTMKALEWKKLAEDATILKEGSSFLNYDNMVRQVLLSDNLKST

SEQ ID NO: 134028 - protein, 351 aa, Glycine max
  Coding DNA Sequence Number=SeqID_17250
  Homolog annotation: Hit_ID=Q41001; Match level="QueryCoverage=30%, HitCoverage=57%, E-value=7e-45, Identity=80%"; Hit description=Blue copper protein precursor
  Pfam annotation: Domain name=Cu_bind_like; Domain location=34-114; Score=132.8; E_value=9.3e-37; Accession=PF02298.8; Description =Plastocyanin-like domain
MAFSSALILWSLLAINMALPTLATVYTVGDTSGWAIGTDYSTWTGDKIFSVGDSLAFNYGAGHTVDEVKESDYKSCTAGNSISTDSSGATTIALKSAGTHYFICSVPGHCSGGMKLAVTVKSGKASDATPTTSTTTATKSNSSSASSVSPIVAMFIVSSISYYVLPAAAANATAATDPEAETLRRWAWLLGPRAVGASAGPSLTTAGPEATGESEGDTGAGGESVGELEGEEAVGPEEEEEEGVGDGGEEAGAVFETGAGAGGGGVEVVGGGAEEVVGGEALGAAACGGDGEALGVAAGEAEGDWAREEVASNMKKKKKDVLAIVREKGWKVMRKKKKNMKRVNGEGVVYI

SEQ ID NO: 134029 - protein, 315 aa, Glycine max
  Coding DNA Sequence Number=SeqID_17251
  Gene Ontology: Mol. function=transcription regulator activity; Cellular component=nucleus; Biological process=regulation of transcription
  Homolog annotation: Hit_ID=Q1RUX8; Match level="QueryCoverage=65%, HitCoverage=61%, E-value=3e-54, Identity=54%"; Hit description=Helix- loop-helix DNA-binding domain, putative
  Pfam annotation: Domain name=HLH; Domain location=114-165; Score =59.8; E_value=9e-15; Accession=PF00010.16; Description=Helix-loop -helix DNA-binding domain
DYLYSLVGATPNYGNFQAAEEEKVLLGIINNNIEHNLYANWDSSSTSMLQNVKEQQWDSHSSPEACTVEQSVTTPSFPPPPPPSSSVEATVTTTSRRKRRRTKSAKNKEEIENQRMTHIAVERNRRKQMNEYLAVLRSLMPSSYVQRGDQASIIGGAINFVKELEQLLQSMEGQKRTNQGKENVVGLNGTSRTTTTTPFAEFFAFPQYTTRGTTMAQNNQEQKQWAVADIEVTMVDNHANLKVLSKKQPGQIMKIVVGLQSLKLSILHLNVSTLDDMVLYSVSVKVEDGCLLNTVDEIAAAVNQLLRTIQEVTFS

SEQ ID NO: 134030 - protein, 386 aa, Glycine max
  Coding DNA Sequence Number=SeqID_17252
  Gene Ontology: Mol. function=transferase activity, transferring glycosyl groups; Cellular component=transcription factor TFIID complex; Biological process=queuosine biosynthetic process
  Homolog annotation: Hit_ID=Q6K4A3; Match level="QueryCoverage=91%, HitCoverage=85%, E-value=0.0, Identity=87%"; Hit description =Putative queuine tRNA-ribosyltransferase
  Pfam annotation: Domain name=TGT; Domain location=100-336; Score =388.1; E_value=1.4e-113; Accession=PF01702.8; Description=Queuine tRNA-ribosyltransferase
MEIIHLFGFLGTIKALTNSQLEDIGCQIILGNTYHLALRPTSELLDEVGGLHNFMNWKRALLTDSGGFQMVSLLHLADITEKGVTFQSPVDGKPMLLTPEESIQIQNRIGADIIMALDDVVKTTITGPRIEEAMYRTLRWIDRCIAAHKRPHDQNLFGIVQGGLDPILRDICVKGLVERNLPGYAIGGLSGGEDKNSFWRVVAQCTAALPEDKPRYVMGVGYPLDIVVCSALGADMYDCVYPTRTARFGTALVPEGVLKLKHKAMADDTRPIDPTCPCMVCKTYSRAYIHCLVTKDAMGSQLLSYHNLYYMLQLSRNLHSSIVEGRFPEFVCDFLRKMFPKGDVPEWVCDAMEVAGIDISSCCAQFSSCQEHDSKSMPEEEVSLVR

SEQ ID NO: 134031 - protein, 538 aa, Glycine max
  Coding DNA Sequence Number=SeqID_17253
  Gene Ontology: Mol. function=hydrolase activity, hydrolyzing O -glycosyl compounds; Biological process=carbohydrate metabolic process
  Homolog annotation: Hit_ID=Q105A0; Match level="QueryCoverage=99%, HitCoverage=96%, E-value=1e-156, Identity=68%"; Hit description =Isoamylase isoform 3
  Pfam annotation: Domain name=Alpha-amylase; Domain location=211-500; Score=-81.0; E_value=0.0048; Accession=PF00128.14; Description=Alpha amylase, catalytic domain
  Pfam annotation: Domain name=Alpha-amylase_C; Domain location=454 -537; Score=20.7; E_value=0.0018; Accession=PF02806.8; Description =Alpha amylase, C-terminal all-beta do
  Pfam annotation: Domain name=Isoamylase_N; Domain location=44-161; Score=56.5; E_value=8.5e-14; Accession=PF02922.8; Description =Isoamylase N-terminal domain
  Pfam module annotation: Pfam domain module=Alpha-amylase::Alpha -amylase_C::Isoamylase_N; Domain location=211-500::454-537::44-161
MDRAKHRATTAYGGRAQEGVLEEESSKVIESRPSWKAFPGQSFPLGVSEVDSGINFAIFSQNATAVTLCLVLPERGSIDALDGGMIEMVLDPDLNKTGDIWHICIEDWTLRVGRGQGLLNTPSTTDLPRSNVLYGYRIDGPRDWGKGHRFDSSIVLVDPYAKLVEGRRYFGDISMKLSKFLGTYDFDSLPFDWGENYKLPNISEKDLVIYEMNVRAFTSDESSGLDSNIRGSYLGMIEKIPHLLELGINAVELLPVFEFDELEFQRRPNPRDHMINTWGYSTINFFAPMSRYASAGGGSVNASREFKQMVKSLHSAGIEVILDVVYNHTNEADDAFPYTTSFRGIDNKGSFATRVAGSSDLYSVNNRRPYHGINFVIAHDGFTLRDLVSYNFKHNEANGEGGNDGSNDNFSWNCGLEGETDDASVRALRSRQMKNFHLALMISQNDITWHEDNWDNHDSKFLAFTLHDKSGGDIYLAFNAHDYFVKVLLPAPPKKRNWFRVVDTNLKSPDDFVLDGVPNVGNTYNIAPYSSILLEAKF

SEQ ID NO: 134032 - protein, 260 aa, Glycine max
  Coding DNA Sequence Number=SeqID_17254
MSMIYKTVEWHFWEFTKFDRWLHKFKKNIPLYTTIPLSDPESNPSRSLSLSATLRMANNTEEQQHNSIRSSIMEWKQMHPLHQIAETPTHKLLLKQWLKEEELINNRIALKETQIDSTRKEITTLYIFFFLFHSTTLMLLFNSSSSSSCHRSWVPSLCSLLFSLGLIWALRYKSDVEAHVEKMLQREKEDKGLLGRCVEELKKKGLEFDLLKEVDALRRAKSLRVENKEVRKWSSRDLVSLFFFSMACFSLALTRVILCT

SEQ ID NO: 134033 - protein, 505 aa, Glycine max
  Coding DNA Sequence Number=SeqID_17255
  Gene Ontology: Mol. function=nucleic acid binding
  Homolog annotation: Hit_ID=Q6ZFE5; Match level="QueryCoverage=35%, HitCoverage=66%, E-value=8e-27, Identity=41%"; Hit description =Putative RNA-binding protein cp33
  Pfam annotation: Domain name=RRM_1; Domain location=280-350; Score =64.2; E_value=4.2e-16; Accession=PF00076.12; Description=RNA recognition motif. (a.k.a. RRM, R
  Pfam annotation: Domain name=RRM_1; Domain location=374-446; Score =77.1; E_value=5.5e-20; Accession=PF00076.12; Description=RNA recognition motif. (a.k.a. RRM, R
  Pfam module annotation: Pfam domain module=RRM_1::RRM_1; Domain location=280-350::374-446
MDLPRDVDDYIKQTLDDTLGIPVSSKTLESKLRASQDSQWRLRERLLSLLPQLKQKDQLIDRLKQSEAGMNARALKKFVEENQRLATECERLLARCHQLENECALYDKDREALMEFGNDADERAREAQTRVLDLERDLLFMGNELNKYKHQHQLVNSSVCTPGEKNLLDSVLATPTLTSKDDDSTYAFLQVNSENEACKQLLSMWNCINPSTRSVLSLVAKVKSLEKDKEHLRTNLHKAEEESNKRKSSPRTSSPMQRKIDFDDQEEPLVSEEEFSRTRLLAQNVPWTSTPEDIRTLFEKHGKVLEVELSMYKKNRNRGLAFVEMGSPEEALEALNNLESYEFEGRVIKVNYARPKKEKTAPPPVKPKVVTFNLFVANLSYEASSKDLKEFFDLGTGRVVSAEVVYRDNPRRPSGYGFVSFKSKKEAEAALAEFQGKVFMGRPIRVDRGRRFVQQPGDGSAKSEDTPSELSVNGAEAPQPAEGSAKSEDTPSELSVNGEEADKAD

SEQ ID NO: 134034 - protein, 72 aa, Glycine max
  Coding DNA Sequence Number=SeqID_17256
  Homolog annotation: Hit_ID=Q9LUJ9; Match level="QueryCoverage=61%, HitCoverage=47%, E-value=8e-16, Identity=84%"; Hit description =Arabidopsis thaliana genomic DNA, chromosome 5, P1 clone:MUD12
MPLGLILGIGRAFRRKRPSSLDILSSKRAPRGYYKGKNCKPTGFHTRKDNQHVRQLQEEAFSALMVFTDYTC

SEQ ID NO: 134035 - protein, 93 aa, Glycine max
  Coding DNA Sequence Number=SeqID_17257
  Subcellular localization annotation: CTP_CleavageSite=43; ConfidenceScore=5.47e-01
MACPKPAMVLDLKPSSEAPPFLPLTNSLRCPPPTTIPNVTPARSQPISNRAAVAINHGFRSGFSHKGFENLFYGVEWCSKKTKTTRKERFKNL

SEQ ID NO: 134036 - protein, 144 aa, Glycine max
  Coding DNA Sequence Number=SeqID_17258
  Homolog annotation: Hit_ID=Q9SK88; Match level="QueryCoverage=56%, HitCoverage=19%, E-value=7e-15, Identity=39%"; Hit description =Similar to auxin-independent growth promoter
MHRRNKTVVPLGMLRRFLAASIFSIVVTSFFFVHVHVSPSPTDHKFNDKIPSFRDPQSWTRELAPPHLSKAPLSVPKLKDSRKDSDYEKLWKPPSNHGFIPCTKPTPNYSTPGRSRGYLSVHTNGGLNQMRTGMLESSSISLVS

SEQ ID NO: 134037 - protein, 404 aa, Glycine max
  Coding DNA Sequence Number=SeqID_17259
  Gene Ontology: Mol. function=nucleotide binding
  Homolog annotation: Hit_ID=Q67X84; Match level="QueryCoverage=99%, HitCoverage=72%, E-value=1e-149, Identity=65%"; Hit description =Putative auxin-independent growth promoter
  Pfam annotation: Domain name=DUF246; Domain location=1-342; Score =606.6; E_value=2.3e-179; Accession=PF03138.5; Description=Plant protein family
ICDMVAIARIINATLVIPELDKKSFWHDTSIFSDIFDEEWFISSLANDIKIIKKLPKKLVNATKIVMQFRSWSGMDYYENEIAALWDNFNVIRASKSDSRLANNNLPPEIQKLRCRACYEALRFSPHIEKMGKILVERMKSFGPYIALHLRYEKDMLAFSGCTHELSTAEAEELRIIRENTTYWKRKYINPIEERSKGFCPLTPKEVGIFLTALGYPSKTPIYIAAGEIYGGESHMTDLQSRYPLLMSKEKLASIEELEPFSSHASQMAALDYIVSVESDVFVHSYPGNMAKAVEGHRRFLGSGRTISPDRAVQHDPISFIRKALVHLFDKLANGSMTEGRTLSNKIIDLHKKRLGFFRKRKGPVSGTKGLDRFRSEETFYANPLPGCLCRTESLNINASHFSV

SEQ ID NO: 134038 - protein, 148 aa, Glycine max
  Coding DNA Sequence Number=SeqID_17260
  Gene Ontology: Mol. function=aminoacyl-tRNA ligase activity; Cellular component=mitochondrion; Biological process=tRNA aminoacylation for protein translation
  Homolog annotation: Hit_ID=Q2R1C1; Match level="QueryCoverage=98%, HitCoverage=30%, E-value=3e-56, Identity=68%"; Hit description=Seryl- tRNA synthetase family protein, expressed
MFIFCRPEESEHYHQELIKIEEDLFSSLGLHFKLGAAAYHKFDVEAWMPGLERFGEISSASNCTDYQSRRLGIRYCPASEAQATSAKKSKGNLAPPQFVHTLNATACAVPRMIICLLENHQQEDGSVLIPEPLRPFMGGLSVIAIKSL

SEQ ID NO: 134039 - protein, 557 aa, Glycine max
  Coding DNA Sequence Number=SeqID_17261
  Gene Ontology: Mol. function=receptor activity; Cellular component =nucleus
  Homolog annotation: Hit_ID=UPI00001971B2; Match level="QueryCoverage =87%, HitCoverage=57%, E-value=1e-178, Identity=58%"; Hit description= transferase, transferring glycosyl groups
  Pfam annotation: Domain name=F-box; Domain location=15-62; Score =33.1; E_value=9.8e-07; Accession=PF00646.23; Description=F-box domain
  Pfam annotation: Domain name=JmjC; Domain location=227-349; Score =32.4; E_value=9e-07; Accession=PF02373.13; Description=JmjC domain
  Pfam module annotation: Pfam domain module=F-box::JmjC; Domain location=15-62::227-349
MESQSQRDRRADALGDLRVLPDEILCSILERLTPRDAARVSCVSSVMYILCNEDPLWMSLCLKGASGFLQYKGSWKKTALHNENLLDKYKEYSQGPLHFDDTGNVKRIKDIPLKDFYNEYDAKKPVMLTGLADTWPARHKWTTDQLLLNYGDVAFKISQRSSRKISMKLKDYVSYMKVQHDEDPLYIFDEKFGEAVPSLLKDYCVPHLFQEDFFDILDTEKRPSYRWLIIGPERSGASWHVDPALTSAWNTLLCGRKSGNVSLAFDRWALYPPGKVPLGVTVHVNEEDGDVNVETPSSLQWWLDFYPLLADEDKPIECTQLPGETIYVPSGWWHCVLNLETTIAVTQNFVNSNNFEYVCLDMAPGYCHKGVCRVGLLALDEVSYENVRQNVSCNETDSSYSALSRKEKRAKTQKDVDDLYYKRAMDGRPLQFPVELRQQHGPARTKRMVIQALDSKTKIERANMEACIALNADKWLECLSKICAFHNLPLPTDDERLPVGTGSNPFGSLLDWHLALMRCSTVHQRRYLTEGGGELLFIDENDDGSGDNNDGGGGSSG

SEQ ID NO: 134040 - protein, 357 aa, Glycine max
  Coding DNA Sequence Number=SeqID_17262
  Gene Ontology: Mol. function=protein domain specific binding; Cellular component=nucleus; Biological process=intracellular signaling cascade
  Homolog annotation: Hit_ID=Q39558; Match level="QueryCoverage=71%, HitCoverage=93%, E-value=1e-124, Identity=90%"; Hit description=14-3- 3 protein 32kDa endonuclease
  Pfam annotation: Domain name=14-3-3; Domain location=8-245; Score =517.1; E_value=2e-152; Accession=PF00244.10; Description=14-3-3 protein
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKPDDHLIGIGIGLCSLNYFEDCALHSDSRSAVRDRYPEVVEIVKNHLAKIDAANVFHGIDDYARTHFSSVAIISGAPVSLQVTGKNQRDKVAKDEVGDDELMD

SEQ ID NO: 134041 - protein, 96 aa, Glycine max
  Coding DNA Sequence Number=SeqID_17263
MADIYKDDGWIKGKLEAARGSQFPLCGFPLSSKGLSPPRNYPTPSPHLILPPQLNSQLVSSPNSDLRMTAQQLSSNRLVNFSVFIGVKMKIMVFIK

SEQ ID NO: 134042 - protein, 256 aa, Glycine max
  Coding DNA Sequence Number=SeqID_17264
MPKLHGMTLCCRWRPSPVDVHSNTRVECSSKCLGRLGRHQTGDSQPQSLIREGTMIYPIEVSIGIGNYHQLGPAQWAKAEAAETLTDQKLGKTEAPATAEGRTPAANSNTQTAQAKTASETTTALATEPSLAAAAVAVVLAEAEAEVEVEVEVEPEAAEIGDSAGAWTVGNGGRGDNGAGGLEKTEKLLLKAGEEGESSEGESSGAWVAEWEAALRCGRAQVSPRIKDGFLNDGFGDLLRELVEMAKILIPAIVVG

SEQ ID NO: 134043 - protein, 80 aa, Glycine max
  Coding DNA Sequence Number=SeqID_17265
MGCYTTTAGHHRQGTSGNPPALIPPSLSSPRSSTLVILDPKYLDLEFFDGETFDCYQVFQNSGLIDFMSLKLSYFPELVK

SEQ ID NO: 134044 - protein, 54 aa, Glycine max
  Coding DNA Sequence Number=SeqID_17266
MQEQRLTVRCGEDFRSDRAGSAGAERRADTDSEREQIAPFIPAVSTPQKRPWRN

SEQ ID NO: 134045 - protein, 57 aa, Glycine max
  Coding DNA Sequence Number=SeqID_17267
MKAKCLRNKCKYREGMNEKVKVKKRLSHEMPKVTIELSSTVGLSAHPPLSAASTRLA

SEQ ID NO: 134046 - protein, 77 aa, Glycine max
  Coding DNA Sequence Number=SeqID_17268
MDATEAAYDAIVNEVLNNLTKNVAKKSIVEKLDESETSHEATSKAQVLPNIVVFCSINSGLTPLKYAPPVALIEDHV

SEQ ID NO: 134047 - protein, 55 aa, Glycine max
  Coding DNA Sequence Number=SeqID_17269
MKRMTKNMEALNLGENLGLYELKVVVASTCNFVKLVELGDLPRTGHSLGRRDEPV

SEQ ID NO: 134048 - protein, 160 aa, Glycine max
  Coding DNA Sequence Number=SeqID_17270
MSWNFTDCARMLPFDFRHVTELHELPNDGCQVPQSGQTRVASQQTNGPQTKLGETPFGRSISLPAEHAKILKIVEARLYGECDSKVMNKKLKDQRTTQVNQEQVKSSRIKNKSRVQESRRIQDSRRKPRIKNQDSRFKISRIKIKIQDSRFNNEEKTQSR

SEQ ID NO: 134049 - protein, 105 aa, Glycine max
  Coding DNA Sequence Number=SeqID_17271
  Subcellular localization annotation: CTP_CleavageSite=38; ConfidenceScore=5.01e-01
MNFVFCIFLENVMNSLSALAALSKMASRKRKSIGARPTAQYDTRRFLSLDAWNRYTDNVLGRSILSERKVVIYHTEFDDFKTELERGNLHKRLTNLADGSIDLAL

SEQ ID NO: 134050 - protein, 71 aa, Glycine max
  Coding DNA Sequence Number=SeqID_17272
TRSPLDGEKVWGNDHNLSPPTSRLTSLNDKGRIMTIICLYAIITRLAAPEGQRAQNDHNLSLRVYHSTCCS

SEQ ID NO: 134051 - protein, 77 aa, Glycine max
  Coding DNA Sequence Number=SeqID_17273
  Subcellular localization annotation: CTP_CleavageSite=40; ConfidenceScore=5.52e-01
MGQTIFRTKTGAKSHLGQKTGGAQTVSGTSGQWLRQQRPQVSNRREMTQNAENAGGTRPKTDGGQIGDKDSSARLML

SEQ ID NO: 134052 - protein, 493 aa, Glycine max
  Coding DNA Sequence Number=SeqID_17274
  Homolog annotation: Hit_ID=Q6IMT1; Match level="QueryCoverage=80%, HitCoverage=14%, E-value=1e-139, Identity=67%"; Hit description=SAB
MPAIHLSLKKLLQCEVHIHIDDRVNVEIYPLKIHLTEMMYRMMWEYFFPEEEQDSQRRQEVWKVSTTAGARRVKKGSSVLEASASNSHSTKESEASSKSGISAILFPTSSQPPSHVDLAQASKTQNVKANPGNGATLELRRTSSFDRTWEETVAESVANELVLQSFSSSKNGQFGSTEQQDEAAKNKSKDSKGVKGGRSSHEEKKVAKSHEEKRSRPRKMMEFHNIKISQVELLVTYEGQRFVVNDLKLLMDQFHRTEFTGTWRRLFSRVKKHIIWGVLKSVTGMQGRKFKDKGQSQPPGAGVPEIDLILSDNEGQAGKSDQYPPSWPKRPSDGAGDGFVTSIRGLFSTQRRKAKAFVLRTMRGEAENDFQGDWSESDMDFSPFARQLTITRAKKLIRRHTKKFRSRGQKAPKRSHKHNPIPNLTKLRKTFGSTGILQKSSTKQYQPMPKSQTDWKAISKPSEQSSASQLSRQKACYGGRFELPHGFVEEELQ

SEQ ID NO: 134053 - protein, 130 aa, Glycine max
  Coding DNA Sequence Number=SeqID_17275
  Homolog annotation: Hit_ID=Q6IMT1; Match level="QueryCoverage=68%, HitCoverage=3%, E-value=3e-21, Identity=51%"; Hit description=SAB
MEFECSFLFALGTYCYLLSGMLPLNQPISPVRAESEIKLGGTQCNIIMSRLKPWLVLHSSKKKKMVLRQEASVVARPQSTDGKTIMWTCNVSAPEMTIVLFNMAGSPVYHLLNVSLADFIRLFKDPFVGL

SEQ ID NO: 134054 - protein, 1534 aa, Glycine max
  Coding DNA Sequence Number=SeqID_17276
  Homolog annotation: Hit_ID=Q6IMT1; Match level="QueryCoverage=99%, HitCoverage=58%, E-value=0.0, Identity=63%"; Hit description=SAB
MGTTVHTELGELNLHLADEYQECLKESVFGVESNCGSIMHVAKVNLDWGKKDVESSEEDGPRCRLGLSVDVTGMGVYLTFKRVESLVSTAISFQALLKSLSASKKKSTHSQGSLTKSSGKGTQFLKFNLQRCSIHVWGETGLENTIVPDPKRVNYGSQGGRVMINVLADGTPRNANIMSTISDEYQKLKYSVSLEIFQFSLCVNKEKQSTQMELERARSVYQEYMEENRPVTNVALFDMQNAKFVQRSGGLKDIAVCSLFSATDITVRWEPDVHLSLVELVLQLKLLVHNSKLQEHGNEHMVDVSHVQDASWKKEVTTESGHLEKQKKKESIFAVDVEMLSISAGLGDGVDAMVQVQSIFSENARIGVLLEGLMLSFNGARIFKSSRMQISRIPSVSASASDTKGHVVTTWDWVVQGLDFHICMPYRLQLRAIDDVIEDMLRGLKLIIASKTNSIFPVKKESSKVKKPSTVQFGCIKFCIRKLTADIEEEPIQGWLDEHHQLLKKEAAELAARLNFLDEFISKAKQGSKSTDTVSSSQERKISFNNVEVDVKDSSTTESMREEIYKRSFRSYYQACQNLVLSEGSGACVEDFQAGFRPSTTRTSLLSISALDLDVSLKKIDGGDFGMIEVLKKLDPVCLENDIPFSRLYGTNILLNTGSLVVQLRDYSFPLFSGSSGKCEGRLVLAQQPQMYQDVYVGRWRKVRMLRSASGTTPPLKTYSDLLIHFQKGEVSYGVGYEPAFADVSYAFTVALRRANLSVRNPGPLILPPKKERSLPWWDDMRNYIHGKISLRFSESKWNVLASTDPYEKVDKLQIVTNSMDLHQSDGRVFVSAKDFKILLSSLESLANRCGFIIPTGVSGAFLEAPVFTLEVTMDWDCESGDPMNHYLFALPVEGKPRDKVFDPFRSTSLSLRWNFSLRPFPSPSQKQSSSSITRRDIEGDATAFDPSHISHNVSPVSPTFNFGAHDLAWILKFWSLNYIPPHKLRSFSRWPRFGIPRVARSGNLSLDKVMTEFMLRLDATPACIKNMPLDDNDPARGLTFAMTKLKYELCYSRGKQKYTFESKRDILDLVYQGLDLHMIKAFLNKEKCASVAKVVNMILKSSQSVSMDKVSCEKGYMTEKNCDDGFLLSSDYFTIRRQSPKADPARLLAWQEAGRRTIEMAYVRSEYDNGSETDDHMRSDPSDDEGYNVVVADDCQSVFVYGLKLLWTIGNRDAVWAWVGGLSKAFEPPKPSPSQQYAQRKLLEENKQRDRADFHQDDVSKCPPTGKISKSPSFQQLSTPGSVSSSPNSVKVDNLPSVKKENMDDSGGTRRLMVNVIEPQFNLHSEDANGRFLLAAVSGRVLARSFHSILHVGYEMIEQALVTKDVHINEYQPEMTWKRMEFSVMLEDVQAHVAPTDVDPGAGLQWLPKILKSSPKVLRTGALLERVFMPCDMYFRYTRHKGGTPELKVKPLKELTFNSDNITATMTSRQFQVMLDVLTNLLFARLPKPRKSSLSFPVEDDEDVEEEADEVVPDGVEEVELAKINLEKREREQ

SEQ ID NO: 134055 - protein, 101 aa, Glycine max
  Coding DNA Sequence Number=SeqID_17277
  Homolog annotation: Hit_ID=Q9FPS3; Match level="QueryCoverage=48%, HitCoverage=8%, E-value=4e-13, Identity=69%"; Hit description =Ubiquitin-specific protease 24
GRKYELVATITHHGMEPSKGHYTADAQYPNGRWLRFDDQSVFAIGTNKKKHYSPIRKDCWSINVGDYLLAGQAQYLLFMAQIVKRPYYKSHGTKIQTFKPV

SEQ ID NO: 134056 - protein, 268 aa, Glycine max
  Coding DNA Sequence Number=SeqID_17278
  Homolog annotation: Hit_ID=Q6IMT1; Match level="QueryCoverage=77%, HitCoverage=8%, E-value=3e-65, Identity=62%"; Hit description=SAB
MLCWGIPLHAWDLEYIKQITSAVGEAVEVDNDVEELQRLDRAFASGLLAWILSRILGASVGFRVGGWKCLRDVVVKFKKGAIESVSVGEIKLSLRQSLVKLGVGFISRDPKLQVLICDLEVVMRPSNKSPGKKKTRKSRASGRGKWMIVGNIARYLSVCVTDLVLKTPKFTVEIKELNVDISKDGGSKSNLLVRLQILPIFVHIGEPRASCDFLSNLSGGGCSSSGQASITALERSSAPFICETFSVSCEFGHNSKNRYYILIEYQRY

SEQ ID NO: 134057 - protein, 471 aa, Glycine max
  Coding DNA Sequence Number=SeqID_17279
  Homolog annotation: Hit_ID=Q10L99; Match level="QueryCoverage=97%, HitCoverage=97%, E-value=3e-38, Identity=30%"; Hit description=IQ calmodulin-binding motif family protein, expressed
  Pfam annotation: Domain name=IQ; Domain location=128-148; Score=32.1; E_value=1.9e-06; Accession=PF00612.17; Description=IQ calmodulin -binding motif
  Pfam annotation: Domain name=IQ; Domain location=150-170; Score=11.5; E_value=2.5; Accession=PF00612.17; Description=IQ calmodulin-binding motif
  Pfam module annotation: Pfam domain module=IQ::IQ; Domain location =128-148::150-170
MAKKKSWFSLVKRLFIWDTHSTQDKKEKRRKWIFGRLKSKRLPSIKAPLPSKGTTLSEAEQEQSKHALTVAIASAAAAEAAVTAAHAAAEVVRLTGQRNENSEESQPVKTRNGAPQSTYQCQREIKESAAAIKIQTAFRGYLARKALRALKGIVKLQAIIRGRAVRRQAMSSLKCLQSIVSIQSQVCARRLQMVEGRCDYSENEEMQDSKDKIIRMDSNSERKWDESTVLKEEVDTSCTSKRERTKEYSFNHRVLKLTYINPSQRSAESERSKVNGRWRYWLEQWVDTQLSKSKELEDLDSVFSSHSRAGEEYGGRQLKLRSNIQRQNPVEGLDSPILGSRRSFPHRRQCSVGEDHSFLSSPATPAYMAATESAKAKARSTSSPKIRTGGNVDMNSDSYSPCKKKLSIASSINSEMLSNGRVGKLSVNQQQRSPSFKGLSVPIKSSRTTIKDLSINSDCSLPNWDRQAFFK

SEQ ID NO: 134058 - protein, 884 aa, Glycine max
  Coding DNA Sequence Number=SeqID_17280
  Gene Ontology: Mol. function=protein binding; Cellular component =membrane; Biological process=defense response
  Homolog annotation: Hit_ID=Q1SW20; Match level="QueryCoverage=97%, HitCoverage=95%, E-value=7e-92, Identity=31%"; Hit description =Disease resistance protein; AAA ATPase
  Pfam annotation: Domain name=NB-ARC; Domain location=142-412; Score =194.2; E_value=3.2e-55; Accession=PF00931.13; Description=NB-ARC domain
MADSVVSFVLDHLSQLLAREAKLLCGVEDRILSLQNELEMINEFLNTSKSKKGIEKIVVSQIRDVAHLAEDVIDTFLAKVVVHKRRSMLGRMLHGVDHAKLLHDLSEKIDKIKITLNEIRDNKIKYVEFQESNNQSTIKEEEKAESLHERKRNVEVENVVGFVHDSKVVIKQLVEGGSLRNAVSIIGMGGLGKTHSCSKGKKKGKKHTQDVSNLSEEELKKLVWKRLERKRYLVVLDDMWKRRDWDEVQDAFPDNNEGSRILITSRLKELASHTSHHPPYYLKFLNEEESWELFCRKVFRGEEYPFDLEPLGKQIVQSCRGLPLSIIVLAGLLANKEKSYKEWSKVVGHVNWYLTQDETQVKDIVLKLSYNNLPRRLKPCFLYLGIFPEDFEIPVRPLLQRWVAEGFIQETGNRDPDDVAEDYLYELIDRSLVQVARVKASGGVKMCRIHDLLRDLCISESKEDKVFEVCTDNNILISTKPRRLSIHCNMGHYVSSSNNDHSCARSLFIVGSGNFFSPSELKLLLKGFKLVRVLDIGTDRLVRKIPFNLGNFIHLRYLRMDTWGVKFIPASILTLENLQIIDLGHFRVFHFPISFSDPISFPAGIWKLNHLRHLYAFGPIMLRGHCSGSNEVMLNLQTISAIVLDRQTISLIKKGRFPNLKKLGLQVSSRCKDQVPELLQSLHQLCHLKNLRIYLEGKGASGTPNHESMEWNIGCKPQELLQSLGQLSCLTILRIMNVFDLLTCGVVTFPPNVTKLTLAGIKCITDEGMKALGNLTKLGILKLLGSSDDSFDLNCVEGGFPQLQVLEMSFLGVGNWKLGNGTMLRLQSLEINYCEGLNDLPNELWSLTDLREVRVRRPSEPMAHMLRNLKIKNAVELVIGDIRT

SEQ ID NO: 134059 - protein, 141 aa, Glycine max
  Coding DNA Sequence Number=SeqID_17281
  Pfam annotation: Domain name=YSIRK_signal; Domain location=70-96; Score=10.5; E_value=0.017; Accession=PF04650.7; Description=YSIRK type signal peptide
MTTPHTRQESEEEVDRRSRHFRRGKRLVRGRRLNINRTLEIPRAGTRTGLCRETPSQRTREESRRKRKNPRKEEKGAMKKKGLGVESVAIGSGVFIVDCSDPIRSVRCSLGDPRRIGLVRESGGSHRMRRGCRRGCVGSHC

SEQ ID NO: 134060 - protein, 206 aa, Glycine max
  Coding DNA Sequence Number=SeqID_17282
  Homolog annotation: Hit_ID=Q1S6A6; Match level="QueryCoverage=61%, HitCoverage=22%, E-value=3e-10, Identity=30%"; Hit description=FAR1
MKNYLILLWSLKKTVIDDECGETDSEEDSIEIESEEESFEMEIEEDYVESEDQEDSAGNEEESNEYEGYREDKGLTAKKQKRRPETRCGCKARFQVHIVLRSHLWHATKFKDFHNHELQIGMHSVLVASHRKMDECDIMQMNRLRKAGIDTLDIYNSFASKLGGYLNVQFGKKKNMYNQISRQRRLGGSDGASAIEFLRVLTLNDL

SEQ ID NO: 134061 - protein, 538 aa, Glycine max
  Coding DNA Sequence Number=SeqID_17283
  Gene Ontology: Mol. function=cytokinin dehydrogenase activity; Cellular component=vacuole; Biological process=electron transport
  Homolog annotation: Hit_ID=Q1SII4; Match level="QueryCoverage=98%, HitCoverage=95%, E-value=0.0, Identity=77%"; Hit description=FAD linked oxidase, N-terminal
  Pfam annotation: Domain name=Cytokin-bind; Domain location=255-531; Score=630.2; E_value=1.7e-186; Accession=PF09265.1; Description =Cytokinin dehydrogenase 1, FAD and cyto
  Pfam annotation: Domain name=FAD_binding_4; Domain location=77-223; Score=74.9; E_value=2.6e-19; Accession=PF01565.13; Description=FAD binding domain
  Pfam module annotation: Pfam domain module=Cytokin-bind::FAD_binding _4; Domain location=255-531::77-223
MRYHYPPRNNILGEHNILFLKSFTILFLSCIAIRLNLCLSSIPSSLKSLPLGGHLNFDEVSLSHAARDFGNRYQYHPMAVLQPESVSDIASTIKHIWLMGPSSHLTVAARGHGHSLQGQAQAHGGVVINMESLKVPEMQVHVDVGNSPPYVDVSGGELWINILHETLRYGLAPRSWTDYLHLTVGGTLSNAGVSGQAFRHGPQISNVQQLEIVTGTGEVVNCSAENNGDLFHSVLGGLGQFGIITRARIVLEPAPAMVKWIRVLYSDFTAFTRDQERLISAENTFDYIEGFVIINRTGLLNNWRLSFNPQDPVQASHFKSDGRTLFCLEMAKYFNVEEIDAANQEVEEHLSRLSYIPSTLFSTEVTFVDFLDRVHISEVKLRSKGLWDVPHPWLNLLIPKSQIHNFAEVVFGNILTETSNGPVLIYPVNKSKWDNRTSVVIPEEAIFYLVAFLTSAVPSSTGTDGLEHILSQNKRILEFCESAQLGVKQYLPHYNTQQEWRAHFGPHWETFLQRKSVYDPLAILAPGQRIFQKAITFS

SEQ ID NO: 134062 - protein, 59 aa, Glycine max
  Coding DNA Sequence Number=SeqID_17284
  Homolog annotation: Hit_ID=Q9FVE8; Match level="QueryCoverage=97%, HitCoverage=5%, E-value=1e-10, Identity=53%"; Hit description=Plasma membrane Ca2+-ATPase
MEKYLRENFSVQPKNPSEDALLRWRSAVSVVKNPRRRFRMVANLAQRADAEQKRKKLQA

SEQ ID NO: 134063 - protein, 304 aa, Glycine max
  Coding DNA Sequence Number=SeqID_17285
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q8S2G5; Match level="QueryCoverage=96%, HitCoverage=62%, E-value=1e-138, Identity=81%"; Hit description =Glycerol-3-phosphate dehydrogenase-like protein
  Pfam annotation: Domain name=NAD_Gly3P_dh_N; Domain location=44-247; Score=-36.2; E_value=0.0012; Accession=PF01210.13; Description=NAD -dependent glycerol-3-phosphate deh
MFGNGEAVTHSACSNGSVQTVNGNLEEKLDELRLLMGKVDGDPLRIVGVGAGAWGSVFTAMLQEAYGGLREKVLIRIWRRPGRTVDRALAKHLFEVINSREDVLRRLIRRCAYLKYVEGRLGDRVLYADEILKDGFCLNMIDTPLCPLKVVTNLQEAVWDADIVINGLPSTETREVFEEISKYWKERITVPAIISLAKGVEAELGPEPRIITPTLMINQATGVPIENILYLGGPNIASEIYNKEYANARICGAEKWRKPLAKFLRQPHFIVWDNGDLVTHEVMGGLKNVYAIGADIIQSPWVGD

SEQ ID NO: 134064 - protein, 63 aa, Glycine max
  Coding DNA Sequence Number=SeqID_17286
MYMPNSEVLLLWASGSGEREVGGDWHNGGWVRCFYTTLSSLVMSDSCPADISSLLLTDATPWV

SEQ ID NO: 134065 - protein, 868 aa, Glycine max
  Coding DNA Sequence Number=SeqID_17287
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8W0V0; Match level="QueryCoverage=99%, HitCoverage=82%, E-value=0.0, Identity=69%"; Hit description=Type IIB calcium ATPase
  Pfam annotation: Domain name=Cation_ATPase_N; Domain location=35-112; Score=48.9; E_value=1.8e-11; Accession=PF00690.16; Description=Cation transporterATPase, N-terminus
  Pfam annotation: Domain name=E1-E2_ATPase; Domain location=129-370; Score=211.7; E_value=1.7e-60; Accession=PF00122.10; Description=E1 -E2 ATPase
  Pfam annotation: Domain name=Hydrolase; Domain location=374-703; Score=64.6; E_value=3.1e-16; Accession=PF00702.16; Description =haloacid dehalogenase-like hydrolase
  Pfam module annotation: Pfam domain module=Cation_ATPase_N::E1-E2 _ATPase::Hydrolase; Domain location=35-112::129-370::374-703
MRAAGNRGGGSMLSKEIQEAGFGIEPDELASIVRSHDTKCLEHHEGVEGLARAVRVSLQQGVNTLDVQHRQNVYGFNRHAENPPRSFWMFVWDAMQDLTLIILMVCSFVSVGVGILTEGWPKGMYDGVGIILCILLVVFVTSICDYKQSLQFKDLDKEKKNVSIQVTRDSKRQKVSIHDLVVGDIVHLSIGDIVPADGLFTSGFGLLIDESSLSGESEAVNVDQEKPFLLSGTMVQDGSAKMLVTSVGVRTEWGRLMDTLNEGGDDETPLQVKLNGVATIIGKIGLCFAIVTFMVLTGRFLCGKIAHHEITKWSLNDASSLLNFFATAVIIIVVAVPEGLPLAVTLSLAFAMKKLMNDKALVRHLSACETMGSASCICTDKTGTLTTNHMVVDKIWICQQTKAIKIGNSENVLKSSISEHISDLLLQSIFQNTGSEIVKGQDGRNKIMGTPTESALLEFGLLLGGDSKFYNDKYKIVKVEPFNSIRKKMSVLVALPDGTNKYRAFCKGASEIVVKMCEKVVNADGKVVQLNEQQRNSVTEVINGFASQALRTLCIAFKDIEGSSGSDSIPEDKYTLIAIIGIKDPVRPGVKEAVKTCLEAGIVVRMVTGDNINTAKAIARECGILTDGIAIEGPDFRNKSPQELMNIIPKIQVMARSLPLDKHTLVKHLRDDFYEVVAVTGDGTNDAPALHEADIGLAMGIAGTEVAKENADVIVMDDNFATIVNVTRWGRAVYINIQKFVQFQLTVNVVALMLNFVSACVSAESISGSAPLTAVQMLWVNMIMDTLGALALATEPPHDGLMKMPPVGRNAKIITRVMWRNIIGQSIYQIIVLLVLKFRGKQILKLNGPDDATLLLNTVIFNTFVFCQ

SEQ ID NO: 134066 - protein, 57 aa, Glycine max
  Coding DNA Sequence Number=SeqID_17288
MMASIRLTLDPSILPCPELFLPDLEGVTHTVLEEEALDMEGEKNLGHSEKSCMGLMS

SEQ ID NO: 134067 - protein, 76 aa, Glycine max
  Coding DNA Sequence Number=SeqID_17289
  Gene Ontology: Mol. function=ATPase activity, coupled to transmembrane movement of ions, phosphorylative mechanism; Cellular component=membrane; Biological process=calcium ion transport
  Homolog annotation: Hit_ID=Q8W0V0; Match level="QueryCoverage=98%, HitCoverage=7%, E-value=8e-21, Identity=59%"; Hit description=Type IIB calcium ATPase
MVMAATIGFQAIIVQYLGAFAQTVPLSQELWLTSVMIGAVSIVVGVVLKCIPVPSSNYIATHHDGYEQLPSGPELA

SEQ ID NO: 134068 - protein, 106 aa, Glycine max
  Coding DNA Sequence Number=SeqID_17290
MTGRDNAVRYWLGSCRSENTRGLQLAKEVHEGSEARPRRKKATPTLLGGLRTEWIESHKILGPQNPSVTKCQTRESIQDLGQCCATFRKIALPTPNPQPKCLAYLN

SEQ ID NO: 134069 - protein, 95 aa, Glycine max
  Coding DNA Sequence Number=SeqID_17291
MLLQFINNPDRKEKQELERIKRKDMHRSKSRVDAHTYDKSGQLLESFGVCGCGLVNWHRILEIWSMGKQMVTPDSNSKCSVCGRIVYLVSQENYF

SEQ ID NO: 134070 - protein, 113 aa, Glycine max
  Coding DNA Sequence Number=SeqID_17292
MQSQMQSQGLTLPPKAKVGPSAARVSTKDIYGLYVDDSSSRLFALRRAYEESITVHNVALGNDQVKDKQVGEGPTKPVDMLDPDVDPLYLMTLTIPQLFLKSLQVSWDASVFG

SEQ ID NO: 134071 - protein, 120 aa, Glycine max
  Coding DNA Sequence Number=SeqID_17293
MSKLKSRINSEYDPSDEDVANQDQMVELNLGLKYTGPQSELKVYKRTRKSKGGTGPGVVEGEKETNEDTNLCKDTWITDARPTNFLRPDSPTLDGGSGLKEAASTGELAKNMGISFGKEE

SEQ ID NO: 134072 - protein, 140 aa, Glycine max
  Coding DNA Sequence Number=SeqID_17294
MITVEIKFSVVVVVGILARTTVVVVVQAVVVVETSQQVQYAQPIQCVLASPQQPLLAYAQPRASPLTPQVFPPFPPPSILSFLLLLDAKFVLRKGFVGSDGLYQFPQLPDSMPKCKLPSNVCNSVKASVQSPIVNTITSD

SEQ ID NO: 134073 - protein, 123 aa, Glycine max
  Coding DNA Sequence Number=SeqID_17295
  Homolog annotation: Hit_ID=Q2QQ06; Match level="QueryCoverage=50%, HitCoverage=18%, E-value=1e-15, Identity=65%"; Hit description =Expressed protein
MGKENNNVNGPYIASNLSSNICCTYSFNGSNTGQMLSEVQFFWPALMIISCSFQALASVIKEYIFIDSATRLKHKSLDIFVVNSFGSGFQLTLSPVSPRVRIGLSQTARAKPLKVCAKADSSR

SEQ ID NO: 134074 - protein, 65 aa, Glycine max
  Coding DNA Sequence Number=SeqID_17296
MCMEDSLGMLERELSTRVGRLCIKRKIEVAETEIKSVELRAVWGYSAEVKEGRAKTQLAGKERGG

SEQ ID NO: 134075 - protein, 90 aa, Glycine max
  Coding DNA Sequence Number=SeqID_17297
  Subcellular localization annotation: CTP_CleavageSite=68; ConfidenceScore=5.69e-01
MGSKWTKLKLALGLDSCVHIPRSFDNSSSAATRFSGGVSPTVVSPAGDSSSYRPSTPTPSSSGLRLPKSGPKSPKFLFCFSFTTESPSPW

SEQ ID NO: 134076 - protein, 495 aa, Glycine max
  Coding DNA Sequence Number=SeqID_17298
  Gene Ontology: Mol. function=protein serine/threonine kinase activity; Cellular component=flagellin-based flagellum; Biological process=protein amino acid phosphorylation
  Homolog annotation: Hit_ID=Q6YXH1; Match level="QueryCoverage=86%, HitCoverage=86%, E-value=1e-134, Identity=59%"; Hit description =Putative calcium-dependent protein kinase
  Pfam annotation: Domain name=APH; Domain location=111-275; Score= -13.7; E_value=0.054; Accession=PF01636.13; Description =Phosphotransferase enzyme family
  Pfam annotation: Domain name=Kdo; Domain location=102-275; Score= -68.4; E_value=0.0038; Accession=PF06293.4; Description =Lipopolysaccharide kinase (Kdo)
  Pfam annotation: Domain name=Pkinase; Domain location=109-385; Score =278.1; E_value=1.7e-80; Accession=PF00069.15; Description=Protein kinase domain
  Pfam annotation: Domain name=Pkinase_Tyr; Domain location=109-383; Score=13.0; E_value=2.9e-13; Accession=PF07714.7; Description =Protein tyrosine kinase
  Pfam module annotation: Pfam domain module=APH::Kdo::Pkinase::Pkinase_ Tyr; Domain location=111-275::102-275::109-385::109-383
MRKKRKGSETDGSADLAVILAPNHGSASSNLKSHYSLEDCCRLKKRCCKEEDVDTEPATSFKRRLAGIATAPPCGTSSLITPGRGLKRKIGCIDVATQMGRKKKIEDDYVSGETIGQGKFGSVWLCRSKVSGAEYACKTLKKGEETVHREVEIMQHLSGHSGVVTLQAVYEEAECFHLVMELCSGGRLIDRMVEDGPYSEQRAANVLKEVMLVIKYCHDMGVVHRDIKPENILLTASGKIKLADFGLAMRISEVRLHSSHNYTSDNIIIKAMSYYLKICISGQNLTGLAGSPAYVAPEVLLGRYSEKVDIWSAGVLLHALLVGSLPFQGDSLEAVFEAIKTVKLDFQNGMWESISKPARDLIGRMLTRDISARISADEVLRHPWILFYTANTLKMLPIKTKFKNQIGASCQQLVAVPEPRLGGNRIDTYSLREGSSSESCNSDDQDECVLIDVLASAISHVRISEPKRSRVCGPTGPIVQQGSSNMKPNNLCKAF

SEQ ID NO: 134077 - protein, 484 aa, Glycine max
  Coding DNA Sequence Number=SeqID_17299
  Gene Ontology: Mol. function=protein serine/threonine kinase activity; Cellular component=membrane; Biological process=protein amino acid phosphorylation
  Homolog annotation: Hit_ID=Q6Z8Z4; Match level="QueryCoverage=97%, HitCoverage=75%, E-value=1e-120, Identity=50%"; Hit description =Putative receptor protein kinase PERK1
  Pfam annotation: Domain name=Pkinase; Domain location=99-378; Score =145.4; E_value=1.5e-40; Accession=PF00069.15; Description=Protein kinase domain
  Pfam annotation: Domain name=Pkinase_Tyr; Domain location=99-378; Score=107.7; E_value=3.3e-29; Accession=PF07714.7; Description =Protein tyrosine kinase
  Pfam module annotation: Pfam domain module=Pkinase::Pkinase_Tyr; Domain location=99-378::99-378
MAFLVSLICHVYRKDRCTIHSPIFSMDKETSSGSTTNLISHRSGTSSVPETKYAMNSPIYHITGCFQKASFFFGNPKETYHGNIFPFSLAELENATENFSSSNLIGVGGSSYVYLGRLKDGSNVAVKRLKDQGGSEADSAFFKEIELLARLHHCHLVPLLGYCSELKGKHVQRLLVFDYMANGNLRDCLDGVSGKHVDWATRVMIAIGAARGLEYLHEAAAPRILHRDVKSTNILLDENWQAKITDLGMAKNLRSDDLPSCSNSPARMQGTFGYFAPEYAIVGRASLESDVFSFGVVLLELISGRHPIHKSTGKEESLVIWATPRLQDSRRVIRELVDPQLKGNFPEEEVQIMAYLAKECLLLDPDTRPTMSEVVQILLSISPGKSRRRRNIPASLFQEPEDAEKQRQSTPSKFPTHSSLPIYNDHNLSVENKNKAEDAVSAENMESLILLTSKSDGSRASEEEIVDLTEPRFESFCITNGNAP

SEQ ID NO: 134078 - protein, 189 aa, Glycine max
  Coding DNA Sequence Number=SeqID_17300
  Homolog annotation: Hit_ID=Q2QQ06; Match level="QueryCoverage=39%, HitCoverage=21%, E-value=6e-25, Identity=74%"; Hit description =Expressed protein
  Pfam annotation: Domain name=CRT-like; Domain location=30-141; Score=- 49.5; E_value=0.0094; Accession=PF08627.1; Description=CRT-like
  Subcellular localization annotation: CTP_CleavageSite=78; ConfidenceScore=5.54e-01
MSFAVALCTTSSFFPSRFEIRNPKQLQLPPLLSMSLSSKLPLHFSGNAIFNRNHPTMFKIRASNSSSKLVLLSSTIVVTTAVANRVLYKLALVPMKEYPFFLAQFITFGYVVIYFSILYFRYRARIVTDEMLAIPKLRFVAIGFLEALGLVSGMSAAAYELAETDKLAEAYKQAEKLETYKLEASQRSL

SEQ ID NO: 134079 - protein, 97 aa, Glycine max
  Coding DNA Sequence Number=SeqID_17301
  Gene Ontology: Cellular component=endoplasmic reticulum; Biological process=ER to Golgi vesicle-mediated transport
  Homolog annotation: Hit_ID=Q8VXX9; Match level="QueryCoverage=85%, HitCoverage=64%, E-value=2e-24, Identity=68%"; Hit description=Bet1 -like protein At4g14600
MSSNSHRGASFYGNAAPYRSREGLSTRPVASSDEIQLHIDPGVDFDDEITGLRGQVRKLKNVAEEIGSEVKFQRDFLEQVIVRLKMENHAVNAATIF

SEQ ID NO: 134080 - protein, 554 aa, Glycine max
  Coding DNA Sequence Number=SeqID_17302
  Gene Ontology: Mol. function=binding; Cellular component=mitochondrion
  Homolog annotation: Hit_ID=Q6K8X7; Match level="QueryCoverage=76%, HitCoverage=86%, E-value=1e-115, Identity=47%"; Hit description =Pentatricopeptide (PPR) repeat-containing protein-like
  Pfam annotation: Domain name=PPR; Domain location=157-191; Score =11.5; E_value=0.32; Accession=PF01535.11; Description=PPR repeat
  Pfam annotation: Domain name=PPR; Domain location=192-226; Score=7.8; E_value=0.9; Accession=PF01535.11; Description=PPR repeat
  Pfam annotation: Domain name=PPR; Domain location=265-299; Score=4.7; E_value=2.1; Accession=PF01535.11; Description=PPR repeat
  Pfam annotation: Domain name=PPR; Domain location=335-369; Score=6.1; E_value=1.4; Accession=PF01535.11; Description=PPR repeat
  Pfam annotation: Domain name=PPR; Domain location=370-404; Score =19.2; E_value=0.015; Accession=PF01535.11; Description=PPR repeat
  Pfam module annotation: Pfam domain module=PPR::PPR::PPR::PPR::PPR; Domain location=157-191::192-226::265-299::335-369::370-404
  Subcellular localization annotation: CTP_CleavageSite=60; ConfidenceScore=5.25e-01
MANRFISAGIRRYAQPRLLSPLSDYQPNQLSKFCFISFVFGARTLCSSVDSRASAFHVPLARKLKSRKQSPLPALKNWVDEGNDVSHSELRRIARTLVKSKCYHHALEVVKWIENQKNFHMIPADYAMKLELIIENYDLMEAEEYFMNLPDSAAKKAACLTLLRGYIRVRDTNKAETFMVKLYELGLVLSPHPFNEMMKLYLATCEYRKVPLVMQQMKRNKVPCNVLSYNLWMNACTEEEGYGVAAVETVFRQMQNDRNVEVGWSSLATLANAYKKAGQSKKAILVLKDAERKLSTCNRLGYFFLITLYASLKEKEGVLRLWEASKAVGGRISCANYICILICLVKLGDIVQAKRIFLEWESNCQKYDIRVSNVLLGAYARNGSMEEAESLHLHTLQKGGCPNYKTLEILMEGYVNWQKMDEAIITMKRALAMMKDCHWRPPHGLVLAIAEYLEKDGNLKYANKMHLSANKPPFHILKMMDEDKIEMDNETLSILKAFTGCVQAEVFGGEAVTWNSVSFLGFFKENFNSYISMYVFRLKQVELKSTGAERFCGI

SEQ ID NO: 134081 - protein, 379 aa, Glycine max
  Coding DNA Sequence Number=SeqID_17303
  Gene Ontology: Cellular component=membrane
  Homolog annotation: Hit_ID=Q9M7R1; Match level="QueryCoverage=85%, HitCoverage=92%, E-value=1e-107, Identity=60%"; Hit description =Purine permease
  Pfam annotation: Domain name=DUF6; Domain location=49-187; Score =31.1; E_value=3.8e-06; Accession=PF00892.11; Description=Integral membrane protein DUF6
  Pfam annotation: Domain name=Nuc_sug_transp; Domain location=88-302; Score=-166.4; E_value=0.016; Accession=PF04142.6; Description =Nucleotide-sugar transporter
  Pfam annotation: Domain name=TPT; Domain location=205-354; Score =167.2; E_value=4.1e-47; Accession=PF03151.7; Description=Triose -phosphate Transporter family
  Pfam module annotation: Pfam domain module=DUF6::Nuc_sug_transp::TPT; Domain location=49-187::88-302::205-354
KVHYWQQASSRGEESEFRTEADMAEGRNEDKDRTMKRLLLITNCLLLTIGTSGGPLVMRLYFLHGGHRVWLSSFLETAGFPLMLLPLAVSYFRRRRTAAAGTSKPKLISMKPPLLAASAFIGILTGLDDYLYAYGVARLPVSTSALIIATQLGFTAFFAFLLVRQKFTAYSVNAVVLLTVGAGVLALHTSGDRPPGESVKEYVMGFVMTVIAAALYGFILPLVELVYKKIKQPLTYSLVMEIQFVMCFSATLFCLLGMIINNDFKVIPREAKKFEHGEGSYYAVLVGSAILWQAFFLGAIGVIFCASSLFSGILIAVLLPVTEVLAVIFYKEKFQAEKGVSLLLSLWGMVSYFYGEIKHSKKMKMKNSDTEAELAQQYS

SEQ ID NO: 134082 - protein, 177 aa, Glycine max
  Coding DNA Sequence Number=SeqID_17304
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=98%, HitCoverage=80%, E-value=9e-26, Identity=61%"; Hit description =Cysteine protease 8
  Pfam annotation: Domain name=Inhibitor_I29; Domain location=7-58; Score=56.2; E_value=1.1e-13; Accession=PF08246.2; Description =Cathepsin propeptide inhibitor domain (
  Pfam annotation: Domain name=Peptidase_C1; Domain location=54-176; Score=-64.2; E_value=4.7e-07; Accession=PF00112.13; Description =Papain family cysteine protease
  Pfam module annotation: Pfam domain module=Inhibitor_I29::Peptidase _C1; Domain location=7-58::54-176
AWEVDGSTWKSLHELYEKELRYQIFKENVQRIEAFNNAGNKPYKLGINQFADLSNEEFKARNRFKGHMCSIITRTPTFKYEHVTAVPASLDCRQKGAALIKGYEDVPANNETALLNAVANQPVSVSIDASGYEFQFYSGGVLTGSWCHARALLWGYGVSDDGTKYWLIKKFMGSKLE

SEQ ID NO: 134083 - protein, 291 aa, Glycine max
  Coding DNA Sequence Number=SeqID_17305
  Gene Ontology: Mol. function=transporter activity; Cellular component= membrane; Biological process=transport
  Homolog annotation: Hit_ID=Q1R3I4; Match level="QueryCoverage=82%, HitCoverage=89%, E-value=1e-108, Identity=84%"; Hit description =Hypothetical ABC transporter permease protein yddQ
  Pfam annotation: Domain name=BPD_transp_1; Domain location=46-246; Score=128.8; E_value=1.5e-35; Accession=PF00528.12; Description =Binding-protein-dependent transport s
LFAPWLAPVDPNWQDAAARLQAPNAQHGLGTDSYGRDLLSRLIYGTRPALGLVALVTVITLPAGLLVGILSGYYGGWLERILMRFTDVVMSMPRLILAFAFVAMLGPGLVNGALALALTTWPAYARQARSEIQRLRHSDYLAAAEMMGIRGLRLLVGHILPLCLPSAIVRLALDLAGIILAAAGLGFLGLGARPPMAEWGAMIADGMQVIFDQWWIAAIPVWPLTCWAMACATYWSHSMTEHRVIVDALNIDYPSARVVNGLSFTLGNERLALVGESGSGKSMSARALMGL

SEQ ID NO: 134084 - protein, 93 aa, Glycine max
  Coding DNA Sequence Number=SeqID_17306
MIRTKNKQAKSASSSFTFGIGSINKTNIGILKITKRVENNKDERFEKKVQQMCTKVARCNNTRQTHEIYKSFNGKPTIVFYRKGSLLNVCIQE

SEQ ID NO: 134085 - protein, 145 aa, Glycine max
  Coding DNA Sequence Number=SeqID_17307
MASFGTPVIFTMLQVSMYVDECAYGSSFSRPWNRFPWISWMRELNVGMWSIKLNDVVDMMNTSGFGWDDTRKNILKLATMLIKEFEKLQGIFGKDRANGRGAERCEDAMENQIGENQVSDDDEWLHQHDNSPSFIGNTFVGPPSK

SEQ ID NO: 134086 - protein, 136 aa, Glycine max
  Coding DNA Sequence Number=SeqID_17308
  Subcellular localization annotation: CTP_CleavageSite=84; ConfidenceScore=5.33e-01
MPPKVSSSSGRGGKSDTKGKDVILALPEPITKKATTSSSSGSPTQIGSSTQKGKLEGSLTHITTVKPESSTQESPKPTTTKQTVADYAWLIQTLLALEDIGLTRVPKLAKKTWAEMASESDDDSETDLQKQIQRSK

SEQ ID NO: 134087 - protein, 100 aa, Glycine max
  Coding DNA Sequence Number=SeqID_17309
MRGIVHEPQVNIGADQNTLVSRGLYVLALRGLHVLTIRGLHAFTSRGLHILALRGLHVLALRGLHALTLGTSYPHRQRTTRPRLERTTRPHHQRVARPHL

SEQ ID NO: 134088 - protein, 86 aa, Glycine max
  Coding DNA Sequence Number=SeqID_17310
LIRQIGKSVVFTFSISQFVGLASIPKRDTQWLSARKKLEEDELSGSLSAPLQVIKRTPLAHPLSETSALSQNTVMHPKQFRFELSV

SEQ ID NO: 134089 - protein, 73 aa, Glycine max
  Coding DNA Sequence Number=SeqID_17311
GDLVLKKMSHAVKDSRGKWAPNYEGPFVVKRAFSGGALILTNMDGAESSQAMVRSQDESMAEINQGKTMTGHD

SEQ ID NO: 134090 - protein, 266 aa, Glycine max
  Coding DNA Sequence Number=SeqID_17312
KWALAAGKDSVDDVVCKKYDISKEKWTQFCQSRRDPLWEDVQKKAQAIQKQNTAPHVLCCGSYEFLENKLMEEKKKKQLEEAAKFGSTDTLIDPPSPVRRHVKWKMTRTKKIGQMISEAAKEIADKIDVLTAAIGRPEHPGRVCVARADVTIKQYFGLTPRTSRTSSSIASEDLEQLMQKIRDQLEDSIIEKGLALPPEPEVGLSTARVSTKESCMYPSGNDPDTGDSEKWGLYIKENPPRLVALGRLYEGSTTIHDIHLRNDQVK

SEQ ID NO: 134091 - protein, 53 aa, Glycine max
  Coding DNA Sequence Number=SeqID_17313
MPRQNDLMGYSFAGKNPKRFDMPSGCSIDGLKDVIKQVAPQVIPPYGIHESQT

SEQ ID NO: 134092 - protein, 77 aa, Glycine max
  Coding DNA Sequence Number=SeqID_17314
MSHPIRALCLDVLQYKGDQSGSQCFARMLEPCGISIDLKEHSNLVTPKTYTPKSPLGPLPPDSGPTPKIILAHRHCS

SEQ ID NO: 134093 - protein, 366 aa, Glycine max
  Coding DNA Sequence Number=SeqID_17315
  Homolog annotation: Hit_ID=Q1SS26; Match level="QueryCoverage=58%, HitCoverage=25%, E-value=2e-09, Identity=21%"; Hit description =Unnamed protein product; no similarity, hypothetical start
  Subcellular localization annotation: CTP_CleavageSite=38; ConfidenceScore=5.52e-01
MAESSKKHKGSSSSAAAHRTSRFGATEASSAPIPPSLSSSTLFSSDKQHIRYSSLFQSRQILDPKYLDLEFFDGETFDCYQVFQNTGLILFMSLKLPYYHELVRFFYSNLKIQDGTLISEVHGIPMIIDESLFFSLTQLPSQGAPFDGTLVDDWKFDYSSHDARRMVCIDQADMTGRLLAGSLTFDCRIMHYIIVRILMPRSSDLAQASEEDLILMWAFLTSRPIDWAHLVRYRMHKALQFGAPLPYLQLVTLFLRHFEIPLDSEPFVIVKRSFAIGVGAVTSFGYRKDIDRQWLKKDAQPLQDERTPSPPPQRDDSSALMNAVLSESRGLCTYVGERFDSLDGCIDAIDARFEGMDTRITHLEED

SEQ ID NO: 134094 - protein, 225 aa, Glycine max
  Coding DNA Sequence Number=SeqID_17316
  Gene Ontology: Cellular component=mitochondrion
  Homolog annotation: Hit_ID=Q8TGM6; Match level="QueryCoverage=53%, HitCoverage=97%, E-value=1e-09, Identity=43%"; Hit description =Protein TAR1
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGRRALGLMASGATCVQRLDGSRDSAIHTKYRISLRSSSMQEPRYPLPRVIVCKCCVVTTPAGHRLRAPGSRT

SEQ ID NO: 134095 - protein, 281 aa, Glycine max
  Coding DNA Sequence Number=SeqID_17317
  Homolog annotation: Hit_ID=Q8TGM6; Match level="QueryCoverage=42%, HitCoverage=97%, E-value=1e-09, Identity=43%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVVLFLRLLICLNSAGSPADRGLVGSVRARKGSSMGPD

SEQ ID NO: 134096 - protein, 55 aa, Glycine max
  Coding DNA Sequence Number=SeqID_17318
MTQRDEGRNGASCDPRMPLTTLEVPLRFFDGTRRNRLHKYGNRLPESNFARNNCL

SEQ ID NO: 134097 - protein, 215 aa, Glycine max
  Coding DNA Sequence Number=SeqID_17319
  Gene Ontology: Mol. function=RNA-directed DNA polymerase activity; Cellular component=intracellular; Biological process=RNA-dependent DNA replication
MAKSTLDQLSYRGPPMRRSGVVVKAFDGSRKSVIGEVDLPITIGPFVFQITFQVMDIQAAYSCLLGRPWIHEAGAVTSTLHQKLKFVRNGKLITVSGEEALLVSHLSAFSFIGADETEGTSFQGLTLEGKKPEKNEVSFATWKSAQKVVQEGTGVGWGKVVQLLESKNREGLGFASFCRIRNEQCLDQAPLLAPFCSAGVHQQLARSQCCLGRCS

SEQ ID NO: 134098 - protein, 37 aa, Glycine max
  Coding DNA Sequence Number=SeqID_17320
MSSPLGGDFHFSEGEVIVGYDVIDDPLKAFYEDVLGY

SEQ ID NO: 134099 - protein, 67 aa, Glycine max
  Coding DNA Sequence Number=SeqID_17321
MVGLCAHCGCGKTCCAPSPDRHLVPHVMEWYLEICRGGQETLGTSGGVLLPKTKLDQSRPNPGIVGQ

SEQ ID NO: 134100 - protein, 148 aa, Glycine max
  Coding DNA Sequence Number=SeqID_17322
  Gene Ontology: Mol. function=receptor activity
  Homolog annotation: Hit_ID=O21999; Match level="QueryCoverage=38%, HitCoverage=37%, E-value=1e-22, Identity=91%"; Hit description=LacZ -alpha
MTMITNSSSERLKEIPTSTPTDPASQFYSTALPANQLPGSEFDKPLLNLNSQASEFLHRFRGSTGLEETWDEIQRDGAAAQMRQLPPGIQQPPLDGMQAWHWPSFYNVVTGKTLALPNLIALQHIPLSPAGVIAKRPAPIALPNSCAA

SEQ ID NO: 134101 - protein, 303 aa, Glycine max
  Coding DNA Sequence Number=SeqID_17323
  Homolog annotation: Hit_ID=Q9AVH2; Match level="QueryCoverage=75%, HitCoverage=99%, E-value=2e-72, Identity=54%"; Hit description =Putative senescence-associated protein
TRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 134102 - protein, 67 aa, Glycine max
  Coding DNA Sequence Number=SeqID_17324
MSSGCLLVDPNGQNLGRIDGDPVLRETRIWATWEYVSSVGGGQQGMVGLCAHCGCGKLVVHHRPTAP

SEQ ID NO: 134103 - protein, 254 aa, Glycine max
  Coding DNA Sequence Number=SeqID_17325
  Gene Ontology: Mol. function=signal transducer activity; Cellular component=nucleus; Biological process=regulation of transcription, DNA-dependent
  Homolog annotation: Hit_ID=Q8LAD5; Match level="QueryCoverage=88%, HitCoverage=47%, E-value=4e-62, Identity=50%"; Hit description=F-box protein ZEITLUPE/FKF/LKP/ADAGIO family
  Pfam annotation: Domain name=F-box; Domain location=24-71; Score =29.1; E_value=1.6e-05; Accession=PF00646.23; Description=F-box domain
  Pfam annotation: Domain name=Kelch_2; Domain location=178-227; Score =16.7; E_value=0.083; Accession=PF07646.5; Description=Kelch motif
  Pfam module annotation: Pfam domain module=F-box::Kelch_2; Domain location=24-71::178-227
MEESEGSGSGNNQSYSSSSSSSGSAISNMAQDYLFTILLLLPIDAILSLSMTCKRFRALSSSHTLWRSLCKRDFGSTCVDSLLNSSNNNQHHHFPWMRLYKQVSLMDSVCCHKLLVSDLDFPAARASHSLNFVSDCLVLFGGGCEGGRHLDDTWVAYIGNDFRRMLKWQTVHSGIPSGRFGHTCVEMGDCLVLFGGIDDRGNRQNDTWLGHVMFSENNGVTFSWKMLAVGNVAPPPRGAHAACSIDEKRMIIHG

SEQ ID NO: 134104 - protein, 97 aa, Glycine max
  Coding DNA Sequence Number=SeqID_17326
MWAFLTGRQNDWAHFLRYRMNKALGANAPLPYPQLVTLFLSHFQIPLDDEPFVQVKRSFAIGAGAVTSFGYRIDTRITQLEEDVSYLRRCFDLPPPS

SEQ ID NO: 134105 - protein, 35 aa, Glycine max
  Coding DNA Sequence Number=SeqID_17327
MPFLTFRMLQNFTDCATMLLFDFQNVAELYGLPND

SEQ ID NO: 134106 - protein, 67 aa, Glycine max
  Coding DNA Sequence Number=SeqID_17328
MNIKHQQTNNIKHSTKQPENAQKNIADSQLTGRKVQPALIPLNVTTRLVATKVILSQHKFIQQHAIT

SEQ ID NO: 134107 - protein, 118 aa, Glycine max
  Coding DNA Sequence Number=SeqID_17329
MLCVATCPSRASERRGSRVRFPKEERCAESPPTFICGKRWENRRKLVKMRILSSGVVFTLEEVFEVDKSGAFAPTYPPLERKSDLCSSSLCMDQVILLRGDHFKALDLKNDPFYLARN

SEQ ID NO: 134108 - protein, 263 aa, Glycine max
  Coding DNA Sequence Number=SeqID_17330
  Gene Ontology: Mol. function=lyase activity
  Homolog annotation: Hit_ID=Q64YQ5; Match level="QueryCoverage=93%, HitCoverage=45%, E-value=7e-27, Identity=35%"; Hit description =Putative outer membrane protein probably involved in nutrient binding
  Pfam annotation: Domain name=SusD_RagB; Domain location=25-253; Score= 106.3; E_value=9.2e-29; Accession=PF07980.2; Description=RagB, SusD and hypothetical proteins
MDSGKYQLHPQYASLFNYQADKTNKEFIIKFDMESHNNSATNSFQHLAPQYKTGNGQSYVVPLKSLVDSYWTLQGRPIEQCPLHSKQEYELNPKLNRDPRYAASIFGQSDLFNKEKIDIYDSKSLFYYQNLRSSRSGYWFKKFVDEADAFRTGGNMHFPLARYAEVLLTYAEAKIMLNNVDDLAKSCINQIRQRAGLDMSVANVNLTVKSQQEWIDLIRNERRIEFAGEGLRYSDILRWKTAEVVLNQPALGHMRQGADGKSE

SEQ ID NO: 134109 - protein, 120 aa, Glycine max
  Coding DNA Sequence Number=SeqID_17331
MDGHIDVTLIKEFYLNLYDPEDKSPKYVRGEVGIRLSDEDEHGRASATAGGHSRDHSVDFTGHYTSFRGLRGGGWCCRYRLCNRYGSSAKHLGSMAHSSSGHPQPAQDAPSSPLDEPTIA

SEQ ID NO: 134110 - protein, 256 aa, Glycine max
  Coding DNA Sequence Number=SeqID_17332
  Gene Ontology: Mol. function=helicase activity; Biological process =viral genome replication
  Homolog annotation: Hit_ID=Q94LS3; Match level="QueryCoverage=99%, HitCoverage=18%, E-value=8e-44, Identity=36%"; Hit description =Putative helicase
MFTAWMHSNKICSYGRDLTYHQYISRFVYVARKRCWQPRKQGNTIGRLIWVPPSAGELFYLRVMLSTAKGAQSYNDIRTVNGLVYPTFREPCFAKFFLGNDQEFISALREANNWGTAHYLRKLFVKLLFMNTMDKPEYVWQQTWQWMADDIIFNHRKQDEQKTIVDTIMSVVNTQSAAVYFLYGYGGTGKTFVWTTLSSGIRSNGGIVCTVASSGIASLLLPGGRTAHSKFAIPVPATKNSTCNIHQGSELAELLK

SEQ ID NO: 134111 - protein, 237 aa, Glycine max
  Coding DNA Sequence Number=SeqID_17333
  Homolog annotation: Hit_ID=Q1SP02; Match level="QueryCoverage=35%, HitCoverage=18%, E-value=4e-13, Identity=43%"; Hit description=IMP dehydrogenase/GMP reductase
  Pfam annotation: Domain name=DUF1723; Domain location=43-92; Score =60.4; E_value=5.8e-15; Accession=PF08330.1; Description=Protein of unknown function (DUF1723)
ERPDLKLVSHGRKVDKIGRPAPEIEGMIAATGLSPLIRCSVITTDPGLIFAFVERWHRETSTFHLPVGELTITLDDVASLLHVPITGALHKFEPLITSYAIGLLTKLLKGQTMGCSSPHVSAPLGGGIRLGSGCIGPHVQAYERRVASLYTTGGLLHYTSSVHTCVVHDAYDEGSPRAYRWLMGKAHMTGIKGAPYWRRMDALTMTDRVLRQFGFIQTVPPPPVCDSLTGGAKLGIL

SEQ ID NO: 134112 - protein, 351 aa, Glycine max
  Coding DNA Sequence Number=SeqID_17334
  Gene Ontology: Mol. function=DNA binding; Biological process=DNA recombination
  Homolog annotation: Hit_ID=Q31IU8; Match level="QueryCoverage=75%, HitCoverage=50%, E-value=4e-37, Identity=36%"; Hit description=DNA breaking-rejoining enzyme
MTGHKLRHTWNYEFSSKMDRMESPPNQYEQEQIRSLLMGWKEGSGTASTYNRRFIESKAAELALNMQKDMINRGDNESAYEAKTKGYYFFLNDEAWRLSRNVTVNIKMVKDVIDKELMEGYLKVLKYLACELSPASVKVINNNFRRFIVSVEPKRVDEFSLVRFRGSDGKNNNIMSSVRILIKKWYELGYSGIDEDAYDFLCKLIITDNKKGEVVRRRDKVKGPLTDIELQSFLEACYRAYEKGNIDITQLAMALLTSATGRRPLQISQMKVSDIRRLKVNENSYSYAISIPRIKQGLGFREACRNFQVTKELYDLLRKQCDLSIEQTRSILKRELINKEIENTPLFISMQ

SEQ ID NO: 134113 - protein, 232 aa, Glycine max
  Coding DNA Sequence Number=SeqID_17335
  Gene Ontology: Mol. function=DNA binding; Biological process=DNA recombination
  Homolog annotation: Hit_ID=Q0AFY9; Match level="QueryCoverage=95%, HitCoverage=63%, E-value=7e-59, Identity=53%"; Hit description=Phage integrase family protein
  Pfam annotation: Domain name=Phage_integrase; Domain location=61-229; Score=43.7; E_value=6.4e-10; Accession=PF00589.13; Description=Phage integrase family
MDWRTKHGTVATVSANREKALLSHMWNKCREWGFTDAENPCKGVRGYGEAGRDVYVEDDVYRAVWDAADQPLRDALDLAYLTGQRPSDALSMDRRDVRDGFLHISQSKTKHKLRIAIEGELAALLARFAARTFKRRGKHTGAVIVHTALLLDEHGQPLSKGQLRSRFDAARARAGVEKSAFQFRDLRAKAGTDKADASADIRQAQRQLGHSSVVMTETYTRKRKGDRVTPTK

SEQ ID NO: 134114 - protein, 214 aa, Glycine max
  Coding DNA Sequence Number=SeqID_17336
  Homolog annotation: Hit_ID=Q25UH6; Match level="QueryCoverage=70%, HitCoverage=37%, E-value=5e-21, Identity=39%"; Hit description =Hypothetical protein precursor
MGADLGPHDGRRSSTHGVDLPGFAEQLFEAGGFRSVAEVAALKPCTHKCQAIRRRRIQRAAVVDRVASERDRLASQGQACGVQQRGQIGHIAVRAAMAQHQWLAEAAARYAEIVVQHRPDARHAGQRCSEHAADIRTVQGGGQFAQALLTCRCHAGAAGVAEDAVDLRRDLQQAVEQIRVIRVDCTGIGAAVVRFHHQRGQLHCRGRTGGEAAT

SEQ ID NO: 134115 - protein, 63 aa, Glycine max
  Coding DNA Sequence Number=SeqID_17337
  Gene Ontology: Mol. function=catalytic activity; Cellular component =cytoplasm; Biological process=metabolic process
  Homolog annotation: Hit_ID=Q944T1; Match level="QueryCoverage=93%, HitCoverage=15%, E-value=1e-25, Identity=100%"; Hit description =Inosine-5'-monophosphate dehydrogenase-like protein
ATAVYKVSSIAYKSGVPVIADGGISNSGHIVKALSLGASTVMMGSFLAGSLEAPGAYVYQFIW

SEQ ID NO: 134116 - protein, 45 aa, Glycine max
  Coding DNA Sequence Number=SeqID_17338
MYRGPRGSFGVEGRSKVGPSGQAEGIYTDAPDPIRTPQLSVLGRE

SEQ ID NO: 134117 - protein, 66 aa, Glycine max
  Coding DNA Sequence Number=SeqID_17339
  Homolog annotation: Hit_ID=UPI00006A2901; Match level="QueryCoverage =73%, HitCoverage=61%, E-value=3e-13, Identity=47%"; Hit description =UPI00006A2901 related cluster
MIGRADIEGSKSNVAMNAWLPQASYPCDVPPQPNSPPDNVFRPDRPAEADPWVQKRGAVPRFRFTE

SEQ ID NO: 134118 - protein, 91 aa, Glycine max
  Coding DNA Sequence Number=SeqID_17340
  Gene Ontology: Mol. function=unspecific monooxygenase activity
  Homolog annotation: Hit_ID=O04892; Match level="QueryCoverage=79%, HitCoverage=23%, E-value=2e-13, Identity=58%"; Hit description =Cytochrome P450 like_TBP
PEPVGCRWTARAASAARAGSSRAGRGTDWERALRGPLPPGVEQSTQNCALNVKVKKFNQARVNGGSNYDSLKRNHSQGNGLGGISGERRPC

SEQ ID NO: 134119 - protein, 93 aa, Glycine max
  Coding DNA Sequence Number=SeqID_17341
  Gene Ontology: Mol. function=oxidoreductase activity, acting on single donors with incorporation of molecular oxygen, incorporation of two atoms of oxygen; Cellular component=cytoplasm; Biological process=cell redox homeostasis
  Homolog annotation: Hit_ID=Q13MQ6; Match level="QueryCoverage=92%, HitCoverage=16%, E-value=8e-13, Identity=39%"; Hit description =Putative dioxygenase, ferredoxin reductase component
MLGKRIMYDRVPFFWTAHYGTRYEYLGHAEEWDDYRLLGSLQDKRFIAFYCQQGMIAAVCSAGMYTLTAALVHEMQQPMTLEQGLALFEAYQG

SEQ ID NO: 134120 - protein, 97 aa, Glycine max
  Coding DNA Sequence Number=SeqID_17342
MAQERVCSLPLFGNLWDNNYGCLITTSQPFITHMAVFYRPNSQKKSPVESPTVATCPSRASEGEAHGCAFQRRKGARSRHQRLFVGNVVKTEGNRSK

SEQ ID NO: 134121 - protein, 87 aa, Glycine max
  Coding DNA Sequence Number=SeqID_17343
MDVASSTGEKRVSPLSMARSLVTWRVPPLTMARRRDAFHVGTANNIGEKHADSAGLAYPIGETPATQRFAGARVAVFQDLGLQCSRS

SEQ ID NO: 134122 - protein, 358 aa, Glycine max
  Coding DNA Sequence Number=SeqID_17344
QQDALEARQQQQLQAREQAAVTLQQAKDAHLHQQQRWQQHQQQQQLAQQQLASARQQRDEIDQRVSGERQAWQQQLQQLEQQLAAHQLSLPAAPERAGWLQTLQQRWQQWQESERLLAGLQPQLAKSETECSSLQHTLAREQQQVASLQQALNHLQQQQQAQQQQRQQLFGDRCVADARQQQHATLQQHDQALAQQLQRWQQAQSELHGLKGQYEQIVSQQQALAQRAADAESAFRQALLLSDFADESALRAALLAEDEVQTLRQRLQTLEQQHQQHTALHARLAQRLSDHQQQRPAALSDADAGSIAIRLEQLRVALRDTHASRVKRSSSCTAIPGSVSSSKRCWRRSPLTKRNWHS

SEQ ID NO: 134123 - protein, 85 aa, Glycine max
  Coding DNA Sequence Number=SeqID_17345
MESSNVKNKSSGKRKMSSEDTRSYFTWNLEMDRVLADSHEKAKRFRFKVIPNWDDIVDLCAKDRAIGLGAENALDADDIMSKENK

SEQ ID NO: 134124 - protein, 111 aa, Glycine max
  Coding DNA Sequence Number=SeqID_17346
  Gene Ontology: Mol. function=chitin binding; Cellular component =extracellular region; Biological process=chitin metabolic process
  Homolog annotation: Hit_ID=UPI000066154C; Match level="QueryCoverage =90%, HitCoverage=66%, E-value=8e-10, Identity=35%"; Hit description =Homolog of Homo sapiens "Keratin-associated protein 10-1
  Subcellular localization annotation: CTP_CleavageSite=24; ConfidenceScore=5.23e-01
MVRTCSPLKARTCNPLNGEVPKVRACSPLKARTCSPLEVKACSPQMVRTCSPLKARTCSPLNGEVPKVRACSSLKARTCSPLEVRACRPLMVRTCSPLKARTCNPLNGEGN

SEQ ID NO: 134125 - protein, 78 aa, Glycine max
  Coding DNA Sequence Number=SeqID_17347
MASFLLVGIPGFLQTLQQSELAGSPQSTMPHVCTSEGDMDLPASRDKMTRPKYNACMMTQCRHKRAWFIAQQGDIPAW

SEQ ID NO: 134126 - protein, 163 aa, Glycine max
  Coding DNA Sequence Number=SeqID_17348
MDVDKILPSSSTLGWHSLKVKGEIRGFPDIGQPFELLLNPRAGKRQPELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 134127 - protein, 210 aa, Glycine max
  Coding DNA Sequence Number=SeqID_17349
EVQEQMKADMEPMKEQMTTMMEAMMSMRKMMEVNMSTVVTASTATEVDPTHPSSLNQVNYLALDMVGQGGKALGSAGGPHFVQVQNKHFFPLYGLPPNYTPPNVAHTPDENVDNFASIPIESQQPQSDHAHGQAVGGVPLPNTLEGPQFHPQPQPLQFAVGRVPSAMVEKGKFYHIEERLRAIEGGRDYAFADITELCLVPDVVIPPKLK

SEQ ID NO: 134128 - protein, 38 aa, Glycine max
  Coding DNA Sequence Number=SeqID_17350
MVKTPLRHFTEHLVGALLGTNNKGMGAMWLAPSFQNTT

SEQ ID NO: 134129 - protein, 332 aa, Glycine max
  Coding DNA Sequence Number=SeqID_17351
  Gene Ontology: Mol. function=chitin binding; Cellular component =extracellular region; Biological process=chitin metabolic process
  Homolog annotation: Hit_ID=UPI000044A8F0; Match level="QueryCoverage =69%, HitCoverage=99%, E-value=9e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHALAFIGLHALTFRGLHVPSEDYASSPSEGYTPSPSEDYTPSPSEGYTLPPSEGYTPSPSEDYTSSPTDDYTSSPSEGYTPSPSEQYRSLPTEAYTRLYILAIRGLHVLDFRGLHVLDFRGLHALAFRGLYVLAFRGMHVLTFSGLHVLAFRGPYILAFRGLHILAFKGLHALAFRGLRLFAFRGLHALTFGGLHVLTFRGQHALAFRRLHVLAFRGLHVLTFRALHVLTFRGLHTLAFRGLHVLAFRGLHSLAFRGLHALAVRGIHTLTFGGLHILTFRGQHILAFRGIHVLAFRALHVLTFRGLHTLAIRGLHTLTFGGLHVLAFRGLH

SEQ ID NO: 134130 - protein, 113 aa, Glycine max
  Coding DNA Sequence Number=SeqID_17352
IPLGAILAIVDPVVIAVSKFKLVMRSLLERKSVLGTYQQKLNSCSSLLIQQQLSSGSTHEPAECALFLPWLLFSPHFESGDILSIQGSMQKFQRKSPLPHSYYLLNTIGITII

SEQ ID NO: 134131 - protein, 79 aa, Glycine max
  Coding DNA Sequence Number=SeqID_17353
MGNPLCRTKSVRIAFRSLKGDWSTHQIWLYQTPLVRFVVYCGALKNCLGCVLMQEGKVVGYLSRKLRIHGAITLLMTWS

SEQ ID NO: 134132 - protein, 120 aa, Glycine max
  Coding DNA Sequence Number=SeqID_17354
  Gene Ontology: Mol. function=hydrolase activity
  Homolog annotation: Hit_ID=Q1SPB9; Match level="QueryCoverage=80%, HitCoverage=18%, E-value=8e-10, Identity=32%"; Hit description =Transposase
MVIISLSTMGGATCAARSLHHYRDLALMNALKIVFPECTNLLCRFHIDKNVKAKCKSLIGQKNAWEYVMDSWCTLVDCLSEQQFVEHLQKFRVACYPWPMFVDYVCETWIVSHKEKFIMA

SEQ ID NO: 134133 - protein, 65 aa, Glycine max
  Coding DNA Sequence Number=SeqID_17355
MTDLCLVPDVVIPPKFKVPDFDRYKGTTCPKNHLKMYCRKMGAYSRDEKLLMHFFQNSLAGAVVI

SEQ ID NO: 134134 - protein, 102 aa, Glycine max
  Coding DNA Sequence Number=SeqID_17356
MAFLGETSSQTIINSRWNMSRQNNFVGYAFTGKNPQKFDIPKGCTIDELKDLIKQVAPKGNPPHGIHEAQLVLVESNYRKQFVPIEILALFSKPVMENEDEV

SEQ ID NO: 134135 - protein, 92 aa, Glycine max
  Coding DNA Sequence Number=SeqID_17357
MVYKGLEDFEDPNESLENNPVLNLLAAPTHQWSKHASTAKRSFGVLSATEESGRASISRLHAKHEISALSVAIVFSQAQRTTGAKLKSTYSR

SEQ ID NO: 134136 - protein, 310 aa, Glycine max
  Coding DNA Sequence Number=SeqID_17358
MAQKKLPTKRLRKDAAREGSSVAPQVDVEFDGHRDGEYAEFQEEIARRQWAQLVSPTTKYNLEIVMVFYANAWPTEEGVKDKRSWASGFDEEAISQLLCILGQDFARSVTRRRMRIMRTSMTTLTQIWITLLLSNILPSDHNSDLPLSKCQLVYAILTQGTSFVVQVEGTSTWVVVTENKKGYIHLVVQREQGRVHPLWIFACKGITPSRHPVDPEKSNKALIFPALILGLCQFYGVLAGTTARGGPVVASHRRTAATSTGDAILGGQHPNPFLWPTLEQFRAIVAWPGDEPDFETGATWLMCWISLLDE

SEQ ID NO: 134137 - protein, 277 aa, Glycine max
  Coding DNA Sequence Number=SeqID_17359
  Homolog annotation: Hit_ID=Q1SS26; Match level="QueryCoverage=64%, HitCoverage=21%, E-value=3e-08, Identity=23%"; Hit description =Unnamed protein product; no similarity, hypothetical start
MGFSRLNSRQYFKITSHNIKMITSILGREFLIELAKGLAKFGLVDFMSLKLPYYPELVKVFYCNLKIQDGIIISEVHGIPMVIDQSLLFSLTNLPNQGAPFKGTIVDDWKFDYSSHDARRMVCNDQAEMTGRLLVGSLTFDNRIMHYIIVRILLPRSSNLAQAFEEDLILMWAFLTGRQIDWAHLVRYRMHKALRANAPLPYPHLITLFLHHFQIPFDDEPFVQVKRSFAIGAGAVTSFGYRKDRNGQWLKKDALPPQDERTPSPPPQRDDSALMNE

SEQ ID NO: 134138 - protein, 149 aa, Glycine max
  Coding DNA Sequence Number=SeqID_17360
  Homolog annotation: Hit_ID=Q9JKS4; Match level="QueryCoverage=64%, HitCoverage=9%, E-value=3e-07, Identity=44%"; Hit description=LIM domain-binding protein 3
MPIPSKDTFIGLHALGIVRLHSLTFRGLHMLAYRGLHAFAFVGLHALTFRGLHILDYMSSTSEDYMSSTSEDYTFSPLEDYMSLPYEGYTASPFEDYTPSPSEDYTGLHVLTFKGLHILAFRGLQALAFVGLHAPTLKGLLILTFRGLH

SEQ ID NO: 134139 - protein, 43 aa, Glycine max
  Coding DNA Sequence Number=SeqID_17361
MDDMGLNQFRFFNMVHDILVKKWVYDPNMVGSWCLTHATKNVV

SEQ ID NO: 134140 - protein, 113 aa, Glycine max
  Coding DNA Sequence Number=SeqID_17362
  Subcellular localization annotation: CTP_CleavageSite=41; ConfidenceScore=5.42e-01
MALVTGPFLGRIASSDSNKKMPKKNWNRGRPRKTLKRRYISCGSVQVEGTSTWLLKENKGGYIPCGSLLVMDFTRLLEISRTGGCLETGCRHGLWPNQYLHGVETRLNRYGRN

SEQ ID NO: 134141 - protein, 78 aa, Glycine max
  Coding DNA Sequence Number=SeqID_17363
MTKGAEDDVSLCASTGSFAPGLTQIVCTDNHLGIFACHWTPRLWMTKVQKTMLACPWLTKVADDDVGLRMLPDFESDG

SEQ ID NO: 134142 - protein, 66 aa, Glycine max
  Coding DNA Sequence Number=SeqID_17364
MLHGGVREKRTTRRREVGDDNNEGEKEETNMETKSNCFRCSSFRIDVLDQNEVVTTMMEYPQSEEA

SEQ ID NO: 134143 - protein, 101 aa, Glycine max
  Coding DNA Sequence Number=SeqID_17365
  Gene Ontology: Mol. function=6-phosphofructokinase activity; Cellular component=6-phosphofructokinase complex; Biological process=glycolysis
  Homolog annotation: Hit_ID=Q1SEA0; Match level="QueryCoverage=56%, HitCoverage=11%, E-value=2e-11, Identity=65%"; Hit description =Phosphofructokinase
SFGFDIAVEEAQGAINFAHVEAESTENGIDIVKLMGRYSGAELSGGYWFIGNMLLACCFPSCSTALSPFSTFLLFSFCILAPSVFVAAPLASASTLGMLSM

SEQ ID NO: 134144 - protein, 132 aa, Glycine max
  Coding DNA Sequence Number=SeqID_17366
  Gene Ontology: Mol. function=ionotropic glutamate receptor activity; Cellular component=membrane; Biological process=ion transport
  Homolog annotation: Hit_ID=Q7XAV6; Match level="QueryCoverage=95%, HitCoverage=25%, E-value=2e-17, Identity=57%"; Hit description =Glutamate receptor
MSFMSFSNNTNLSCTREEALNFGALSDSDGGKQLLDNILCINMSGLTGPIQFGLDRSPLNPSYDILNVIVQYKFILFGDGHKNPSYCDLVKMITSDVFDTAIGDIAIVSVRTKIVDFTRPYIESGLVVVATV

SEQ ID NO: 134145 - protein, 57 aa, Glycine max
  Coding DNA Sequence Number=SeqID_17367
MRAEDAEGHRAASEEADGERPYEKPMNEEEWGRAGGDAAENHGWCSEGNDGVLRGDW

SEQ ID NO: 134146 - protein, 73 aa, Glycine max
  Coding DNA Sequence Number=SeqID_17368
MDEDRPETHDGRPKRKFQLITFSVERRFPCPQNEGPLSSACIRKPSELKPNVSLSGVKVVTDSVVVSDDGDIP

SEQ ID NO: 134147 - protein, 223 aa, Glycine max
  Coding DNA Sequence Number=SeqID_17369
AADPDGVEDTVCEKYDISKEKWTQFCQTRRDPSWEHVRKKAQAIQKQNTAPHVLSRGAYDYLEQKLLVEKTKKKLEEAAQSGSVDGVIDPPSPIRRHVKWKMACTKKTGEMTTEAAKEITEKIGSFVPHGRQDVLAAAIGRPEHPRRVRAAGASVTIKQYFGLAPRTSRSASSLPHNELQFESESYIKSSQRDVYLGAYLNGFHCSGHWQMVVILPKGTPSCL

SEQ ID NO: 134148 - protein, 1103 aa, Glycine max
  Coding DNA Sequence Number=SeqID_17370
  Gene Ontology: Mol. function=nucleic acid binding; Cellular component= chromatin; Biological process=DNA integration
  Homolog annotation: Hit_ID=Q1RWN2; Match level="QueryCoverage=97%, HitCoverage=80%, E-value=0.0, Identity=64%"; Hit description =Peptidase S8 and S53, subtilisin, kexin, sedolisin; Integrase, catalytic region; Zinc finger, CCHC-type
  Pfam annotation: Domain name=rve; Domain location=265-428; Score =185.4; E_value=1.4e-52; Accession=PF00665.16; Description=Integrase core domain
  Pfam annotation: Domain name=zf-CCHC; Domain location=25-42; Score =27.2; E_value=3.2e-05; Accession=PF00098.13; Description=Zinc knuckle
  Pfam module annotation: Pfam domain module=RVT_2::rve::zf-CCHC; Domain location=608-864::265-428::25-42
RGGNRGRGRNGGRGRGRGRQSKELVECYRCHKLGHYQNECPTWEEGANYAEFNEKEEVLLMAQESSKEEVYDESNVEMWFLDSGCSNHMVGRKDWLFNFDDSFRDFVKLGDNSKMPVMGKGNLKLYIGGLVQVVTEVYYLPGLMNNLLSIGQLQQKNLTIVFSNDLCKVYHENRGLIMSTQMSVNRMYIIHASVLTPMCMKVANMSQSQLWHHRYGHLNYKGLRVLAKKEMVKGLPEIEETEEICEDCIIGKQHRDSIPKTVNWRANEKLQLVHSDICGPINPTSNGGSRYFMTLTDDFSRKTWTYVLTKKTNALAIFKQFKAVAEKETNCQIKCLRTDRGGEFTSTAFNDFCSKNGIKRQLTAAYTPQQNGVSERKNRTIMNMVRSMLAGMKVPKRFWPEAVLWATYVLNRSPTMSVKDITPEEAWSNVKPSVHHFKVFGCLAYAHVTDTQRKKLDPKSIKCVNLGISEESKAYKLYDPVAKKIIVSRDVIFDETKGWEWDGKSQKLQSIDVEESVDPSVAEDVNAHGDSSDNESPLQHASETESEEHDAEPVVTPRSRRPPAWVRDFVTDIENVEDAELHNLAVFSSNHDPTTYEEAAKFEIWRKAMDQEIESIERNDTWELTDLPKGSKKIGVKWIYKTKYNEDGKVEKYKARLVAKGYSQQHGIDYNEVFAPVARWDTIRTILALAASNGWNVYQLDVKSAFLHGELVENVYVEQPLGYQKQGKNSVYKLKKALYGLKQAPRAWYSKIESYFVQEGFTKCPYEHTLFVKQDNKGKVLIISLYVDDLIYTGNDEGMFCEFRKSMRSNFAMTDLGRMRYFLGVEVKQVDDGILICQHKYAQDILARFGMENCNAVCNPMVPGNKLTKDEGGKSVDATKYRQMIGSLMYLLATRPDLTFSVCLIARYMDRPTELHLAAAKRVLRYLKGTMEFGVWYKKQNGRVNLQGWTDSDYAGDLDDRKSTSGYVFTFGSGPISWSSKKQAIVTLSTTEAEFVAAASCACQAVWLKRILDQLGKPQDSGVVIWCDNSSSVKLSKNPVMHGRCKHIDVRFHFLRDLAKEGVVKLKHCSTQEQLADIMTKALKLDSFCKLREELSMCDVKDV

SEQ ID NO: 134149 - protein, 157 aa, Glycine max
  Coding DNA Sequence Number=SeqID_17371
AFKNVFPKEIPHGLPPSSGIKHQVDLLPGASLPNRPTYKSNPQETQRKDAHAKVQYVKRLYDQVKVQIAKKNESYVKQAHKERKEVEGMMRIMKLAKYKLKAPSGEGRRPKWRKDKAPRVEKDEGPSGERMKAQVEKDEGPEAETLSRQLIFAEGSN

SEQ ID NO: 134150 - protein, 66 aa, Glycine max
  Coding DNA Sequence Number=SeqID_17372
  Subcellular localization annotation: CTP_CleavageSite=33; ConfidenceScore=5.27e-01
MVALAVATAAALLYIIFFMLNMASIMATIWSFMASMSASICSCTSSTSLMTLALARVRSDFKERMQ

SEQ ID NO: 134151 - protein, 83 aa, Glycine max
  Coding DNA Sequence Number=SeqID_17373
MVAKDQLTMKDKRDEEEKLEKQKKKNDSKALEISLSTAIPLELEVIPQVEKDSILNRQGITNQKRGCINPVDSEPDSFLLKCR

SEQ ID NO: 134152 - protein, 251 aa, Glycine max
  Coding DNA Sequence Number=SeqID_17374
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-43, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGCTPSPSEGCTPSPSEGYTPSPSEDYTSSPSKDYTSSPSEGYTRSPSEGYTRSPSEDYTSSPSASCTPSPAEVYTSSPSEDYTSSPLEGYTPSPSEDSTSSSLEDCMSSPSEGCTPLPSEDYTFSPSKGYMPSPSEDYMPSPSEDYISSPSEDYTSSRSEGCMPSPSEDYTPSPLDGYTPSPSDDYMSSSLEDSTSSPSQDSTSSPLEGCKPLPSKNYTSSPLEGSTPSPSQDYTSSPLEGCTPLPLEDY

SEQ ID NO: 134153 - protein, 270 aa, Glycine max
  Coding DNA Sequence Number=SeqID_17375
  Homolog annotation: Hit_ID=Q1H022; Match level="QueryCoverage=99%, HitCoverage=82%, E-value=5e-76, Identity=53%"; Hit description=Von Willebrand factor, type A
  Pfam annotation: Domain name=VWA; Domain location=81-245; Score=11.5; E_value=0.00051; Accession=PF00092.18; Description=von Willebrand factor type A domain
MAFTHPWLLWTLPLALLPLLLERSHSKHYSWVGLLPPDPLSKTIGFLLKVLAVISIVFIILGLAGPHSLEQQVERTGIGAQIGLVLDRSASMDDPFAGDKDGNVGETKSVAAARLMTKFVQSRQNDMMGLITFSNSAMYVLPLTENKEAILSAIQATAGNSLFQTNIGGGLTGAVELFKDMPDSGSRAIILISDGAGRVSDMVQQKLRDWLQRYNIGLYWIVLRQPGGITIFDPKYTESGYDGPMPTEVLLYQFFQTLRTPFNAYEASDP

SEQ ID NO: 134154 - protein, 309 aa, Glycine max
  Coding DNA Sequence Number=SeqID_17376
  Gene Ontology: Mol. function=nicotinate-nucleotide adenylyltransferase activity; Biological process=pyridine nucleotide biosynthetic process
  Homolog annotation: Hit_ID=Q8ZDG1; Match level="QueryCoverage=63%, HitCoverage=90%, E-value=8e-79, Identity=68%"; Hit description =Probable nicotinate-nucleotide adenylyltransferase (EC 2.7.7.18) (Deamido-NAD(+) ...
  Homolog annotation: Hit description=pyrophosphorylase) (Deamido -NAD(+) diphosphorylase)
  Pfam annotation: Domain name=CTP_transf_2; Domain location=7-187; Score=181.3; E_value=2.4e-51; Accession=PF01467.16; Description =Cytidylyltransferase
  Pfam annotation: Domain name=DUF143; Domain location=208-309; Score =180.7; E_value=3.7e-51; Accession=PF02410.6; Description=Domain of unknown function DUF143
  Pfam module annotation: Pfam domain module=CTP_transf_2::DUF143; Domain location=7-187::208-309
MSDLYALFGGTFDPIHYGHLRPVTALAQQVGLQKVTLLPNNVPPHRPQPEASAQQRVAMLRCAIADRPLFDIDTRELTRTTPSWTVDTLETLRAERGAQQPLGFIIGQDSLLTLGKWHRWQELLSLCHLLVCQRPGYAAQMATPEMQQWLDAHRAHEVQQLHRAPAGHIWLADTPLFDISATEIRQRRHHGQDCADLLPAAGNLLQGKALQEFVIDKIDDLKGQDIVAIDVQGKSSITDCMIICTGTSNRHVSSIADHVMQESRAAGLKPLGVDGKAAADWVVVDLGEVIVHVMQEESRQLYELEKLWS

SEQ ID NO: 134155 - protein, 259 aa, Glycine max
  Coding DNA Sequence Number=SeqID_17377
  Gene Ontology: Mol. function=ligase activity
  Homolog annotation: Hit_ID=A0B1A2; Match level="QueryCoverage=72%, HitCoverage=74%, E-value=1e-45, Identity=50%"; Hit description =Hypothetical protein precursor
MLLRASSRFWRYLMKNLLTYAAILLAGGLATANMASAAVTHVAIYRGGAGCPGCSEMVRKALEQSGLPLDIAYVGEQEKIKVTQDNLASFDVYIQPGGGQDIPGAFAALGDEGAEAIRKFVRNGKSFLGLCMGAYLADENWLGLIPSSLDSEVMRKGTNIPDEGDYVVDVVWQGKTEKFYYQDGPYLNAEDAHGFVALARYANGDIALAKYTYGKGTVLLSGPHPEADESWMAPEKNNPAYTSAGSKMARLINDLKPGR

SEQ ID NO: 134156 - protein, 132 aa, Glycine max
  Coding DNA Sequence Number=SeqID_17378
  Homolog annotation: Hit_ID=Q6D8M6; Match level="QueryCoverage=65%, HitCoverage=46%, E-value=3e-07, Identity=37%"; Hit description=TetR -family transcriptional regulator
MLDEDVAAFSVESEKRDDSQHDAFFRALVDYLLPDGPASHWLIYLELWPLAARDTQFEQLLLSSTQTWTAIIRQGLSGQAFGHLSEAGKDEVARNLHALIDGYSSALILNYSADKRTHFFLEIMAALQKLCR

SEQ ID NO: 134157 - protein, 49 aa, Glycine max
  Coding DNA Sequence Number=SeqID_17379
  Homolog annotation: Hit_ID=Q6YXW5; Match level="QueryCoverage=79%, HitCoverage=3%, E-value=3e-10, Identity=74%"; Hit description=Cyclin- like protein
MYTDIHILRHVLPVCGTLCIFCPSLMARSRQPVKRYKKLIVDIFPRNHQ

SEQ ID NO: 134158 - protein, 142 aa, Glycine max
  Coding DNA Sequence Number=SeqID_17380
  Homolog annotation: Hit_ID=Q1T6D1; Match level="QueryCoverage=60%, HitCoverage=13%, E-value=2e-10, Identity=40%"; Hit description =Quinoprotein amine dehydrogenase, beta chain-like
MKEILGLQAPMELTPETKTFLQCVTSRIDINLRVDLPMDIELVVYHYKNPIYGIKQESGLAQQWYDELDDLAAPEPESKINVQDDNLDKKLVVEDEKVPFSVGVFTSPRTSELTQVNHSYTLTPSCKLNGAEKPKEAQQHLV

SEQ ID NO: 134159 - protein, 365 aa, Glycine max
  Coding DNA Sequence Number=SeqID_17381
  Gene Ontology: Mol. function=nucleic acid binding; Cellular component= nuclear pore; Biological process=DNA integration
  Subcellular localization annotation: CTP_CleavageSite=49; ConfidenceScore=5.34e-01
MSVFGILTISIHDTVASHDPQQSFINDKATSTTTGNANSGTVQSSDHPQSSATESPNSSEQLLARPDNIHPMITRAKDIKQALQDSKWHSAMNDEFDALQRNKARTVVPLTPNRNAIGHKWVFGVKENFDGSVNKYKVGLVAKEQLDVNNAFLNGFLEEEVYMIQPSGFETSDKSLVHSLSSGAPLMTQYTYIRDLLTKTNMLEAKPISSPMTSSCKLSKDGSDLLQDASFYRSVVGALQYVTITHLELSFVVNKVCQFMSAPLESHWTTVKRILRYLKDPIDRHSNSGAAVYVADILWIQTIFKELAVPHITPLVLCDNSTMVQHIPGIDQWADLLTKPLSSTRFAYPSSKLNVAELPLVSQPH

SEQ ID NO: 134160 - protein, 276 aa, Glycine max
  Coding DNA Sequence Number=SeqID_17382
MGEVEEVQEQMKADTEALKEKMATMMEVMMTIMEVSAAYQTHARARVMGEVEEVQEQIKADMEEKMATMVEAMMSMKKIMEANTVAVAATSAVAKVNQMPPSDLKPNESSNLRYGGQRFGKYGRPHDVQIRNKHAFPPYGSPPKEDVNNSAPILIESQQPQVDHAHVSQPMGETHEIPHHNLADFEPCLGYATGGQAVGGIPMPNTLEGPQYHPQPHPLHSTAIKNLHAMTEMGKLDHIEERLKDIEGGEDCAFANLEELFPVPEHGHSQVQGAGL

SEQ ID NO: 134161 - protein, 212 aa, Glycine max
  Coding DNA Sequence Number=SeqID_17383
  Gene Ontology: Mol. function=helicase activity; Biological process =viral genome replication
  Homolog annotation: Hit_ID=Q1SN45; Match level="QueryCoverage=98%, HitCoverage=15%, E-value=5e-47, Identity=40%"; Hit description=AAA ATPase
  Pfam annotation: Domain name=DUF889; Domain location=30-212; Score =189.3; E_value=9e-54; Accession=PF05970.5; Description=Eukaryotic protein of unknown function (DUF889)
MCHRYSIEALDKSLQDIMHNINPFGGKVIVFGGNFRQILPVVPRDIGDGKLAEPNDGYGEITIPDEFLIKDFQDPIQAIVEATYQDLLHNYSNDDFLQKRDVLASTKDVVDKINDYVLSLISGEEKEYCSADSVDKSDELLSPAFGVLTAEFLNSLKTSGIPNHKLIIKVGTPIILLRNLDQADGLCNGTRLIVTRLGSSVVEAEIITGPNI

SEQ ID NO: 134162 - protein, 282 aa, Glycine max
  Coding DNA Sequence Number=SeqID_17384
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=88%, E-value=2e-53, Identity=36%"; Hit description =Leucine-rich repeat
  Pfam annotation: Domain name=LRR_1; Domain location=11-33; Score =16.6; E_value=0.089; Accession=PF00560.23; Description=Leucine Rich Repeat
  Pfam annotation: Domain name=LRR_1; Domain location=112-134; Score =0.5; E_value=2.3e+02; Accession=PF00560.23; Description=Leucine Rich Repeat
  Pfam annotation: Domain name=LRR_1; Domain location=136-158; Score =10.0; E_value=3.9; Accession=PF00560.23; Description=Leucine Rich Repeat
  Pfam annotation: Domain name=LRR_1; Domain location=160-182; Score =11.6; E_value=1.9; Accession=PF00560.23; Description=Leucine Rich Repeat
  Pfam annotation: Domain name=LRR_1; Domain location=184-207; Score =7.7; E_value=10; Accession=PF00560.23; Description=Leucine Rich Repeat
  Pfam annotation: Domain name=LRR_1; Domain location=209-232; Score =3.4; E_value=65; Accession=PF00560.23; Description=Leucine Rich Repeat
  Pfam annotation: Domain name=LRR_1; Domain location=257-280; Score =6.4; E_value=18; Accession=PF00560.23; Description=Leucine Rich Repeat
  Pfam annotation: Domain name=LRR_1; Domain location=35-57; Score =17.1; E_value=0.062; Accession=PF00560.23; Description=Leucine Rich Repeat
  Pfam annotation: Domain name=LRR_1; Domain location=59-81; Score =19.1; E_value=0.016; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=11-33::112 -134::136-158::160-182::184-207::209-232::257-280::35-57::59-81
TIRTSLGNLTCLVELDLSANQLEGTIPTSLGNLTSLVKLQLSRNQLEGTIPTSLGNLTSLVRLDLSYNQLEGTIPTSLANLCNLMEIDFSYLKLNQQVNELLEILAPCISHGLTALAVQSSRLSGNLTDHIGAFKNIDTLLFSNNSIGGALPRSFGKLSSLTYLDLSINKFSGNPFESLRSLSKMSSLQIDGNNFQGVVKEDDLANLTSLMEFHASGNNFTLKVGPKWLPNFQLSYLDVTSWQLGPNFPSWIQSQNQLQHFGLSNTGILDSIPTWFWEALSQ

SEQ ID NO: 134163 - protein, 140 aa, Glycine max
  Coding DNA Sequence Number=SeqID_17385
  Subcellular localization annotation: CTP_CleavageSite=56; ConfidenceScore=5.63e-01
MASSISQGLVFTTAMLVSTTVLYLAFSRQKTSPPFQISQNSNSLHSNKKILRSCIYSEEKKRERKKNKKKVKFAENVMVKEVERVSNEKNREKQGRQNRVSLSSNECRSEIPKKHEMPANRIALYNGNDHFFIKSDIQGY

SEQ ID NO: 134164 - protein, 41 aa, Glycine max
  Coding DNA Sequence Number=SeqID_17386
MGTNVSNYGNKKGKCWGPQLCGSLILPLEPSTRHDDGCDLL

SEQ ID NO: 134165 - protein, 187 aa, Glycine max
  Coding DNA Sequence Number=SeqID_17387
MASANSDAIPINTANPHIPPRYLSDANHDLDHVNPLFLMWCSSISLCLSEMLLLIMNRWIIALIESRLPHITIEEAEGLILAQELRLRKYNKLDSSSNTFAPSVNLTQANSRGSGGHNGREEGSFNCGGGRGVRSSVQCQVCFKYNHRLLLVTIGSIHNIKLPIVEIMDSMEIVAIALTGLRIRIKN

SEQ ID NO: 134166 - protein, 268 aa, Glycine max
  Coding DNA Sequence Number=SeqID_17388
  Homolog annotation: Hit_ID=Q47522; Match level="QueryCoverage=17%, HitCoverage=59%, E-value=2e-21, Identity=97%"; Hit description=LacZ protein
  Pfam annotation: Domain name=CbiN; Domain location=45-112; Score=4.1; E_value=0.00012; Accession=PF02553.6; Description=Cobalt transport protein component CbiN
DLPSQWLLFLSAVPPVQLLTGWCVTAKAPPDISAGKCSGRVPFAIQAAQLLGRAIGAGLFAITPAGERGMCCKAIKLGNARVFPVTTLNSIKPIFEPNSSEVESGLFALQAALGAGIVGYALGRMSGRTKGREEAERASDLNSVDDVPQAAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134167 - protein, 411 aa, Glycine max
  Coding DNA Sequence Number=SeqID_17389
  Gene Ontology: Mol. function=acid phosphatase activity; Cellular component=periplasmic space
  Homolog annotation: Hit_ID=Q6EV19; Match level="QueryCoverage=67%, HitCoverage=67%, E-value=1e-156, Identity=96%"; Hit description=Acid glucose-1-phosphate phosphatase precursor
  Pfam annotation: Domain name=Acid_phosphat_A; Domain location=154 -404; Score=28.3; E_value=1.5e-09; Accession=PF00328.12; Description =Histidine acid phosphatase
  Subcellular localization annotation: CTP_CleavageSite=60; ConfidenceScore=5.05e-01
GEFGHNLLRGQFATVVGDKRQFSQGFALFAIDKDRQPAPSAGRVLSRSGHTPARRCRRRRAEAEGYLRQPAFLKLAKARNPAERVANNQQRPPVTDDIQRTGDGAGALFKTGTFHSTFSGGELGMRKALLALAVAGSISATFGVQAQETPEGYQLEQVLIMSRHNLRAPLANNGSVLEQSTPKQWPEWEVPGGQLTTKGGVLEVYMGHFMREWLAQQGMIKTGECPPADAVYAYANSLQRTVATAQFFITGAFPGCDVPVHHQEKMGTMDPTFNPVITDNSPEFRDKALKAMEAEREKMQLAESYKLLEQMTNYAESPSCKEKKVCSLADAKDTFSADYEKEPGVSGPLKVGNSLVDAFTLQYYEGFPADQVAWGEIKTDQQWRVLSKLKNGYQDSLFTSTEWRKTSPGIL

SEQ ID NO: 134168 - protein, 86 aa, Glycine max
  Coding DNA Sequence Number=SeqID_17390
APLDVSICLHAFGIVGCGSFSGVKSCEREDPFHPGLFVGDAGGFQSPTREPLNVGGLVPPHCSLKSVVSDDACPGACFVQRDATTL

SEQ ID NO: 134169 - protein, 123 aa, Glycine max
  Coding DNA Sequence Number=SeqID_17391
GVGTVDGTPPKASLPQNVPKDFRFDHGGGDIRMPSWGKKTVSFLRLSSLLEQDCSCGWRFGERVGLYEANSKQRSSLPQKYLEGKARDMANQRIGPVCGYTSFADLWGCPLSKRGQFGGPSLN

SEQ ID NO: 134170 - protein, 317 aa, Glycine max
  Coding DNA Sequence Number=SeqID_17392
  Homolog annotation: Hit_ID=Q6A8U3; Match level="QueryCoverage=29%, HitCoverage=14%, E-value=5e-23, Identity=60%"; Hit description =Threonyl-tRNA synthetase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLSDLRSVDKVEPSLHVTSDDVFLDEMTQHRALRVEHHQARADFLREGEQIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134171 - protein, 90 aa, Glycine max
  Coding DNA Sequence Number=SeqID_17393
MAEKTKKKLEEATQSGSTEAVIDPSSPIRRHMKWKMARTKKTGQMMSEAAKEIVEKIASQGSFVPHGHQDVLTATIGRPEHPDRVHAVRA

SEQ ID NO: 134172 - protein, 148 aa, Glycine max
  Coding DNA Sequence Number=SeqID_17394
  Homolog annotation: Hit_ID=Q40538; Match level="QueryCoverage=24%, HitCoverage=64%, E-value=3e-07, Identity=86%"; Hit description =Nicotiana tabacum (clone 5) activating factor DNA sequence
MEMFLLQQKFGGKIIDIVSREMQTPEEKDEALNAVKNTILEIFLIVVFGYDPCLSTFHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 134173 - protein, 75 aa, Glycine max
  Coding DNA Sequence Number=SeqID_17395
PLIELVRNYVLSWEDGVEKRSLEYQEPMDLRLNPFQEGGDDAILPPMVLVRRLQENWARTTKEGPRILINLMVDF

SEQ ID NO: 134174 - protein, 219 aa, Glycine max
  Coding DNA Sequence Number=SeqID_17396
MATRWRQFKSSLTTKFVYADIEGQDKQDPFVKYGLYPLTWKEFVATRKTPNWQMTHGSFVPHDRDDILNTAIGGPELEHVGHVRAMGSSVTISHNYGRASRGFNNSSTSITQQHLAEIIGILKEDWKNEIIGNLKEDTKESNAETVVNPLGGEYVVHVILTMGLGERRRHPLGNKPWKEELHHQESSLDKKLREEASMEEKNEKDRGGTKLKEKKSERS

SEQ ID NO: 134175 - protein, 132 aa, Glycine max
  Coding DNA Sequence Number=SeqID_17397
MEVGSWKWKLLEVEVGNGSYWKLKVENGSWKLEGEVVVIIKKEENVNHAGFDDVKKNLLDNERLHQKGGECGSCLVLMMSKRNHLIVIIIKGENVNIKPFLKTKGFKVMQGSGNRLPGSVIDYQKGRMKKSY

SEQ ID NO: 134176 - protein, 237 aa, Glycine max
  Coding DNA Sequence Number=SeqID_17398
MYVRDKAISYPFRLHISRVTSVKIIVDKKGFKVYYTEEMLSRQMKVEVVNYPRNWSSLFSGKKLIHALDDYDAKTLWNQIVSTDTLKASTSGYDRSYNTKNYDFIEVLRPIRNYYFVDACVFFTKDANNYSFIQHLLQLPTIQSEGTYNLLKISEAQMIAHASNAAIANEVVHHIQEPASKQSITSNEATSRDKGEPDVVIVYSTSLGPAPLNYAQPAIVTRDQVQDMIRKEMESFA

SEQ ID NO: 134177 - protein, 66 aa, Glycine max
  Coding DNA Sequence Number=SeqID_17399
MATTVIKIGDMTTVAIKIGDTVIAANKFKEMVTAAKEKRKMDIDVIENKKKPTNPRSIPRFSTKCA

SEQ ID NO: 134178 - protein, 154 aa, Glycine max
  Coding DNA Sequence Number=SeqID_17400
MSRESRPLRVWRIRKIERVWLCRETCMSVYACHTLVHMVPTHLLLEVASPLSLPFSIPLPFIFQEAKESIDEEDPRPTSSNGAYINRYYYIPWGFMSHWKLEWFEDISFYLGMEVPYDAQECNVTLMRFDAKVIEDRGDHIDMMPEEEEVYSSE

SEQ ID NO: 134179 - protein, 47 aa, Glycine max
  Coding DNA Sequence Number=SeqID_17401
MTKLRSKNEKVLFFENFARNVLSRTKLRDLPGCKVTRNKKGIEETNV

SEQ ID NO: 134180 - protein, 88 aa, Glycine max
  Coding DNA Sequence Number=SeqID_17402
SLCQFYGVSVTSSKGIRPLTNRAFIKKYCVPRQAQGETPQQPGDGRQRATDTPPSPLEFTSAHPQKAQDVKEALLGGNLVPFKSLLVI

SEQ ID NO: 134181 - protein, 664 aa, Glycine max
  Coding DNA Sequence Number=SeqID_17403
  Gene Ontology: Mol. function=transcription factor activity; Cellular component=nucleus; Biological process=regulation of transcription
  Homolog annotation: Hit_ID=Q9CAN3; Match level="QueryCoverage=97%, HitCoverage=99%, E-value=1e-176, Identity=53%"; Hit description =Transcription factor SCARECROW, putative; 52594-50618
  Pfam annotation: Domain name=GRAS; Domain location=251-553; Score =420.1; E_value=3.1e-123; Accession=PF03514.5; Description=GRAS family transcription factor
  Subcellular localization annotation: CTP_CleavageSite=77; ConfidenceScore=5.42e-01
MLAGCSSSTLLSPRHRLRSEASAQFQACHFQLPSSMSTQRLDLPCTTTTFTRNNKDTTSSRSVLSVDQKPIEAKTSTCSLKQHIRLPPLAITAAPSPLVEDSIIKDNTNNNKSLKRLAAEHQDDSFTNNIAKRKKKSSSTECDWFQPDVVGTTLGGFNNNNNNNNTSLASFSSEEDRVCFVPSEVVSHSAPFPLNPWLESCVTKITNFGEGSHRPHHHHHSDHASGSVSNASSESQSLRLNDNVSEHEVGNGSGNPYYHHEVDTGEEDNHHGFELVSLLTGCVDAIGSRNVTAINHFIAKLGDLASPKGTTSISRICAYFTEALAIRVTRLWPHVFHITTTTTSRDMVEDDESATAMRLLNQVTPIPRFLHFTSNEMLLRAFEGKDRVHIIDFDIKQGLQWSGLFQSLASRSNPPTHVRITGIGESKQDLNETGERLAGFAEALNLPFEFHPVVDRLEDVRLWMLHVKEHETVAVNCVLQLHKTLYDGSGGALRDFLGLIRSTNPSVVVVAEQEAEHNENRLEGRVCNSLKYYSALFDSIDESGLPQESAVRVKIEEMYAKEIRNIVACEGRERVERHESFGNWRRMMVEQGGFRCMGVTERELSQSQMLLKMYSCESYSVKKQEKEGATGVTLSWLEQPLYTVSAWGPVDAAAGTSSSFSQPS

SEQ ID NO: 134182 - protein, 78 aa, Glycine max
  Coding DNA Sequence Number=SeqID_17404
MDLNGKVITNEDNKEIPDTVNTLIFTIAQHFIEDPSLWNDRSAKLLSNLKRRTLADFRWYGDTFLTRVYTREDSQQPF

SEQ ID NO: 134183 - protein, 150 aa, Glycine max
  Coding DNA Sequence Number=SeqID_17405
  Gene Ontology: Mol. function=chitin binding; Cellular component =extracellular region; Biological process=chitin metabolic process
  Homolog annotation: Hit_ID=Q1RT77; Match level="QueryCoverage=73%, HitCoverage=15%, E-value=3e-11, Identity=41%"; Hit description=Zinc finger, CCCH-type
  Subcellular localization annotation: CTP_CleavageSite=62; ConfidenceScore=5.34e-01
MCSPLKVKVQDPLKPRTCSPLKIKVQDPLKARTCSPLKMRACSPLKARACSPLKVRTCSPLKARTCSPLKVRTCSPLKARTCSPLKVRTCSPLKDRVLVPKGGEGVQPSKGDNSCNLILSFANLSGNSLRVYVLFDFDHLGVTAMESFDV

SEQ ID NO: 134184 - protein, 171 aa, Glycine max
  Coding DNA Sequence Number=SeqID_17406
MERKDKELRGSSNAEVPEESEKVQALKAELERMRVVKEKLKTSVTTIRKECDKLGDVNMTTAEANNELKLQRAERDKSRVESMILKDKLKACQRLEDEHAKVSTLQVEKEARERVIESLHEEATKWMDRFAFTLNGSQELPRLLARAKAMADVYSAPEEVHGLFDYCQHMV

SEQ ID NO: 134185 - protein, 127 aa, Glycine max
  Coding DNA Sequence Number=SeqID_17407
  Gene Ontology: Mol. function=transition metal ion binding; Biological process=electron transport
MVHITLTYGRKEKNVCNSVIRTLLNIQGKMKDGLNTHQDLSEMGIRAKLHQGLMLKAFKLVGLKSRDCHILMQQLLVVAIRGILPDKVRLAITWLYLFFNAICRKVLDLVMLDELENEDVIILCQLP

SEQ ID NO: 134186 - protein, 147 aa, Glycine max
  Coding DNA Sequence Number=SeqID_17408
  Gene Ontology: Mol. function=protein dimerization activity; Cellular component=nucleus; Biological process=regulation of transcription, DNA-dependent
  Homolog annotation: Hit_ID=Q0GPE7; Match level="QueryCoverage=58%, HitCoverage=54%, E-value=5e-34, Identity=89%"; Hit description=BZIP transcription factor bZIP17
  Pfam annotation: Domain name=bZIP_1; Domain location=27-91; Score =33.3; E_value=8.5e-07; Accession=PF00170.11; Description=bZIP transcription factor
  Pfam annotation: Domain name=bZIP_2; Domain location=27-81; Score =19.5; E_value=0.0079; Accession=PF07716.5; Description=Basic region leucine zipper
  Pfam module annotation: Pfam domain module=bZIP_1::bZIP_2; Domain location=27-91::27-81
MASSSGTSSMSNILLQSSSSEEDLQLLMEQRKKKRKQSNRESARRSRMRKQKHLDDLIAQVDHLKKQKSLTLMKVDITTKHYLEVKAENSILWAQKTELTQSLQSLNDIIDLINTTNGDRSGHQSGMVLATVQCFGKMDVGVSVTVQ

SEQ ID NO: 134187 - protein, 361 aa, Glycine max
  Coding DNA Sequence Number=SeqID_17409
  Gene Ontology: Cellular component=integral to membrane; Biological process=red or far red light signaling pathway
  Homolog annotation: Hit_ID=Q6R8G0; Match level="QueryCoverage=65%, HitCoverage=33%, E-value=5e-56, Identity=48%"; Hit description=PHO1 -like protein
  Pfam annotation: Domain name=SPX; Domain location=3-228; Score=48.6; E_value=2.2e-11; Accession=PF03105.10; Description=SPX domain
GDIEDQVIEVKTLEQDGSRPLYKTNFQKFDEEGGEVEARLFQKLDEELNKVNAFYKDQVEAAQHEVTLLSKQMEALVALRVKVKSPDTETMDESHQQKDSMVGPEDNPLQQANRNTHYEEQAEENNNYITKDPLEILQHVKVDNVPQSPISTIKKAFTDSSDNELSFSKEELRKVKEQLRLVFVEFYQKLLHLKDYSFMNLSAFSKIMKKYEKHTSRAAFAAYMTVVDNSYVGSSDEVAQQTPTTVTENEATEVTKIEETTPEQPATRVTTTEEPKEETTKEAKEEEAPVETNEATEVIEEVKPEVEENPAPERTEEEEVKEETKETESAPVEEQKQEENKPAETVEETKTEQVSVEKTEA

SEQ ID NO: 134188 - protein, 106 aa, Glycine max
  Coding DNA Sequence Number=SeqID_17410
  Gene Ontology: Cellular component=integral to membrane
  Homolog annotation: Hit_ID=Q9ZUM2; Match level="QueryCoverage=69%, HitCoverage=24%, E-value=2e-14, Identity=51%"; Hit description =Expressed protein
MIQSPIHNEIVKVKDLLRGNPNGSGNRNLVETVSYESDDVDDSVKDGKEVEDAILPERGAVDVPLPIGGFRQVKGGNSHHHHRRHTSRHHEIAEWNILRRFSITVL

SEQ ID NO: 134189 - protein, 86 aa, Glycine max
  Coding DNA Sequence Number=SeqID_17411
MGVKCLEVVKRGSHPNNRWSPDEIRTQNDHNLSLRFVGHDRAWAARHRMTIICLCVPPDTITSGWRKGARNDHNLSPPTSRLTVPE

SEQ ID NO: 134190 - protein, 199 aa, Glycine max
  Coding DNA Sequence Number=SeqID_17412
MADAKFAGLLGLGKPLVEILPPGQLRGFCPLLAWLGSAVLGILPTFGLRPRWLSLCLGGGSSCHNMAKTQGRQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 134191 - protein, 48 aa, Glycine max
  Coding DNA Sequence Number=SeqID_17413
MAINSWGSGLDGGGRTNSARAPNKICGGCTNSARQSICGAPDSVVEDA

SEQ ID NO: 134192 - protein, 341 aa, Glycine max
  Coding DNA Sequence Number=SeqID_17414
  Gene Ontology: Mol. function=DNA binding
  Homolog annotation: Hit_ID=Q1S0F5; Match level="QueryCoverage=92%, HitCoverage=70%, E-value=1e-27, Identity=32%"; Hit description=IMP dehydrogenase/GMP reductase
MGSSQTPSLKKRFYQVKVMSLGITSLKELGQLIGQLQWQAFCKAYGKIWDLAMAEVSTEAIASLAQYYDQPLRCFTFGDFQLSPMVEEFEEILGCPLGGRRPYLFSGFYPSLARISKIVQISAQELDHRKQVENGVVGIPRKCLGAKARILAGRGEWAPFIYIFALLIFGGVLFPNVDGLVDLAVIDAFLAYHDHKESPVRHACPLESHHSCTKKGGANWDRLLANEEEASINRFPQWKEGRTWVLISCRGFPNVPLIGTRGCISYNPVLAIRKLGYPIRGAPLEEELAPIISRGFNKTNVETLQKVRKAWEVVQKKDKELRGSNNGPIGGYRKLLKAHVQ

SEQ ID NO: 134193 - protein, 140 aa, Glycine max
  Coding DNA Sequence Number=SeqID_17415
  Gene Ontology: Cellular component=flagellum
  Homolog annotation: Hit_ID=Q6D6F7; Match level="QueryCoverage=78%, HitCoverage=88%, E-value=8e-16, Identity=42%"; Hit description =Flagellar protein
  Pfam annotation: Domain name=FliT; Domain location=17-136; Score =122.9; E_value=8.9e-34; Accession=PF05400.3; Description=Flagellar protein FliT
MEANRPQCVLYFRIILMNTPSAALSHWQALHAQSIAMLNLAHSGQWDALIEQEMHYVQLVERISQTPIMSCPPAQVEQARALLEMILENENALKALLKVRMDELRSLIDQTGKQQSITSTYGKLSGNILYPESLTRDTQL

SEQ ID NO: 134194 - protein, 90 aa, Glycine max
  Coding DNA Sequence Number=SeqID_17416
  Subcellular localization annotation: CTP_CleavageSite=44; ConfidenceScore=5.18e-01
MSNSMPAPNPWGQTQTANNSTSVAEISSVPRFMGWVEIQLSGISASSGVDDGEMGTLLPHPFSVEVEIHLLISLISAIYMNMTLQLSGST

SEQ ID NO: 134195 - protein, 119 aa, Glycine max
  Coding DNA Sequence Number=SeqID_17417
MTMLPTIGETLLWQKFRDVDVDQRSHKPIERSFPLGFSWHPMAQLGFMNWMHMSVNGVHGGCSDCASLKVCLMVVRRNIDLGKRGVKKVAFLAMVCGDKSLETIEELLEWKGEIGAGEE

SEQ ID NO: 134196 - protein, 253 aa, Glycine max
  Coding DNA Sequence Number=SeqID_17418
MVLLGLVGLSSIGISSHNCVDYTSDLLGLAPSWWFSGLLTNQAKYLACYLVASNPRPRGFVGCSLMGTSKLKASSRIVMRLAIRVSLGASFSLVTLLSGLSEFIPKSGHFFHLNVALGSFTQLIHAIAGRGAWNATLPLGRRGHAMRFANRMFRAEAFDKGIKAIYGSWWESTILAQFKKASKYSSGSMVPSYGSRLSGFHPKVICSVNCASGVPFPLGVLKQCVSGVFFALGAMGVFERSLAFEARPSAIHG

SEQ ID NO: 134197 - protein, 122 aa, Glycine max
  Coding DNA Sequence Number=SeqID_17419
  Gene Ontology: Mol. function=RNA-directed DNA polymerase activity; Biological process=RNA-dependent DNA replication
MVSKVLIDLGNSTDILYWKTFQRLEVSLDTVPLHGGPLLDFADERVDTRGSVNLMTIFDQGKLSRSFTIRYLLFDADTSYFALIGRKTLNEPRAIFSTPHLKMKYPTLAEEIITVTADQKQA

SEQ ID NO: 134198 - protein, 487 aa, Glycine max
  Coding DNA Sequence Number=SeqID_17420
  Gene Ontology: Mol. function=inorganic phosphate transporter activity; Cellular component=membrane; Biological process=phosphate transport
  Homolog annotation: Hit_ID=Q7WB30; Match level="QueryCoverage=92%, HitCoverage=81%, E-value=0.0, Identity=81%"; Hit description =Probable phosphate transporter
MAPWYGRVRAGHSPSRSFARPVAASAGDLHADPEQARRQQHRGGQGQDPGQQDVAHRAALQAALVGDHGARHARGQHVGGGDRQAEDVGQADGPDRGELRRHALRVGHALLADLLAHRQHHAAPADHGAGAQRQRHRHDHPEGRVFGGGGQVGAQALQVGAFTRRQALDARHLLGGVVQAQQVAAHVDALGGGQVGVVADAAQVGLQRVDGGQGQLRVAAEIARQVRGGAGALERQEVAQHGFVALVESAQVGGGVAGALDLVGGAVGVQHEVGRHDADQHQHDQADAFLAIVRAVHEAHAHGRQHQHQAVPERRMFLVVDGAALFRRLVHLRQRQPALERQQQAAGHQESGHRRHHQRGADVDRLAPVHAIGQRQVGDQRVGQAHAQDRADQRVRAGGRDAEIPGAQVPGYGCGQHGQHHGQPASGINVDQQFDRQQVDDGICHAHAAQHHADEVDNAREHLRQVGRHGLGVDDRLDGDRRWRGMH

SEQ ID NO: 134199 - protein, 81 aa, Glycine max
  Coding DNA Sequence Number=SeqID_17421
MRMRKWRKELEYPKPWSVVGFYSKNPCTSLMVPPVETLIRNFNRLKWKRMKKDEFWALWDVIWIRNDNRLPESFLGELSDE

SEQ ID NO: 134200 - protein, 91 aa, Glycine max
  Coding DNA Sequence Number=SeqID_17422
MVYHLKDAPAQAAEDHSPSPPPQRDDSSSLMHNILDRLDGLHTFFGERFDSLDNCIDAIDARFAGMDTRITQLEEDMSYVRQCFDLPPPSS

SEQ ID NO: 134201 - protein, 115 aa, Glycine max
  Coding DNA Sequence Number=SeqID_17423
  Subcellular localization annotation: CTP_CleavageSite=72; ConfidenceScore=5.48e-01
MVKDVSSTSRTLKSLLKPKLSWKLRLCSIFGLSRASKTDPLLWFSNALSRLTSLPSGCHSLSAYASLSETPAASTIRKYTFNIGYLEHSTSVLKPMLKVPMLNVSMLTSVLENRC

SEQ ID NO: 134202 - protein, 202 aa, Glycine max
  Coding DNA Sequence Number=SeqID_17424
MDGTIHSEVHGIYMIIDQSLFFLLTKLPSQGAPFEGTIVDDWKFDYSSHDTRCMVCNDQADMTGRLLAGSLTFDCRIMHYIIVRISFPRSSNLAQASEEDLILIWAFLAGRQIDWVHLVRYQMHKALQTNAPLPYPQLVTHFLHHFQISLDDEPFVQVKRSFAIGASAVATFGYHKDMDGQWLRKQDVQQSIPNECTPSPPP

SEQ ID NO: 134203 - protein, 328 aa, Glycine max
  Coding DNA Sequence Number=SeqID_17425
  Homolog annotation: Hit_ID=Q6A8A7; Match level="QueryCoverage=27%, HitCoverage=7%, E-value=7e-42, Identity=92%"; Hit description=2 -oxoglutarate dehydrogenase
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLNSIPLEIVDGQLISAPLSDDLLVSSPEIKEVHLLGALDSRHNQLARSIRGNDVDGHAEVDLMVFDEVRFTVNLGICIVHGGHRFEGLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134204 - protein, 166 aa, Glycine max
  Coding DNA Sequence Number=SeqID_17426
  Homolog annotation: Hit_ID=Q1SXA1; Match level="QueryCoverage=48%, HitCoverage=21%, E-value=2e-12, Identity=48%"; Hit description=Zinc finger, SWIM-type
MSYLLISKNIHNLIENDPSTLVSTLIAHIKSIDVYTTTYRKVLLAKQKAIEDIYDNKERSYHDLPILLQVMQQFLTGMVVEKEISHNNTCIWPSGLLGELCNEAYWSPHHESMIFPDPEKKKISEKRVKRSGVSCAALQVIQRKIALVVLAQANNNVECMSYCLYL

SEQ ID NO: 134205 - protein, 81 aa, Glycine max
  Coding DNA Sequence Number=SeqID_17427
  Gene Ontology: Mol. function=phosphoinositide phospholipase C activity; Biological process=intracellular signaling cascade
  Homolog annotation: Hit_ID=Q1S1N3; Match level="QueryCoverage=90%, HitCoverage=22%, E-value=6e-13, Identity=51%"; Hit description =Calcineurin-like phosphoesterase family protein, related
  Pfam annotation: Domain name=DUF1723; Domain location=27-76; Score =73.5; E_value=6.6e-19; Accession=PF08330.1; Description=Protein of unknown function (DUF1723)
MPSPDPRIEPLSVQSGFSNVAELGQVKIGGALVAALVERWRPESHTFHLPIGEYTITLEDVVLQLGLRIDGRPVTIPTYYD

SEQ ID NO: 134206 - protein, 151 aa, Glycine max
  Coding DNA Sequence Number=SeqID_17428
ASASQAHYDRSRFTSQEAWDCYSDIVIGKKILPERNVMIYHTEFDEFKTKLERRNWHKELTNFLDGSNDVALVKEFYANLYDLEDKSPKQGTSFVVQVEGTSTWVVVTENKRGYISCGSVLVEGTSTRLFKENKGGYIPCGCLLVKGFLQG

SEQ ID NO: 134207 - protein, 142 aa, Glycine max
  Coding DNA Sequence Number=SeqID_17429
  Gene Ontology: Mol. function=RNA-directed DNA polymerase activity; Biological process=RNA-dependent DNA replication
MGAYSRDEKLLMHFFQESLARAVVTWYTNLEASRICSWKDLITAFIRQYQYNTDMALDKTQLQNMSKREHESFKEYAQWWRDLAAQVLVGYMPYSFANLVFAGKRIEVGLKRGKFDYVAPAGMNNRRFKASGAKKKEGDAHT

SEQ ID NO: 134208 - protein, 114 aa, Glycine max
  Coding DNA Sequence Number=SeqID_17430
PRDHTLADSEPCPGYAIEGKAVGVPSAMVEREEFDHIEERLRAIEGGRDYAFVDMAKLCLVLDMVIPSKFKVPDFDKYKGTTCPKNHLKISSSAPNDGEEDDNNDSRHVTGVLL

SEQ ID NO: 134209 - protein, 81 aa, Glycine max
  Coding DNA Sequence Number=SeqID_17431
  Subcellular localization annotation: CTP_CleavageSite=39; ConfidenceScore=5.04e-01
MRGYPMFTLTFCQPGAIESLDVRRLTSSSAPFIVLTMKSGDMRGYIMVTRTFRQLGENELVDARRLTSSSAPFVVLTREVR

SEQ ID NO: 134210 - protein, 175 aa, Glycine max
  Coding DNA Sequence Number=SeqID_17432
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=90%, HitCoverage=66%, E-value=4e-36, Identity=45%"; Hit description =Protein ULTRAPETALA1
MILDFKRGEDYIEVLCGATNKKYGDYVGRLKINNEGQYFITCECCPECPLVNVTLEAFEKHALREGSRRWKRNIWVHCKDEDKVPLWKTPLIKYYTHLANVANRKDSTMRKQNFHRDEFLRCTRCGKERRFHLKSRPDIKNYHDALNNKCWTCSLWPYQKLGSQSQLKHDIQVHA

SEQ ID NO: 134211 - protein, 72 aa, Glycine max
  Coding DNA Sequence Number=SeqID_17433
MASPMTCRETASPMTCGGALWLSASFVNKGERVRRYRGDVGRLILIVLKIFAGLTFVLQRHSSPMTCKILLH

SEQ ID NO: 134212 - protein, 200 aa, Glycine max
  Coding DNA Sequence Number=SeqID_17434
  Gene Ontology: Mol. function=hydrolase activity; Biological process =metabolic process
  Homolog annotation: Hit_ID=Q1XQT4; Match level="QueryCoverage=98%, HitCoverage=95%, E-value=4e-56, Identity=52%"; Hit description=HAD -superfamily hydrolase subfamily IA, variant 3
  Pfam annotation: Domain name=Hydrolase; Domain location=1-181; Score =70.8; E_value=4.3e-18; Accession=PF00702.16; Description=haloacid dehalogenase-like hydrolase
MDGVLIDAREWHYRALNQALACFGRASTREEHEGGFDGLPTRDKLHRLSERYGLPVSLHSFINELKQQYTLREIWQHCWPVFAHQYALARLKREGYRTAVASNSIRQSIETMLGQAKLLELIEFYLSNEDVSRGKPDPEIYQKAIQRLALQPKECVIVEDNPHGIAAARAAGAHVLTVSHPRDVTWERINQFIQHCEDIP

SEQ ID NO: 134213 - protein, 259 aa, Glycine max
  Coding DNA Sequence Number=SeqID_17435
  Gene Ontology: Mol. function=aspartic-type endopeptidase activity; Biological process=proteolysis
MAIPFKTKDVNEEVTSKDIKSLMEQANYTNKYLQALGETIKTKVVPKQKSIEGASPSVPIEIEKPLFKPFKVSEKAKRKIRELRKTKSLTEGVGDNHSELLNKIGSLLKVISDTPQASENTSKMVTRNAQTEYNIMNTLQHMTMVATTYQTSHECSEETIIDILVAGFSGQLKGWWDNYLTNEEKSKIYSALKTDLNGKVITNDDDKDIPDAVNTLIFTIAQHFIGDPSLWKDRSAELLSNLKCRTLADFTVVQRYFPN

SEQ ID NO: 134214 - protein, 63 aa, Glycine max
  Coding DNA Sequence Number=SeqID_17436
MGTLGEAPSIDFCLGTTLVLMVSPKAFDVVLWEVIPIGLTHHPSLASFVMTFVVGSPMMSCFQ

SEQ ID NO: 134215 - protein, 297 aa, Glycine max
  Coding DNA Sequence Number=SeqID_17437
  Gene Ontology: Mol. function=RNA-directed DNA polymerase activity; Biological process=RNA-dependent DNA replication
  Subcellular localization annotation: CTP_CleavageSite=20; ConfidenceScore=5.47e-01
MDRLTTMMSALLSAQNSQAAAATVEQPLVSTTPLSTVTSPPLFLPPGCTWGMPPPVCGSPQPAVSEVPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQHWREVAAQIVPPLEEREMTKIFLKTLNQFYYEKM

SEQ ID NO: 134216 - protein, 240 aa, Glycine max
  Coding DNA Sequence Number=SeqID_17438
  Homolog annotation: Hit_ID=Q3BM75; Match level="QueryCoverage=92%, HitCoverage=39%, E-value=4e-17, Identity=41%"; Hit description =Putative membrane protein
  Pfam annotation: Domain name=FUSC; Domain location=123-235; Score =67.7; E_value=3.7e-17; Accession=PF04632.3; Description=Fusaric acid resistance protein conserved region
MERLRERMLLLFPVLSSIADRLSALLSDGQALPEGLPVLVDDIRDWLDGPTNASEYARLRARISALKPQVDRDLQHLQLASLLLRLEELVDLWQDCRTLQHAIDHGTAPMDRAHYRIRTERVAADKHVDYGMALFSALSAGVALMSYCVLWIALGWEGGGNGAMMAAVTAAFFAAQDDPAPSMVSFLVWAMVASVVAGVYLFGVFPAVHDFGLLALVLAVAFLPLGLMLHHPKSACSRCR

SEQ ID NO: 134217 - protein, 110 aa, Glycine max
  Coding DNA Sequence Number=SeqID_17439
  Gene Ontology: Mol. function=oxidoreductase activity; Cellular component=membrane; Biological process=electron transport
  Homolog annotation: Hit_ID=Q9SJH2; Match level="QueryCoverage=100%, HitCoverage=22%, E-value=1e-37, Identity=66%"; Hit description =Putative cytochrome P450
MGFPLKGETMEFFNAQRRNQLFEEFVHPRILKHGKIFRTRIMGSPTVVVNGAEANKFLLSNEFKLVKSSWPSSSVELMGRDSIMEKDGARHRFLRGVIGTSLGYAGLELL

SEQ ID NO: 134218 - protein, 70 aa, Glycine max
  Coding DNA Sequence Number=SeqID_17440
MVAVGDGESAWDVRNGFGRKKEEEIVFFLSYTKAKAENVQVRNGLGHRNVAHTPDIFSKIPTVRSWTSVL

SEQ ID NO: 134219 - protein, 231 aa, Glycine max
  Coding DNA Sequence Number=SeqID_17441
MVYANSEGQHKHDPSVKYGIDPHAWDEFAASRKNPNWQDSMEKQTTQGTFVPHGRDNILNTAIGRPDYGGRVRAAGSGEAIIMEMSQRGSQISSPIEPNIHVLGARVNTKGSNAEVVVNPSGEDHVAHVISTMGLYVHRQDSTDVDKVINGDVEVLLPTLEIKYVRQTLGIFIARPTPLVKLVLDEVSAISPNKVIKVFQPVNDVAVDDPLRELIKSLVDIYEKPIQLVWD

SEQ ID NO: 134220 - protein, 82 aa, Glycine max
  Coding DNA Sequence Number=SeqID_17442
  Subcellular localization annotation: CTP_CleavageSite=36; ConfidenceScore=5.13e-01
MAFLGETSSHTIVNSTLGFIFPNRSIVHNDNGVSFQASTPVPIRAPNSCDFQMLKTRIHNTLKLTNKQFLDEIYYRQPFTYA

SEQ ID NO: 134221 - protein, 108 aa, Glycine max
  Coding DNA Sequence Number=SeqID_17443
MEKDEGPEAKALSRQLMLLKAQTNLKAQTYQGNPGGVYPGVSSVTGSEVYPDLSSFTGSGVFPGLSSFTGSGVSPDLSSFTGSGVIQTFVACNKRSTPTQVHITLYNC

SEQ ID NO: 134222 - protein, 95 aa, Glycine max
  Coding DNA Sequence Number=SeqID_17444
  Gene Ontology: Mol. function=isomerase activity; Biological process =carbohydrate metabolic process
  Homolog annotation: Hit_ID=Q1SSI6; Match level="QueryCoverage=78%, HitCoverage=20%, E-value=1e-22, Identity=66%"; Hit description =Galactose mutarotase-like
MTKIFVLLCLLFLASSGFVHGSSKKDHIRLFELKKGDFSIKVTNWGATLVSVILPDKNGKLGDIVLGYDSPKAYTIRIKLFNNIFNALQLELIHT

SEQ ID NO: 134223 - protein, 444 aa, Glycine max
  Coding DNA Sequence Number=SeqID_17445
  Gene Ontology: Mol. function=catalytic activity; Biological process =cellular metabolic process
  Homolog annotation: Hit_ID=Q8S4X1; Match level="QueryCoverage=94%, HitCoverage=61%, E-value=1e-170, Identity=72%"; Hit description=UOS1
  Pfam annotation: Domain name=CIA30; Domain location=260-444; Score =147.3; E_value=4.1e-41; Accession=PF08547.2; Description=Complex I intermediate-associated pro
  Pfam annotation: Domain name=NmrA; Domain location=129-311; Score= -108.7; E_value=0.065; Accession=PF05368.3; Description=NmrA-like family
  Pfam annotation: Domain name=TrkA_N; Domain location=129-281; Score= -5.0; E_value=0.037; Accession=PF02254.8; Description=TrkA-N domain
  Pfam annotation: Domain name=adh_short; Domain location=127-259; Score=-60.4; E_value=0.053; Accession=PF00106.15; Description=short chain dehydrogenase
  Pfam module annotation: Pfam domain module=CIA30::NmrA::TrkA_N::adh _short; Domain location=260-444::129-311::129-281::127-259
  Subcellular localization annotation: CTP_CleavageSite=74; ConfidenceScore=5.33e-01
MEAFYTTLSSPASTSVLNFQGSELPRRKLCKKSSHTILASPTLPKPFLQIYGRPQTLLYRSTRLSSGAHRVTISAEAGRQNWDFGRFVKTLFFFNGFPSPAKFFDFLVEKLSDPSPSEVVNTMGTSDIVLVAGATGGVGRRVVDILRKKGIPVRVLVRNEEKARRMLGSDVDLVIGDITKDSTLIPEYFKGVKKVINAASVIVGPKEGDTPDRAKYSQGIKFFEPEIKGDSPEKVEYIGMRNLIKAVKDNLGLRREKLLFGFEGNNYRQLPWGALDDVVMGGVSESTFQIDPSGGENGGPTGIFKGVVSTANNGGFTSIRTKPLCICKGKAAYNIPPPYLRIVKSLSAMGRVFTIGFQNFSEPENLSAYDGLEFRLKGDGRRYKIIVRTSSDWDALGYTAGFDTEKGKWQSIRVPFSSLRPVFRARTVSDAPPFDPSIVVSLQA

SEQ ID NO: 134224 - protein, 96 aa, Glycine max
  Coding DNA Sequence Number=SeqID_17446
MARPSTLLLLLMLLLSSFCSLFEARKLVLEKQQKKENPSSRRDSLFLSALPKGTVPPSSPSKKGHSMEVDEKLIARHLIAIDRVLLRSVPSPGVGH

SEQ ID NO: 134225 - protein, 59 aa, Glycine max
  Coding DNA Sequence Number=SeqID_17447
MATIEMVSKRKGWLETMKEEGLARKKAKQCQYKAECIVEVLVDCQNKHIGRHKCGSWDW

SEQ ID NO: 134226 - protein, 104 aa, Glycine max
  Coding DNA Sequence Number=SeqID_17448
MANKNISSNETYPPALIPKTIPKLQNSLRVGKGNIGSKGLAKELIQGRLIWPEAYKNKMPKSSPNMHVKQEVSTRVKPRLLCKQSMGQNTPNKIDDDGSNSHQG

SEQ ID NO: 134227 - protein, 252 aa, Glycine max
  Coding DNA Sequence Number=SeqID_17449
  Homolog annotation: Hit_ID=Q8TGM6; Match level="QueryCoverage=47%, HitCoverage=97%, E-value=1e-09, Identity=43%"; Hit description =Protein TAR1
VCSHSNPSQKIRVGRRCNPQGDPTNQLPCALRVYSPVDSHTCQTPWSVFQDGPNEEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 134228 - protein, 145 aa, Glycine max
  Coding DNA Sequence Number=SeqID_17450
  Gene Ontology: Mol. function=glutathione transferase activity; Biological process=auxin mediated signaling pathway
  Homolog annotation: Hit_ID=Q9FQD8; Match level="QueryCoverage=67%, HitCoverage=43%, E-value=2e-35, Identity=73%"; Hit description =Glutathione S-transferase GST 20
  Pfam annotation: Domain name=GST_C; Domain location=7-124; Score =35.2; E_value=2.3e-07; Accession=PF00043.15; Description=Glutathione S-transferase, C-terminal domain
MRIYVSFVSEFLETIYISLTNNRWMTPKSTSEIRLMRAARKAMTTSRDERAKALKETRELMERIEEEIKGKKYFGGDNIGFLDIALGWISYWLPVVEEVGSMHIIDPLKFPAITSWMTNFLSHRVIKDNLPPRDKMLVYYRNFVN

SEQ ID NO: 134229 - protein, 152 aa, Glycine max
  Coding DNA Sequence Number=SeqID_17451
  Gene Ontology: Mol. function=ER retention sequence binding; Cellular component=integral to membrane; Biological process=protein retention in ER
  Homolog annotation: Hit_ID=Q1RVI9; Match level="QueryCoverage=66%, HitCoverage=44%, E-value=6e-45, Identity=94%"; Hit description=ER lumen protein retaining receptor
  Pfam annotation: Domain name=ER_lumen_recept; Domain location=1-87; Score=42.8; E_value=7.1e-18; Accession=PF00810.9; Description=ER lumen protein retaining receptor
MIFWAFSIYLEAVAILPQLVLLQRSGNVDNLTGQYIFFLGAYRAFYILNWIYRYLTEPHFTRWIACVSGVVQTALYADFFYYYFIRSFVLQLEEQFETEVACLNYLKLFWNLDLCDQSPLNFTERRGLDDVSFESNETRLTPLPVHEWGKGD

SEQ ID NO: 134230 - protein, 132 aa, Glycine max
  Coding DNA Sequence Number=SeqID_17452
MGAIVSITRNFEEYPITRQLCLMFRSNCRMDECHKRQDGAKDECEEPQELQLGGISAVSEPMSSILDQIMMALEQPHINILGVYGSSNERKRNVVKKITRRIQRDKLFDEVVMASVMKKPDLQLHEKGYAFV

SEQ ID NO: 134231 - protein, 318 aa, Glycine max
  Coding DNA Sequence Number=SeqID_17453
  Gene Ontology: Biological process=cell adhesion
  Homolog annotation: Hit_ID=Q1RVI6; Match level="QueryCoverage=73%, HitCoverage=74%, E-value=2e-67, Identity=62%"; Hit description =Fasciclin domain, putative
  Pfam annotation: Domain name=Fasciclin; Domain location=105-240; Score=104.4; E_value=3.4e-28; Accession=PF02469.12; Description =Fasciclin domain
  Subcellular localization annotation: CTP_CleavageSite=60; ConfidenceScore=5.20e-01
MRIMQESQSFIIPTTILLLALCYTTSGQLSPIQPPTTSPSLPSPPLSQPSPPSPALHSPPATAPAPGFNTVPLVPVTPSGAPTPTTIIPKGPTIDIVQILRKAKRFSVLTRLLKTTQLINQLNSQLVTSSSGGLTLFAPEDSAFSKLKAGFLNSLTDRQKVELLQFHTLSSVISISNFDTLTNPVQTQAGDDPQRLQLNVTTYGGSQVSMATGAVNASVTGTVYSDNKLAIYQVDKVLLPLDLVLPSKAPAPSPALARKGLPKADKGNSTAADDGTVDGNDDSDGKALPAGVSAGCTMKWVNNVVVVGVVGLVGGVLM

SEQ ID NO: 134232 - protein, 357 aa, Glycine max
  Coding DNA Sequence Number=SeqID_17454
  Homolog annotation: Hit_ID=Q1RVI7; Match level="QueryCoverage=41%, HitCoverage=50%, E-value=2e-69, Identity=90%"; Hit description =Fasciclin domain, putative
  Pfam annotation: Domain name=Fasciclin; Domain location=153-287; Score=86.1; E_value=1.1e-22; Accession=PF02469.12; Description =Fasciclin domain
MSRVMRDNLFDLTVMAIVTEKPDMKQIQGVLAWEQVRFKFGEEIVIERAKLLSERIKKQKRILFFLDDLSAGIDLDRVGIPFGTDHTGFKIVLFSGCPESPAAAPKAPAKPAPATPAPAPAKPLVPSLPQSPSSGVDSSGSQDIVKILRKAKSFNTLIRLLKTTQIINQVNAQLVTSKNGGLTILAPDDGAFSELKAGYFNSLGDRQQKALIQYHVLPVYVSSSNFDALSNPVLTLASDSPTGYQLNVTAYGNSVNISTGVVNATLTGIVYTDKTLAIYHVDKVLIPLDFSKPKPIAPAPAVAKAPKADKENASAEDDDQAQAAKDSSGAMSLVSTQGTTLVSFGVALLAAAATMSS

SEQ ID NO: 134233 - protein, 715 aa, Glycine max
  Coding DNA Sequence Number=SeqID_17455
  Gene Ontology: Mol. function=ubiquitin-protein ligase activity; Cellular component=ubiquitin ligase complex; Biological process =protein ubiquitination
  Homolog annotation: Hit_ID=Q84QD7; Match level="QueryCoverage=99%, HitCoverage=100%, E-value=0.0, Identity=64%"; Hit description =Avr9/Cf-9 rapidly elicited protein 276
  Pfam annotation: Domain name=Arm; Domain location=378-418; Score=1.3; E_value=8.4; Accession=PF00514.13; Description=Armadillobeta-catenin -like repeat
  Pfam annotation: Domain name=Arm; Domain location=420-460; Score =42.7; E_value=1.2e-09; Accession=PF00514.13; Description =Armadillobeta-catenin-like repeat
  Pfam annotation: Domain name=Arm; Domain location=461-503; Score =14.4; E_value=0.19; Accession=PF00514.13; Description=Armadillobeta -catenin-like repeat
  Pfam annotation: Domain name=Arm; Domain location=505-545; Score =21.1; E_value=0.0041; Accession=PF00514.13; Description =Armadillobeta-catenin-like repeat
  Pfam annotation: Domain name=Arm; Domain location=546-584; Score =18.5; E_value=0.024; Accession=PF00514.13; Description=Armadillobeta- catenin-like repeat
  Pfam annotation: Domain name=Arm; Domain location=585-626; Score =14.2; E_value=0.21; Accession=PF00514.13; Description=Armadillobeta -catenin-like repeat
  Pfam annotation: Domain name=U-box; Domain location=286-360; Score =79.3; E_value=1.2e-20; Accession=PF04564.6; Description=U-box domain
  Pfam module annotation: Pfam domain module=Arm::Arm::Arm::Arm::Arm::Ar m::U-box; Domain location=378-418::420-460::461-503::505-545::546 -584::585-626::286-360
MASAAIFSSLRRRRSPSLEAFLVPVDLSDVALLETLISVASDVASCFSGHRFPFQRRNSRALIGKVEIFRSMLECLRDSAAAGALTPTAVLCLKEFYLLLYRSKILLDYCAQSSKLWLLLQNHCVSGHFHDLSQEFSTLLDVFPVGEVGLSDDVREQIELLQRQSKRAKLFIDKKDDVLRTRFFWFLEEFESGRVPDSKDLRCFFVDKLRILDAKSCRVEIEALEEQIVNHEGDVEPTVPVLNGMVAITRYCRFLLFGFEEELEIEIQKKGRKRLIAQEIAETFLTVPKDFCCPISLDLMCDPVIISTGQTYDRRSIWRWMEEGHCTCPKTGQLLSHNRLVPNRALRNMIMQWCSAHGVPYDPPEGVDASVEMFVSACPSKASLEANRGATTLLIQQLADGSQAAQTVAAREIRLLAKTGKENRAFIAQAGAIPHLRNLLSSPNAVAQENSVTALLNLSIFERNKSMIMEEEGCLGSIVEVLRFGHTTEARENAAATLFSLSAVHDYKKRIADNVGAVEALAWLLQEGTQRGKKDAVTALFNLSTHTENCLRMIEAGAVKAMVVALGNEGVAEEAAGALALIVRQPVGAMAVVREEAAVAGLIGMMRCGTPRGKENAVAALLELCRSGGAAATERVVRAPALVGLLQTLLFTGTKRARRKAASLARVFQRCENASLHYGGLGVGYSFASDSASTRNTTTFVSDVSLPMSISVPVL

SEQ ID NO: 134234 - protein, 128 aa, Glycine max
  Coding DNA Sequence Number=SeqID_17456
  Homolog annotation: Hit_ID=Q1SE34; Match level="QueryCoverage=84%, HitCoverage=16%, E-value=5e-12, Identity=33%"; Hit description =Cyclin-like F-box; tRNA-binding arm
MGGKSEKGEVMEWSVANTKAFIEKIYERVKNGQLQGSTFKTTTWEEINKDLFEMIQTNYGVDKLKSKFNRLRQMHRDFSTLLARTGVTWEMESNKVNAPDEVWDELIKIKLIDTVDLEGGPGTSFCSL

SEQ ID NO: 134235 - protein, 67 aa, Glycine max
  Coding DNA Sequence Number=SeqID_17457
  Gene Ontology: Mol. function=DNA binding; Biological process=DNA integration
  Homolog annotation: Hit_ID=Q1SIT1; Match level="QueryCoverage=98%, HitCoverage=19%, E-value=2e-12, Identity=52%"; Hit description =Integrase, catalytic region
MSSSCRDRAQSLLGCKDLQLLRREEMKLQLSELDEIRLEAYENSKFYKDNTNKFHDNLIAKKDFVVG

SEQ ID NO: 134236 - protein, 105 aa, Glycine max
  Coding DNA Sequence Number=SeqID_17458
AKVQSSLRLCLNGVFYRGSPILISGAQQIRVSRYRSRVELPYHFHKARCRNMPFCGRAKARLTGALSKGGRMRGVATNVYLWKTSEKLKEIGQNENSKFESCIYA

SEQ ID NO: 134237 - protein, 83 aa, Glycine max
  Coding DNA Sequence Number=SeqID_17459
MAWVVIERDHVTKSRVHKDEMEHLSALGKLGKYFHNDSPLYEDTGVWMIPVSVLHLYLCWKAIVQCGPKVFTQTVAIFLRVNE

SEQ ID NO: 134238 - protein, 111 aa, Glycine max
  Coding DNA Sequence Number=SeqID_17460
MVLKSKAEFLILLVLVVCQPSCGLGEDWSTRRLSRHNNKVIPPSCGELVLKSQCSENSKCRWCTSEDLDDMCFSKSEALRLPHQRVALLLSIQFMIYFKFETWLGYIVEDR

SEQ ID NO: 134239 - protein, 402 aa, Glycine max
  Coding DNA Sequence Number=SeqID_17461
  Gene Ontology: Mol. function=sequence-specific DNA binding; Cellular component=nucleus; Biological process=regulation of transcription, DNA-dependent
  Homolog annotation: Hit_ID=Q940V6; Match level="QueryCoverage=99%, HitCoverage=100%, E-value=0.0, Identity=84%"; Hit description=Heat shock transcription factor
  Pfam annotation: Domain name=HSF_DNA-bind; Domain location=12-185; Score=188.2; E_value=2e-53; Accession=PF00447.8; Description=HSF -type DNA-binding
MDDAQGSSSSLPPFLAKTYEMVDDPSTDSVVSWSITSKSFIVWNPPEFARDLLPRFFKHNNFSSFIRQLNTYGFRKVDPEQWEFANDDFVRGQPHLMKNIHRRKPVHSHSLQNLQAQGPIGEAERQSFTDEIEKLKHDKEQLLVELQKYQHEWQAYEIQMHSSKDRLEKLEQNQQKMVSSVSHVLQKPVISVNILPLTETMDRKRRLPRSGHFYDEASVEDAMETSQMLPRENADNTTVLTLNVERLDQLESSMAFWEAIVHDIGDTFVQIQSNMDFDESTSCADSPSISCAQLDVEVRPKSPGIDMNSEPTTAAVPEPVASKEQPAGTTVAATGVNDVFWEQFLTEDPGASETQEVQSERKEYDGRKNEGKPSDLNKFWWNKWNANNLPEQMGHVGQAEKT

SEQ ID NO: 134240 - protein, 73 aa, Glycine max
  Coding DNA Sequence Number=SeqID_17462
  Gene Ontology: Mol. function=zinc ion binding; Cellular component =COPII vesicle coat; Biological process=ER to Golgi vesicle-mediated transport
  Homolog annotation: Hit_ID=Q9ZQH3; Match level="QueryCoverage=90%, HitCoverage=8%, E-value=2e-23, Identity=73%"; Hit description =Expressed protein
MRIITQRQFEIYEGGHHLGARLRGRVAIDGVGGESIEVATKGAGPGPLLELVVGVEVGLAVLAPGQEVAIGAV

SEQ ID NO: 134241 - protein, 216 aa, Glycine max
  Coding DNA Sequence Number=SeqID_17463
  Gene Ontology: Mol. function=DNA binding
  Homolog annotation: Hit_ID=Q1SWX1; Match level="QueryCoverage=78%, HitCoverage=30%, E-value=4e-19, Identity=37%"; Hit description=IMP dehydrogenase/GMP reductase
MANQEEWVPFADILALLIFGVVLFPNLDGLVDLAAINAFLAYHHSKESPVVAILVDLFDTFDRRCEKNNARIVCCLPVLCVWLVSHLFQQDIRHPCPLQSYRSCVEKRRVDWDQYMAGIGGITINWFPQWKEGKEGVLFSCGDYPNIPLIGTRGCINYNPALAIRQLGYPMRGAPTEESLSPFLMRDFSAQSFKIIQRVHKAWESPLRKDKELRGI

SEQ ID NO: 134242 - protein, 128 aa, Glycine max
  Coding DNA Sequence Number=SeqID_17464
  Homolog annotation: Hit_ID=Q9SD67; Match level="QueryCoverage=32%, HitCoverage=5%, E-value=9e-12, Identity=80%"; Hit description=FtsH metalloprotease-like protein
MVHDEVWYMRILHACMCTLWKDTTNTLCWGKCLGNYDQALLKGRCSFGVSITNGIEEKTAKLKGSEKALVARHEASHAVVGTAVANLLAGQPHVEVWTLEYLILEFIDLVLWWEIKEKYKSVMCDIQR

SEQ ID NO: 134243 - protein, 127 aa, Glycine max
  Coding DNA Sequence Number=SeqID_17465
VVEASGNRLPVCVIDYIEEWVTGNRLPATSLVHPDEPARTLQRTVEWILPTPTPYRLVEPVQVIEVTSSEEDPEEDPEELPPEPAVDALDFLEGDEDPLPEVDSPEDVMSASEADSTKDSGPGDMAI

SEQ ID NO: 134244 - protein, 703 aa, Glycine max
  Coding DNA Sequence Number=SeqID_17466
  Gene Ontology: Mol. function=phosphoinositide binding; Biological process=intracellular signaling cascade
  Homolog annotation: Hit_ID=Q2RAA5; Match level="QueryCoverage=48%, HitCoverage=31%, E-value=2e-80, Identity=46%"; Hit description=Phox domain-containing protein, putative, expressed
  Pfam annotation: Domain name=PXA; Domain location=63-246; Score=40.5; E_value=5.8e-09; Accession=PF02194.6; Description=PXA domain
MESVNDLIQEAKLRTLWVEFRWKLQQPRPQTYLSHLEKKQLSLNDPCLTSLPSPAKWKRKIDSPAVEAAMSDFIDKILKDFVVDLWYSEISPDKEFPEQIRAIIMDVLAEISGRVKEINLVDLLTRDLVDLIGVHIELFRRNQAVIGVNIMKTLSSEERNDRLKFHLLNSKELHPALISPESEYKVLQRLMSAVLATVLRQREAQCPVIRSISRELLTCLVMQPIMNLASPGYINELIESLLLLFNDDGTEGMGSDQSTNVASLHHGHSVASKGGHNNLTASNKHPSLNQGTDMILAKMSDQGGTSLQDSTLHQESKQVGPADWARMLEVTTQRRTEILMPENLENMWTKGRNYKRKENKIIKAGSKDLSAKSPSTDSSRPHRKLAQETSASKRGKYEVADGKSSLPPLPAIGSDPLQNVGSAKNSESPKNPGKELSIVGDLASDAYRSPLKRSSSASSLGILSNKEDSRISEFFNPELERHSEGFRGKSSSNMIVRKEGSLVPKLRCRLLIKAFGYKLHLVLSNRAIWILFYSKHPLATDDRYGSSAVLTFLGSACANIKVGLSLDFTMPDLALVHMGCTLASLTKGPEPESSEMDATEVDATCAIGIGKIERGLVGVEGEDVGLGGENRDVTIQHWSGESSIEKSRKKNLGSLNLAKGSNSNSASEAQVHLTQGNTHSSSNYDSVYGNQGMMVAVCMVEWS

SEQ ID NO: 134245 - protein, 228 aa, Glycine max
  Coding DNA Sequence Number=SeqID_17467
  Gene Ontology: Mol. function=binding
  Homolog annotation: Hit_ID=Q94I34; Match level="QueryCoverage=52%, HitCoverage=18%, E-value=3e-13, Identity=35%"; Hit description =Putative selenium-binding protein-like
  Pfam annotation: Domain name=PPR; Domain location=95-129; Score=28.7; E_value=2.1e-05; Accession=PF01535.11; Description=PPR repeat
  Subcellular localization annotation: CTP_CleavageSite=36; ConfidenceScore=5.39e-01
MTLFLWVPGSATVGNGTKDSDFSRPICKLRSPMSVTACARSGSLLLVKHVHSLLLKSGYERFGLARSALLYFCLHCCGTKEAEVVFEELRDGNQVLWSLMLAGYVQRDMIDDAMDVFEKMHARDVVAWTTLISGYAKGEDGCEKPLDLFGCMRRSSEVLPNEFTLDCVVRVCARLGILCAGKVVHRLCIKAIDDAKRVYESMGGDNKEMQRMQNQNQAQGQARKKNQN

SEQ ID NO: 134246 - protein, 84 aa, Glycine max
  Coding DNA Sequence Number=SeqID_17468
MVTGRENTNKSSCIQNNSLMPKEEKVQVADDSLSEADLLSEWYPLSEAYSSLSGLENPKRGSVRDVFAQGGASPPNEVVVPSRA

SEQ ID NO: 134247 - protein, 185 aa, Glycine max
  Coding DNA Sequence Number=SeqID_17469
  Gene Ontology: Mol. function=phosphoinositide binding; Biological process=intracellular signaling cascade
  Homolog annotation: Hit_ID=Q2RAA5; Match level="QueryCoverage=95%, HitCoverage=15%, E-value=5e-23, Identity=39%"; Hit description=Phox domain-containing protein, putative, expressed
MDDIVRQFKGVSDGLRRKVVGSSSLINEGSATSNTPWNLSWNADEIDKSIPRQSTAESVSSDNEEGERNNFDRENIDREAAQDSGLHSYNALISKGYSSRISNWDEESRNLDFDRKHDMVVEARAGNGIPATNFILIHDNLEDPVGVPPEWTPPNVSVPILNLVDNIFQLNKRGWIRCFLVYKLS

SEQ ID NO: 134248 - protein, 157 aa, Glycine max
  Coding DNA Sequence Number=SeqID_17470
MVTHSLDHCASSSSFIFFFSPPPLVGSGFDWWRCVKVGDSGDGVAMSMGLIRWCADGLWWFKEAMLAFGWNNGYGGVKGGHARRGLSRHTSTKPQSLCHAQIPMEEDGRNDTAVVHGVKAEGVSIVADGDSDNNGGGDGPRAAGGRGSGGISKEQRS

SEQ ID NO: 134249 - protein, 149 aa, Glycine max
  Coding DNA Sequence Number=SeqID_17471
  Gene Ontology: Mol. function=5'-3' exonuclease activity; Cellular component=intracellular; Biological process=DNA replication
  Homolog annotation: Hit_ID=Q10PN9; Match level="QueryCoverage=98%, HitCoverage=35%, E-value=5e-41, Identity=54%"; Hit description=5'-3' exonuclease, N-terminal resolvase-like domain containing protein, expressed
  Pfam annotation: Domain name=5_3_exonuc; Domain location=16-113; Score=38.2; E_value=2.8e-08; Accession=PF01367.11; Description=5'-3' exonuclease, C-terminal SAM fold
MVSFGVEDFEERYGGLKPSQFADMIALTGDRSDNIPGVHGIGDVHAVQLLSRFGEGTPYAGPWEEGTLERLLDSVDQIKEDHIKKALLRSDLPLYMVPLAIKDLSFNKPEDNGSKFNSLLTAISAYAEGFSADPIIRRTVHLWQKLDSR

SEQ ID NO: 134250 - protein, 310 aa, Glycine max
  Coding DNA Sequence Number=SeqID_17472
  Gene Ontology: Mol. function=zinc ion binding
  Homolog annotation: Hit_ID=Q2R2F0; Match level="QueryCoverage=68%, HitCoverage=59%, E-value=2e-59, Identity=51%"; Hit description=AT hook motif family protein, expressed
MDLELPPFHLPKPKPKLILSSLDTEKMKMGTRRKKREEAPLSLSEDDDGDENENSQNEGSKRVKNEGYEQAREQRIKENMERMQKLGLFDLSHKLKPLKKQKKRTHQPNHSPQRRSFRIMSRAPINYAERDFRESASKKNDEVEIVIPEGTNPEVYTEEQEKLLGDCESTWELYVDGYDEDGNRIYDPIKGETCHQCRQKTLGQHTHCNKCELLQGQFCGDCLYMRYGENVVEANHNTKWTCPPCRDICNCSRCRRGKGWMPTGVKTGFQICGSLSDLKIAAPSWKAQMLKNIVPEEISEGRGICRYHTE

SEQ ID NO: 134251 - protein, 93 aa, Glycine max
  Coding DNA Sequence Number=SeqID_17473
  Gene Ontology: Mol. function=5'-3' exonuclease activity
  Homolog annotation: Hit_ID=Q10PN9; Match level="QueryCoverage=66%, HitCoverage=14%, E-value=2e-12, Identity=61%"; Hit description=5'-3' exonuclease, N-terminal resolvase-like domain containing protein, expressed
  Pfam annotation: Domain name=5_3_exonuc_N; Domain location=7-92; Score=-42.9; E_value=2e-05; Accession=PF02739.7; Description=5'-3' exonuclease, N-terminal resolvase-like domain
MECPFFFWALPPYISWHHIFHLFHINEDRQNFRHNLYPAYKSNRPPTPDTIVQGLQYFKASIKAMSIKIIEASVEADDVIGTLALRSVDAGYK

SEQ ID NO: 134252 - protein, 290 aa, Glycine max
  Coding DNA Sequence Number=SeqID_17474
  Homolog annotation: Hit_ID=Q6L3T5; Match level="QueryCoverage=50%, HitCoverage=17%, E-value=1e-08, Identity=29%"; Hit description =Putative Sas10/Utp3 family protein, identical
MGVLEIGVFEIGQMEEEYPLSLLSLALTPHLTRRCETRECEEETKVQFWGLAVKNRTHTMGKKRGTSYQKKDAKSSKSKTSSRHGAYSSDDMDDDIDTFHKQRDIVPLDINDDAEESEDEELPIFDVQDIDEDEDDEDEDDGEDDDDDDDRDDVVAKMIRQRKYLQGKFGGGDDEMNDADDDDEDEEDYKLTLGGKKFSHGAENRNFELQSSDDEAPKEEEELALQIQREKAKSLTMEDYDLVDISEDKDNEKLTLKVSAVDDLVGLLPYCGQFPYYLRKNTMEEGILGQ

SEQ ID NO: 134253 - protein, 163 aa, Glycine max
  Coding DNA Sequence Number=SeqID_17475
  Homolog annotation: Hit_ID=Q6L3T5; Match level="QueryCoverage=79%, HitCoverage=17%, E-value=3e-13, Identity=39%"; Hit description =Putative Sas10/Utp3 family protein, identical
MIKQLDTKLPFELEDILKGNNGLETVVNSDNENAPTTADSIIKNQEQPLVSAKSTEETVPNKQFEMQKLETSKNSVQKTRKVKPQKDHIGAQSLEMLKVRASLEEKLKNKGLYSSIAPKPSNALKRLKPVNGYSFTLLSFTLLVSSMLELISHLQISQHARNI

SEQ ID NO: 134254 - protein, 223 aa, Glycine max
  Coding DNA Sequence Number=SeqID_17476
  Gene Ontology: Mol. function=translation initiation factor activity; Cellular component=cytosol; Biological process=regulation of translation
  Homolog annotation: Hit_ID=Q6K8R0; Match level="QueryCoverage=83%, HitCoverage=37%, E-value=9e-61, Identity=56%"; Hit description =Putative eukaryotic translation initiation factor 2A
MASNNHSPPLEILVRGPEDFSLWTGPPFANGQPSIKLEKVKCINAKFSDDGSKLMVTKSNSLISVYDCRIAEEIRAFEVPNVVAAALSPNGTYLQTFQKPSAPQEKNVTLWSIETGAAVHQQSQKNMTKANWPAIQFSSDEATACRLATNEVQFFDTGDFSKGVVCRLRVPGVAAAELSSLPGSHVAAFVPESKVEYLEDKRLSFTSRFLANRKNIRLAIGSL

SEQ ID NO: 134255 - protein, 334 aa, Glycine max
  Coding DNA Sequence Number=SeqID_17477
  Homolog annotation: Hit_ID=Q00ZH4; Match level="QueryCoverage=31%, HitCoverage=37%, E-value=4e-17, Identity=44%"; Hit description=[R] KOG1995 Conserved Zn-finger protein
  Pfam annotation: Domain name=RRM_1; Domain location=219-299; Score =33.2; E_value=9.3e-07; Accession=PF00076.12; Description=RNA recognition motif. (a.k.a. RRM, R
CGNLNFAKRVECNKCGAPSPNPNSSNDRGGSGSGGGYNRGGGGYGNNRGGRGNDYSSGGGRSGSYDGGRGNEYNSGRGGNSEGRGGSYRGSQGREDGGYGQVPAPTAQSYGGVGGNYPSTYSSYSGGNASYGTEAVPPPASYTGGPNSYPPSYGGSVGGYGGDNQGDGRSGGRSGPPAGYDSSYGAGNRGGFGGSSAETPATVKQCDENCDDTCDNSRIYISNLPPDVTTEELRELFGGIGQVGRIKQKRGYKDQWPWNIKIYTDESGNNKGDACLAYEDPSAAHSAGDYDLRGYKISVAMAEKSAPRAPPAYNQGGNRGGYGGDRRRDNYRDG

SEQ ID NO: 134256 - protein, 71 aa, Glycine max
  Coding DNA Sequence Number=SeqID_17478
MRLLKQTPEDPLSVGMDLSFAQQVADPPTPIMEMPEDPTMLVLRLSFTPPATPVLHLTDEEDMQDTQGTRD

SEQ ID NO: 134257 - protein, 138 aa, Glycine max
  Coding DNA Sequence Number=SeqID_17479
MEHEMELQRLNQNEETDKKKRMIAFKASSSMQEENEEEDSDDEEDFSLFVKKFQKFVKKRRIERRQNFNNGRKSQEDSQVLRCYNATNLVTLKIIALQMKNDLRRVIRKGMMKEGPKRPTLHGMTMIHPMVQKRRLIF

SEQ ID NO: 134258 - protein, 161 aa, Glycine max
  Coding DNA Sequence Number=SeqID_17480
  Gene Ontology: Mol. function=catalytic activity; Cellular component =cytosol; Biological process=cellular metabolic process
  Homolog annotation: Hit_ID=Q3SCM6; Match level="QueryCoverage=94%, HitCoverage=47%, E-value=7e-72, Identity=81%"; Hit description =Cinnamoyl-CoA reductase
  Pfam annotation: Domain name=Epimerase; Domain location=1-161; Score=- 62.6; E_value=0.048; Accession=PF01370.11; Description=NAD dependent epimerasedehydratase family
MDLLDIDSIAAAIKGCSGVIHLACPNIIGQVEDPEKQILEPAIKGTVNVLKAAKEAGVERVVATSSISSIMPSPNWPADKIKGEECWTDLEYCKQKGLYYPIAKTLAEKAGWDFAKETGFDVVMINPGTALGPLLPPRINSSMAVLVSVLKGNYHISPLNQ

SEQ ID NO: 134259 - protein, 83 aa, Glycine max
  Coding DNA Sequence Number=SeqID_17481
MCKVVRFAAAARLRRLSTAIPGPCKVQKRGTDILHDPWFNKFSLFGWSKSNFNLKRDGRAGFSYMLPSAECRVRGSIGVIIPA

SEQ ID NO: 134260 - protein, 213 aa, Glycine max
  Coding DNA Sequence Number=SeqID_17482
  Gene Ontology: Mol. function=transition metal ion binding; Cellular component=chromatin; Biological process=electron transport
MTKNKMLKEHNKTFLTWFKDTIFGDDNAFEMLRKLADEPKRNVRTWRGYNINNYSFYTKSQDDKSIVQNNGVSLKAESQHFATVNNDNPHSVFMSYFGVIEEILELNYCKWDDSNIGVWTNDFGFTLVDRKKLAYQNKPFIMVEQAKEVFYVQDPCGERWSVVLHRKTIDVNLEDDDSTLDTYHTPFSTHMPNVNREEEVNDVHANQNDHDVG

SEQ ID NO: 134261 - protein, 91 aa, Glycine max
  Coding DNA Sequence Number=SeqID_17483
  Subcellular localization annotation: CTP_CleavageSite=32; ConfidenceScore=5.45e-01
MATPSSFLILKSTPSSSTLKRTRKFTRLISFVCQTRRGEEATDKVNVTYVNWKQVPAAQKDLIWEDIQALVESKEDDNDKVYEKYECSKEK

SEQ ID NO: 134262 - protein, 112 aa, Glycine max
  Coding DNA Sequence Number=SeqID_17484
  Gene Ontology: Mol. function=zinc ion binding
  Homolog annotation: Hit_ID=Q5JLV3; Match level="QueryCoverage=98%, HitCoverage=57%, E-value=9e-20, Identity=44%"; Hit description=Zinc finger protein-like
MAIDIRQEWGHDADLHVALASAEQQLLQTEYEDYAMSQTSSIACLRSVTLILLMILLVRQALILTKNSVTGQDASIIFNFEMSVLQFVGVLLPCFAMARSWYAIQNQRRRQG

SEQ ID NO: 134263 - protein, 144 aa, Glycine max
  Coding DNA Sequence Number=SeqID_17485
MHVAQLISDAIYYLQGSRTYEESLGPGEVQQGPRGFHREVLCPEVGTGRGTTAAWGRLVASNRRTAATSRALQLIYKCWSIAYDPWSTSRRPSPKPKVSKSTRPMTDKSSRVRLVATYPLAGGRRETHRCVFQERKMCGVATNV

SEQ ID NO: 134264 - protein, 143 aa, Glycine max
  Coding DNA Sequence Number=SeqID_17486
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=7e-20, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLQALAFRGLHVLAFRGLYVLSFRGLHVLTFRGLHILIFRGLHALAIRGLHVLSFRGLHVLTLRGLHFLIFKGLHVLAFRGLHALTFRGLHSLAFIGLDALTFRGLHVLAFRGLHVLAFRGLHVLAFKGFHILAFRGLHILRL

SEQ ID NO: 134265 - protein, 96 aa, Glycine max
  Coding DNA Sequence Number=SeqID_17487
  Homolog annotation: Hit_ID=Q1SMK1; Match level="QueryCoverage=53%, HitCoverage=5%, E-value=6e-09, Identity=67%"; Hit description =Integrase, catalytic region; Peptidase aspartic, active site; Ribonuclease H
MKADMEAMKGQMTMMMEAMMRMNKMMKESSEDFRIQHHDLTPYWPKGKPIFVGVRDRSCPPFRSRDSFFEGSVGSKVGGSGMGICVLTLDAMSHGQ

SEQ ID NO: 134266 - protein, 110 aa, Glycine max
  Coding DNA Sequence Number=SeqID_17488
  Gene Ontology: Mol. function=actin binding; Biological process =cytoskeleton organization and biogenesis
  Pfam annotation: Domain name=Transposase_21; Domain location=55-110; Score=-133.7; E_value=0.0034; Accession=PF02992.5; Description =Transposase family tnp2
MHKYPNCGVSRYKVKDDNECNSDESIKKGPLAKVLWYLLIILRFKCSFSNEDDAKDLTWHANGRNWDEILRHPIDSSQRKKINHLYPNFGKETRNLRLGLATNGMNPFGC

SEQ ID NO: 134267 - protein, 320 aa, Glycine max
  Coding DNA Sequence Number=SeqID_17489
  Gene Ontology: Mol. function=transferase activity, transferring hexosyl groups; Cellular component=cytoplasm; Biological process =metabolic process
  Homolog annotation: Hit_ID=Q1SIP8; Match level="QueryCoverage=86%, HitCoverage=60%, E-value=3e-72, Identity=50%"; Hit description =Probable indole-3-acetate beta-glucosyltransferase T27E13.11- Arabidopsis thaliana
MPAKVQTNYKHLHPSLYSYYIPSISWIPRVDIPLLDGNHRQILQWALKSCEWLPKAQYQLLPSIYELESQVIDALKANLSIPIYIIGPNIPYFSLGDNSCYTNNGANNNGASHGYLNWLGRQPKCSVLYISQGSYLPISSAQMDEIANALHDSNVRFMWVTRGETPRLKEICGHMGLVVAWCDQLRVLLHPSVGGYWTHCGWNSVIEGVFSGVPFLTFPIAMDQPLISKLIVEDWKVGLRVKKDDKLDTLVGRDEIVVLLRKFMELDSDVGREMRKRAKELQHLAQLAITMDGSSENNIKDFMKNIVQSGSNRVQVQNGI

SEQ ID NO: 134268 - protein, 112 aa, Glycine max
  Coding DNA Sequence Number=SeqID_17490
  Gene Ontology: Mol. function=transferase activity, transferring hexosyl groups; Biological process=metabolic process
  Homolog annotation: Hit_ID=Q1SIP8; Match level="QueryCoverage=86%, HitCoverage=25%, E-value=9e-09, Identity=37%"; Hit description =Probable indole-3-acetate beta-glucosyltransferase T27E13.11- Arabidopsis thaliana
MEILHPQLQLVRRPERRRRNIPLIRNDDGLEQKRVTNHERRRWRRVEAVKDELELCLHLRHDSFEDVVEGVRGSTEAIEESHCSVTTKVTRMLGFFLYDEFGEVHHGVDVAT

SEQ ID NO: 134269 - protein, 51 aa, Glycine max
  Coding DNA Sequence Number=SeqID_17491
MTVEISLGGAMMVPVGYEWKVRWEVTEQCMHVSEQCATPHINVHDKLSVAS

SEQ ID NO: 134270 - protein, 44 aa, Glycine max
  Coding DNA Sequence Number=SeqID_17492
MEKVEGLRILKMRGVALAPSYPQERVVKALDLETIFSSLKGENR

SEQ ID NO: 134271 - protein, 95 aa, Glycine max
  Coding DNA Sequence Number=SeqID_17493
MAQPPILRTYHMNTRLVGSKTMIVILTPLPGPMEVTCLHPTKQYSNGIGNLRIIHVLVISALSRWHGNITVEIHNTLPFTLHCFKKLNVSPAKLT

SEQ ID NO: 134272 - protein, 72 aa, Glycine max
  Coding DNA Sequence Number=SeqID_17494
MAASFACSMVKFCGERCAQRLSRVAEKASEIALSCLGNNDDLKPGRDTVSENLKAIIIEITRFRNCAMASVA

SEQ ID NO: 134273 - protein, 78 aa, Glycine max
  Coding DNA Sequence Number=SeqID_17495
MERDNVFLFFREEDCEAERRYKYKYLLISDESENADEEIENEKLVVDGLTTGKFEVSFCSMSQKCPHESRGFEQTIKI

SEQ ID NO: 134274 - protein, 281 aa, Glycine max
  Coding DNA Sequence Number=SeqID_17496
  Gene Ontology: Mol. function=RNA-directed DNA polymerase activity; Cellular component=chromatin; Biological process=chromatin assembly or disassembly
MPFGLCNAPSTFQAAMNSLLTSFLWRFATVFFDDILVYSKSLSSHIQHLKIIFHTLVQGQFYLKRTKCLFAQTQVEYLGHLVSNRGVKPEPSKVRTMVQWPLPTSPKELGAFLGLTGFYRKFIKNYMLIAAPLNSLLGKEAFNWSLTANSAFEQMKTAMTSAPVLALLDFDKPFIVETDASDTGMGVVLMQKGHPLCFDLRPGTSCNRLGRAKMAGRHRGGAPIRPIVSRITIHWPSFYNVVTGKTLALPNLIALQHIPLSPAGVIAKRPAPIALPNSCAA

SEQ ID NO: 134275 - protein, 167 aa, Glycine max
  Coding DNA Sequence Number=SeqID_17497
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=100%, E-value=1e-21, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSHLLEFGMIGLLNESISCFLKRVDLWVLVPSPLEGYTPSPSEDYTSSPSEGYTSSSSEGYTPSPLEDYTSSPLEDCTSSSSKGCLPSPSEGYMPLPSEDYTSSLSEGYTPSPLEDYMSSPSKGCTPSPSVGCTASPSEDCMSSPSEGCTPSPSEGCTPSPSKDDTS

SEQ ID NO: 134276 - protein, 44 aa, Glycine max
  Coding DNA Sequence Number=SeqID_17498
VFRKLRSPIPEEVIPEELLPQLAFTTSGRPSFGRGHSGPSSFCG

SEQ ID NO: 134277 - protein, 39 aa, Glycine max
  Coding DNA Sequence Number=SeqID_17499
MVGSGCAGLDVTRYEPNMHHKSKGNDLKVQKHEPSKVRD

SEQ ID NO: 134278 - protein, 172 aa, Glycine max
  Coding DNA Sequence Number=SeqID_17500
  Gene Ontology: Mol. function=histone-lysine N-methyltransferase activity; Cellular component=nucleus; Biological process =multicellular organismal development
  Homolog annotation: Hit_ID=Q8LBW3; Match level="QueryCoverage=98%, HitCoverage=97%, E-value=1e-58, Identity=64%"; Hit description=LOB domain-containing protein 12
  Pfam annotation: Domain name=DUF260; Domain location=6-106; Score =246.7; E_value=4.8e-71; Accession=PF03195.5; Description=Protein of unknown function DUF260
MGGTSPCASCKLLRRRCSKDCIFAPYFPSDDPRKFSIVHKVFGASNISKMLQELPIHQRADAVSSLVYEANARVRDPVYGCVGAISYLQNQVSQLQMQLAVAQTEILCIQMQQQEPTLATQLVDQDDKSMLLSVNNNYEMLPQFLKFPSSSSSSSNVFQDPHEPLKRESFWT

SEQ ID NO: 134279 - protein, 910 aa, Glycine max
  Coding DNA Sequence Number=SeqID_17501
  Gene Ontology: Mol. function=DNA binding; Cellular component=beta -galactosidase complex; Biological process=DNA integration
  Homolog annotation: Hit_ID=Q1SDN3; Match level="QueryCoverage=95%, HitCoverage=93%, E-value=1e-117, Identity=45%"; Hit description =Polynucleotidyl transferase, Ribonuclease H fold
ALLRTLPVIPRYKHYFNSPMASPNLSSLEDSLNPHSPYYVHPSENPSTSLVSPLPDPTNYNSWCISMSIALSEKNKLEFIDGSLLQTAPNHALHIAWKRSNNMVVSWLIHSVSPSIRQNLLWLDNTVDIWRDMKSRYSQGDLLRISELQQEVASVKQGIYVATVERMDMLLKIVGKRMAIQVISHQIEEEGVELFLVMKHGYPPGHHLHKAPGANINNTATKPMNNENSTAIAIIQEGQNSEMKLTSQQYQALMSLLQQTSTNGSSSSTQTTHINQLGITSKTDSIIGSVLPIICTINNDTNLNTWLLDSGATDQIASSLDIYSECKQISPIIVSLPNGEQLIARYSGTVHISEFLVLTNVLYLPNFNFNLISISKLTNSMHYQLVFFANKCLIQEISTKRMIGTIDVESALSVLTEKSKILEPYLNCFPFSTIDINDPTILAHPFITTHNPQAFSSPIDSSSPTPLPPQPEPVSIDQPHTKHTSSAHSPRRTDRVRTRPTKYNDYQTSFTSATVTNHPGIKHPISSVISYNKLSSSYHSFILNISANFEPKSYTEARKHDSWVQAMHDEIYALERNNTWVLTDLPQHKNVIGCKWVYKIKHNVDGSIERYKARLVAKGYTQIEGQDYLDTFSLVDKITTDRLFLSLATSNKLYLKQLDVNNAFLHGDHLEEVYMVLPLGMKSAKPGQSTADYSLFTLKRNNSFTALLVYVDDILLSGNDLTSSITKLLDDTFKIKDLGNLKYFLGFEVARGTSGINICQRKYALDFLIDTDIPDITFAIQHLSQFIASPTTAHYTALYRILRFIKVAPGLGLFFFSTRELQLKAFSDSDWAGCVDTRKSITAEYRALASVTCEIQWLTYLLHDFDIIHKPALVFCDNKSALHIAANPVFHQRTKHIEIDCHLVRDKLLL

SEQ ID NO: 134280 - protein, 113 aa, Glycine max
  Coding DNA Sequence Number=SeqID_17502
MKRCRPIGQNSSKLNQSKKGSNQQLDELKVCLRSKRSLSQHLCETETNMLAIISKYQEELNLVTTHEHKVADEYARVYAEKEARGRVIDSLHQEATMWMDRFAFTLNESQELP

SEQ ID NO: 134281 - protein, 65 aa, Glycine max
  Coding DNA Sequence Number=SeqID_17503
PFHPGLFVGDAGGFQSPTREPLNVGGLVPPHCSLKSVVSDDACPWRFALFNAMLLLLKLASAGNA

SEQ ID NO: 134282 - protein, 67 aa, Glycine max
  Coding DNA Sequence Number=SeqID_17504
MAVIGLTKTPQPPLPRRYNPNVTCAYHGGVSRHSIEHSTYALEFDFQVCSIRNCSFYTSGEGAINDE

SEQ ID NO: 134283 - protein, 277 aa, Glycine max
  Coding DNA Sequence Number=SeqID_17505
  Gene Ontology: Mol. function=phosphoinositide phospholipase C activity; Biological process=intracellular signaling cascade
  Homolog annotation: Hit_ID=Q1SP02; Match level="QueryCoverage=92%, HitCoverage=64%, E-value=1e-31, Identity=32%"; Hit description=IMP dehydrogenase/GMP reductase
  Pfam annotation: Domain name=DUF1723; Domain location=57-106; Score =54.2; E_value=4.5e-13; Accession=PF08330.1; Description=Protein of unknown function (DUF1723)
MILTNIAFLYTSIQEHPELKLSYHERKVHSLGRPVPAIEGLVFGTGLSPLIACSVDTGDRGLLSSFVEQWYRETSSFHLPVGELTITLDDVSSILHMPVDDARLPELRQGSVVGRTYTCNEYVIYTSADARQALRDLSQTGRYAWGVVALVHMYDQLNDASINSSRQLGGYITLLQCWIYEHFPSVAESTTDQDYDEDSSRACRWIVTKKTVKSIRTMVYRERLDRLRIPDVFWIPYGEHRPVRDFHLISCYFGLLCWGLVAVYYRPERVVRQFGYT

SEQ ID NO: 134284 - protein, 141 aa, Glycine max
  Coding DNA Sequence Number=SeqID_17506
  Gene Ontology: Mol. function=actin binding; Biological process=actin cytoskeleton organization and biogenesis
  Homolog annotation: Hit_ID=Q1SZ88; Match level="QueryCoverage=69%, HitCoverage=5%, E-value=1e-23, Identity=61%"; Hit description=IMP dehydrogenase/GMP reductase
MHVNSFHSYVYQIRNSVKLKRIMQTILSLGNVFNHGTIRGLTVGFRLDSLLKLTDTRATNNNMTLMHYLCKDILHSLLARVNFPISSLPLRNDHHISLLYHDFHRDSTANEREGNQLDLPWFQCTDQWISVYSWLETLDKD

SEQ ID NO: 134285 - protein, 116 aa, Glycine max
  Coding DNA Sequence Number=SeqID_17507
  Subcellular localization annotation: CTP_CleavageSite=27; ConfidenceScore=5.21e-01
MPSSSRSQKKNIRNSSVARITFMGDLSCRKVQQAKRSRNEEKKKEIRRGPSPTLVLSVQDTLSAQEGKVLIEATSTRIQLALSARFALGARCNGAEREASRSARLRRPRAQFCTYK

SEQ ID NO: 134286 - protein, 147 aa, Glycine max
  Coding DNA Sequence Number=SeqID_17508
MGLHLHTSISLPLAPHNLRRRWTFIGCSILIDLYLEEELTRKTNHVGSAMKEEELTRMSILIDLYLEEELTRETNHVGSAMKEEELTRMSILIDLYLSEELTRETNHVGSAMKEEELGRIIRERGNSVFTDISRGISVISHKGSILL

SEQ ID NO: 134287 - protein, 133 aa, Glycine max
  Coding DNA Sequence Number=SeqID_17509
  Gene Ontology: Mol. function=receptor activity; Cellular component =integral to membrane; Biological process=negative regulation of apoptosis
  Homolog annotation: Hit_ID=Q94GN3; Match level="QueryCoverage=86%, HitCoverage=50%, E-value=2e-39, Identity=61%"; Hit description =Putative receptor-associated protein
  Pfam annotation: Domain name=UPF0005; Domain location=4-133; Score= -60.3; E_value=0.011; Accession=PF01027.11; Description =Uncharacterised protein family UPF0005
MLLDMLEFGLTIKSTIVLEAAFLTGVVTASLTFYTFWAVKRGSDFSFLGPFLFASLMVMLLFALIQVFYPLGPIGRMVIACIGAIVMCGFIVYDTDDLIKRYTYDDYIWAAIAIYGDIINLFIYLLTILNDLF

SEQ ID NO: 134288 - protein, 370 aa, Glycine max
  Coding DNA Sequence Number=SeqID_17510
  Pfam annotation: Domain name=DUF1639; Domain location=230-279; Score =124.4; E_value=3.3e-34; Accession=PF07797.4; Description=Protein of unknown function (DUF1639)
MVFTCSEKEESMAMGPERSKPLHNFMLPCLKWGGQRHLRCTKHPSDSSSADAAGDRRSPAPREFDSPPPPLTNADTRTRLTRPRFLVGDEGIDAVREKLMLDLKTEADRMKDAILGKEVAEYNNDVEMNDAPPPPVTGVRMKDAILGKEVAEYNNGVEMNDAPPLPVTGVRTWNLRTRRAPVAGDKGVRIDERRGGGGGSSLSPLRMKSPKLRGSPEKEERRPVKFSLTLAKKEIEEDFMRIVGHRPPRRPKKRPRNVQKQLDTLFPGQWLSEVCADSYKVPDDAETGKNNTLNSDDCSKSHALVYYFAFVATIKSFLVQNCNYECSSSGAILVCSTRFINGGWQKAKILPYKHTLASKNAMVEGSKNTT

SEQ ID NO: 134289 - protein, 104 aa, Glycine max
  Coding DNA Sequence Number=SeqID_17511
MKKKGNFNTPLDKKIQDLKRNTRRRTMRSSILSRQRHFGDKKKKRLMVTWDDLDSEKSNNSDDEQPNICLMANTDDEQHALNLTLIVVLHQTMKKICLLVDEYD

SEQ ID NO: 134290 - protein, 95 aa, Glycine max
  Coding DNA Sequence Number=SeqID_17512
MGSTSSPLQALPSFIETSLRIEGTEICVLFKVEGSEEALPSGNFEIEDGFIEAEDLYDSVDEKAERFIETFYQQMRMQSQNPYISSSHSSLCGTA

SEQ ID NO: 134291 - protein, 42 aa, Glycine max
  Coding DNA Sequence Number=SeqID_17513
KSNLGIALVGVGCEQNKVDVRVDNKLRKTSEIVLGLSGAYID

SEQ ID NO: 134292 - protein, 111 aa, Glycine max
  Coding DNA Sequence Number=SeqID_17514
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8LD27; Match level="QueryCoverage=62%, HitCoverage=30%, E-value=1e-23, Identity=70%"; Hit description =Proteasome subunit beta type 6 precursor
MALLYIYFHWQNFLETGLIVGGWDKYEGGQIYGVPLGGTIVQQPFAIGGSGSSYLYGFFDQAWKEGMTKDEAEKPQTKNVQDSMYLVRTTPVPRKETKNGPALHKPYSPHD

SEQ ID NO: 134293 - protein, 188 aa, Glycine max
  Coding DNA Sequence Number=SeqID_17515
MEYSSDSFHYLAPLIRIRQLLACIRLEYSSLESNNCTDWLSKHRSDGRNVKVWSMLLATANGRSRFGWRLISHNNSLFFQKEIINWLHVNICGSKHAFDTTWSIVFGVILDRVWWRRNEFVFRNKWTSSEGVVGSVLALTKDIIRSKECHKILSHDDYHDYRVNSGGKETNMLIYLLRFQIPKLSSKI

SEQ ID NO: 134294 - protein, 54 aa, Glycine max
  Coding DNA Sequence Number=SeqID_17516
MSNKTQRQIMVILRLVSTERSKFDSIGMMCRQFVKFRDMPELKRKHRCTNREVP

SEQ ID NO: 134295 - protein, 150 aa, Glycine max
  Coding DNA Sequence Number=SeqID_17517
  Homolog annotation: Hit_ID=P55886; Match level="QueryCoverage=98%, HitCoverage=63%, E-value=5e-69, Identity=85%"; Hit description =Hypothetical protein yigA
  Subcellular localization annotation: CTP_CleavageSite=16; ConfidenceScore=5.05e-01
MAQTLYAQRFKRLTAQCQMGKSRRRADAPAVREKTNRCARQPQLARPAVEAAEELVKAVRRRQTRLQMQQTIEQAFVGVGLLHQQRHVLFELVDMVARARHVPFHQRHGPANRMRHAHLFDDACIANKKLRIAQQIINNSSVVQFRHCFL

SEQ ID NO: 134296 - protein, 57 aa, Glycine max
  Coding DNA Sequence Number=SeqID_17518
YATKFKYLSEFCAPAGEKEWKCRRFEEGLRHELKRIIIPLDIIVFHLLVEKSKTKEY

SEQ ID NO: 134297 - protein, 101 aa, Glycine max
  Coding DNA Sequence Number=SeqID_17519
MRVRESFTHGEGTHSASRLSSSRLSVSLALSENSLTRAKHDVEVSEPFFKPGNAEKKERERAPNSRKNLNSEIHRGKEQSKEAKFVEASFTMIDRGRTRIK

SEQ ID NO: 134298 - protein, 103 aa, Glycine max
  Coding DNA Sequence Number=SeqID_17520
MEYISQNDQRMKLMESQLTFIHSLLLQRAPNTLPSQTKANPKKKEALNEERQEENKEGEKEVPTPPEGDRGCVGEDMEEDENALIILGFPFLNTCDLEVEVRL

SEQ ID NO: 134299 - protein, 102 aa, Glycine max
  Coding DNA Sequence Number=SeqID_17521
MRLSALNEYGSGVIDILFGNVCHIGWCTVGRQAIWQEGARWGHRVHLSNVLAAATATILASIIFFMLIMASIIVAIFSFMASMSAFICSCTSSASPITLARV

SEQ ID NO: 134300 - protein, 150 aa, Glycine max
  Coding DNA Sequence Number=SeqID_17522
MVIPHTPFAIQTQSSPMARRDKLWSFCALLSSGGGGPDDMRRQIMVIPHSLLPFRHSCVRWHAETNYGHSAPFCHLEAAGPMTCGDKLWSFRTPLLPFRHSCVQWHAETNYGHSAPFCHPEAAGPMTCEDKLWLFRTPFCHSDTVVSDGT

SEQ ID NO: 134301 - protein, 429 aa, Glycine max
  Coding DNA Sequence Number=SeqID_17523
  Gene Ontology: Mol. function=cysteine-tRNA ligase activity; Cellular component=mitochondrion; Biological process=cysteinyl-tRNA aminoacylation
  Homolog annotation: Hit_ID=Q9FMB9; Match level="QueryCoverage=98%, HitCoverage=77%, E-value=1e-140, Identity=61%"; Hit description =Cysteine-tRNA ligase
  Pfam annotation: Domain name=tRNA-synt_1e; Domain location=1-309; Score=431.4; E_value=1.2e-126; Accession=PF01406.10; Description =tRNA synthetases class I (C)
  Pfam annotation: Domain name=tRNA-synt_1g; Domain location=8-302; Score=-283.9; E_value=0.012; Accession=PF09334.1; Description=tRNA synthetases class I (M)
  Pfam module annotation: Pfam domain module=tRNA-synt_1e::tRNA-synt _1g; Domain location=1-309::8-302
SLPTTSDLGHARAAVSFDIRLQLTCGFYSGCRYLKHLDYEITYVRNFTDVDDKMATWVECFQYLADHVKIIKRANETGEDPLMLSNRFCDEYNADMADLQCKTPSKEPRVSEHLNEIKDMITQIISNGYAYEVDGDVFYAVDKCPNYGMLSGQRLEHNRAGERVAVDSRKRHPADFALWKAAKPGEPSWDSPWGPGRPGWHIECSAMSACYLTHKFDIHGGGIDLIFPHHENEIAQSWAADHESHVSYWMHNGHVTNNNEKMSKSLGNFFTIRQITERYHPLALRHFLISAHYRSPLNYSISQLENSSDAIYYIFQTLQDCKDAVSPLLQGETEKNEKVPQINEAAKECIKKLNVEFQTKMSDDLQTPVILTGALQEALKFVNTSLKMLKKKMQKRAQLQLIQSLLEVEKEVGKVLDVLGLLSSKSYAE

SEQ ID NO: 134302 - protein, 205 aa, Glycine max
  Coding DNA Sequence Number=SeqID_17524
  Gene Ontology: Mol. function=RNA-directed DNA polymerase activity; Cellular component=chromatin; Biological process=chromatin assembly or disassembly
MIIQSSAIDQDVIKEDDDEVTEIWPKNSIHCRLERGRSIAQAKWYHPELVVAMNQRAPPNSSRSSSIIGIEKWSLIDELVIFVTLNPPELQFYVSGSKGNDTDAQAVDRIMGAIPVNEYHHLLALVGAGGSDGLGTKSESGVIFGKLSPHSRREANSSGESRLTGKEEGGLRGVSNNGGGVEEMEEGQEEMVDEGEGRVLEQNER

SEQ ID NO: 134303 - protein, 110 aa, Glycine max
  Coding DNA Sequence Number=SeqID_17525
  Gene Ontology: Mol. function=chromatin binding; Cellular component =chromatin; Biological process=chromatin assembly or disassembly
MFSILDEGDGNNALYGERVPEGGINQNNLIPVLKKRKLWFLLPIIHHGFGNHLVLKPTKVMETWDPQSKGGKVSTRNNETHGVSTLHSTIEAYKQLYQYAPKSDRVHSNA

SEQ ID NO: 134304 - protein, 281 aa, Glycine max
  Coding DNA Sequence Number=SeqID_17526
  Gene Ontology: Mol. function=nucleic acid binding; Cellular component= intracellular; Biological process=regulation of transcription
  Homolog annotation: Hit_ID=Q9C9H1; Match level="QueryCoverage=93%, HitCoverage=95%, E-value=1e-30, Identity=37%"; Hit description =Putative zinc finger protein; 21453-22187
METTQLDYNTKRANPTSPTRLKLFGFSVHHEDIMEEDEVVVAHDDVADSTTKATSTSPSPSDSPDSSVAAAGPPSSGDRKYECQYCCREFANSQALGGHQNAHKKERQQLKRAQLQASRNAAVSFVRNPMISAFAPPPHLLAPPGSVMVSAAPPSWVYMPPRAAPPPFHVSVSHGCAFPSAHGNNNGFSGGSSSNSNNVTITTGVKSAGAGMFPYVGVVGDSSLAALSTVQVQARAHHARIDGPSLSRFSKGDGGPKFDDAWGLDLHLSLAPAAPPSLGSA

SEQ ID NO: 134305 - protein, 199 aa, Glycine max
  Coding DNA Sequence Number=SeqID_17527
  Gene Ontology: Mol. function=structural constituent of ribosome; Cellular component=ribonucleoprotein complex; Biological process =translation
  Homolog annotation: Hit_ID=Q8PNS4; Match level="QueryCoverage=98%, HitCoverage=90%, E-value=6e-93, Identity=88%"; Hit description=50S ribosomal protein L3
  Pfam annotation: Domain name=Ribosomal_L3; Domain location=3-194; Score=253.1; E_value=5.9e-73; Accession=PF00297.12; Description =Ribosomal protein L3
PRVTEDGRSIPVTLIEATPNRIAQIKTVETDGYSAVQVTVGARRAALVNKPEAGHFAKAKVEAGRGLWEFRVEDAQLGDFAVGGEVKADIFEVGQIVDVQGVTKGKGFQGTIKRHNFRMGDATHGNSLSHRAPGSLGQRQTPGRVFPGKKMSGHMGAVQQSTQNLEVVKVDVERGLIAVRGAVPGAAGGDVIVRPASKA

SEQ ID NO: 134306 - protein, 53 aa, Glycine max
  Coding DNA Sequence Number=SeqID_17528
MVLYALQIMFEEIRVGSGDKRQSKMAKHKQDAYTTAVEYQQALPEGVDYESWS

SEQ ID NO: 134307 - protein, 230 aa, Glycine max
  Coding DNA Sequence Number=SeqID_17529
  Homolog annotation: Hit_ID=Q6AVG1; Match level="QueryCoverage=48%, HitCoverage=28%, E-value=8e-26, Identity=52%"; Hit description =Expressed protein
MKGQNNQYSLNSVSKFFNAQFHFIQFLSYILILGFGISIGVIFSFYLKDCNFSLQFTQLSLSSFPRTPPLPPTTAKPEISNQTQTQTQSQIQTQTQMQTQTQIETQTQIENSHVGLKEFLKPPPVVHDMDDEELLWRASVTAKIPDYPFDRVPKVAFLFLTRGPVFLAPLWEQFFKGHEGFYSIYVHSNPSYNGSRPESPVFKGRRIPSKYTGNCGTALWDAQAHLRSRL

SEQ ID NO: 134308 - protein, 299 aa, Glycine max
  Coding DNA Sequence Number=SeqID_17530
  Gene Ontology: Mol. function=transcription regulator activity; Cellular component=nucleus; Biological process=regulation of transcription
  Homolog annotation: Hit_ID=Q67U21; Match level="QueryCoverage=75%, HitCoverage=69%, E-value=6e-50, Identity=46%"; Hit description=Basic helix-loop-helix-like protein
  Pfam annotation: Domain name=HLH; Domain location=7-57; Score=28.6; E_ value=2.1e-05; Accession=PF00010.16; Description=Helix-loop-helix DNA- binding domain
MDCSAARKTQKADREKLRRDRINEQFVELGNILDPDRPKNDKATILCDTIQLLKDLISQVSKLKDEYAMLNEESRELTLEKTDLREEKASLKSDIDNLNNQYQQQLRTMFPWTAMEHSVMMAPSSYPYPVPMAVPPGPIPMQPYPFFANQHPAVISNPCSTYVPYLAPNTIVEQQSTLYVSPPLHPGARPNVSGKQESKSKSSRESMAEKNEESNDVTTDLELKTPGSSADQDLSSGQRKSSKLSRRESSCTEWSSLAHQAVWWRAERITNEKVDKLVKFLCLEAAEVFHCASAATLEV

SEQ ID NO: 134309 - protein, 523 aa, Glycine max
  Coding DNA Sequence Number=SeqID_17531
  Gene Ontology: Mol. function=hydrolase activity
  Pfam annotation: Domain name=Lactamase_B; Domain location=247-508; Score=8.0; E_value=0.036; Accession=PF00753.17; Description=Metallo -beta-lactamase superfamily
MATHRLALIIQNPSNDDEFLLVKQSRPPKFHDEEYDSFVDSDLWDLPSAQLNPLLAESEPPVELELAVSHSESQDVDLRKFDIRSALNEVFGQLGFGAVDGGGWKFHKYVKEAAFGPDLPVNTVFIVGKLVAAEDKDFRDSYRWKSVRSCLNWILEVKPHGDRVGPLVVIGLINESSISTKWKVPPAINYQLDISVQGMEKEEAGFLFFKEYPPGNIIIPMGSRTLRPFHTTNLVVFAPENVSNDSGENNFIVRGDALIVDPGCLSEFYGELEKIVTALPRRLVVFVTHHHPDHVDGLSVIQKCNPDATLLAHEKTMHRISRGKDAKRMLGVDTVVVSEISGQERGGSKADVWSLGYTPVTGDEDIDIGGQRLRVIFAPEDQSARVAFTEILFSRIDEGIHDLPSFDLEKEMVWHAEFVSYYPLSKPSDFLQGSATLDIKAGGNMSVSAKRPYMLEMQMNRRSREANIVKAIEGGAKSLFDIIVYVYSDVDRRAWIAASSNVRLHVDHLAQQHKLPKVMTNML

SEQ ID NO: 134310 - protein, 120 aa, Glycine max
  Coding DNA Sequence Number=SeqID_17532
MERQLATVSDDPLFIAMVLLERAWDVGEDKMIERHDGDPRSYPPESGDGKFLLIQNVQIVEELRDFKYPHHRITAIEIGHFKFHDLEKQDVPEWNPSCCSSLFVLELGTFGYEKGSGGFV

SEQ ID NO: 134311 - protein, 46 aa, Glycine max
  Coding DNA Sequence Number=SeqID_17533
IFRKVIDLIQHQEVAAPESYTAIKTWRLHELCTKSGIEDLFCEFGT

SEQ ID NO: 134312 - protein, 543 aa, Glycine max
  Coding DNA Sequence Number=SeqID_17534
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=98%, HitCoverage=81%, E-value=1e-162, Identity=57%"; Hit description =Putative receptor kinase
  Pfam annotation: Domain name=LRR_1; Domain location=10-32; Score=9.4; E_value=5; Accession=PF00560.23; Description=Leucine Rich Repeat
  Pfam annotation: Domain name=LRR_1; Domain location=34-56; Score =16.0; E_value=0.14; Accession=PF00560.23; Description=Leucine Rich Repeat
  Pfam annotation: Domain name=LRR_1; Domain location=58-78; Score =10.0; E_value=3.8; Accession=PF00560.23; Description=Leucine Rich Repeat
  Pfam annotation: Domain name=LRR_1; Domain location=80-102; Score =13.9; E_value=0.59; Accession=PF00560.23; Description=Leucine Rich Repeat
  Pfam annotation: Domain name=Pkinase; Domain location=260-530; Score =24.6; E_value=5e-10; Accession=PF00069.15; Description=Protein kinase domain
  Pfam annotation: Domain name=Pkinase_Tyr; Domain location=263-530; Score=20.2; E_value=1e-13; Accession=PF07714.7; Description=Protein tyrosine kinase
  Pfam module annotation: Pfam domain module=LRR_1::LRR_1::LRR_1::LRR _1::Pkinase::Pkinase_Tyr; Domain location=10-32::34-56::58-78::80 -102::260-530::263-530
  Subcellular localization annotation: CTP_CleavageSite=52; ConfidenceScore=5.20e-01
VPSNLSNLTALKLLFLSRNSFSGEFPATVTSLFRLYRLDLSNNNFSGEIPAKVGHLTHLFTLRLDGNKFSGHIPDLNLPELQEFNVSSNRFSGEIPKSLSKFPESSFGQNPFLCGAPIKNCASDPTIPGSESAIASLLIPPNNNPTTSVSSSPSPMPKTPTSTSTSSNKSHEKGASKISPVVLIAIITGGVLVLIAIAFLLLCCYFWRNYKLKGGKGSKVFDSEKIVCSSSPFPDQGGLERNRMVFFEGEKRYEIEDLLESPSEMLGTGWFGTTYKAELDGVNVFAVKGLGGTYMTGKREFEQHMEVLGRLRHPNVVSLRAYYFTSEIKLLVYDYESNPNLFQRLHGLGRIPLDWTNRLKIAAGAARGVAFIHNSCKSLRLIHGYIKSTNVQLDKQGNARMSDFGLSVFARPGPVGGRCNGYLAPEASEDGKQTQESDVYSFGVLLLELLTGKFPAKVKTEEVGFGALLDIPMWVRSVPRKRWTLDVFDWDLMRHKDIEEEMVGLLQIAMTCTAAAPDQRPTMTHVVKMIEELRGVEVSPCHH

SEQ ID NO: 134313 - protein, 392 aa, Glycine max
  Coding DNA Sequence Number=SeqID_17535
  Gene Ontology: Mol. function=RNA-directed DNA polymerase activity; Cellular component=chromatin; Biological process=chromatin assembly or disassembly
HGLEIYPKAHENPRAFPWISSPIYLESSTQCPCGALNAIIVKHRFPMPSIDELLDELDQASWFSKLDLRLGFHQIYVTMEDVHKTTCQTNEGHYVFIVMPFGLYNAPSTFQVTMNDLLRPFLRKFVAIFFDDILFYIPTLSLHLYHLKEVFERILFGPECTPASASSSRSVPPTNSLVSDKDPLFISAFWRELFRLCGTKLWMSTAYHPQIVRQMEWSYNTLVHLSTGISISEATYGKLPSSIPQYLQGTSQAEVVDDLLVTHTTIHATLCRHLQKAQASMKNLVDAYHRDVHFFVNGWVYIRLRPHHQTSVVPTYTKLSKRFYGSLQPRTLPFKLSTSDKLGQQSFGYGSQGYHLGDWDQLLAAYDLKDKVIFLDVGDVSTFEPNKPKRHT

SEQ ID NO: 134314 - protein, 550 aa, Glycine max
  Coding DNA Sequence Number=SeqID_17536
  Gene Ontology: Mol. function=hydrolase activity, hydrolyzing O -glycosyl compounds; Cellular component=membrane; Biological process =carbohydrate metabolic process
  Homolog annotation: Hit_ID=Q1RZ23; Match level="QueryCoverage=83%, HitCoverage=93%, E-value=0.0, Identity=85%"; Hit description =Glycoside hydrolase, family 17; Virulence factor, pectin lyase fold
  Pfam annotation: Domain name=Glyco_hydro_17; Domain location=80-401; Score=312.5; E_value=7.6e-91; Accession=PF00332.9; Description =Glycosyl hydrolases family 17
  Pfam annotation: Domain name=X8; Domain location=414-499; Score =179.5; E_value=8.2e-51; Accession=PF07983.3; Description=X8 domain
  Pfam module annotation: Pfam domain module=Glyco_hydro_17::X8; Domain location=80-401::414-499
MACECSVAHCCHAYRYISLLTVLSRLLLQSHYSGCKVVSSASRLQSGLSLLCLHVHLFYLNNPVMITTRGSDQGCGCAFVGVNIGTDVSDLPSASNIVDILQANQITHVRLYDANAHLLQALSNTSIEVIVGVTNEEVLRIGESPSAAATWINKNVVAYVPSTNITGIAVGSEVLSTIPNVAPVLVPAMNSLHKALVAANLNFRVKVSTPQSMDIIPKPFPPSTATFNSSWNSTIYQLLQFLKNTNSSYMLNAYPYYGYTKGDGIFPIEYALFRPLRSVKQIVDPDTVFHYNSMFDAMVDATYYSIEALNFNNIPIVVTETGWPSFGGANEPDATEENAELYINNMIQRVMNDSGPPSQPNIAINTYIYELFNEDKRNGPVSEKNWGIFYTNGSTVYPLSFGASDQITGNSSGVFCVAKDGADTDKLQSGLSWACGQGGANCAAIQPGQPCYLPNNVKSHASYAYNDYYQRKHSSGGTCDFDGTATITTKDPSSSSCIFAGSSNSSTGGLSLPPTALGPSGPFGASMNLQVSSLKYLISAVGVFLALAVL

SEQ ID NO: 134315 - protein, 666 aa, Glycine max
  Coding DNA Sequence Number=SeqID_17537
  Gene Ontology: Mol. function=binding; Biological process=protein amino acid phosphorylation
  Homolog annotation: Hit_ID=Q6F2D0; Match level="QueryCoverage=89%, HitCoverage=82%, E-value=1e-135, Identity=45%"; Hit description =Putative selenium-binding protein, related
  Pfam annotation: Domain name=PPR; Domain location=337-371; Score =27.7; E_value=4.2e-05; Accession=PF01535.11; Description=PPR repeat
  Pfam annotation: Domain name=PPR; Domain location=372-406; Score=1.5; E_value=4.9; Accession=PF01535.11; Description=PPR repeat
  Pfam annotation: Domain name=PPR; Domain location=408-441; Score=4.7; E_value=2.1; Accession=PF01535.11; Description=PPR repeat
  Pfam module annotation: Pfam domain module=PPR::PPR::PPR; Domain location=337-371::372-406::408-441
AVSTAAERTDLQFSGGYQNDDSSGYQQNRVGFYLESQNKADSYELLNKQRPDYVSQANAGQNSYGAGQIADGGHINVTRNVHNNLVGHNGSVNGYFGQGDMKMQQKVGAGVDNAWGSGMHANPFVEKHDWTQEPGQGMQSPNAYSSPGPLESQGNLRGDLNQNIDHFQQPQNVHYKGSHEMRPQYPGYGQSQQSLKDGQYLPNLNTAQRSVVGSHLSSNANPDGESAKASNDSPYRGTLEELDNFCIEGNVKEAVEVLELLEKLDIPVDLPRYLQLMHQCGENKSLEEAKNVHRHALQHLSPLQVSTYNRILEMYLECGSVDDALNIFNNMPERNLTTWDTMITQLAKNGFAEDSIDLFTQFKNLGLKPDGQMFIGVLFACGMLGDIDEGMQHFESMNKDYGIVPSMTHFVSVVDMIGSIGHLDEAFEFIEKMPMKPSADIWETLMNLCRVHGNTGLGDCCAELVEQLDSSCLNEQSKAGLVPVKASDLTKEKEKRTLTNKNLLEVRSRVREYRAGDTFHPESDKIYALLRGLKSQMKEAGYVPETKFVLHDIDQEGKEEALLAHSERLAIAYGLLNSPARAPMRAENSLFEMRKGSTILTMDYAPAGIIGEHELRTLCILGKMKEYKSLNPLCETLVKGTVQLAIGHGIIIQPRPDPSFEFRANA

SEQ ID NO: 134316 - protein, 483 aa, Glycine max
  Coding DNA Sequence Number=SeqID_17538
  Gene Ontology: Mol. function=amino acid transporter activity; Cellular component=membrane; Biological process=amino acid transport
  Homolog annotation: Hit_ID=Q1RZ34; Match level="QueryCoverage=98%, HitCoverage=97%, E-value=0.0, Identity=76%"; Hit description=Amino acid/polyamine transporter I
  Pfam annotation: Domain name=AA_permease; Domain location=56-471; Score=-73.8; E_value=0.0009; Accession=PF00324.11; Description=Amino acid permease
MEDSPLYSSTPSSQQQHLLNHHREESETEQQHGSNTKQHKKLALLPLVFLIYFEVAGGPYGEEAAVGAAGPLIAILGFVIFPFIWSIPEALLTAELATTFPGNGGFVIWANEAFGPFWGSLMGFWKFFSGVINLASYPVLCIDYLKLVIPILSSGFPRFVSISLSTCVLSFLNYSGLAIVGYTAVVLGVVSLLPFVLLSLFSLPKIDPSKWLSFGQEGVEKDWTLYFNTIFWNLNFWDSASTLAGEVEEPHKTFPKALLSAGLLTCLGYIIPLLATTGAMPLDQQSWVGGYFAHVAGVIAGNWLKIWMEIGAVLSIIGLFEAQLSSAAYQLLGMADLGFIPRIFGERSKWFNTPWMAILISTVVALGMSFLTFTEIISTVNFLYSLGMLLEFAAFLRLRRKFPALKRPFQVPLGFFGLIIMCLVPSILLVYVMTVASKIVYVASAFLTFLGIALYYFMNLSKSRKWLEFSRVGDKLGEDDYVL

SEQ ID NO: 134317 - protein, 421 aa, Glycine max
  Coding DNA Sequence Number=SeqID_17539
  Homolog annotation: Hit_ID=Q2R429; Match level="QueryCoverage=90%, HitCoverage=89%, E-value=1e-51, Identity=34%"; Hit description =Expressed protein
MSVVACLNCIAIPELEYRGMEGIPVRTVIPSATRRVPTQNRNLRFAVRAKLSPSDFQDFQSYARPSHLLPASEVKVYTNTSVENISSSLKEDGSKSLFRVKLVTSNAYGSAISDLSAGLLLCLIDENGNSILQRIPVSLMMGRSTESGDMTNIDMLHFQRGSLDEFIFEGPKIARLEALWVSVESGQWRLGSVSLMVISCEGKPSGLEDGVTSYTGFQYDFQIDDVLLGEGTDLSMLELRPSLVTELEGIDPISIFNKGLNDPTLFSSPKISNEESMKEYADLKFSLLFYDAMLTLFGTSVASLSAGENAGIAFLIGGIGGFLYLLLLQRSVDELPASELITNDKGRTDALFRGVKGPIASVALAIGLAVIASRYSSGDLELMLTPKDLIVGMMGFLACKVSVVLAAFKPITLGPKLPSDM

SEQ ID NO: 134318 - protein, 187 aa, Glycine max
  Coding DNA Sequence Number=SeqID_17540
  Homolog annotation: Hit_ID=Q10EV2; Match level="QueryCoverage=72%, HitCoverage=86%, E-value=5e-26, Identity=39%"; Hit description =Expressed protein
  Pfam annotation: Domain name=DUF538; Domain location=12-151; Score =125.7; E_value=1.3e-34; Accession=PF04398.3; Description=Protein of unknown function, DUF538
MATTTPSNRSSEAFALMAILSTLLCTAVAAKESVYEILPKYGLPSGLLPDTVTDYTLDEDGQFVVVLAKPCYIQFDYLVYYETKISGKLSYGSITNLKGIQVQRLFIWFNVDEIKVDLPPSNSIYFQVGIINKKLDVHQFKTVRSCRKSLSCPPCLPRPIQFHERCDLCHQIRGLQVGLLILFAVQH

SEQ ID NO: 134319 - protein, 195 aa, Glycine max
  Coding DNA Sequence Number=SeqID_17541
  Subcellular localization annotation: CTP_CleavageSite=24; ConfidenceScore=5.73e-01
MATPPGSPPPPPPSPPPLANPSASSSTVKRTCKATRLQSLAIRPPGAERPMVHVDPTTSKADGPQKKKLKTYLGIVAHDKVEFEIPETSDNRTKKKVLQTMGDKDGVDNTVYEKYSISKEKWAQFCQTHRDPSWEDVRKKVQAIQKQNTAPHVLCRGGYDYLEQKLMAEKTKKKLEEAAQSGSTEGVINPPSPIR

SEQ ID NO: 134320 - protein, 661 aa, Glycine max
  Coding DNA Sequence Number=SeqID_17542
  Gene Ontology: Mol. function=protein serine/threonine kinase activity; Biological process=protein amino acid phosphorylation
  Homolog annotation: Hit_ID=Q5ZC57; Match level="QueryCoverage=66%, HitCoverage=65%, E-value=3e-90, Identity=43%"; Hit description =Putative receptor serine/threonine kinase PR5K
  Pfam annotation: Domain name=Pkinase; Domain location=160-419; Score =74.8; E_value=2.6e-19; Accession=PF00069.15; Description=Protein kinase domain
  Pfam annotation: Domain name=Pkinase_Tyr; Domain location=161-419; Score=32.3; E_value=1.9e-14; Accession=PF07714.7; Description =Protein tyrosine kinase
  Pfam module annotation: Pfam domain module=Pkinase::Pkinase_Tyr; Domain location=160-419::161-419
DLYYNDNPKAEDASLRACTKVLLPIKDTPDANNPFTFATADIFTKVELTGECADCHYRRGGQCQLDSREIFFCATANSTLMNVQIVTISKEGGVNVTIIGLVVVVALVAVVLLMVLACSFRKKIFCMENPTHRIIEGFLKEHGPLPTTRYSYSEVKKMTNSFRNKLGQGGFGSVYKGKLHDGQVVAVKILNKSEGNGEEFFNEVASINSSKQALIYEFMPNGSLDKFIYEEKNPPGVARQLDCKLLYDIAIGIARGLEYLHRGCNTRILHFDIKPHNILLDEDFSPKISDFGLAKLCPRKESVVSILGARGTAGYIAPEVFSRNFGAVSHKSDVYSYGIMVLEMVGMRYNSKAEVNCSSEIYFPHWIYTHLESDQELGLQNIRNESDDKMVRKMTIVGLWCIQTYPPTRPAISRVVEMLESEVELLQIPPKPTFSSSATPPAHFSSETNDNEWTSEALNNTKILLTSTWESGQLLIKLLKTLEQHRLNQNRLQFLASDNFLNFWMRVIILDLKIKSEVSIPLQILRALPLPLLQPSLWCFHHRRVLTTIVPPSTSKCEPIHHCRSVIIRIFGLLFDLFCINPVLFLVVLIFEQAEVARRMLFEYCTPKKKIYAIPKPFDIEGAGGFEEIDTPKAPLRKPKSKLIVAGIRKGLDTYLEDLTS

SEQ ID NO: 134321 - protein, 563 aa, Glycine max
  Coding DNA Sequence Number=SeqID_17543
  Gene Ontology: Mol. function=protein kinase activity; Cellular component=cell surface; Biological process=protein amino acid phosphorylation
  Homolog annotation: Hit_ID=Q1RZG3; Match level="QueryCoverage=60%, HitCoverage=55%, E-value=1e-114, Identity=58%"; Hit description =Protein kinase
  Pfam annotation: Domain name=Pkinase; Domain location=259-533; Score =133.5; E_value=5.7e-37; Accession=PF00069.15; Description=Protein kinase domain
  Pfam annotation: Domain name=Pkinase_Tyr; Domain location=260-533; Score=76.8; E_value=7e-20; Accession=PF07714.7; Description=Protein tyrosine kinase
  Pfam module annotation: Pfam domain module=Pkinase::Pkinase_Tyr; Domain location=259-533::260-533
MIQLEKNGKSIVLTGVAQQNAISILDEDFHKLLQQDPCGTLKNNYSLPSPFSLYSIHIKFNVTLFRCKHSLKMKPPAHYFNHSCPDYDYDIYYDSLPSPNDKEVHSLFSSCSVIQISSKDLTNTNDILSFVSAEMVLQVVLSNDCDQCYNRWGGQCRLDANQEFYCEKAPKNKSKILKLVLVLGLVTALLSHPYIIIFLIPITSPAVTIALLLVMVMIYHTRWKKKQNPTNQQIKIFLERQGPLQTKRYDYSEIKKVTNSFRNKLGQGGFGSVYKGKLPDGRYVAVKILSELKDNGEDFINEVATISRTSHINIVNLLGFCCEGSKRALVYEFMSNGSLEKFIFEENVVKTDRQLDCQTIYHIAVGVARGLEYLHQGCNTRILHFDIKPHNILLDENFNPKISDFGLAKICTRKESMISIFGARGTAGYIAPEVFSRNFGAVSHKSDVYSYGMMILEMVGRRKNIKTEVNRSSEIYFPDWIYNCLESNQELGLQNIRNESDDKLVRKMTIVGLWCIQTHPSTRPAISKVLEMLGSKVELLQIPPKPFLSSPPTSPVHLSYETL

SEQ ID NO: 134322 - protein, 93 aa, Glycine max
  Coding DNA Sequence Number=SeqID_17544
MESSKITTSKGVWTILVPISITSGENEYKVTKQEEAEQINYSHTKFPLILGTTYCPKDRTGMDSSKIHTFANLQYTCQQVNNARVQLEQVITR

SEQ ID NO: 134323 - protein, 564 aa, Glycine max
  Coding DNA Sequence Number=SeqID_17545
  Gene Ontology: Mol. function=protein kinase activity; Cellular component=cell surface; Biological process=protein amino acid phosphorylation
  Homolog annotation: Hit_ID=Q1RZG3; Match level="QueryCoverage=60%, HitCoverage=55%, E-value=1e-113, Identity=58%"; Hit description =Protein kinase
  Pfam annotation: Domain name=Pkinase; Domain location=260-534; Score =131.8; E_value=1.8e-36; Accession=PF00069.15; Description=Protein kinase domain
  Pfam annotation: Domain name=Pkinase_Tyr; Domain location=261-534; Score=76.9; E_value=6.5e-20; Accession=PF07714.7; Description =Protein tyrosine kinase
  Pfam module annotation: Pfam domain module=Pkinase::Pkinase_Tyr; Domain location=260-534::261-534
MIQLELNGKGIVLIGVAQQNAISILDEDFHKRLQQNPCGTLKNNYSLPSPFSSLYSIHIKFNVTLFKCKQSLKMKPPTHYFNHPCPEYDYDIYYDSLPTPNSKEAHSLFSSCSVIQISTKDLTDTNDILSFVSAEMVLQVVLSNDCDQCYNHRGGQCRLDANQKFYCKEAPKNKSKILKLVLVLGLVTALLSHPYIIIFLIPITSPAVTIALLLVMVMIYHTRWKQKQNPTNQQIKIFLERQGPLQTKRYDYSEIKKVTNSFRNKLGQGGFGSVYKGKLPDGRYVAVKILSELKDNGEDFINEVATISRTSHINIVNLLGFCCEGSKRALVYEFMSNGSLEKFIFEENVGKTDRQLDCQTIYHIAVGVARGLEYLHQGCNTRILHFDIKPHNILLDENFNPKISDFGLAKICTRKESMISIFGARGTAGYIAPEVFSRNFGAVSHKSDVYSYGMMILEMAGRRKNIKTEVNRSSEIYFPDWIYNCLESNEELGLQNIRNESDDKLVRKMTIVGLWCIQTHPSTRPAISKVLEMLGSKVELLQIPPKPFLSSPPTSPVHLSYETL

SEQ ID NO: 134324 - protein, 563 aa, Glycine max
  Coding DNA Sequence Number=SeqID_17546
  Gene Ontology: Mol. function=protein serine/threonine kinase activity; Cellular component=cell surface; Biological process =protein amino acid phosphorylation
  Homolog annotation: Hit_ID=Q53VE0; Match level="QueryCoverage=65%, HitCoverage=55%, E-value=1e-107, Identity=54%"; Hit description =Ser/Thr protein kinase
  Pfam annotation: Domain name=Pkinase; Domain location=249-522; Score =122.8; E_value=1e-33; Accession=PF00069.15; Description=Protein kinase domain
  Pfam annotation: Domain name=Pkinase_Tyr; Domain location=248-522; Score=79.0; E_value=1.5e-20; Accession=PF07714.7; Description =Protein tyrosine kinase
  Pfam module annotation: Pfam domain module=Pkinase::Pkinase_Tyr; Domain location=249-522::248-522
CGILVIHGCDDKEPGAKKTIKCNNTWFDVVGLDQFTITIKDDKLHDLLLQRSCDTFSYSSTFTVSSPLLKASRLKHYLEILRCNHTLGHPPKKSVSNNTLCKNETLYSMVDPNPSGSGYSHHNGCSMLLIPTCLQLLDRHGHLYSSDPFEFITDNIAVEIELSPDCSTCIYAHGGQCRLDNTQKFYCYKVASAGGALGAMIFLIWCIRRRFYKKKNPTHQIIEMFLNTHGHLAAKRYSYSEIKKATNSFRYKLGHGGYGSVYKGKLQDGSLVAVKVLSDSIGNGEEFINEVASISVTSHVNIVSLLGFCLEGSKRALIYKYMPNGSLEKFIYEDKDPLKLNLQLSCKTIYNIAIGVARGLEYLHRGCNTKILHFDIKPHNILLDEDFCPKISDFGLAKICPKKESIVSLLGTRGTAGYIAPEVFSRNFGEVSHKSDVYSYGMMVLEMVGERVNNNVEVECSSEIYFPHWVYKRLELNQEPRLRSIKNESDKEMVRKLVIVSLWCIQTDPSNRPAMSRVVDMMEGSMESLQIPPKPYLSSPPRSPPRPSDHNTYTSHTTYPSEN

SEQ ID NO: 134325 - protein, 64 aa, Glycine max
  Coding DNA Sequence Number=SeqID_17547
MEPKFHNLKSKGSKIEQKQQFQPRHIKMKIELQSLLSWPLTIDKELRSQTKSQKAPQYTSGAEK

SEQ ID NO: 134326 - protein, 63 aa, Glycine max
  Coding DNA Sequence Number=SeqID_17548
MYPFYGPSRTNAPASSNIRTLYEPGGTFLLACQFLERSQTKAQKAPQYTSGAEKRMLRMQGGC

SEQ ID NO: 134327 - protein, 480 aa, Glycine max
  Coding DNA Sequence Number=SeqID_17549
  Gene Ontology: Mol. function=protein kinase activity; Cellular component=cell surface; Biological process=protein amino acid phosphorylation
  Homolog annotation: Hit_ID=Q1RZG3; Match level="QueryCoverage=85%, HitCoverage=64%, E-value=1e-115, Identity=51%"; Hit description =Protein kinase
  Pfam annotation: Domain name=Pkinase; Domain location=176-450; Score =129.3; E_value=1e-35; Accession=PF00069.15; Description=Protein kinase domain
  Pfam annotation: Domain name=Pkinase_Tyr; Domain location=177-450; Score=80.5; E_value=5.3e-21; Accession=PF07714.7; Description =Protein tyrosine kinase
  Pfam module annotation: Pfam domain module=Pkinase::Pkinase_Tyr; Domain location=176-450::177-450
MHNYTKCPDYDLYYNDNPKAEDASLRACTKVLLPIKDAPDANNPFTFATADIFTKVELTDECAACHYRRGGQCQLDSREIFFCATANSIAGRRSWIVKMILGLGLALLSHPYIIIFLIPITSPAVTIALLLVMVKIYHTRWKKQNPTNQQIRIFLEREGPLQTKRYDYSEIKKVTNSFRNKLGQGGFGSVYKGKLPDGRYVAVKILSELKDNGEDFINEVATISRTSHINIVNLLGFCCEGSKRALVYEFMSNGSLEKFIFEENVIKTDRQLDCQTIYHIAIGVARGLEYLHQGCNTRILHFDIKPHNILLDENFNPKISDFGLAKICTRKESMISIFGARGTAGYIAPEVFSRNFGTVSHKSDVYSYGMMILEMVGRRKNIKTEVNCSSEIYFPDWIYNRLESNEELGLQNIRNESDDKLVRKMTIVGLWCIQTHPSTRPAISKVLEMLGSKVELLQIPPKPFLSSPPTSPVHLSCETL

SEQ ID NO: 134328 - protein, 127 aa, Glycine max
  Coding DNA Sequence Number=SeqID_17550
MEAAVAPEQSCVVVDMKRSKVEAVRKRKSIIVSESFTTFVLQKVIEIFVSKMKSCERSSRTSEMLSNAGSSQLRMGNKPQSGRSVRVNGKLILLRYPHGNEGGHSAWFPAAKTSGKRPQNKSNNTNS

SEQ ID NO: 134329 - protein, 74 aa, Glycine max
  Coding DNA Sequence Number=SeqID_17551
MSLPSPNDKEVHSLFSSCSVIQTSSKDLTDTNDIQSFVSAEMCYNHRGGQCRLDANQKFYCEKDTLHMNFSFIP

SEQ ID NO: 134330 - protein, 160 aa, Glycine max
  Coding DNA Sequence Number=SeqID_17552
  Gene Ontology: Mol. function=protein serine/threonine kinase activity; Cellular component=membrane; Biological process=protein amino acid phosphorylation
  Homolog annotation: Hit_ID=Q1RZG3; Match level="QueryCoverage=45%, HitCoverage=13%, E-value=2e-17, Identity=53%"; Hit description =Protein kinase
MKPPTHYFNHPCPEYDNDIYYDRLPSPNDKEVHSLFSSCSVIQISSKDLTVKNSPTSVRIEGLSLTPDWEHGPLPTARYSYSEVKKTFGSVYKGKLQNGRAVAVKILNKPEGSGEEFINEFASISRTPHVNIVRLLGFCLETEMKLQVLARGTAGINTWC

SEQ ID NO: 134331 - protein, 488 aa, Glycine max
  Coding DNA Sequence Number=SeqID_17553
  Gene Ontology: Mol. function=protein kinase activity; Cellular component=cell surface; Biological process=protein amino acid phosphorylation
  Homolog annotation: Hit_ID=Q1RZG3; Match level="QueryCoverage=86%, HitCoverage=64%, E-value=1e-117, Identity=52%"; Hit description =Protein kinase
  Pfam annotation: Domain name=Pkinase; Domain location=184-458; Score =131.3; E_value=2.6e-36; Accession=PF00069.15; Description=Protein kinase domain
  Pfam annotation: Domain name=Pkinase_Tyr; Domain location=185-458; Score=75.8; E_value=1.4e-19; Accession=PF07714.7; Description =Protein tyrosine kinase
  Pfam module annotation: Pfam domain module=Pkinase::Pkinase_Tyr; Domain location=184-458::185-458
MYHYTKCPDYDLYYNNNPKAEDASLRACTKALLPIKDVPDANNPFTFVTADISTIVVLTDECAACHYRRGGQCQLDSREIFFCATANSIGVILISAAGRRSWILKMILGLGLALLSHPYIIIFLIPITSPAVTIAALLLVMVKIYHTRWKKQNPTNQQIKIFLEREGPLQTKRYDYSEIKKVTNSFRNKLGQGGFGSVYKGKLPDGRYVAVKILSELKDNGEDFINEVATISRTSHINIVNLLGFCCEGSKRALVYEFMSNGSLEKFIFEENVIKTDRQLDCETIYHIAIGVARGLEYLHQGCNTRILHFDIKPHNILLDENFNPKISDFGLAKICTRKESMISIFGARGTAGYIAPEVFSRNFGAVSHKSDVYSYGMMILEMVGRRKNIKTEVNRSSEIYFPDWIYNCLESNQELGLQNIRNESDDKLVRKMTIVGLWCIQTHPSTRPAISKVLEMLGSKVELLQIPPKPFLSSPPTSPVHLSCETL

SEQ ID NO: 134332 - protein, 157 aa, Glycine max
  Coding DNA Sequence Number=SeqID_17554
MEPPSQIVSLRTTTTDPDHVKVIQWDDFQHDLARLASLSSALHEANEKKRNLQHKLESLIQWPEVRRVWCRGECELEWRMESRSVFDYEISWRKEMELGRGDECYFIPILFSDCGFKVGDQEALDLDHCLVMLRVSCLWAAPWKPAMSQLTVVPGVT

SEQ ID NO: 134333 - protein, 91 aa, Glycine max
  Coding DNA Sequence Number=SeqID_17555
  Gene Ontology: Mol. function=protein binding; Cellular component =cytoskeleton; Biological process=actin filament polymerization
  Homolog annotation: Hit_ID=Q1SDX9; Match level="QueryCoverage=64%, HitCoverage=46%, E-value=2e-21, Identity=83%"; Hit description=ARP23 complex 20 kDa subunit
MANTLRLYLTCIRNTLEAAMCLQNFPCQEVERHNKPEVELKTSPELLLNPIPIRRKAGACRHCAIYSIKSSISGLSGVLDFKTYLIPPFSL

SEQ ID NO: 134334 - protein, 356 aa, Glycine max
  Coding DNA Sequence Number=SeqID_17556
  Gene Ontology: Mol. function=nucleotide binding
  Homolog annotation: Hit_ID=Q84T10; Match level="QueryCoverage=81%, HitCoverage=11%, E-value=1e-63, Identity=42%"; Hit description =Unknow protein
MASSKKKTMEGLMSGPFIFIPYSSVYDHDDAACGTFVSPNEVYWHDSTGSIQKMKEFHPQCGSSSSPINKSLCNIYPSLRGFFVDECQVQEAPPLCSYIQIMLQLSTVTLPSQAADKILQVFLKWADGLKSGLLSVEDVTYLKECLSKLEFPVLPTVQDKWVSLHPSFGLVCWCDDKKLKKEFKHSDNLDFLYFGELVEDDKEMGQEKISILMKNLGIPAISEVVTREPIYYGLADCSLKKSLVNWTLPYAQRYIHKFHIDKYDKLKQSGFDIFNHLNVIVVEKLFYRNVIKTCGSVSKKRVECSCLLQPKIPLDDFLQPPFWSPTTPFYQTNNHAIYSSNGHLLLWPSLYMPKSP

SEQ ID NO: 134335 - protein, 1482 aa, Glycine max
  Coding DNA Sequence Number=SeqID_17557
  Gene Ontology: Mol. function=nucleotide binding
  Homolog annotation: Hit_ID=Q84T10; Match level="QueryCoverage=95%, HitCoverage=45%, E-value=0.0, Identity=43%"; Hit description=Unknow protein
VSSIKSGMRNNIYDTFQAIIDNGLGNSPTKGSEYDTIDVGPGQENVPVITKDNTENTNCENWVAEQFGMKKFDSLGYGDFLSFLEKHPNLLPHELLKLLVGDTCENSSFRACMSSNQLIALVSQALSGLWENETITKQMISMLLMRQFPSINFELVENGSLVDLLDTVKGHTSSVTSKCVVFSATIIEKNYNGDSSSDRDNNWSEIPTDRSETSHKKSTETVIAKNAIEVLLKAPMLSDLSKWSHWDLRFAPFLGPFISWLLNDVNTKELFCLVTRDGKVIRIDHSATLDSFLEAAVQGSSFQTAVHLLSLISLVGGEKYVPLSLLKCHSCHAFEVMFRNSVEDVEVSNDGNALHQSVEALSKTKFLTEISTAKMRSVFSKHMHKVSKVASILSRFVLDCLGNLPAEFHSFASDVLLSGMQSVFKDAASTILCECSNMEQRLMLHEIGLSLGISEWINDYHALISNNSSDIHCARVSCLKDATTDINTSLKLDQVTLDKSPIPEANMVTSLVPHRLIEGCTEIIETVDPEKSNDESNTCCLGNSFQHVEDMDASRLIESIRRDEFGLDSSLSDIDSCMLKKQHARLGRALHCLSQELYSQDSHFILELVQNADDNNYPENVEPTLTFILRDSGIVVLNNERGFSAQNMRALCDVGNSTKKGSTAGYIGKKGIGFKSVFRVTDAPEIHSNGFHVKFDISEGQIGFVLPTVVPPCDIGVLRRMASTDTELCDDNPWNTCILLPFRSHLSEGMAMNSVLSMFSDLHPSLLLFLHRLKCIKLRNLLNDTLTVMKKEISGDGIIKVSHGKEKIVWFVVSQKLQTNSIRFDVQTTEISMAFTLQESDNGYIPCSDQQPVFAFLPLRTYGLKFILQGDFVLPSSREEVDGDSPWNQWLLSEYPNLFVRAQREFCELPCFRSEPGKGLSAFMSFVPLVGEVHGFFSSLPRLIISKLRMMNCLLVDGDNNEWAPPCKVLRGWTEQVRNLIPDNMLLEHLGLIYLDRNIVLSDELARALGIEEFGPNILVRVLSSLCHTKSGLISMDMSWLASCLNILSVTMFNSSGSVPINFEMKDVQKNLQKMPFIPLSDGTYSSVDEGTIWLHFNHLNTGFDGEHKIEAFPNICAKLRTVSPFLFSASSGTPSLNVTFLDNVTRLLQSIGVQQLSVHDVVKLHILPALSDETMANKNRVLMIEYVCFVMLHLNSSCSDCFIEREHIISEFRCKSLLLTNYGFKCPAEIPIHFCTGFGNPVTPKMLADSVSMRWHEVDISYLSHPVNESVSSALIKWRDFFEKFGITDFAQVVQVDKSVVDICDVTFKQMMWDRGLISAESIVKDWESSEIVQLVSLLSKSGNLENCKYLLEVLDTLWDVCYSNKTTGYFYLKSVGDGHPFKSTFICSLCDIQWVVSTMDDELHYPKDLFYDCETVRMLLGDFAPYAVPKVKSERLVKDFGFKTRVTLDDIFDVLKAWRKSSKTPFKASTSRYDIEDRYM

SEQ ID NO: 134336 - protein, 182 aa, Glycine max
  Coding DNA Sequence Number=SeqID_17558
  Gene Ontology: Mol. function=methyltransferase activity; Biological process=metabolic process
  Homolog annotation: Hit_ID=Q6X0N8; Match level="QueryCoverage=85%, HitCoverage=20%, E-value=9e-75, Identity=87%"; Hit description =Putative spermine/spermidine synthase
  Pfam annotation: Domain name=Methyltransf_11; Domain location=67-163; Score=15.1; E_value=0.0018; Accession=PF08241.2; Description =Methyltransferase domain
MGSKAKKKGSPEDILETLGDFTSKENWDNFFTLRGDSFEWYAEWPHLRDPLLSLLKTIPLPLPLQLLVPGCGNSRLSEHLYDAGHTAITNIDFSKVVIGDMLRRNVRDRPLMRWRVMDMTVMQFEDESFGAVIDKGGLDALMEPELGPKLGNQYLSEGSTLVDGKNVVGRENPTTVGQPGFR

SEQ ID NO: 134337 - protein, 152 aa, Glycine max
  Coding DNA Sequence Number=SeqID_17559
  Homolog annotation: Hit_ID=Q9AVH2; Match level="QueryCoverage=26%, HitCoverage=14%, E-value=6e-16, Identity=97%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCAKSTVPLVLG

SEQ ID NO: 134338 - protein, 47 aa, Glycine max
  Coding DNA Sequence Number=SeqID_17560
MPRPDKPNWPTMHSRSAPHLALSAFRSCAGRAMHAGPVLLLDRALGA

SEQ ID NO: 134339 - protein, 119 aa, Glycine max
  Coding DNA Sequence Number=SeqID_17561
MGDVVPPKGPWDYTLDYLPWFYRVSHPYAILPEEGECPRPSVHLLPILMQLSPAQPLAEYVPGGVYFCQLLIEIVLPGSISDFVKHHAKLVGLYNHAKGHKSSLDYTSSSAIAAGRLRS

SEQ ID NO: 134340 - protein, 156 aa, Glycine max
  Coding DNA Sequence Number=SeqID_17562
  Subcellular localization annotation: CTP_CleavageSite=51; ConfidenceScore=5.84e-01
MAALQKFKLFATPCGVGQSPTQSPRTSPLVQFRRPKTTLRSLLSLNRSLRRQENVVEKNPMRRHSLKALFVSSPPREERVHENETTPMLASVAVPHSSWSNEPGSTNPPWAGFRCRKTKKQKGKVELELCKERRETRHELGEVKNTFIKHEQSVSG

SEQ ID NO: 134341 - protein, 158 aa, Glycine max
  Coding DNA Sequence Number=SeqID_17563
  Homolog annotation: Hit_ID=Q1T1F7; Match level="QueryCoverage=53%, HitCoverage=16%, E-value=4e-11, Identity=43%"; Hit description=IMP dehydrogenase/GMP reductase
  Pfam annotation: Domain name=DUF1723; Domain location=20-69; Score =51.5; E_value=2.8e-12; Accession=PF08330.1; Description=Protein of unknown function (DUF1723)
MRVYVLRLGLSVLVMMRYPTANKGFMNALVERWHQEISSFHLHVKEMTITLDDVSCLLHLSMTGRPIDHVPSTFTREVVKVLFMTRLGILIEEEATAMITVGAKVRLTWLTGPYNWYIQSGSYVWATIAYLLHLVDNMIFFYNPRLTSMSPTSSTSTT

SEQ ID NO: 134342 - protein, 70 aa, Glycine max
  Coding DNA Sequence Number=SeqID_17564
MCYNILQSKSLVRTCSNRKERRVFKKEFPGSKEYLRSTKLRQERGLRAIGQFELVYGRVEVEAARVLDLA

SEQ ID NO: 134343 - protein, 659 aa, Glycine max
  Coding DNA Sequence Number=SeqID_17565
  Gene Ontology: Mol. function=transferase activity, transferring nitrogenous groups; Cellular component=mitochondrion; Biological process=biosynthetic process
  Homolog annotation: Hit_ID=Q9L232; Match level="QueryCoverage=55%, HitCoverage=92%, E-value=1e-135, Identity=68%"; Hit description=2 -amino-3-ketobutyrate coenzyme A ligase
  Pfam annotation: Domain name=ADH_N; Domain location=5-92; Score=76.9; E_value=6.2e-20; Accession=PF08240.2; Description=Alcohol dehydrogenase GroES-like domain
  Pfam annotation: Domain name=ADH_zinc_N; Domain location=120-261; Score=112.0; E_value=1.7e-30; Accession=PF00107.16; Description=Zinc- binding dehydrogenase
  Pfam annotation: Domain name=Aminotran_1_2; Domain location=335-658; Score=257.3; E_value=3.1e-74; Accession=PF00155.11; Description =Aminotransferase class I and II
  Pfam annotation: Domain name=Aminotran_3; Domain location=337-610; Score=-175.7; E_value=0.0075; Accession=PF00202.11; Description =Aminotransferase class-III
  Pfam annotation: Domain name=Aminotran_5; Domain location=353-658; Score=-147.5; E_value=6.1e-05; Accession=PF00266.9; Description =Aminotransferase class-V
  Pfam annotation: Domain name=DegT_DnrJ_EryC1; Domain location=348 -659; Score=-206.7; E_value=0.048; Accession=PF01041.8; Description =DegTDnrJEryC1StrS aminotransferase family
  Pfam module annotation: Pfam domain module=ADH_N::ADH_zinc _N::Aminotran_1_2::Aminotran_3::Aminotran_5::DegT_DnrJ_EryC1; Domain location=5-92::120-261::335-658::337-610::353-658::348-659
MLRWDEWAASAIDAPLIPGHEFYGEVVEVGAGVRDIVVGDRVSGEGHIVCGTCRNCRAGRRQMCIRTIGLGLQRDGAFAEYLSLPATNVWVHHSEVAPELGAIFDPLGNAVHTALTYPLVGEDVLVTGCGPIGLMAIAVARHAGARFIAATDVSTPRLEMARRMGADEVVDVSVRDIRDAQRALGMREGFDIGFEMSGAPSALPGMIDNMNHGGRIAMLGLPSAGFGIDWGKLVTHMLTIKGIYGREMFETWNAMGAMLQTSATLRDAIGRVIAEVVPAREWERGFAAAESAAVMYGTFQKHVAGELAGIEEAGLTKHERGIRGPQSAQITADGAEVLNFCANNYLGLADDPRILDAATTALQEWGYGLASVRFICGTQEQHLELERRLADFLGTDDAILYSSCFDANGGVFETLFGAEDAIISDELNHASIIDGIRLSKARRLRYRNRDMADLEEQLRAAADARFRVVVTDGVFSMDGYIAPLAEICDLAERHDALVFVDDSHAVGFIGENGRGTPELCGVADRVDIYTGTFGKALGGASGGYVAAHAEIVALLRQRSRPYLFSNTLAPAIVAGTLTALDLVEGSADLRARLRENAALFRERMAAEGFDLLPGEHPIVPVMFGDAVKTARIAREMQDRGVYVTAFSFPVVPRGLARIR

SEQ ID NO: 134344 - protein, 43 aa, Glycine max
  Coding DNA Sequence Number=SeqID_17566
MSSKTCSLLTSAPDRTCSTKQSSESDQFPLLNDPNKACIYVIK

SEQ ID NO: 134345 - protein, 641 aa, Glycine max
  Coding DNA Sequence Number=SeqID_17567
  Gene Ontology: Mol. function=protein serine/threonine kinase activity; Cellular component=integral to membrane; Biological process=protein amino acid phosphorylation
  Homolog annotation: Hit_ID=Q9C6K9; Match level="QueryCoverage=94%, HitCoverage=90%, E-value=1e-126, Identity=45%"; Hit description=Wall- associated kinase, putative
  Pfam annotation: Domain name=APH; Domain location=332-514; Score= -15.4; E_value=0.071; Accession=PF01636.13; Description =Phosphotransferase enzyme family
  Pfam annotation: Domain name=Pkinase; Domain location=330-602; Score =138.0; E_value=2.5e-38; Accession=PF00069.15; Description=Protein kinase domain
  Pfam annotation: Domain name=Pkinase_Tyr; Domain location=330-602; Score=127.7; E_value=3.3e-35; Accession=PF07714.7; Description =Protein tyrosine kinase
  Pfam module annotation: Pfam domain module=APH::Pkinase::Pkinase_Tyr; Domain location=332-514::330-602::330-602
MSLVYVILLISCVMVVLLSAGNANGHHDDCPDSFDCGTLGTFSFPFTTVERHNCGVLAIQGCNDPNQTSVKYVQLNNKGKPFQVTHVSSHGRRPRSISIIDMEFSKLLENGSCAVFNYNITVPPSSPMGYFDLQNNISTFNCSRHQHKLNHTNDFINYTNDFINYTSTRCPSSVFYFAPPSYYDQSLRSLISLCSMVKLPVRQDSQFIKNPFGFLNAEITFEFQFSSECHQCYNEERGDHCRLDSNGTFYCAKRKTRVSTRKLALMLGTGVGPWIIFGLFLTLRHCKRKYGQSSITNADPYPSRDTENDRIFFGVPIFSYKELQEASNNFDPTRKLGDGGFGTVYYGTLRDGREVAIKHLFEHNYKRVEQFMNEIEILTRLRHRNLVSLYGCTSRHGQELLLVYEYVPNGTVASHLHGDLARVGLLTWPIRMQIAIDTAAALTYLHASNIIHRDVKTNNILLDISFSAKVADFGLSRLLPNDVSHVSTAPQGSPGYLDPEYFQFYRLTDKSDVYSFGVVLIELISSMPAVDAARERDEVNLANLAMKKIQKGKLSELVDPSLGFESDQVVKRMLTSVAGLAFRCVQGDNELRPSMDEVLEALKKFQNGNYESENLEKGDDDGVISSTSSSEVHPPVYTGIW

SEQ ID NO: 134346 - protein, 87 aa, Glycine max
  Coding DNA Sequence Number=SeqID_17568
MVASAWKEYALQRPYQTCAKARVISEIEEVHVQMKADMEVMKEQMTTMMDAMMSMRKMMEVNMAIVVAAVDAIDFDVLMMIMMMCCN

SEQ ID NO: 134347 - protein, 620 aa, Glycine max
  Coding DNA Sequence Number=SeqID_17569
  Homolog annotation: Hit_ID=Q6D476; Match level="QueryCoverage=38%, HitCoverage=94%, E-value=4e-90, Identity=64%"; Hit description =Copper homeostasis protein cutC
  Pfam annotation: Domain name=CutC; Domain location=2-201; Score =332.1; E_value=9.5e-97; Accession=PF03932.5; Description=CutC family
MTKLEICCYGIDCAMTAQASGADRVELCSAPREGGLTPSAGMLEAAQRELTIPVHPIVRPRGGDFCYTAREFEVMKSDVARIRELGFPGLVIGMLDEDAHVDTVRMQQIMALCDGMAVTFHRAFDLCHSPKRSLEVLTDLGIARILTSGQQQSAETGIALLRELNEYSTGPIIMAGAGVRLSNLQKFLDSGLQEVHSSASRAVASPMRYRKAGVSMCSEAETDEFSRSCVDGDVVEAMKSMMQMSVDRRIGEKDALITLWLNARITLMKSLPYAVVILLFPVAGAALAASSTCPPLSKNITSSNNWIMLGGDAKGAVRQVVAGEFGKDVNSQKRVLGQFDQCGDLMVADITYDKSEGNVVLSMEQHIARVQRGWVADYAYLVKVTRAGKEEVVDNRQGTISWQMGQHGNIISASDKFTSMGKEGFTDTTYRYDKHFRLEKSIARGSDELTNGENTWRWNPQGLVVASTSARSKDTYSYDNQWRELRLHGTSTTPVSTLRSVDECQLWDEVGNCTLSYLHETEVFAKGTIERHLSSAYKYQYWDLHNPGAHHDTDYFIPFRHYPAYADARLRYRAGAAFSGCAGLAACLSDGIGRYARLSGVGRGGRTGLRRAAAGFGNGL

SEQ ID NO: 134348 - protein, 221 aa, Glycine max
  Coding DNA Sequence Number=SeqID_17570
  Gene Ontology: Mol. function=transferase activity, transferring nitrogenous groups; Biological process=biosynthetic process
  Homolog annotation: Hit_ID=Q2NTK0; Match level="QueryCoverage=99%, HitCoverage=92%, E-value=9e-66, Identity=55%"; Hit description =Putative aminotransferase
MAFDFDQGIDRRHSDSLKWHKYGDRDVLPLWVADTDFRSPPCIIEAIKQRADHGVFGYGATPHGLIDITISRLAQRYGWQIEPEWIVLLPGVVSGLNLSVRAFTESSQSTVAPTPIYPPFRAAARLAQRAQVNLPLQLQQDRWVMQLDDSQMQGNERLLMLCNPQNPGGTVYRRDELEAQLAFAQRHDLLVCSDEIHCDLLLTPGVQHIPFASLSEDAAQR

SEQ ID NO: 134349 - protein, 235 aa, Glycine max
  Coding DNA Sequence Number=SeqID_17571
MFPVYMIFPMMLLILSIGNGNGHKEECPLWFDCGNHGRFEWPFTKVEHQDCGIWPIHGCDDDLINPNYVLLKIGPSSIKVQKFEMQRFATIVYFTDHHLRNLLQSDSCEIFSYNITLPPSSPLGYFTINNNITLFKCNRTLQVNTPKTFLKNTSCGYDIFMGPPHSDDVSQGSLAACSMVQLPMNGFAVSANPFAFLTAEISVQFLPSDECMQCHHYRGHCHLDSQRKVNCAQSL

SEQ ID NO: 134350 - protein, 586 aa, Glycine max
  Coding DNA Sequence Number=SeqID_17572
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=58%, HitCoverage=54%, E-value=1e-112, Identity=60%"; Hit description=Wall- associated kinase, putative
  Pfam annotation: Domain name=APH; Domain location=77-255; Score= -15.7; E_value=0.075; Accession=PF01636.13; Description =Phosphotransferase enzyme family
  Pfam annotation: Domain name=Pkinase; Domain location=74-343; Score =159.0; E_value=1.2e-44; Accession=PF00069.15; Description=Protein kinase domain
  Pfam annotation: Domain name=Pkinase_Tyr; Domain location=74-343; Score=150.5; E_value=4.3e-42; Accession=PF07714.7; Description =Protein tyrosine kinase
  Pfam annotation: Domain name=RIO1; Domain location=87-243; Score= -82.1; E_value=0.0061; Accession=PF01163.12; Description=RIO1 family
  Pfam module annotation: Pfam domain module=APH::Pkinase::Pkinase _Tyr::RIO1; Domain location=77-255::74-343::74-343::87-243
MAGLGVAPAWMIIIFGLILTLRRCKRQYGLAQTQLQSRNTRIDPYEKSDSMTDRIFFGVPVFSYKELQEATNNFDHKTKLGEGGFGSVYYGKLQDGREVAVKHLFEHNYKRVQQFMNEIEILTHLRHRNLVSLYGCTSRHSRELLLVYEYVPNGTLAYHLHERDDSLTWPIRMQIAIETATALAYLHASDIIHRDVKTSNILLDNNFWVKVADFGLSRLLPNDVSHVSTAPQGTPGYLDPEYFQHYQLTDKSDVYSFGVVLIELISSMPALDAAREIDEINLANLAIKRIQNGKLGELVAKSLGFDSDQEVTRTLASVAELAFRCVQGDRQLRPCMDEVVEALQKIQSGNYESEDVEKGGIWHSEGESNFSVHRGLGLGSKGNANGHRDDCPDSFDCGSIGKIYFPFTTVERHNCGVLAIRGCNDSDQTSAKHDFRGLLENGSCKALSYNIRVPPSSAFGYFDVQNNISIFNCSRHLRKLNHINGFINYTSTRCPSSVYYFAPPSTDDQTLRSLTSSCSMVQLPKRIDSEFFKGDPFGFLTAEITFEFTFSHDCIRCHEEGRGFCRPDSNGKFHCASPTTPTTPTR

SEQ ID NO: 134351 - protein, 226 aa, Glycine max
  Coding DNA Sequence Number=SeqID_17573
  Gene Ontology: Mol. function=hydrolase activity; Biological process =aromatic compound metabolic process
  Homolog annotation: Hit_ID=Q2T3Z1; Match level="QueryCoverage=95%, HitCoverage=96%, E-value=8e-29, Identity=35%"; Hit description =Hydrolase, alpha/beta fold family
  Pfam annotation: Domain name=Abhydrolase_1; Domain location=27-216; Score=22.1; E_value=0.00015; Accession=PF00561.10; Description =alphabeta hydrolase fold
  Pfam annotation: Domain name=PGAP1; Domain location=3-169; Score= -90.6; E_value=0.053; Accession=PF07819.3; Description=PGAP1-like protein
  Pfam module annotation: Pfam domain module=Abhydrolase_1::PGAP1; Domain location=27-216::3-169
MRAPVLLVHGLFGSLSSPGILAPFGERRVYTPDLIGYGQCLNKGNKGWTLNDQADHLADFVNARKCGPVHLAGHSVGGAVAVLMAKRYPEKVRSLTLIEGNLTLNDAFWSQKISSQSLEEIQAEVSAFRADVAAWVEGAGVARAVVAATAEASYLEGLRHILSSLMPVHLISGENSQSGWHVPSWLKERAATYTVIPDTGHLMMIERPETFARSADIMRCTDWFCF

SEQ ID NO: 134352 - protein, 349 aa, Glycine max
  Coding DNA Sequence Number=SeqID_17574
  Gene Ontology: Mol. function=DNA binding; Biological process=DNA recombination
  Homolog annotation: Hit_ID=Q6D559; Match level="QueryCoverage=96%, HitCoverage=96%, E-value=0.0, Identity=94%"; Hit description =Prophage integrase
  Pfam annotation: Domain name=Phage_integrase; Domain location=164 -325; Score=68.5; E_value=2.2e-17; Accession=PF00589.13; Description =Phage integrase family
MFALGEYPAIKLAEAREKCEQARKQVADGVSPTQARQLDKIRKVNDASNTFELIAKEWLQMKDWAEITKTRRLDMLERVVFPAIGKLPVREITPHHILKILQETAKRGAPTVAAEARRTISSVFELAVATLRADSDPVWPVRKALPANKTQHKQALNPQQIGKLLSCFDNSRGSYQVNYCMWLMWWTLARPAEVTEAEWAEFDLDNALWTIPATRMKARREHVIPLPSQSVNMLRTLQGLTGHRHHLFPGRDDPRGPMTSHSLRQLLKSLGWSGTYSPHATRTTGSTRLNEMGYRPDAIEAQLAHADTNNVRRTYNHATYLDERKVMMQEWADKLDGWVSSTDISVDVS

SEQ ID NO: 134353 - protein, 180 aa, Glycine max
  Coding DNA Sequence Number=SeqID_17575
  Gene Ontology: Mol. function=DNA binding; Biological process=DNA recombination
  Homolog annotation: Hit_ID=Q1HA46; Match level="QueryCoverage=96%, HitCoverage=24%, E-value=1e-68, Identity=71%"; Hit description=Site -specific recombinase, phage integrase family
MLCARAGVPAEDSGGTITSHRGRASAVTALASVPQGMSLYELMQWTGHSTPQSTMHYLRIRPTQLAASFVKADRVAHMISVLIDHDPEAACLTGPATYYDLGDSYCTNPFWSSCQHRMACIGCDFNLLKQSARGLVLESKASVRRYLEEVPLTPDERTIVEQDAEKIEQALQKLALKPEG

SEQ ID NO: 134354 - protein, 98 aa, Glycine max
  Coding DNA Sequence Number=SeqID_17576
  Gene Ontology: Mol. function=transcriptional repressor activity; Biological process=regulation of nitrogen utilization
  Homolog annotation: Hit_ID=UPI000052DC82; Match level="QueryCoverage =99%, HitCoverage=30%, E-value=4e-31, Identity=73%"; Hit description =NmrA family protein
MNKTDLNTTSGNILVLGAGELGLPVLRNLALRAKDVEGAKISVLLRESTITSDQPGKQLVITEIRNLGINIVAGDLVMSSVDELAALFAQFDTVAGCA

SEQ ID NO: 134355 - protein, 407 aa, Glycine max
  Coding DNA Sequence Number=SeqID_17577
  Gene Ontology: Mol. function=serine-type peptidase activity; Biological process=metabolic process
  Homolog annotation: Hit_ID=Q6D8Q7; Match level="QueryCoverage=71%, HitCoverage=90%, E-value=8e-57, Identity=42%"; Hit description =Putative exported protein
  Pfam annotation: Domain name=Abhydrolase_3; Domain location=160-384; Score=12.4; E_value=1.8e-08; Accession=PF07859.3; Description =alphabeta hydrolase fold
  Pfam annotation: Domain name=DUF24; Domain location=38-125; Score =63.8; E_value=5.7e-16; Accession=PF01638.8; Description =Transcriptional regulator
  Pfam annotation: Domain name=PadR; Domain location=26-114; Score= -16.3; E_value=0.074; Accession=PF03551.5; Description=Transcriptional regulator PadR-like family
  Pfam annotation: Domain name=Peptidase_S15; Domain location=137-382; Score=-91.2; E_value=0.0027; Accession=PF02129.9; Description=X-Pro dipeptidyl-peptidase (S15 family)
  Pfam annotation: Domain name=Peptidase_S9; Domain location=175-405; Score=-30.5; E_value=2.1e-05; Accession=PF00326.11; Description =Prolyl oligopeptidase family
  Pfam module annotation: Pfam domain module=Abhydrolase_3::DUF24::PadR: :Peptidase_S15::Peptidase_S9; Domain location=160-384::38-125::26 -114::137-382::175-405
MIPGSDEVDRDEILKYSQAVCQGLREDDDGLRRELLAHAGSRWSLGIINTLGVYGRLRHAEIGRRMHGVTQRMLTRTLRQLERDGLVIRHDFNEIPPRVEYELSDTGNVHGAEIIQVTLNRPPIDNISDVVYETVKKTRSVRQLHMSFLVPRTSDLKPAIIYFPGGGFMTAEHNKFLEMRLALAEAGFVVAAAEYRTIPDIFPAPLIDAKSAVRYLRQHAPDYGIDPSRIGVLGDSAGGWLAQMLGTTNGDKSFDHGNFLSQSADVQAVTTLYGISDLRNIGDGFPEHRQKVHQSPAVTESLLVNGVAFRDFEGTSISSTPEKAINASPIGHIKGCRPPFLIMHGSKDTLVSPNQSVTLYKALLESGNKADYVLIEGAEHGDDHWYQPVVINRVVNWFRGHLFPKNT

SEQ ID NO: 134356 - protein, 480 aa, Glycine max
  Coding DNA Sequence Number=SeqID_17578
  Gene Ontology: Mol. function=protein serine/threonine kinase activity; Biological process=protein amino acid phosphorylation
  Homolog annotation: Hit_ID=Q9C6K9; Match level="QueryCoverage=93%, HitCoverage=72%, E-value=4e-79, Identity=43%"; Hit description=Wall -associated kinase, putative
  Pfam annotation: Domain name=Pkinase; Domain location=307-472; Score=- 62.5; E_value=7.7e-05; Accession=PF00069.15; Description=Protein kinase domain
  Pfam annotation: Domain name=Pkinase_Tyr; Domain location=307-479; Score=-57.5; E_value=6e-09; Accession=PF07714.7; Description=Protein tyrosine kinase
  Pfam module annotation: Pfam domain module=Pkinase::Pkinase_Tyr; Domain location=307-472::307-479
MFSPLINKTLIIFLSQLLLLVSAQDDGKCSPSFNCGYLGLIKFPFTTTKQPHCGLLAIHGCEEHDPYAPKTVKLSNSTSRSYTVLQVEPRTIGILDEKQDHYLKTRNCTIFTGVNFTLPHTSPLASFHIKYNITIFRCNHSLKIVTFPKYFYRYSNCPEYDIYYGLPNTETPLGFKWPSSLAPCSTTQLAVDKISTRNPFQFLSGIMIIEVRLSDECERCLLDGKNRCLLDSKGKFYCARGNKNLAWILGLGIGLPGIIIIGLLIIWHCKPRYVSDFYSNPYPESASIYSGVPVFTFKDLEIATKCFDSSRELGEGGFGIVYYGKLQDGREVAVKRLYENNYRRVEQFMNEIKILMNLRHTNLVSLYGSTSRHSRELLLVYEYISNGTVASHLHHYGSTNTGFLPWPIRMKVAIETATALAYLHASDIIHRDTLDCQDCSPMMSHTFPQLPKEHLAMLIRNITDATSLQTRVMCIVSGLC

SEQ ID NO: 134357 - protein, 66 aa, Glycine max
  Coding DNA Sequence Number=SeqID_17579
  Subcellular localization annotation: CTP_CleavageSite=30; ConfidenceScore=5.15e-01
MVSNASKKKAAAVMAATSSKAADKVANGITDMQISDRTYTSRDIRNRLQNRTGFKNRNQNRTAFEN

SEQ ID NO: 134358 - protein, 89 aa, Glycine max
  Coding DNA Sequence Number=SeqID_17580
  Gene Ontology: Mol. function=protein serine/threonine kinase activity; Cellular component=integral to membrane; Biological process=protein amino acid phosphorylation
  Homolog annotation: Hit_ID=Q5N7Q8; Match level="QueryCoverage=94%, HitCoverage=12%, E-value=1e-30, Identity=76%"; Hit description=Wall -associated kinase 4-like
MAYPNESCHKDCYCFSLSPDIIHRDVKTNNILLDNSFCVEVADFGLSRLFPNDVTHVSTAPQGTPGYVDPEYHRCYQLTNKSDVYSFGV

SEQ ID NO: 134359 - protein, 207 aa, Glycine max
  Coding DNA Sequence Number=SeqID_17581
  Gene Ontology: Mol. function=nutrient reservoir activity; Cellular component=apoplast; Biological process=auxin mediated signaling pathway
  Homolog annotation: Hit_ID=Q84XR7; Match level="QueryCoverage=94%, HitCoverage=95%, E-value=3e-71, Identity=68%"; Hit description =Germin-like protein 1
  Pfam annotation: Domain name=Cupin_1; Domain location=52-197; Score =100.0; E_value=7.3e-27; Accession=PF00190.13; Description=Cupin
  Pfam annotation: Domain name=Cupin_2; Domain location=85-161; Score =47.8; E_value=3.6e-11; Accession=PF07883.2; Description=Cupin domain
  Pfam module annotation: Pfam domain module=Cupin_1::Cupin_2; Domain location=52-197::85-161
MSPPIFKVLTLIISVFAILQISTAGDPDILTDFIVPPNTIPNGNFFTFTGFRAIFSPNNIVSAFKVLKATKVEFPALDGQSVSYAILEFPGGSINPPHTHPRSAELLFAVEGSLQVGFVDTTNKLFTQTLQTGDLFVFPKGLVHFQHNADPQKPALAISAFGSASAGTVSIPSTLFNTTIDDNVLALAFKTDVATIRTLKKGFAPKA

SEQ ID NO: 134360 - protein, 551 aa, Glycine max
  Coding DNA Sequence Number=SeqID_17582
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=87%, HitCoverage=87%, E-value=1e-168, Identity=59%"; Hit description =Cytokinin dehydrogenase 3 precursor
  Pfam annotation: Domain name=Cytokin-bind; Domain location=266-549; Score=581.0; E_value=1.1e-171; Accession=PF09265.1; Description =Cytokinin dehydrogenase 1, FAD and cyto
  Pfam annotation: Domain name=FAD_binding_4; Domain location=78-234; Score=78.2; E_value=2.5e-20; Accession=PF01565.13; Description=FAD binding domain
  Pfam module annotation: Pfam domain module=Cytokin-bind::FAD_binding _4; Domain location=266-549::78-234
MVAGKYPSPTYFILLLITITRLISTVGKTSQWMKALTPPPELASVSLDDTIFSKLRNDPEALQGRASRDYGNLVREVPSAVFHPTSSSDIARLIKLSYNGSVPFKIAARGQGHSTRGQAMVRDGVVVDMAGFRERGNGEGIRVVMSVVVDPNNKNGYGYYYADVGGEQLWIDVLNATLEHGLAPMSWTDYLYLTVGGTLSNAGISGQTFRYGPQITTVRQMDVITGKGEFVTCSQQTNSELFHAVLGGLGQFGIITRARIALAPAPKRVKWVRLLYNDFSAFTKDQEQLISITRRKQNIALDYLEGLLLMHQGPINNWRSSFFPLADHARIISLVTKHSVLYCLEVAKYYDGQNENYVDKELKVLLQGLSYIPGFYYEKDVSYVEFLNRVRSGELKLQSQGLWDVPHPWLNLFIPKSQIMEFDSGVFKNIILKRNITTGPVLVYPMNRNKKNVNWWDNRMSASIPDEDIFYTVGFLHSSGFDNWKAYDAQNKEILQFCNDSGIKVKQYLPHYRTQEDWTNHFGPKWRTFVERKHQFDPKMILSPGQRIFNN

SEQ ID NO: 134361 - protein, 155 aa, Glycine max
  Coding DNA Sequence Number=SeqID_17583
  Gene Ontology: Mol. function=nutrient reservoir activity; Cellular component=apoplast
  Homolog annotation: Hit_ID=Q84XR7; Match level="QueryCoverage=83%, HitCoverage=67%, E-value=7e-23, Identity=47%"; Hit description =Germin-like protein 1
MATSSPSPAFVPYFHPTQLSDFKVLKATKVEFPALDGQSVSCAILEFPGGGSINPSQTPFCRWDLWTQPTSSSLRHYKLEIDLFVFPKDVVHFLHNADPQKTAFAISAFGSASAGTVSIPSTLFNTTIDDNVLALAFKTDVATIQTLKKGFAPKA

SEQ ID NO: 134362 - protein, 661 aa, Glycine max
  Coding DNA Sequence Number=SeqID_17584
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=94%, HitCoverage=94%, E-value=1e-147, Identity=49%"; Hit description=Wall- associated kinase, putative
  Pfam annotation: Domain name=Pkinase; Domain location=327-599; Score =160.2; E_value=5.5e-45; Accession=PF00069.15; Description=Protein kinase domain
  Pfam annotation: Domain name=Pkinase_Tyr; Domain location=327-599; Score=122.4; E_value=1.3e-33; Accession=PF07714.7; Description =Protein tyrosine kinase
  Pfam module annotation: Pfam domain module=Pkinase::Pkinase_Tyr; Domain location=327-599::327-599
MALVDLFCFLLFCHLVLILSAGYGNGHQDCPHSFTCGNLGTFHYPFTKAEKPDCGLLAIHDCDNPHQHRKMIQLEKNGKGIVLTGVAQQNAISILDEDFHKRLQQNPCGTLKNNYSLPSPFSSLYSIHIKFNVTLFKCKQSLKMKPPTHYFNHPCPEYDYDIYYDSLPTPNSKEAHSLFSSCSVIQISSKDLTDTNDILSFVSAEMVLQVVLSNDCDQCYNHRGGQCRLDANKKFYCKEGPKNKSSKSLKLILGLVTGLSVILSAILIIGYIVFRRKYTPSHPQSQSRNTYVDVIGPSSNPDPENGRFYFGVPLFSYKELQKATYNFHHARQLGSGGFGTVYYGKLQDGREVAIKRLYEHNYRRVEQFMNEVQILTRLRHKNLVSLYGCTSSHSRELLLVYEHVPNGTVACHLHGELARRDTLPWHTRMKIAIETASALSYLHASDIIHRDVKTKNILLNESFSVKVADFGLSRLFPNDVTHVSTAPLGTPGYVDPEYHQCYQLTNKSDVYSFGVVLIELLSSMPAIDMTRRRDEINLSNLAINKIQQSAFSELVDPCLGFDSDSEVKRMMVSVAELAFQCLQRDKELRPSMDEVLKVLMRIETGKDMGEHPDDVEDLRPPSLPSPDWDENGLVRKMMVHPSPKAVTDTWHSESTTPNGSG

SEQ ID NO: 134363 - protein, 62 aa, Glycine max
  Coding DNA Sequence Number=SeqID_17585
MRADCPIFKKKIQKSEKKTIGDKKAKKAYITWDDNNLETSDDSEKEMINLCLMGKNYESDEE

SEQ ID NO: 134364 - protein, 50 aa, Glycine max
  Coding DNA Sequence Number=SeqID_17586
MICVQWKWNICGWQNKTMLNERGTISDNASLKEENSRWGFTLIKRVGDPT

SEQ ID NO: 134365 - protein, 291 aa, Glycine max
  Coding DNA Sequence Number=SeqID_17587
MGEVDEVQEWIKADIEAQKEQMDTMMEVMMSMKKMMEVNEAAVATTSAVAEVDPITPSGLDQIIHPTLDMVGQGGKELGSTGAPHFVQVQNEHPFQPYSLPPNYTPPNVVHTPDENVNNSTPIITESQQPQSDHAHVPQPMEETHEIPHHNLADFEPCLEYTTEGQTVGGVPLPNTLEGPQFCTQPQPLHIAVGRVPLAMVEREKLDHIEERLRAIKGGRDYAFANMEELCLVPDVVIPLKFKVLDFDKYKGTTCPKNHLKLYCWKMGAYTKDEKLLMHFFQESLTEAAIT

SEQ ID NO: 134366 - protein, 1115 aa, Glycine max
  Coding DNA Sequence Number=SeqID_17588
  Gene Ontology: Mol. function=calcium ion binding; Cellular component =membrane
  Homolog annotation: Hit_ID=Q1RX39; Match level="QueryCoverage=81%, HitCoverage=99%, E-value=0.0, Identity=70%"; Hit description=MscS Mechanosensitive ion channel
  Pfam annotation: Domain name=MS_channel; Domain location=679-887; Score=36.4; E_value=4.2e-08; Accession=PF00924.9; Description =Mechanosensitive ion channel
SFKSYGSYNKHSRFSGAGNSDSDHEQQLPILHDQETHCHPAMPAGDYVVKINEDGSEAPQGNRIWRESSYEFWNNDGATTTAGGSDQSFDFRQSEDPPSQLIGHFLHKQRASGEMQLDMDLEMEELQREGDDGKLTPVDESPVTHRVSRELKVSFEEPTCNVNFLEAQNDAVRRRHSKDSPSIAEFQRPPQPPQHDCRRSPSPSPAGDEEVVRCTSNASFERSLSMQRKSALLKAKTRSRLMDPPEEPDRKSSRVLKSSQLLSGFLGKKNDEEDEDPFLEEDLPDEFKETHFSLWILLEWLSLILIIGLLITTLCVPFLRNKDLWQLRLWKWEVMVLVLICGRLVSDWVIRIAVFCIERNFLLRKRVLYFVYGVKKAVQNCVWLGLVLIAWHLLFDKRVQRETRSNFLEYVTKVLVCFLVGTLVWLLKTLMVKVLASSFHVSTYFDRIQESLFNQFVIETLSGPPLVEIRKAEEEEERLADEVQKLQNAGVTIPPDLRASAFSNIKSGRLRSGMLPKSPRFKSDKFSRPLSKKSDEPNMITMDNLHKLNPNNISAWNMKRLMNMVRNGALSTLDEQILDNSMDDENATQIRSENEAKAAAKKIFQNVARRGCRYIYPDDLMRFMREDEAAKTMNLFEGASEAERISKSALKNWVVNAFRERRALALTLNDTKTAVNKLHRMLNFIVAIVILVIWLLILELATTKFLLFVSSQVVVVAFVFGNTCKTIFEAIIFLFVMHPFDVGDRCEIDGVQMVVEEMNILTTIFLRYDNQKVIIPNNVLATKAIYNYYRSPDMGDAIEFCLHISTPVEKISLIKHRIQSYIDNKKEHWYPSPLIVYRDYDQLNMVRMAIWPTHRMNFQDMGERFVRRSLLLEEMIKIFRELDINYRLLPLDINVRATPTTSDRLPPSWASVPTPTLGSLLSLLHSGARDAYRQFFVDSMSLIQDILYVSSLSVNGSSRSRVTLKCFSDSFSGVEDLPSTNRPVDGRGLLIDLTAPTRWQPFATWILKLVCKSLTEGTLYVEGLIRASFISAACSLLCYGNADLHMACFDFVHIIGMVTNYDAISYYLEFGQGGLPVFRNMAYDSSLGIFLNTLYSSCPEDIVKLTAADLVSVFL

SEQ ID NO: 134367 - protein, 81 aa, Glycine max
  Coding DNA Sequence Number=SeqID_17589
MQTVSPIGAFVVAVTHGKDATATDRFLGIASPIGDFAMQGRVASQTGELQARAMASQPFQALQLARARVHAKGKWPLALAS

SEQ ID NO: 134368 - protein, 118 aa, Glycine max
  Coding DNA Sequence Number=SeqID_17590
MLAGIECCAEVVQQDSTLEAPIEQFACVAQDALHAQESWFQYQEQRHQHHEYSLQDLSPFLMVHSSKRNCLVLSRRYLSPIYKVQHNLAKAKLVTKFDAILHRKGPVTRAMSKRLQED

SEQ ID NO: 134369 - protein, 110 aa, Glycine max
  Coding DNA Sequence Number=SeqID_17591
MCLWASLWAFPLFWHRLSFSYQGLCEAEEMKIILKRFEQLDVCGKVKMMNFVKASSLSETLNLLSELGESIEESEKHLLAQRIISSLSETFVSSCANRAQLAQRMFTYSH

SEQ ID NO: 134370 - protein, 161 aa, Glycine max
  Coding DNA Sequence Number=SeqID_17592
  Gene Ontology: Mol. function=structural constituent of ribosome; Cellular component=intracellular; Biological process=translation
  Homolog annotation: Hit_ID=Q45NI6; Match level="QueryCoverage=99%, HitCoverage=100%, E-value=3e-52, Identity=68%"; Hit description =Ribosomal protein L32
  Pfam annotation: Domain name=Ribosomal_L32e; Domain location=57-151; Score=176.5; E_value=6.5e-50; Accession=PF01655.8; Description =Ribosomal protein L32
  Subcellular localization annotation: CTP_CleavageSite=11; ConfidenceScore=5.17e-01
MAVPLLSKKIVKKRVKKFKRPQSDRKISVKGFPFFFVLNLNMGYDDNLLTPSLTCSIGTNWRRPKGIDSRVRRKFKGCTLMPNIGYGSDKKTRHYLPNGFKKFVVHNVKDLELLMMHNRTYCAEIAHNISTRKRKDIVERAAQLDVVVTNKTARLRSQEDE

SEQ ID NO: 134371 - protein, 575 aa, Glycine max
  Coding DNA Sequence Number=SeqID_17593
  Homolog annotation: Hit_ID=Q1S3J7; Match level="QueryCoverage=97%, HitCoverage=97%, E-value=0.0, Identity=74%"; Hit description =Proteinase inhibitor I4, serpin
MKDSNSSSSSNRTEPIAQNIIKLISNLCFSLFVFSVLIFTVIAITYQPPDPWLQSTPALTNLFTQSENATFRIDSSVLRTGEDLSPSPQDPPLPPPPPSEPLIDITQQQIANSTVNSTADSTAYSTDAQPPSLPACDETLNCSNPRVLIAVQRFNLRAFKSIAFFDYQPPMNGSVPGECDVAWRFRNKRERSWRKYRDFRRFKIAVTDDCRYKVVHAGGWHSGANARRNVTRTGAGRGGKSLPPRASARDDEINDTIPTLGSDTNFRNGKYLYYSRGGDYCKGMNHYLWSFLCGLGEAMFLNRTFVMDLSVCLASTYNPSNKDEEGKDFRYYFDFEHLKETASIVEEGEFLRDWKKWDKTHLKKKKVPVRKVVNHKVTPMQLKKDKSTIIWRQFDAPEPENYWYRVCEGEAAQYVQRPWHAVWKSKRLMNIVTEISGRLDWDFDAVHVVRGEKAQNKELWPHLDYDTSPDVLVEKLKWMVQPWRHLYIATNEPYYNYFDKLRSNYKVHLLDDYKELWGNTSEWYNETTLLNSGKPVEFDGYMRVAVDTEVFYRGKTRVETFYNLTKDCKDGVNTC

SEQ ID NO: 134372 - protein, 507 aa, Glycine max
  Coding DNA Sequence Number=SeqID_17594
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=97%, HitCoverage=76%, E-value=1e-125, Identity=50%"; Hit description=Wall- associated kinase, putative
  Pfam annotation: Domain name=Pkinase; Domain location=165-437; Score =142.1; E_value=1.5e-39; Accession=PF00069.15; Description=Protein kinase domain
  Pfam annotation: Domain name=Pkinase_Tyr; Domain location=165-437; Score=102.8; E_value=1e-27; Accession=PF07714.7; Description=Protein tyrosine kinase
  Pfam annotation: Domain name=RIO1; Domain location=178-337; Score= -90.1; E_value=0.024; Accession=PF01163.12; Description=RIO1 family
  Pfam module annotation: Pfam domain module=Pkinase::Pkinase _Tyr::RIO1; Domain location=165-437::165-437::178-337
MSHYTKCPDYDLYYNITAAEDASLRACTKVLLPIKDVPDANNPFTFVTADILTKVALTDERAACHYRRGGQCQLDSREKFCCTNVIKKGSSLKLVIGIGIPSMLAIGLLFLFLLYKRKYATSGGQLESRDSYSDSSSNPHRETSSEYFGVPLFLYEQLKEATNNFDHTKELGDGGFGTVYHGKLPDGREVAVKRLYEHNWKRVEQFMNEVKILTRLRHKYLVSLYGCTSRHSRELLLVYEYISNGTVACHLHGELAKPGSLPWSIRMKIAIETAIALTYLHASDIIHRDVKTNNILLDNNFCVKVADFGLSRDFPNNVTHVSTAPQGSPGYLDPEYYNCYQLTSKSDVYSFGVVLIELISSKPAVDMNRSRDEINLSNLAVRKIQESAISELVDPSLGFDSDNGIKGMIVSVAGLAFQCLQREKDLRPSMDEVLDELRRIESGKDEGEVQDEGDVNGAAVSHSSAHSPPPASPEWEEVRLLRNIKPTSPNTVTDKWESKCTTPNISG

SEQ ID NO: 134373 - protein, 269 aa, Glycine max
  Coding DNA Sequence Number=SeqID_17595
  Homolog annotation: Hit_ID=Q00M75; Match level="QueryCoverage=12%, HitCoverage=5%, E-value=8e-10, Identity=96%"; Hit description=PPR -repeat containing protein
MWEFGRVNSRPVFLSQYEVSSVGEFNGKHGGSCFMNQVYNCSPSFYCGNVRPFRYPFTETDTRDILPFVSAEMVLEVVLSNDCYECYNFRGGQCLLVNHKTFNCSEAEKHYSKSEHVMLSLVLVTEENSPISIKKDNDVLDPSSNKTSYPIAQSSPLCEGMGEGYCMQPYPCICKEAVSGFEPMTNKSPRHNFTAAPGLALKSRHKMAVCTLESISSLKRSFKKLNIISTSTENLEVKIFEQFGIVNHSLSIGSWIGTKIDGTCTCLIE

SEQ ID NO: 134374 - protein, 126 aa, Glycine max
  Coding DNA Sequence Number=SeqID_17596
  Subcellular localization annotation: CTP_CleavageSite=47; ConfidenceScore=5.03e-01
MEAAVAPEQSCVVLDIKRSSKARTMRKSIIVSKSFTTFVLQKVIEICVSKLKSCERSSRTTEKLSNAGSSQLRMGNKPQSGRSVRVNGKLILSRYPHGNEGGHSAWFPAAKTSGIRPQNKSNNTNS

SEQ ID NO: 134375 - protein, 240 aa, Glycine max
  Coding DNA Sequence Number=SeqID_17597
  Gene Ontology: Mol. function=molecular_function; Cellular component =cellular_component; Biological process=biological_process
  Homolog annotation: Hit_ID=Q1S6B1; Match level="QueryCoverage=93%, HitCoverage=71%, E-value=3e-34, Identity=35%"; Hit description =Thaumatin, pathogenesis-related
  Pfam annotation: Domain name=Thaumatin; Domain location=30-238; Score= 77.4; E_value=4.4e-20; Accession=PF00314.8; Description=Thaumatin family
MAKNVSLNLFLPMLLLCAGVQSDVTFTFENLCSDTLWRASNPSIGDLEPDLPRDTYEIFNMDDHYSGSIWVRTGCSTNASNYFSCETGDCGNGIMECAGLNPSFPITQLNFVVNNPIVSYEVSLKHGQNMLVRIKPNGGTLVDGSGPCPMVDCNKELSSVCPLDLIAGNKNDQYVGCNSPCDGYKDPKYCCNGNGCQPDEISVKYKGLCPFAHTYPGDNQPPIYQCKGADSYDITFCPAL

SEQ ID NO: 134376 - protein, 294 aa, Glycine max
  Coding DNA Sequence Number=SeqID_17598
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =76%, HitCoverage=36%, E-value=1e-22, Identity=32%"; Hit description =ATP binding / kinase/ protein kinase/ protein serine/threonine kinase/ protein-tyrosine kinase
MNLFFFLKPLSSLMILSYIILFFLLVRNTSCDVDPNYVACPPKTCANNNQSISYPFYIEETQEPFCGNPGFAISCGPNGFPILNLSNTHYIIHQIFYENQTLRVSNAAFSVSRSNTTNSKGCLPVPLTHNLTLPSTPEFDIAPNQSNMRLFYGCESLLPWPEEHRVGCPNETSSVLAFYKEDKNISLVSKNCRGEVVDTIVEDGIIEGGVEEALRKGLLLTWKAGNCSECHSSGGRCGFDSIMYTFRCFCTDRVHSAKCDPDNGPVSNRVNSALGFVVCRYLLKSSKSEFEYDI

SEQ ID NO: 134377 - protein, 97 aa, Glycine max
  Coding DNA Sequence Number=SeqID_17599
MASIMESHPQCVKNAPIAQLTFPMFADPFYNEKFTVQVAEMGECVQVNRENVKEAIEKVMGDGEEKEKREEKELESIKKAMEEGGSFTPTSPCLSMT

SEQ ID NO: 134378 - protein, 258 aa, Glycine max
  Coding DNA Sequence Number=SeqID_17600
  Gene Ontology: Mol. function=nucleic acid binding
MIYYIVEIFVRVASYNAGSYASVKHKYCVMHLWRNFSKQWKDKELRGLVWKCAQSTTEAEFKLSLEKEKLEFNKWIANWVGDPDGTRFENETYENYIRPIRSQQYWETTTFDRLTPPHIKKRPGRPKKCRKKDQNEDQVNNNRLKRSYKEVTCTRCGLNGHNNRGCINSGVPPRPKKWKPTVDEGNNSNATTTTPETIFIPPPMSTAFRPPPLRPPVPIRIIMPDGVSHNKNQPNYEFHTYTRNAQPPRFEELKYGID

SEQ ID NO: 134379 - protein, 83 aa, Glycine max
  Coding DNA Sequence Number=SeqID_17601
MDVDGVKGGSDDENKVLGTNVQEAETEVVEIGVKTKPKVVGIETEVNNDTDNDEVKEHDGDVEFSNHSENDPNYVYVSPEDDG

SEQ ID NO: 134380 - protein, 98 aa, Glycine max
  Coding DNA Sequence Number=SeqID_17602
MGSYRSMMQSRFPMPEVDQSIRLRGRVGSSGRGNQQVLVGLQFSHFLKQIVKFRGHGILGCKEMDLGGEFGNDFFDSIDVRLRTCRFRHWSSMKAPRC

SEQ ID NO: 134381 - protein, 503 aa, Glycine max
  Coding DNA Sequence Number=SeqID_17603
  Gene Ontology: Mol. function=transferase activity, transferring glycosyl groups; Cellular component=integral to membrane; Biological process=metabolic process
  Homolog annotation: Hit_ID=Q589Y3; Match level="QueryCoverage=98%, HitCoverage=98%, E-value=2e-97, Identity=40%"; Hit description =Glucosyltransferase NTGT4
  Pfam annotation: Domain name=UDPGT; Domain location=26-498; Score= -124.8; E_value=0.00025; Accession=PF00201.9; Description=UDP -glucoronosyl and UDP-glucosyl transferase
METTPERNLHFVFIPLMLSGCMRPLVDMAKLMARRKVKVTIVTTARYAVQFKASIDREIQSGSSIQIQLVTFPNAEVGVPEGFENIQLPSIDLKEKLFTALSMLQPQLEELLKKLNPFPCCIIHDKHIFCVADIAVKLKVPRITYDRTNCFNLLCNHNLLTYKVYETVSSDSDEIIIPGLPHRIEMRKCRLPTVSKPYSPNSSQKMDVVRERIRGSEAEAYGIVVNSFEEFEAEYVEEYQRVTGHKVWCVGPLSLTNKDDWDKVGRVSKSPNASEIETNQYMKWLSSWPQSSVIYVGSFCPVEPKVLIEIGLGLEATKRPFIWDLKGIYRRDEMERWLSEERFEVRVKDKGILIRDNWLPQVSILSHRAVGAFFTHAGWISTLDAICAGVPLVILPVSAVEMFYNEKLLSQVAEIGVTMRTEIAIHCGGKDKYGECVREVKKDSVKEAIEKVMRKGGDHEKRREKAKKYADMAKKTIEEGGSSYHNMSMLIDDIVHAQSLNQS

SEQ ID NO: 134382 - protein, 103 aa, Glycine max
  Coding DNA Sequence Number=SeqID_17604
  Gene Ontology: Mol. function=protein binding; Cellular component =chromosome; Biological process=chromosome organization and biogenesis (sensu Eukaryota)
  Homolog annotation: Hit_ID=P84040; Match level="QueryCoverage=78%, HitCoverage=80%, E-value=2e-35, Identity=90%"; Hit description =Histone H4
  Pfam annotation: Domain name=Histone; Domain location=25-94; Score =45.0; E_value=2.6e-10; Accession=PF00125.14; Description=Core histone H2AH2BH3H4
MPGRGKGGKGLGKGGAKRHRKVLRNNIQGITKPAIRCLARRGGVKRISGLIYEETRGILKIFLENVIRDAVTYTEHARRKIVIAMDVVYALKRQGKTLYGFGG

SEQ ID NO: 134383 - protein, 105 aa, Glycine max
  Coding DNA Sequence Number=SeqID_17605
MSGSCYCSVDFSNFIKIFQNEDHKRVSPCQEIESPQEDAVDGHVSRDSDTAIEIDINNSSLSTKNVNGCNSDYDGNGLSMEVYAIYPCLTVKKLWCILPWNLVRM

SEQ ID NO: 134384 - protein, 87 aa, Glycine max
  Coding DNA Sequence Number=SeqID_17606
MERYFLVARLTHITLKRETWVTYGALIPIVAGVVIASGRYVNVASCSLSHSRFGVVLDRLGGGGGRARVSVIWIHYVPKIASFASNK

SEQ ID NO: 134385 - protein, 64 aa, Glycine max
  Coding DNA Sequence Number=SeqID_17607
MLETLALCKCQRWRLDEIEEEAGGKGVVEGKSFVGSFSRRVGDGEERHKDKYGGLLSVLRRGHH

SEQ ID NO: 134386 - protein, 560 aa, Glycine max
  Coding DNA Sequence Number=SeqID_17608
  Gene Ontology: Mol. function=protein serine/threonine kinase activity; Cellular component=integral to membrane; Biological process=protein amino acid phosphorylation
  Homolog annotation: Hit_ID=Q1RX25; Match level="QueryCoverage=94%, HitCoverage=77%, E-value=0.0, Identity=83%"; Hit description=Protein kinase; Amino acid-binding ACT
  Pfam annotation: Domain name=ACT; Domain location=189-252; Score =25.4; E_value=0.00021; Accession=PF01842.15; Description=ACT domain
  Pfam annotation: Domain name=Pkinase; Domain location=304-553; Score =251.5; E_value=1.7e-72; Accession=PF00069.15; Description=Protein kinase domain
  Pfam annotation: Domain name=Pkinase_Tyr; Domain location=304-553; Score=298.2; E_value=1.5e-86; Accession=PF07714.7; Description =Protein tyrosine kinase
  Pfam module annotation: Pfam domain module=ACT::Pkinase::Pkinase_Tyr; Domain location=189-252::304-553::304-553
  Subcellular localization annotation: CTP_CleavageSite=22; ConfidenceScore=5.35e-01
MLTEGNNSSCGSGSGVQHHTTSSSSSPAQSRLQRQKLEVYNEILRRLKDSGNEEAMQPGFHDQLWAHFNRLPTWYALDVNVERAADVLMHKRLLHLAHDPANRPSIEVRLVQVHPTSNGNSADTFESDDPGIESGQSSSKYSSRQSIHPPPAFGSSPNLEALALEANNSEDIEEEQSAHANVQYSRHMHEITISTDDKPKLLSQLTALLSEIGLNIQEAHAFSTTDGFSLDVFVVEGWPHEETEKLKAALERGVLKKIERQVKSSPQSVSSVDKPDQAKMKSELDYLTIPTDGTDVWEIDPKHLKYGTQIASGSYGELFKGVYCSQEVAIKVLKADHVNSELQREFAQEVYIMRKVRHKNVVQFIGACTKPPGLCIVTEFMSGGSVYDYLHKQKGFFKFPTLLKVAIDVSKGMNYLHQHNIIHRDLKAANLLMDENCTVKVADFGVARVKAQSGVMTAETGTYRWMAPEVIEHKPYDHKADVFSFGIVLWELLTGKLPYEYLTPLQAAIGVVQKGLRPTIPKNTHPKYVELLERSWQQDPTLRPDFSEIIEILQQLAKEV

SEQ ID NO: 134387 - protein, 128 aa, Glycine max
  Coding DNA Sequence Number=SeqID_17609
MAPTRHPLDQEKSNRALGFSTLITGLCQSYGVPVTPSTIIRPLITQAFIKKYCMPRQAQGDAHQDGPGSAPFVCPTPEQFGAEVAWPGDWPDAQAGEEPAGTPDEADESHMDEDMTDLLDFLGGSGAT

SEQ ID NO: 134388 - protein, 783 aa, Glycine max
  Coding DNA Sequence Number=SeqID_17610
  Homolog annotation: Hit_ID=Q7X997; Match level="QueryCoverage=94%, HitCoverage=93%, E-value=1e-130, Identity=46%"; Hit description=Bzip- like transcription factor-like protein
  Pfam annotation: Domain name=DUF630; Domain location=1-61; Score =106.2; E_value=9.4e-29; Accession=PF04783.3; Description=Protein of unknown function (DUF630)
  Pfam annotation: Domain name=DUF632; Domain location=280-633; Score =293.3; E_value=4.5e-85; Accession=PF04782.3; Description=Protein of unknown function (DUF632)
  Pfam module annotation: Pfam domain module=DUF630::DUF632; Domain location=1-61::280-633
MGCVASKLEEEEEVVAICRERKRLLKQAVEKRYALAEAHCKYFHSLNAVAAAIKLFVARHSSPSSPFLITFPPPCPSSPSPSPSHPTENVITNPMFLQQTPSETKHEAIACDSCISSTTSESSEEESEEKREGEGEEGNGEEEQHQHQQPCGYYCMPMTMPMSMSMSMPMPMSMSMPIPPSMPSPQRDFGWDFFYPFDSMRSEVMSGYHRNSDDDLRAVREEEGIPELEEEVEREEIQHKVVSVEENNNNNSNNEGAVEHVLSGVETVKVVDVATENQGEQRGLAVLDTPAEGRELLEALKDIEDHFLRAYDSGKEVTRMLEANRIPLHSSLDEIKESSTKLIHAITWKSISSRQPSCKSLTVPNVKNSSTWVEYKNDLFDDYGGMDSGSHLLTLGRLYAWEKKLFEEVKTYAGESFNCMWQAGDNTRKNYEKKCTQLRNKNVRGDDVLSTDKTKAEVKDLYAGILVAIRRAESISKRIEKMRDEELQPQIVELLKGLTQSWKIMLESHETQKKILSEVKYFTCATYGKFCNQSHGFATLQLEAQLHNWRDCFKEYTASQKAYVEALHGWLSKFIVPEVEFYSRSKNVTMPYQFNGPPLLVICNDWLASLQKLPDKMVTVALKSVVKDVRALWLQQNKEQQQKRRVDRLTRDLERRYSSTSHKVVETKMLEFHVVDHELEVGNDQEEEECMMEKSDHLETLRRKLEVEKEKHHSSMQETQRITLHGLQSGFSLVFESLTEFSKASQKMYNGLVTYSENSDKVGNITYIEGGCNVENCNSQNGQ

SEQ ID NO: 134389 - protein, 291 aa, Glycine max
  Coding DNA Sequence Number=SeqID_17611
  Homolog annotation: Hit_ID=Q10S29; Match level="QueryCoverage=81%, HitCoverage=71%, E-value=8e-49, Identity=47%"; Hit description =Expressed protein
  Subcellular localization annotation: CTP_CleavageSite=54; ConfidenceScore=5.34e-01
MAAATLSVRPDRLSPGSVFPRPPVQPPLRKPIAAPEPWRAAAPRIRIRTVAPVQASSRADDSAPFEMSVENALKLLGVSEGASFDDILRAKNAIVANCKDDQDAIAQESMLKVNVNIHYTNSQGGDWSVVKLGYVWINFSIDIIDCVGYKVEAAYDMLLMQSLTQRRAGKVVNSSVRYADVKRVKSPAGGSMPQWLKNSPVSIESPSTSDLGLQAGVYGALMGLTYLNGASAPAAGYAGADVPGLLLAGSFGASLYFMTKKNVKLGKATVITIGGLVAGAVVGSAVENWLQ

SEQ ID NO: 134390 - protein, 99 aa, Glycine max
  Coding DNA Sequence Number=SeqID_17612
  Gene Ontology: Mol. function=hydrogen ion transporting ATP synthase activity, rotational mechanism; Cellular component=proton -transporting two-sector ATPase complex; Biological process=energy coupled proton transport, ...
  Gene Ontology: Biological process=against electrochemical gradient
  Homolog annotation: Hit_ID=Q40079; Match level="QueryCoverage=84%, HitCoverage=17%, E-value=6e-40, Identity=96%"; Hit description =Vacuolar ATP synthase subunit B isoform 2
  Pfam annotation: Domain name=ATP-synt_ab_N; Domain location=24-90; Score=62.0; E_value=1.9e-15; Accession=PF02874.13; Description=ATP synthase alphabeta family, beta-barrel domain
MGVAENIPDMEEGTLEIGMEYRTVSGVAGPLVILDKVKGPKFQEIVNIRLGDGTTRRGQVLEVDGEKAVVQVFEGTSGIDNKFTTVQFTGEQKVETSIL

SEQ ID NO: 134391 - protein, 125 aa, Glycine max
  Coding DNA Sequence Number=SeqID_17613
MFGYALKALGCTYFMVKHGKVQLGVEVVEVEKKKLYHSMLGISVQRRTTRYKFYQEWVEWNCIQENPLYGKFNIKGLPFAHKLTKLFKDVVANGKFQWALSFGILPASVKVDMDDGYHQVLRALA

SEQ ID NO: 134392 - protein, 708 aa, Glycine max
  Coding DNA Sequence Number=SeqID_17614
  Gene Ontology: Mol. function=protein transporter activity; Cellular component=nuclear pore; Biological process=protein import into nucleus, docking
  Homolog annotation: Hit_ID=Q8H2D6; Match level="QueryCoverage=99%, HitCoverage=82%, E-value=0.0, Identity=63%"; Hit description =Transportin
  Pfam annotation: Domain name=HEAT; Domain location=131-166; Score =9.7; E_value=2.8; Accession=PF02985.12; Description=HEAT repeat
  Pfam annotation: Domain name=HEAT; Domain location=179-215; Score =6.0; E_value=7.9; Accession=PF02985.12; Description=HEAT repeat
  Pfam annotation: Domain name=HEAT; Domain location=220-256; Score =14.3; E_value=0.46; Accession=PF02985.12; Description=HEAT repeat
  Pfam annotation: Domain name=HEAT; Domain location=261-297; Score =2.1; E_value=24; Accession=PF02985.12; Description=HEAT repeat
  Pfam annotation: Domain name=HEAT; Domain location=388-427; Score =14.7; E_value=0.34; Accession=PF02985.12; Description=HEAT repeat
  Pfam annotation: Domain name=HEAT; Domain location=446-481; Score =13.0; E_value=1.1; Accession=PF02985.12; Description=HEAT repeat
  Pfam annotation: Domain name=HEAT; Domain location=613-650; Score =19.2; E_value=0.015; Accession=PF02985.12; Description=HEAT repeat
  Pfam annotation: Domain name=HEAT; Domain location=92-128; Score=5.6; E_value=8.9; Accession=PF02985.12; Description=HEAT repeat
  Pfam annotation: Domain name=IBN_N; Domain location=40-108; Score =58.1; E_value=2.8e-14; Accession=PF03810.9; Description=Importin -beta N-terminal domain
  Pfam module annotation: Pfam domain module=HEAT::HEAT::HEAT::HEAT::HEA T::HEAT::HEAT::HEAT::IBN_N; Domain location=131-166::179-215::220 -256::261-297::388-427::446-481::613-650::92-128::40-108
MAAAAATTPSWQPQEQGFKEICGLLEQQISHSSSADKAQIWQHLQRYSHLPDFNNYLAFIFSRAEGKSVEVRQAAGLYLKNNLRNTFKSMQPAYQQYVKSELLPCLGATDKHIRSTAGTIISVVVQIGGVVGWPELLQALVNCLDSNDLNHMEGAMDALSKICEDIPQYLDSDVPGLAERPINIFLPRLFRFFQSPHASLRKLSLGSVNQYIMLMPSALYVSMDQYLQGLFILANDAAAEVRKLVCAAFVQLIEVRPSFLEPHLRNVIEYMLQVNKDTDDEVALEACEFWSAYCDAQLPPENLREFLPRLIPVLLSNMAYADDDESVIEAEEDGSQPDRDQDLKPRFHVSRFHGSDEVEDDDDDVVNTWNLRKCSAAALDILSNVFGDEILPTLMPIVEAKLSAGGDDAWKDREAAVLALGAIGEGCINGLYPHLLEGIGHPKGYEQFDNVLMGLLRRILDDNKRVQEAACSAFATLEEEAAEELAPRLEIILKHLMTAFGKYQRRNLRIVYDAIGTLAEAVGGELNQPVYLDILMPPLIEKWQQLSNSDKDLFPLLECFTSIAHALGTGFAQFAEPADPAATTGVQYDKEFIVCSLDLLSGLAEGLGSGIESLVAQCSLRDLLLHCCVDDAPDVRQSAFALLGDLARGGDWVKISLGLPKHVCPVHLHPRLSEFLEAAAKQLEISKVKEAISVANNACWAIGELAVK

SEQ ID NO: 134393 - protein, 316 aa, Glycine max
  Coding DNA Sequence Number=SeqID_17615
  Gene Ontology: Mol. function=heat shock protein binding; Cellular component=integral to membrane; Biological process=protein folding
  Homolog annotation: Hit_ID=Q10S35; Match level="QueryCoverage=86%, HitCoverage=94%, E-value=7e-46, Identity=43%"; Hit description=DnaJ domain containing protein, expressed
  Pfam annotation: Domain name=DnaJ; Domain location=6-73; Score=80.7; E_value=4.7e-21; Accession=PF00226.21; Description=DnaJ domain
MEAEMDHYAVLGLPSGEEGAKLTEKEINKAYRWKALELHPDKRPDDPNAAANFQQLRTSYDILRDDKARKLFDDLLRVKRERELRNLQRDGKRRKMVSDLERRERDANAPDPAAKEREEEARIARQLKEEIARIRAMHGKKEEAPAAAPAKEKDSGGSSGVDQEKVLKVSWEKVGEDYSADKLRELFSKFGEVEDVVIKGSKKKGSALVVMAIKEGAVAATGSVIGHLANPLLVVPLKPASVADSSSVPKSAETTRMSNLVGAGYQAFEDSVLKKLQKPLQCYCIAKFLGSVTTAEMDAMSSILLPEAYISPNLKH

SEQ ID NO: 134394 - protein, 291 aa, Glycine max
  Coding DNA Sequence Number=SeqID_17616
  Gene Ontology: Mol. function=hydrogen ion transporting ATP synthase activity, rotational mechanism; Cellular component=proton -transporting two-sector ATPase complex; Biological process=energy coupled proton transport, ...
  Gene Ontology: Biological process=against electrochemical gradient
  Homolog annotation: Hit_ID=Q40079; Match level="QueryCoverage=97%, HitCoverage=50%, E-value=1e-123, Identity=81%"; Hit description =Vacuolar ATP synthase subunit B isoform 2
  Pfam annotation: Domain name=ATP-synt_ab; Domain location=1-135; Score=89.7; E_value=8.8e-24; Accession=PF00006.15; Description=ATP synthase alphabeta family, nucleotide-binding domain
  Pfam annotation: Domain name=ATP-synt_ab_C; Domain location=197-291; Score=88.8; E_value=1.7e-23; Accession=PF00306.17; Description=ATP synthase alphabeta chain, C terminal domain
  Pfam module annotation: Pfam domain module=ATP-synt_ab::ATP-synt_ab _C; Domain location=1-135::197-291
MYKLANDPTIERIITPRIALTTAEYLAYECGKHVLVILTDMSSYADALREVSAAREEVPGRRGYPGYMYTDLATIYERAGRIEGRKGSITQIPILTMPNDDITHPTPDLTGYITEGQIYIDRQLYNRQLHLLLINYVDLILRPKLNILIIFNWADIPTNQRPPITISVDEVVHALMVHHWSLLQSAIGEGMTRRDHSDVSNQLYANYAIGKDVQAMKAVVGEEALSSEDLLYLEFLEKFERKFVAQGAYDTRNIFQSLDLAWTLLRIFPRELLHRIPAKTLDQFYSRDAGN

SEQ ID NO: 134395 - protein, 145 aa, Glycine max
  Coding DNA Sequence Number=SeqID_17617
  Gene Ontology: Mol. function=protein binding; Cellular component =nucleus; Biological process=multicellular organismal development
  Homolog annotation: Hit_ID=Q570C0; Match level="QueryCoverage=84%, HitCoverage=20%, E-value=3e-45, Identity=64%"; Hit description =TRANSPORT INHIBITOR RESPONSE 1 protein
MLFFSHTETFVGDNHPLELDLLNPGVGNNHGLDLRAHINAPTLRDQIEVSEVQLPLDGDGSNLGEAVDNGGRRDYVTVFNKDSPATPTLDLVPGLADEGDQTSILVTIDKGEHVLQHLLREQVIYSRPHVQWNTTTLPKTLLFSE

SEQ ID NO: 134396 - protein, 54 aa, Glycine max
  Coding DNA Sequence Number=SeqID_17618
MCDSNIASIESPCDALSVDAPGMFRFDVIYNCAVLREGVEEVRMAWNMVLRGWK

SEQ ID NO: 134397 - protein, 393 aa, Glycine max
  Coding DNA Sequence Number=SeqID_17619
  Gene Ontology: Mol. function=protein phosphatase type 2A regulator activity; Cellular component=protein phosphatase type 2A complex; Biological process=signal transduction
  Homolog annotation: Hit_ID=Q7XJ10; Match level="QueryCoverage=79%, HitCoverage=88%, E-value=9e-49, Identity=32%"; Hit description =Serine/threonine protein phosphatase 2A-like protein
  Pfam annotation: Domain name=B56; Domain location=57-378; Score =117.8; E_value=3.2e-32; Accession=PF01603.10; Description=Protein phosphatase 2A regulatory B subunit (B56 family)
MRIDTFITQECDSSNDFDNRSAFQRFLCKGIAAFGFCMNQNRRNNVVKQPYERKQQESPHFTIPSSPSGNEELLSTISYCTFVFTFTDPSESPAQRDSKRLQLTRLVSILKSSKKPVHEKVLGASSGHDLSQPLQATPSTFQPFFFPHRIARKRRPHLYILIPMGIDHSFLCNLQALFQPEDPMERESLKNVYHKIYSEFISDRSFMRKSMTKGTIINGFTVPLKEEHKLFLMRVLIPLHKTKGMQKEPMLGGVVVRGILRYWPVINCQKEILLIGELEDLVAERALYVWNNEQFVKMALIGTVEVFTVIVEGMEKNLKSHWSKSVRQLTESVKVMLEDIDPDMYSKGLMDMEAKESMAHQEDIKRKKRWERIELEAAKNQFLNPQRYIRVSY

SEQ ID NO: 134398 - protein, 462 aa, Glycine max
  Coding DNA Sequence Number=SeqID_17620
  Gene Ontology: Mol. function=amino acid transporter activity; Cellular component=membrane; Biological process=amino acid transport
  Homolog annotation: Hit_ID=Q10HT5; Match level="QueryCoverage=93%, HitCoverage=79%, E-value=0.0, Identity=71%"; Hit description=Amino acid permease family protein, putative, expressed
  Pfam annotation: Domain name=AA_permease; Domain location=26-452; Score=-20.7; E_value=3.5e-05; Accession=PF00324.11; Description =Amino acid permease
MESNNAEYVTLGGEGSTPKLEKMSKVSIMPLMFLIFYEVSGGPFGVEDTVRAAGPLLALLGFLLFPFIWSVPEALLTAEMGTMFPENGGYVVWVSSALGPNWGFQLGWMKWLSGVIDNALYPVLFLDYLKSAIPALGGGFPRIIAVIVLVLALTYMNYRGLTIVGWAAILLGIFSLLPFMVMGVIAIPRIKPTRWIMVDLKKVNWGLYLNTLFWNLNYWDSISTLAGEVDNPGKTLPKALLYAVMLVVLGYFLPLLIGTGAMPVNRELWYDGYFSEVARVIGGVWLRSWVQAASALSNMGMFMAEMSSDSFQLLGMAERGMVPEFFAKRSRYGTPLVGILFSASGVVLLSWLSFQEIVAAENFLYCFGMLMEFVAFVKLRRKLPYAERPYKVPVGKTGAILMCVLPTLLIFVVLALASFKVFIVSFSAVIIGLVLRPCLKYMEQRRWLRFSVNPDLPDIRAT

SEQ ID NO: 134399 - protein, 121 aa, Glycine max
  Coding DNA Sequence Number=SeqID_17621
  Gene Ontology: Mol. function=binding; Cellular component=nuclear pore; Biological process=protein import into nucleus, docking
  Homolog annotation: Hit_ID=Q8GTE6; Match level="QueryCoverage=81%, HitCoverage=23%, E-value=1e-52, Identity=96%"; Hit description =Transportin-like protein
MEHFMQSWCTALSMIRDDVEKEDAFRGLCAMVKANPSGALSSLVYMCKAIASWHEIRSEDLHNEVCQVLHGYKQMLRNGAWDQCMSALEPPVKEKLSKYQEVPQALKISLDGVSHEKCTGE

SEQ ID NO: 134400 - protein, 100 aa, Glycine max
  Coding DNA Sequence Number=SeqID_17622
MELKGASLRRGYELLKGQKQKKNRLAKESNIVPKGKGNGVVSCTEEVGGVVRMKIVVRKSELKQLVEVMNGGVKKNICPEPKETPKSAGVLSYKASLKRN

SEQ ID NO: 134401 - protein, 54 aa, Glycine max
  Coding DNA Sequence Number=SeqID_17623
  Homolog annotation: Hit_ID=Q6X0N8; Match level="QueryCoverage=63%, HitCoverage=4%, E-value=3e-11, Identity=100%"; Hit description =Putative spermine/spermidine synthase
MSVDAIPLKSSGKPSLQTFMVVVEKELSTLVHQITSLLHNSSLHSNSKQRRGSF

SEQ ID NO: 134402 - protein, 53 aa, Glycine max
  Coding DNA Sequence Number=SeqID_17624
  Homolog annotation: Hit_ID=Q1SGR1; Match level="QueryCoverage=85%, HitCoverage=5%, E-value=1e-16, Identity=82%"; Hit description =Kinesin, motor region; Prefoldin
MGMAGALDVEALLNEKANRKDRFNYKERCENMMDYIKWMKVCIKWFQDLEISY

SEQ ID NO: 134403 - protein, 634 aa, Glycine max
  Coding DNA Sequence Number=SeqID_17625
  Gene Ontology: Mol. function=RNA-directed DNA polymerase activity; Cellular component=chromatin; Biological process=chromatin assembly or disassembly
  Pfam annotation: Domain name=RVP_2; Domain location=254-377; Score= -46.8; E_value=0.0044; Accession=PF08284.2; Description=Retroviral aspartyl protease
  Pfam module annotation: Pfam domain module=RVP_2::RVT_1::Retrotrans _gag; Domain location=254-377::470-634::15-105
MCLEYHGTPEYDRLTIASFYMEGRALAWFQWMTSNGQFTSWPVFLQALQTRFAPSQYEDPTGALCKLMQKGSVAAYLAEFEDLANRVVDVPPPFLLSCFVSGLLSEICREVQAHQPLTIYQAAGLARLQEDKLSDHRPPPPPPRPRPPPLPNPNPIRPNRLPPLLSPPPCLNPPPPFKRLTFEEIASRRERGLYFSCDEKYHRGHRCTSRVFLLIAEGEDDPNPPHIDTFDPGPDPNPKTLPDPDPYPTQLSLNSMAGHIAPETLRFMATISDHDVVLLVDGDSTHNFIQHQLVDQLGLSTRPTTPLRVMVGNGQHLQCFSICESIPIIIQSTEFIVDLYVLPLSGANVVLGVQWLKSLGPILTDYSTLAMQFFYNEKLITLQGDIDASLHALSPLQFKRLCRTHSEATFYHITLLSPPSSLNNQEPPPVVQPLISKYESLFHPPTTLPPIRDTDHHIHLLPQASSVNVRPYRYPHYQKQKIENQKHDGSWCFCVDYRALNALTVRDRFPIPTVDELLDELGGASYFSKLDLLQGYHQIRMHPDDIPKTAFRTHHDHYEFKVMSFGLCNAPSSFQATMNSIFRPYLCQFIIVFFDDILIYSTSIDDHLQHLELAFQIYTRLCYDCCPFGQGNHH

SEQ ID NO: 134404 - protein, 903 aa, Glycine max
  Coding DNA Sequence Number=SeqID_17626
  Gene Ontology: Mol. function=transmembrane receptor activity; Cellular component=membrane; Biological process=defense response
  Homolog annotation: Hit_ID=Q1SI46; Match level="QueryCoverage=95%, HitCoverage=80%, E-value=0.0, Identity=54%"; Hit description=Leucine Rich Repeat, putative
  Pfam annotation: Domain name=LRR_1; Domain location=450-471; Score =8.9; E_value=6.2; Accession=PF00560.23; Description=Leucine Rich Repeat
  Pfam annotation: Domain name=LRR_1; Domain location=473-494; Score =2.8; E_value=84; Accession=PF00560.23; Description=Leucine Rich Repeat
  Pfam annotation: Domain name=LRR_1; Domain location=496-518; Score =14.8; E_value=0.32; Accession=PF00560.23; Description=Leucine Rich Repeat
  Pfam annotation: Domain name=LRR_1; Domain location=520-540; Score =5.7; E_value=24; Accession=PF00560.23; Description=Leucine Rich Repeat
  Pfam annotation: Domain name=LRR_1; Domain location=542-561; Score =7.1; E_value=14; Accession=PF00560.23; Description=Leucine Rich Repeat
  Pfam annotation: Domain name=LRR_1; Domain location=563-584; Score =4.5; E_value=41; Accession=PF00560.23; Description=Leucine Rich Repeat
  Pfam annotation: Domain name=LRR_1; Domain location=586-607; Score =12.0; E_value=1.7; Accession=PF00560.23; Description=Leucine Rich Repeat
  Pfam annotation: Domain name=LRR_1; Domain location=630-657; Score =3.7; E_value=58; Accession=PF00560.23; Description=Leucine Rich Repeat
  Pfam annotation: Domain name=LRR_3; Domain location=450-469; Score =34.1; E_value=4.9e-07; Accession=PF07725.3; Description=Leucine Rich Repeat
  Pfam annotation: Domain name=NACHT; Domain location=52-204; Score= -15.5; E_value=0.00092; Accession=PF05729.3; Description=NACHT domain
  Pfam annotation: Domain name=NB-ARC; Domain location=12-306; Score =122.0; E_value=1.7e-33; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_3::NACHT::NB-ARC; Domain location= 450-471::473-494::496-518::520-540::542-561::563-584::586-607::630 -657::450-469::52-204::12-306
TEVELLEKITESVNLELRRLRNHPHNLKGVIGIEKPIQSLESLIRQKSINVNVIGIWGMGGIGKTTIAEAMFNKLYSEYNASCFLANMKEEYGRRGIISLREKLFSTLLVENEKMNEANGLSEYIVRRIAGMKVLIVLDDVNHSDLLEELFGDHHWFGPGSRIIITSRDKQVLIANKVDDIYEVGALNSSQALELFSLYAFKKNHFDMEYDELSKRVVNYANGIPLVLKVLGRLLCGKDKEVWESQLDKLKSMPNKHVYNAMKLSYDDLDRKEKNIFLDLSCFFIGLNLKVDHIKVLLKDSESDNSVVAGLERLKDKALITISENNIVSMHNVIQEMAWEIVRGESIEHAESRSRLIDPVDICDVLANNKGTEAIRSIRADLSVFLKLKFSPHIFTKMSKLQFLSFTNKHDEDDIEFLPNGLQSFPDELRYLHWRYYPLKSLPENFSAEKLVILDMSNSQLEKLWDGVQNLVNLREVKVCDSKNLKELPDLTQATNLEELDISACPQLTSVNPSIFSLNKLQRLNIGYCYITKVVSNNHLSSLRYLSLGSCPNLEEFSVTSENMIELDLSYTRVNALTSSFGRQSKLKLLRLGSTDIKKLPSSFKNLTALQYLSVELSRQLHTLTELPPSLETLDATGCVSLKTVLFPSIAQQFKENRRDVRFWNCLNLDEHSRKAIGLNARINAMNSAYQHLSAPDQNYNNYSRKYRFYQVKYVYPGRKIPEWFEYQTRDDYIMIDLPSTPRSSQLGFIFSFVISYPLHRTVGYFSRFTFHIIISDDGGYKSEKSSINIYMSALHLRPNSKHVCVIYDQRCSRYLNSRAENKRRLKIEVEVMGDTHPEWGAELEAFGVSVINTSAYHNFVQQINTSSGHNFIQHIGMSDPMHSLCLKSSCAYPSCGLDEDFD

SEQ ID NO: 134405 - protein, 428 aa, Glycine max
  Coding DNA Sequence Number=SeqID_17627
  Gene Ontology: Mol. function=zinc ion binding; Biological process =metabolic process
  Homolog annotation: Hit_ID=Q8RWG0; Match level="QueryCoverage=80%, HitCoverage=34%, E-value=1e-116, Identity=55%"; Hit description =Putative PHD-type zinc finger protein
  Pfam annotation: Domain name=PHD; Domain location=150-209; Score =10.2; E_value=0.0054; Accession=PF00628.19; Description=PHD-finger
MMREKKEFPKGEFLGFSCWSGLGPVCSRLARMHVFVLNAPLPPLALVLVFALSAPWVLSAICTLAMLRGLLIINFYKTKTLFSTECASVSSIPRGEWYCQICQHTFLRERPVLHNADAVAAGRVEGVDPIEQIAKRCIRIVKDIGAEMGGCVLCRSSDFSRSGFGPRTIIICDQCEKEYHVGCLRDHKMAYLKELPEGDWFCCNDCTRIHSTLENLLIRVAERLPESLLDVIKKKQVGRCLEPLNEIDVRWKLLNGKIASPETRPLLLEAVSMFHECFDPIVDPAAGRDLIPAMVYGRNLQTQDFGGMYCALLIVNSSVVSAGMVRIFGRDIAELPLVATRYKNRGKGYFQTLFACIERLLAFLNVKNLVLPAAEEAASIWTEKFGFSKMKPNQLTNYRMNCHQIMAFKGTNMLHKTVPQCRVINTQL

SEQ ID NO: 134406 - protein, 372 aa, Glycine max
  Coding DNA Sequence Number=SeqID_17628
  Gene Ontology: Mol. function=zinc ion binding
  Homolog annotation: Hit_ID=Q8RWG0; Match level="QueryCoverage=39%, HitCoverage=14%, E-value=1e-39, Identity=54%"; Hit description =Putative PHD-type zinc finger protein
MESTATTVSPDSENDTTNTRVNGYVVYTRRKRTLLTLHSGNDAAKRLRTAEIKVEARNDDDDVVFKRPKLESELTEEELKTTSSSKKIIVVHKKPATVKELFQTGLLDGVPVVYVGCKKDSTTELRGEIKDGGILCSCSLCNGRRVIPPSQFEIHACNIYKRAAQYICLENGKSMLELMRACRAAPLHTLEATIQNFINSPPEEKYFTCKNCRGCFPSSNVERVGLLCLSCVESRKSEKSSIHAVGKRIRVVNEKFDKLQIQESGDGSSRVKNSCFKEKVIGGRDEMSEKDRMVGKVVFGILVVEGKRSRNGKKQEEFKNWARYWKFKNETRKVVNETDPKLLRSFTKILKHRMKNTRYISLPKIGKGNQEI

SEQ ID NO: 134407 - protein, 1367 aa, Glycine max
  Coding DNA Sequence Number=SeqID_17629
  Gene Ontology: Mol. function=receptor activity; Cellular component =cytoplasm; Biological process=intracellular protein transport
  Homolog annotation: Hit_ID=Q8H7Q9; Match level="QueryCoverage=85%, HitCoverage=88%, E-value=1e-135, Identity=29%"; Hit description =Putative kinesin-related protein
  Pfam annotation: Domain name=M; Domain location=1104-1124; Score=2.8; E_value=53; Accession=PF02370.7; Description=M protein repeat
  Pfam annotation: Domain name=M; Domain location=1152-1172; Score=4.9; E_value=29; Accession=PF02370.7; Description=M protein repeat
  Pfam annotation: Domain name=M; Domain location=710-730; Score=11.3; E_value=3.6; Accession=PF02370.7; Description=M protein repeat
  Pfam annotation: Domain name=Osmo_CC; Domain location=780-825; Score =6.9; E_value=1.1; Accession=PF08946.1; Description=Osmosensory transporter coiled coil
  Pfam annotation: Domain name=Osmo_CC; Domain location=954-999; Score =12.3; E_value=0.13; Accession=PF08946.1; Description=Osmosensory transporter coiled coil
  Pfam annotation: Domain name=Pox_A_type_inc; Domain location=1104 -1126; Score=2.7; E_value=33; Accession=PF04508.3; Description=Viral A-type inclusion protein repeat
  Pfam annotation: Domain name=Pox_A_type_inc; Domain location=1344 -1363; Score=1.4; E_value=50; Accession=PF04508.3; Description=Viral A-type inclusion protein repeat
  Pfam annotation: Domain name=Pox_A_type_inc; Domain location=443-465; Score=0.7; E_value=65; Accession=PF04508.3; Description=Viral A-type inclusion protein repeat
  Pfam annotation: Domain name=Pox_A_type_inc; Domain location=527-549; Score=9.3; E_value=3.5; Accession=PF04508.3; Description=Viral A-type inclusion protein repeat
  Pfam annotation: Domain name=Pox_A_type_inc; Domain location=710-732; Score=1.8; E_value=44; Accession=PF04508.3; Description=Viral A-type inclusion protein repeat
  Pfam annotation: Domain name=Pox_A_type_inc; Domain location=738-760; Score=1.7; E_value=46; Accession=PF04508.3; Description=Viral A-type inclusion protein repeat
  Pfam annotation: Domain name=Strep_SA_rep; Domain location=1114-1138; Score=1.8; E_value=52; Accession=PF06696.2; Description=Streptococcal surface antigen repeat
  Pfam annotation: Domain name=Strep_SA_rep; Domain location=1162-1186; Score=4.2; E_value=21; Accession=PF06696.2; Description=Streptococcal surface antigen repeat
  Pfam annotation: Domain name=Strep_SA_rep; Domain location=300-324; Score=4.7; E_value=18; Accession=PF06696.2; Description =Streptococcal surface antigen repeat
  Pfam annotation: Domain name=Strep_SA_rep; Domain location=482-506; Score=4.4; E_value=19; Accession=PF06696.2; Description =Streptococcal surface antigen repeat
  Pfam annotation: Domain name=Strep_SA_rep; Domain location=968-992; Score=5.1; E_value=15; Accession=PF06696.2; Description =Streptococcal surface antigen repeat
  Pfam module annotation: Pfam domain module=M::M::M::Osmo_CC::Osmo _CC::Pox_A_type_inc::Pox_A_type_inc::Pox_A_type_inc::Pox_A_type _inc::Pox_A_type_inc::Pox_A_type_inc::Strep_SA_rep::Strep_SA _rep::Strep_SA_rep::...
  Pfam module annotation: Pfam domain module=Strep_SA_rep::Strep_SA _rep; Domain location=1104-1124::1152-1172::710-730::780-825::954 -999::1104-1126::1344-1363::443-465::527-549::710-732::738-760::1114 -1138::1162-1186::...
  Pfam module annotation: Domain location=300-324::482-506::968-992
MNADSNLFVSVVSVENGKTIAKSSKVSVRNGGCQWSDNFSESISISRDNSSKEIDDCDLKLIVAMGSSRSGILGEATVSLTSYMSSGAAIPLSIPLNKCNHGTVLHVTVQCLTPRTKLRDQESSETKFHLKAINESNYDLSVKSNESDCSNVQSVESSSVEDFDSILSPGEIETMATSFSGSVSNCSHNSTEGSTGRGNISPSISDGQSPTARQDSTSSQKSVSHHNYPVNDTSQPNNSSFNSQNMQHIGALSSKKTNASNNRLEAAGDTSEELRAEAKMWEMNARKLMGDLDMLRTEFSDQSKKLAGIEMDLSATQVERDGLKKEVEQLKLSFEDPVVRQKALEDSVSQVEGIPEIENALKEELKFEKESNANLSLQLKKSQEANIELVSVLQELEETIEQQKVEIENLSSLPLKFSDLDKSFQQSIEGNKHLMQQLEQLEESKKSLLVKVQELEGTLEDKMRGTEHAKIQNNRTLSDIEMEYESKLSAKDKEISSLKAKLFDSVPESCNNVETVSRNLGDTDLLREIEALKEKVRELEMDCNELTDENLELVFKLKEAKKNSKDGGASEDLLSDKLKDQSSTSLGSEVSNNLFRIFHSEGMVQAKKDIKISNDDHFSIQELETSKLALEVRITDLNKELTNKTSVIGNLEANLSHKEKEIGVLQKLLSELEANVYHLEQEKSQLEKHMDTLIKENKHELELHILDIEQEKQQLSIRVSVLEAQLRDLTNEQEFRLSELENSRSQAARLQEKIMEMQSEIDSSTEDLKQKLMVAKIHWSEAQEECEYLRGANQKLQITIEDLAEECSSFEKLNGDLKQQNLKLEGYCSHMEARLRESDERFSKCSEGVELLEKKFDLKLEDIASKEKHLTSDLDGFFYENRKHMEQAQVLLNQMQMEMMVETQNLELEVEKLSLKLSAAHDEKERIASNAMLEVSTLRADKAKLESAFEEAQSKVSLAKKEVDMIQSQYEQKLEDLTTQLAEYKIKMEMLMTEHEKLLKLVEDYKSRELKFKSTINALELKLTVTEYERQQVMDESGILKVQLQQTHQFENEIIALKNELDASNSEKERLEASLCLTSELCEDLKAEKISSGLKILALEQAASELEDCKKTRASLEEKLLQLENDLKAKETRCVQDTELSHSKRINRQHQQTIQLLEQEKAEFQTKAQVLEEELKLIKEQKRNQVSKLNRKSLPVHDDLKASKQNPVVKNTIQYRSNRRKSLKNDREVMKDQQDPGYSIKHQSEVETELGLLDENVHAVEVDPLPKTQLVENELAKEKEVKNIYEVQFDRSPSQDRNNQANGPVKPMAEELVTKEKFERTKSMLEAELRDIQERYFHMSLKYAEVEAEREELVMKLKATRKKGWLS

SEQ ID NO: 134408 - protein, 416 aa, Glycine max
  Coding DNA Sequence Number=SeqID_17630
  Gene Ontology: Mol. function=RNA-directed DNA polymerase activity; Cellular component=intracellular; Biological process=RNA-dependent DNA replication
MTDMCLMADIIIPPKFNVPDFDRYKGTTCPKNHFKMYCRKMGAYSRDEKDLAAQVALPMVEREMIMMIVDTLPIFYYEKLVGYMPASFADLVFAGERIEVGLKRGKFDYVSPADTNNRRTETVGAMRKEGDAHAITLTPAWPKPQQAPHAQRGPLQTSAPAQPRLAGNANPDMGSNIGRNLPAKKAPEFAPIPISLEEANEFLYIIQQSEFKIVEQLNKNPARAHVAQDISVEGFKGIVNNITANNYLTFVEEEIFAEGRGHNRALHVLVKCMEYIMARVLIDNGSSLNLLGSKRGDRPPDSNWAPHLPDVLVSCSSSMPYVETTEESFEMTFQSFEVVSNASIESLPIQPRMSDTVIMVAWVMLGHSYEPIMGLGKNKDGMVGQVDIKGNCERFELGYKPTRTDVRKNILERRNK

SEQ ID NO: 134409 - protein, 212 aa, Glycine max
  Coding DNA Sequence Number=SeqID_17631
  Pfam annotation: Domain name=zf-DNL; Domain location=129-185; Score =32.5; E_value=3.4e-07; Accession=PF05180.3; Description=DNL zinc finger
  Subcellular localization annotation: CTP_CleavageSite=44; ConfidenceScore=5.74e-01
METLATSSSATLPSSSSPFSIFPSRRTSLSPPKTLQFRLPSSKRDDARDSDSNQNNLPILSDRCLSLSPLSKDAAMGLVLSAATGRGWTTGSGMEGPSVPAVGRDSESGTGNISTFPWSLFTKSPRRRMLVAFTCTICGQRTTRAINPHAYTDGTVFVQTSGRWLATYRKNSKRQVILHSQLQEFFSVNTLNWFMDKWTGLCGSMVLMPVLN

SEQ ID NO: 134410 - protein, 536 aa, Glycine max
  Coding DNA Sequence Number=SeqID_17632
  Gene Ontology: Mol. function=DNA binding; Cellular component=nucleus; Biological process=electron transport
  Homolog annotation: Hit_ID=Q7G1Q5; Match level="QueryCoverage=76%, HitCoverage=80%, E-value=1e-136, Identity=59%"; Hit description =Transducin family protein, putative, expressed
  Pfam annotation: Domain name=WD40; Domain location=126-165; Score =11.3; E_value=1.8; Accession=PF00400.22; Description=WD domain, G -beta repeat
  Pfam annotation: Domain name=WD40; Domain location=179-218; Score =3.4; E_value=14; Accession=PF00400.22; Description=WD domain, G-beta repeat
  Pfam annotation: Domain name=WD40; Domain location=317-358; Score =16.4; E_value=0.11; Accession=PF00400.22; Description=WD domain, G -beta repeat
  Pfam annotation: Domain name=WD40; Domain location=362-400; Score =21.6; E_value=0.0029; Accession=PF00400.22; Description=WD domain, G- beta repeat
  Pfam annotation: Domain name=WD40; Domain location=37-75; Score=37.1; E_value=6.1e-08; Accession=PF00400.22; Description=WD domain, G-beta repeat
  Pfam annotation: Domain name=WD40; Domain location=80-120; Score =11.7; E_value=1.6; Accession=PF00400.22; Description=WD domain, G -beta repeat
  Pfam module annotation: Pfam domain module=WD40::WD40::WD40::WD40::WD4 0::WD40; Domain location=126-165::179-218::317-358::362-400::37 -75::80-120
MNKRKALPDLCNREVGHLSPRNFALRLGSSEDLVLRLQLLRNLQKHRGCVNAVSFNADGDILVSGSDDCGIILWDWETGRIRLSFHSGHSNNVFQAKIMPHSDDRTIVTCAADGQVRHAQLLENGRVETKCLAKHQGRAHKLAIEPGSPHIFYTCGEDGLVQRFDLRTGAATELFTCQPIKDRWSYMPVIHLNAIAIDPRNPNLFAVAGSDEYARLYDIRKYKWDGSTDFGQPTNFFCPPHLIGDQQVGITGLAFSELRELLVSYNDELIYLFTQDMGLGPNPPDPVSPKSMNSDASEIGFSHGSVSSQSKMDADEKVTPQVFKGHRNCETVKGVNFFGPKCEYVVSGSDCGRIFIWKKKSGQLIRVMEADKYVVNCIESHPHTMVLASSGIEHDIKIWTPKALEKATLPKNIEQRVHVFDHIHWFTIGGGYDDDDDDNIMFDDDYEVDMSDNDDDEEEEDDDDDDDNDDNYSAYPEDLMQLISLPRRRVRTESNGENSSTDRDLLQLILTFNANSDSSNEDDDDGDTTSQDDLFS

SEQ ID NO: 134411 - protein, 432 aa, Glycine max
  Coding DNA Sequence Number=SeqID_17633
  Gene Ontology: Mol. function=tRNA (guanine-N2-)-methyltransferase activity; Cellular component=mitochondrion; Biological process=tRNA processing
  Homolog annotation: Hit_ID=Q9LYL0; Match level="QueryCoverage=88%, HitCoverage=88%, E-value=1e-148, Identity=64%"; Hit description=N2, N2-dimethylguanosine tRNA methyltransferases-like protein
  Pfam annotation: Domain name=TRM; Domain location=57-422; Score =138.7; E_value=1.6e-38; Accession=PF02005.7; Description=N2,N2 -dimethylguanosine tRNA methyltransferase
  Subcellular localization annotation: CTP_CleavageSite=30; ConfidenceScore=5.58e-01
MLFTLSNAVQTLSSPCTYFPHNSSSKFKCVSSKVPVFAQKPRESSYYIERGLEFCAGDAFFRQESATGRDLGVLAASLHKKENGRLRVLDALCGCGIRSLRYLAEAEADFVAANDGNEDYGSTIVENLMRVSAEEEGRWVVTHLEANRVMMDYYLQKSFFDFIDVDSFGSDSSFLRSAICTLKLGGLLYVTSTDGFSSGGHRPHHSLAAYGAYVRPMPYSNEIGLRMLIGGVAREAALLGYHITPLFSYYAFHGPVFRVLLRLNRGKIHDSRHYGYIGYCHQCGNSHEFSWDRLGQISCSCSTPKVSNSLVVSGPLWTGPLHDAAYLTNMLNLAKQWKWIVDDGKDSLEKLIKLMVDESDPKLPFGYIKLDEMASRAKINSPPLKALMSAMHQKGYAASRSHIETNAIKTNCPMTECIKIAKELLQLQVSAA

SEQ ID NO: 134412 - protein, 343 aa, Glycine max
  Coding DNA Sequence Number=SeqID_17634
  Gene Ontology: Mol. function=hydrolase activity, hydrolyzing O -glycosyl compounds; Cellular component=membrane; Biological process =carbohydrate metabolic process
  Homolog annotation: Hit_ID=Q8VXZ7; Match level="QueryCoverage=93%, HitCoverage=90%, E-value=1e-131, Identity=60%"; Hit description =Putative alpha-galactosidase
  Pfam annotation: Domain name=Melibiase; Domain location=15-297; Score= -145.6; E_value=1.4e-07; Accession=PF02065.9; Description=Melibiase
MTKQKIRNALLVHLVILFFFSTSVVSARVVSLLQNYGNPIFRSNFHSIYDTSKYGVFQLSNGLADALVSTGLADLGYVYVNIDDCWSSVTRNLKGQLVPDHKTFPSGIKALADYVHGKGLKLGIYSDAGYPPMRDALNATGQKIFYSLCEWGVEDPALWADKVGNSWRTTGDINDSWASMTTIADLNDKWAAYAGPGGWNDPDMLEVGNGGMTYQEYRAHFSIWALAKAPLLIGCDVRNLTAETLEILSNKEVIAINQDSLGVQGRKVQVSGADGCRQVWAGPLSGNRLAVALWNRCSKVATITASWEALGLESGVHVSVRDLWQLETFSLEIIKRQKPPTVL

SEQ ID NO: 134413 - protein, 187 aa, Glycine max
  Coding DNA Sequence Number=SeqID_17635
  Gene Ontology: Mol. function=nucleic acid binding; Biological process= transport
  Homolog annotation: Hit_ID=Q8H6Q8; Match level="QueryCoverage=99%, HitCoverage=6%, E-value=3e-33, Identity=37%"; Hit description=CTV.20
MGIDAAVLMCLRNIRHNQFEDSLIGTVETSLGQGPIYFNCYPNKTVSLMDRNILDSLFLNIHFHGLDMKEGSIPTALIYRIQYKVMNTCASRVLLKPQKGETTLFITDMTKANVSLPRKIKWDEVTLPERWVMDKATPSIPRPAPTIEHIKQDNSGKIEIIFNRRNSFSSRIEASRSEYESAKRSFS

SEQ ID NO: 134414 - protein, 149 aa, Glycine max
  Coding DNA Sequence Number=SeqID_17636
MEAFGLLAGNGKKMKKNYFRICRACSAVQSCSVTVEATDSASHQSRTRMHVRCESDAGHAAEVSHPCFLALDIEQMKSSSANLIKQMDFIEDTKGRLCVPKEEVKIEVPPELVEDNLLPLRYRPFNYGDYFQYFVSTLKENALDVFVGV

SEQ ID NO: 134415 - protein, 94 aa, Glycine max
  Coding DNA Sequence Number=SeqID_17637
MAVSEWVAAAIDVYVMLLVPLLGPDGGTGPFGSMFRIIGPYFPPASLVPGNASIPATLVWPHPDTCRGAGSSGTTTLSLGSARFKEGSVAARLK

SEQ ID NO: 134416 - protein, 149 aa, Glycine max
  Coding DNA Sequence Number=SeqID_17638
MGKGGLRRRLPEDPLRVLPELPQEAVPEKFRKKCSSGRNQRSSGTPLPEIEYFTNYKKIRVPHDLHIIVRTRGLGRAIGRVIDRDRQNDHDDVPERRRPTSGTTSSEIDLSNFRKKYFWKSNILIPKLLPHVVKISFGNSFLLFIFSKN

SEQ ID NO: 134417 - protein, 88 aa, Glycine max
  Coding DNA Sequence Number=SeqID_17639
MIQREWRKELAFPVTRNAVDFDSKCPFASSKVQGCVVIDYTNMVIDYQRATLPEITACNRLHYYGNRLPVVILAKKQKTKGFLGEKKF

SEQ ID NO: 134418 - protein, 127 aa, Glycine max
  Coding DNA Sequence Number=SeqID_17640
MATRGSKPRFVLIIVLPLLLSLMCQEIVATGRLRSKEGCTSTGIECNVKVTGSHDPLEMDEYGQAYVSPPHDDYDYDFYRKHGDIPSPGVDLAMIVIMVLGTKTCLLVKYRAEDDDVRDVLYGLWAF

SEQ ID NO: 134419 - protein, 909 aa, Glycine max
  Coding DNA Sequence Number=SeqID_17641
  Gene Ontology: Mol. function=potassium ion transporter activity; Cellular component=integral to membrane; Biological process =potassium ion transport
  Homolog annotation: Hit_ID=O22881; Match level="QueryCoverage=73%, HitCoverage=99%, E-value=0.0, Identity=55%"; Hit description =Potassium transporter 2
  Pfam annotation: Domain name=K_trans; Domain location=21-668; Score =1006.1; E_value=1.2e-299; Accession=PF02705.7; Description=K+ potassium transporter
MDLESSKCWDTSKGSWKTILLLAYQSLGVVYGDLSISPLYVYTSTFAEDIEHSETNEEIFGALSFVFWTLTLVPLFKYVFVVLRADDNGEGGTFALYSLICRHAKVSLLPNRQHADEALSTYKMEEAPEKDTSKVKMMLEKYKGLHTALLIVVLLGTCMVIGDGLLTPAISVSGLEVSMSKKHHQCSEAMFADLGHFSYMAIQIAFTFLVYPALILAYMGQAAYLSHHHDSELQISFYVSVPESVRWPVLILAILASVVGSQAIISGTFSIINQSQSLGCFPRVKVVHTSDKIHGQVYIPEINWILMILCIAVTIGFRDTKHMGNASVSTRVSSDDRDAGDNMPYFFTSLTKFCEGAWLPILLALFLMIIMFLWHYATIRKYEYDLHNKVSLDWLLALGPSLGIARVPGIGLVFTDLTTGIPANFSRFVTNLPAYHRILVFVCVKSVPVPHVPAAERYLVGRVGPAAHRSYRCIVRYGYRDVHQDVDSFESELVARLADFIQYDWYRSRRSSMSIEDDGSNSNESSSYRLTVIGTTGFTIQPGYESGGESVQQASVSVGFPTVQSVTDVIEMEPVMTERRVRFAIEDEPESDARSETGVQMQEELEDLYAAQEAGIAFILGHSHVRAKQGSSVLKKLALNYGYNFLRRNCRGPDVALKVPPVSLLEDIGFNAIAVCSFQKDFVNETVGMTLPLKFNAREILSFYEFPKIPHSPLLTTRFCEWQQIDNHHSAEYQEKAKMGLGTLPLTPSYSSFSSKSGGLLHDITNHSRVNRSMKFRVSAKQEKQEEKKKQSLFSSVTEALDFSQVRSAEDAQLIEEAREATRSGERMSREQYGALRRKIGGTYKDFFKSYVEVDGAYVEEGWVDKTCKVCKKDTKGEARQVDKLGRYVHVACLEKANAGNFFTRLFSR

SEQ ID NO: 134420 - protein, 93 aa, Glycine max
  Coding DNA Sequence Number=SeqID_17642
MCVKARLQSDSLGSISQNSHVAHAAHHDNVLSEVVIFTSTTLRLLGRFGIPSHSHLDVIETSKPFTVKKLIWVNAKKGQITKLIAIYPQWGLL

SEQ ID NO: 134421 - protein, 382 aa, Glycine max
  Coding DNA Sequence Number=SeqID_17643
  Gene Ontology: Mol. function=oxidoreductase activity; Cellular component=proton-transporting two-sector ATPase complex; Biological process=flavonoid biosynthetic process
  Homolog annotation: Hit_ID=UPI000034EE1D; Match level="QueryCoverage =98%, HitCoverage=99%, E-value=1e-131, Identity=60%"; Hit description= oxidoreductase, acting on paired donors, with incorporation or reduction of ...
  Homolog annotation: Hit description=molecular oxygen, 2-oxoglutarate as one donor, and incorporation of one atom each of oxygen into both donors
  Pfam annotation: Domain name=2OG-FeII_Oxy; Domain location=231-330; Score=149.8; E_value=7e-42; Accession=PF03171.10; Description=2OG -Fe(II) oxygenase superfamily
MSPAMVVGSGEKGESDTPGNQYQKGVKQLVENGLHTIPKKYILPPSDRPATNSENSNVAKQNLQLPIIDFSELIGPRRPQVLQSLANACERYGFFQLVNHGISDDVISSMRDVSGRFFDLPFEERAKHMTTDMHAPVRYGTSFSQTKDSVFCWRDFLKLLCHPLPDFLPHWPASPLDFRKVVATYSEETKYLFLMLMEAIQESLGIKVEVKKQEEETEGNDNNILKDLEDGSQMMVVNFYPPCPEPDLTLGMPPHSDYGFLTLLLQDQVEGLQIQFQGQWLTVKPINNAFVVNVGDHLEIYSNGKYKSVLHRVIVNAMKKRTSVASLHSLPFNCTVRPSPKLIDEANPKRYADTNFDTFLAYVSTREPKRKEFLDSRKLSST

SEQ ID NO: 134422 - protein, 239 aa, Glycine max
  Coding DNA Sequence Number=SeqID_17644
  Gene Ontology: Mol. function=oxidoreductase activity; Cellular component=membrane; Biological process=electron transport
  Homolog annotation: Hit_ID=Q2MJ00; Match level="QueryCoverage=99%, HitCoverage=38%, E-value=7e-95, Identity=77%"; Hit description =Cytochrome P450 monooxygenase CYP97C10
MRCAERLVEKLQPDALNGTAVNMEAKFSQLTLDVIGLSVFNYNFDSLNMDSPVIEAVYTALKEAEARSTDLLPYWKACFFQSYIHDMDFLSLFVMSCVHFKFLCKIIPRQIKAEEAVSIIRKTVEDLIEKCREIVESEGERIDVEEYVNDSDPSILRFLLASREEVSSVQLRDDLLSLLVAGHETTGSVLTWTLYLLSKDSSSLAKAQEEVDRVLQGRRPTYEDIKNLKFLTRCIIESL

SEQ ID NO: 134423 - protein, 73 aa, Glycine max
  Coding DNA Sequence Number=SeqID_17645
MVVARLGDKVVYNGAEVQMWHTLARWLDNKSLSLKKGMGLILFGDAEYKMGGAGYKCPYVLSDRLAQISYQPK

SEQ ID NO: 134424 - protein, 189 aa, Glycine max
  Coding DNA Sequence Number=SeqID_17646
  Gene Ontology: Mol. function=oxidoreductase activity; Cellular component=membrane; Biological process=electron transport
  Homolog annotation: Hit_ID=Q9SCP8; Match level="QueryCoverage=80%, HitCoverage=27%, E-value=2e-59, Identity=74%"; Hit description =Cytochrom P450-like protein
MKLTSEFSHSHNSKTLSQTQLKQYLKKREHYRPERTFGDGETGPKQELGDLGNKTLGVFAVVPEHVLGDGGVANDDEVSGAGGEAVDGAVVLHPLEEREEERAAEEIRDVVELGGGEGNAGVVVAGGEGAGEGGEPVGAEPRAGLGGAGAGVGGFVDGGFDGEAIRFWSGRGNGGSAGKEERERCEMGE

SEQ ID NO: 134425 - protein, 509 aa, Glycine max
  Coding DNA Sequence Number=SeqID_17647
  Gene Ontology: Mol. function=nucleobase transporter activity; Cellular component=membrane; Biological process=nucleobase, nucleoside, nucleotide and nucleic acid transport
  Homolog annotation: Hit_ID=Q9LZD0; Match level="QueryCoverage=95%, HitCoverage=81%, E-value=0.0, Identity=64%"; Hit description=Uracil transporter-like protein
  Pfam annotation: Domain name=Transp_cyt_pur; Domain location=31-477; Score=359.4; E_value=5.8e-105; Accession=PF02133.6; Description =Permease for cytosinepurines, uracil, thiamine, allantoin
MKCSNSSSYTSPPDFELESDDPTLTNEDLKPTTPSQRTFSGFEIASLWVGLVVGVPSYYLAGSLVDLGMAWWQGIATVVAANMILLVPLVLTGHAGTRYGISFPVLVRSSFGINGAHVPTLIRALIGCGWYGIESWIGGEAIFLLLPKAMKEATSLSQSLPWLGTSPLEFACFLVFWVAQLAFVWKGIDGIRKLEKYSAPILVALTSCLLIWSCVKAGGIGHMLSLSSRLSTSEFWSVFFPSLTANISFWATVAINIPDFTRYAKSQKDQVIGQIGLPIFMGAFTFVGLAVTSSTKVIFGQVISDPILLLGQIGGLTTKIVAILGISLAIITTNIAANVVAPANALVNLSPKWFTFRRGALLTALLGIAFQPWRLLKSSESFVYTWLVGYSALMGPIAGIVLADYYIVQKTNLNVSDLYSRSPYGAYRYSRGFNVAAILALVVGVLPVVPGFLQKVGIATSVPNTFVVIYNNAWFVSFFSAGFLYLVLSNLRGKPGNSAARDPLLPTAK

SEQ ID NO: 134426 - protein, 86 aa, Glycine max
  Coding DNA Sequence Number=SeqID_17648
MSRNFTDCLMMGVKFLEAVKRRLHSIKQWSPDEIRAINSWGSGLDGGGCMNDNQFMGLRIRFDGGGCTNSARQSIHGAPDSMVEDA

SEQ ID NO: 134427 - protein, 75 aa, Glycine max
  Coding DNA Sequence Number=SeqID_17649
MVSCAYATLDLVCVSTLEVAQGWVGYASASPSFSSIAVSLKFIHDRGNHCPRGVLTTVHRRLVGPTFPCHGITTY

SEQ ID NO: 134428 - protein, 195 aa, Glycine max
  Coding DNA Sequence Number=SeqID_17650
  Homolog annotation: Hit_ID=Q5YJL6; Match level="QueryCoverage=85%, HitCoverage=93%, E-value=1e-33, Identity=47%"; Hit description =Autophagy protein AGP6
  Pfam annotation: Domain name=Mod_r; Domain location=37-185; Score =108.3; E_value=2.3e-29; Accession=PF07200.3; Description=Modifier of rudimentary (Mod(r)) prote
MEVLARGSQEHQHGSSSSSSNTSHVPPAQAAGLVAILKDKSVDELRKLLSNKDVYQQFLSSHDEVKIQNNVIDPTKAYESKVNDDLCKENLQLADENLRKEPRVVELRNQLAVAQEKLNELEKQKEEMLKLNSPLYLLQWIQEAMNNTEEESENLHQQVLDREIDLGAFLQKYKKLRTAYHRKSLIHLAARTSNI

SEQ ID NO: 134429 - protein, 178 aa, Glycine max
  Coding DNA Sequence Number=SeqID_17651
  Gene Ontology: Mol. function=pepsin A activity; Cellular component =cellulose and pectin-containing cell wall; Biological process =proteolysis
  Homolog annotation: Hit_ID=Q5ZAZ8; Match level="QueryCoverage=49%, HitCoverage=17%, E-value=2e-33, Identity=75%"; Hit description =Putative aspartic proteinase nepenthesin II
GAAAECSPRVNQCSYTFQYGDGSGTSGYYVSDAMYFNLIMGQPPAVNSTATIVFGCSISQSGDLTKTDKAVDGIFGFGPGPLSVVSQLSSQGITPKVFSHCLKGDGNGGGILVLGEILEPRMYKAFLKEIDLVILEDLNVSQDDIVLKGSITPSHQNPFGFYCILAYTNPKLCHMPHS

SEQ ID NO: 134430 - protein, 154 aa, Glycine max
  Coding DNA Sequence Number=SeqID_17652
  Gene Ontology: Mol. function=DNA binding; Biological process =regulation of transcription
  Homolog annotation: Hit_ID=Q1RZ93; Match level="QueryCoverage=78%, HitCoverage=32%, E-value=2e-35, Identity=65%"; Hit description =Homeodomain-related
  Pfam annotation: Domain name=Myb_DNA-binding; Domain location=96-147; Score=35.4; E_value=2e-07; Accession=PF00249.21; Description=Myb-like DNA-binding domain
QNHFFHQQQQPLFQPQHQSLSQDLGFLRPIRGIPVYQNPPPIPFTQHHHLPLEASTTTPSIISNTNTGSTPFHSQALMRSRFLSRFPAKRSMRAPRMRWTSTLHARFVHAVELLGGHERATPKSVLELMDVKDLTLAHVKSHLQFIPYEFLESA

SEQ ID NO: 134431 - protein, 142 aa, Glycine max
  Coding DNA Sequence Number=SeqID_17653
MVAEIIDLSDSPPSSPWSSHNDAARILNFDSVSNEKNQFEKVIPISLMACTNPNQPQTSLWRAASRHTNEHSQIATTFQPSMQLQRVATVLEPVPESITCMFPHGARLKEPWTHREHEFVSFKLHILSILSFCFSISITLLQ

SEQ ID NO: 134432 - protein, 302 aa, Glycine max
  Coding DNA Sequence Number=SeqID_17654
MPGWILDMSDGCQANKSVFLCSMSVMHLCLWLLDELFNGFWASVKGVIVRIYVKFIVQACLVDGQGSNWRPFIHAHDLSTFSHYKVSLGRLSGKRIGCYLQALYIALSCLLLVFLNGYNFPDQGREFHFQMRCEDYGLKLIKCLHADQTFGLYSLAYKVEEWIDIRVDSFVGDLKPLERLIPLKSLSMKGIGERLRCTGKSARNGVDYTFDLLDSAHKYVQEFSKGLVVYFSQTGQGDLGYAVRFAGCVLHTEVFDEGVKVVYGSRFACVRKASRCSSGFVVPSYCSRLSRFHLKGMSASIM

SEQ ID NO: 134433 - protein, 98 aa, Glycine max
  Coding DNA Sequence Number=SeqID_17655
MVLLLSTWPLAVVPVYPFPICRRAKEAQTVEIVRSSVWHICKLLALSAPPGKVEGVCLECWPVVVDSHHFGGKGVSSDVETVDPFMKFSHDIFCQLTV

SEQ ID NO: 134434 - protein, 102 aa, Glycine max
  Coding DNA Sequence Number=SeqID_17656
MVSTRSGLKRETLFEGSHLHPTAMTDTNTLQQLQNRIVEMERRHEEELRKLKADHEAYIKCPEGKEHSAYTLPKRTQGESQPRRTINTSYDLSLSHMHQPAG

SEQ ID NO: 134435 - protein, 303 aa, Glycine max
  Coding DNA Sequence Number=SeqID_17657
  Gene Ontology: Mol. function=RNA-directed DNA polymerase activity; Cellular component=mitochondrion; Biological process=RNA-dependent DNA replication
MVFKSQSIAQHVAYLEEVFGELCKYDMFFNPKKCTFEVGGGKFLSFMITDQGIKANLDKCTAILEMHSPTNILEVKKLNGSLASLSRFLLKLAEKAKPFFKLLKKTESFLWDESYEQAFLAFKITIATTASNIKGSGVGFILEGPDNVTLEQALKLYFRASKNQAEYEKLVANSQLVHGQVANKYQTKEIVMLKYYHIAKTFIDNFECFEMYYISRESNTKVNLVSKLANTKKVEHLKTIIQETLQTPTIDAEEVMAREEKEPSWRTPYKNFLIQGVLPLNKDEARCLKRKANYYIILDGELF

SEQ ID NO: 134436 - protein, 64 aa, Glycine max
  Coding DNA Sequence Number=SeqID_17658
  Homolog annotation: Hit_ID=Q8H885; Match level="QueryCoverage=78%, HitCoverage=5%, E-value=2e-16, Identity=82%"; Hit description =Putative mitotic control protein dis3
MDPITADLRNMNSLAKKMRLRRIERGALTLASAEVKFQIDTETHDPLDIGIIFLLNNISVLLFL

SEQ ID NO: 134437 - protein, 132 aa, Glycine max
  Coding DNA Sequence Number=SeqID_17659
  Gene Ontology: Mol. function=ribonuclease activity; Cellular component=nucleus; Biological process=regulation of progression through mitotic cell cycle
  Homolog annotation: Hit_ID=Q9SHL7; Match level="QueryCoverage=72%, HitCoverage=10%, E-value=3e-44, Identity=89%"; Hit description =Putative mitotic control protein dis3
  Pfam annotation: Domain name=RNB; Domain location=9-130; Score=-65.0; E_value=5e-07; Accession=PF00773.9; Description=RNB-like protein
MGFGSSKVREEKLCFHIVSSFYSHEERVDIADVTNFVHPGTPLDDEAAQRGTSVYLVERRIDMLPKPLTEDICSLRSDVERLAFSVIWEMTPEADIISTRYTKSVIKSSAALSYVEAQARMDDSVYACYNCL

SEQ ID NO: 134438 - protein, 201 aa, Glycine max
  Coding DNA Sequence Number=SeqID_17660
  Gene Ontology: Mol. function=ribonuclease activity; Cellular component=exosome (RNase complex); Biological process=rRNA processing
  Homolog annotation: Hit_ID=Q9SHL7; Match level="QueryCoverage=95%, HitCoverage=20%, E-value=1e-64, Identity=64%"; Hit description =Putative mitotic control protein dis3
  Pfam annotation: Domain name=OB_RNB; Domain location=87-148; Score= -3.1; E_value=0.055; Accession=PF08206.2; Description=Ribonuclease B OB domain
MQLFEWLLSENKRKASEEGILAETVESYVKSLVRPDLLDLLVRPASEDVDMEEVEDLRPSKRKVIYSEHKPMSEITSGLHRGIYHQGKLRVNRYNPFEAYVGSESIGDEIVIYGRSIMNRAFDGDIVAAELLPQDQWQGVSSLSIAHEEDEDENEDVHLAPNSADDAPRAVSQQGSSEQLNAVPSRPCGRIVGIIKRNWHS

SEQ ID NO: 134439 - protein, 163 aa, Glycine max
  Coding DNA Sequence Number=SeqID_17661
  Subcellular localization annotation: CTP_CleavageSite=51; ConfidenceScore=5.14e-01
MTHHMCSWVRGQWIPFDADTLNQFLDHMCSRVSNDFAQTSIRSQVRIMRTRMTTLTQMWMMLLLNNIFPSDHNSDLPLLKCQLVYAILTGMSVHMAQLIANAIYIFAGMTPTRYPLDLEKSNRALGFPALITVLCQFYEVPVIPSKVIRPPITRAFIEKYCTP

SEQ ID NO: 134440 - protein, 202 aa, Glycine max
  Coding DNA Sequence Number=SeqID_17662
  Gene Ontology: Mol. function=ribonuclease activity; Cellular component=exosome (RNase complex); Biological process=rRNA processing
  Homolog annotation: Hit_ID=Q8H885; Match level="QueryCoverage=61%, HitCoverage=14%, E-value=1e-40, Identity=65%"; Hit description =Putative mitotic control protein dis3
MHQQLKGRINDNFLINYRRYTPAPVSCSDTWAIVITAGKHRGLTPNTEKASKQAHSPGRVTQRRAISSASNMLHNKSFVKKTKGGKVMKQVREHYLRDDIYCGAPFCTVCDSSGARLSASPSTILVVDTNVVLNQIDLLENPAIDDVVVLSIVLEEVKNKNMSVYNRIRAICSNSMRKFFVFSNEYHRINKESMGKLRMQQD

SEQ ID NO: 134441 - protein, 83 aa, Glycine max
  Coding DNA Sequence Number=SeqID_17663
MENMVDDVTQALSVHPCSISLSMCLWLSGKLCSGKLRILMALRKCRVVPTQLKMGSPHGTPLGSHPTLLGTDTRTMFTFGTSF

SEQ ID NO: 134442 - protein, 278 aa, Glycine max
  Coding DNA Sequence Number=SeqID_17664
  Gene Ontology: Mol. function=DNA binding; Biological process=DNA integration
  Homolog annotation: Hit_ID=Q1SKC8; Match level="QueryCoverage=67%, HitCoverage=51%, E-value=2e-54, Identity=52%"; Hit description =Integrase, catalytic region
RTREPRVSLSPKGRLRQMGFVDSRVRHGHQRQKGSENVVADHLSREEAQSILWHYYSSPYGGHYSGDRTTSGILLARFFWPSIYKYAHDHVASPYHPQTNGQAELSNKELKRILEKTITSSRKDWAAKMDDALWAYRTTFKTLIGFSPFLMVYGKTCHLSVELEYRVYWVLKFLNFDGSLSREKQRLQLLELEEMRPNAYESSWHYKQKIKMFFPGKLKSKWSGPFMVKEVKPSGVVELINPTTSNLEKTWIINGQRLKIYNGSDIERLTTVIHLQDP

SEQ ID NO: 134443 - protein, 199 aa, Glycine max
  Coding DNA Sequence Number=SeqID_17665
  Subcellular localization annotation: CTP_CleavageSite=57; ConfidenceScore=5.46e-01
MGPKYTLRLMRTLGSSLASLAQSSSSLLSNALGGRIASPWMHATTPSVVYLPPSWIRLSSFRCPPSLLHQALRPLPGQTALSPFHVGIDGFVHNISPTLGFSTPLHSCHNLPFGGVTKKASRAGQGCVFHRRKTRGVATNVYLRKTLEKSKDDGLCILKMRIRELFLCTGKGVSFAPTYSPIAMRKSDLRSSFIELIIG

SEQ ID NO: 134444 - protein, 91 aa, Glycine max
  Coding DNA Sequence Number=SeqID_17666
MDPITILVALKWLQCEGYSSELRHDFEIPNGENARNLVANLVLKCHNDPTVNISEIVIFMRHVWWSAGKERLRRENEIERRRRRLRSQSEN

SEQ ID NO: 134445 - protein, 65 aa, Glycine max
  Coding DNA Sequence Number=SeqID_17667
MGSRALPTLVSYTRDAFEVHTGWIGCTKYQSEGMITGMGIGRPQRHSLTILNNISGVVKPGRRSL

SEQ ID NO: 134446 - protein, 38 aa, Glycine max
  Coding DNA Sequence Number=SeqID_17668
MAFRQWDWQNRHGISPLGLAKQAPITSWQQWVSPVERK

SEQ ID NO: 134447 - protein, 77 aa, Glycine max
  Coding DNA Sequence Number=SeqID_17669
  Homolog annotation: Hit_ID=Q9FFC3; Match level="QueryCoverage=57%, HitCoverage=8%, E-value=5e-12, Identity=74%"; Hit description =Protease-like protein
MKLCYDLVLKDKIVVYDIAQQRIGWANYDCSLSVNVSVTMSKDEYINAGQLHVSSSKIHILSKLLPCWESKSSLKIM

SEQ ID NO: 134448 - protein, 617 aa, Glycine max
  Coding DNA Sequence Number=SeqID_17670
  Homolog annotation: Hit_ID=Q1SAY7; Match level="QueryCoverage=54%, HitCoverage=59%, E-value=2e-16, Identity=22%"; Hit description=Actin- binding, actinin-type
GSSGNIPEEGVLPERSSGTLKVLPEVRVFRILPDEPLLPESSRKRFSGSLPEEVFFRKTFGYFRKNTSSGNFPENVLPELSEEPLTGSIVMLRFHCYANSDAHYKLTVRGRGTNLFAEKKKKALARLAEKKLHGEEKKKQVPGEEEAVPGEKKKLCSGREEESVFRERRRISLKAENLKPVILLKAGVPLAVSLAGLIYAWIVAKKNLSTKVFSSPEKECVSPKITCHQGTKHEESFLHNLSSIKYEESSFSPMNSSVLSGSLVIHDHNNCCLEQEITSLRSQIEGLQMRELALRLQFELYCEMKEQESLLLDVKNMLSLENDRAEFLSKEISSIETETKRLESFVVQYMSVVEEHQYWKSQNRVLQKRVQRLLRDSKAKSRLIKCQALKIKEKEEEILRNHDALQTRVCVINKLEGEIMELQRILEQLEDEKDEVVKKLETAEAYASKLDKEKMHRKPLKYYLEVESRDVSKEDYTKVLSELEEIKKDRATEIEELIHLRRVNACLREELMRHYEEQHEQDRDHEEVEFEGGLGVVKYESEHELHHSLLEHQNGSSAHGDHAASKRRKLLKRLKRWVEGSEKVRVKPEIKCLDMHSGSYGSKKPQVPPSVRFCSSA

SEQ ID NO: 134449 - protein, 187 aa, Glycine max
  Coding DNA Sequence Number=SeqID_17671
MKNPRKKKRPKPQKKLEKNKGVVAAAAVVAENENENEEEKRKRSILEALVEAFSLSSVREASMAYNIAGGDPDRASEILRKGFSDRSEDSFSCFSYGSSSSSSSSSGLELGSKGGWRQQQQQKKMVASTGTVSTVLGKEYVRRNNNNIRNKGLSSNGVFEMEEAEQFLCSMLGDDSDINLAVVRDVL

SEQ ID NO: 134450 - protein, 251 aa, Glycine max
  Coding DNA Sequence Number=SeqID_17672
  Gene Ontology: Mol. function=isomerase activity; Biological process =flavonoid biosynthetic process
  Homolog annotation: Hit_ID=Q2QYK6; Match level="QueryCoverage=73%, HitCoverage=88%, E-value=9e-53, Identity=57%"; Hit description =Chalcone-flavanone isomerase family protein, expressed
  Pfam annotation: Domain name=Chalcone; Domain location=43-250; Score =61.7; E_value=2.4e-15; Accession=PF02431.6; Description=Chalcone -flavanone isomerase
MNGGARATYRMGGLGTSHVVKGIEIDWKITRVNILQLNYFNLVATEEVLVDEITYPTKITTTKPLSLLGHGITDMEIHFIHVKFYSIGVYLEPEVVGHLDQFKGKSAKELEDNEEFFNALISAPVEKFIRLVVIKEIKGAQYGVQIETAVRDRLAAEDKYEEEEEEALEKVIEFFQSKYFKKLSVITYHFPANSATAEIVVSLEGKEDSKYVIENANVVEAIKKWYLGGSSAVSSSTIQSLASTFSQELSK

SEQ ID NO: 134451 - protein, 349 aa, Glycine max
  Coding DNA Sequence Number=SeqID_17673
  Homolog annotation: Hit_ID=Q9FUA7; Match level="QueryCoverage=45%, HitCoverage=85%, E-value=6e-55, Identity=67%"; Hit description=PRLI -interacting factor N
  Pfam annotation: Domain name=DUF1771; Domain location=184-249; Score =53.9; E_value=5.4e-13; Accession=PF08590.1; Description=Domain of unknown function (DUF1771)
  Pfam annotation: Domain name=Smr; Domain location=257-331; Score =69.3; E_value=1.2e-17; Accession=PF01713.11; Description=Smr domain
  Pfam module annotation: Pfam domain module=DUF1771::Smr; Domain location=184-249::257-331
ASDILLDLAASTNEKPNTARHPNYGVDNIDDERFFADPNDSLIDRRLECTSLSWEGYLSNNPWSVGSFGRKYAEVLNNSKANSAVSPGCTKSEIPQKVLESLFNIPKSTEHDKNTMNWRNVVKKIQSLGPGFYVSPHVAESQQRGLGLATLGNLSQSEEDSSCIFGKITSAILVEFTRKAKGDEYHVFREDSRKQWDSVKSYYTKAATAYTKRERAYAAYLSDQGKEQTKLAQKADTKASHDIFVARNKGIENVITIDLHGQHVKQAMRMLKLHLLFGSYVPSVQTLRVITGCGSHGVGKSKLKQSVINLLDREAIEWREENRGTVLIKLSRWREYSFLDTSSDSDSND

SEQ ID NO: 134452 - protein, 44 aa, Glycine max
  Coding DNA Sequence Number=SeqID_17674
MATIKGALSNFQRIEINEIHDFSSKREQHPQDQGSTTMKWKRKD

SEQ ID NO: 134453 - protein, 124 aa, Glycine max
  Coding DNA Sequence Number=SeqID_17675
  Subcellular localization annotation: CTP_CleavageSite=36; ConfidenceScore=5.16e-01
MDDMVLSNNEFMKSIVDNVKRDVCHSTKTTSKHVVTNSTKTTSNHLVKNLKATPSPLEQDFSQQNSGIRTCIETIFIYSENEDNTSKRVLGLKGKYVHLKTCTNVGGSSSKRKKVVEDVVYAAE

SEQ ID NO: 134454 - protein, 80 aa, Glycine max
  Coding DNA Sequence Number=SeqID_17676
MGLGVARGRVAWERGLMGSSTRLTCDAREMEKMDGGDRIGGKRVIKREWGGFGEENPTRKVHGLRRRAHRERSLCEKLGQ

SEQ ID NO: 134455 - protein, 88 aa, Glycine max
  Coding DNA Sequence Number=SeqID_17677
MGDQEETQEQMKADMSALKEQMASMTEAMLGMRQLMEKNVDTAAADEEGAHWGTTASLIWDTTRGASSTADMNPHGTRANLGSSRIKP

SEQ ID NO: 134456 - protein, 108 aa, Glycine max
  Coding DNA Sequence Number=SeqID_17678
MICMFRQTVDVKLIAEEAQACAYLLNDSLDLRDNEIADAIEGFPVHDICLHYDKDYLNSFDNLNLICIPILENKEHWYLMFITTEERKVYHLDSYLTNNVNEERERLI

SEQ ID NO: 134457 - protein, 56 aa, Glycine max
  Coding DNA Sequence Number=SeqID_17679
MEMQRKIKEKSLGSFLEKLCSWPASAPDRTSSIKRHLIYLGIKKENHAREILCKNM

SEQ ID NO: 134458 - protein, 276 aa, Glycine max
  Coding DNA Sequence Number=SeqID_17680
  Homolog annotation: Hit_ID=Q9LZW0; Match level="QueryCoverage=17%, HitCoverage=23%, E-value=5e-11, Identity=62%"; Hit description =Putative zinc finger protein
  Pfam annotation: Domain name=zf-C2H2; Domain location=68-90; Score =23.0; E_value=0.0011; Accession=PF00096.16; Description=Zinc finger, C2H2 type
MKISKKKGLKPEQQEKASNSNKEEVIDFMELSNKAQEQEQPSSKVVDSPLCDSKGADDENTKLEAKTFSCNYCKREFSTSQALGGHQNAHKQERALAKRRQGFDVGGFGHFPYYPYPSFYNSNSLYGGSFNRALGVRNDSMIHKLPWTPRYDHSWLKQQDHVPMPNSSIFDGFGIVKGCYPIIKSDGTLSLRQENGNANDGTLSLFPNAAANSTSQLVNNGGNANDGTLSLFANAATNSSSLLGNREILATKIDDHSMPEETSKAASANLDLSLKL

SEQ ID NO: 134459 - protein, 86 aa, Glycine max
  Coding DNA Sequence Number=SeqID_17681
MVISLCLYIFGLPISPKLVVIEAERKLAALVLNPRLRNQYLPTYAYRREEESQFYRSPKRRRERFDQLYSVRNGDEKKIRNLSGCL

SEQ ID NO: 134460 - protein, 978 aa, Glycine max
  Coding DNA Sequence Number=SeqID_17682
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=96%, HitCoverage=97%, E-value=0.0, Identity=57%"; Hit description =Receptor-like protein kinase
  Pfam annotation: Domain name=LRRNT_2; Domain location=32-74; Score =45.2; E_value=2.2e-10; Accession=PF08263.3; Description=Leucine rich repeat N-terminal domain
  Pfam annotation: Domain name=LRR_1; Domain location=103-125; Score =10.1; E_value=3.6; Accession=PF00560.23; Description=Leucine Rich Repeat
  Pfam annotation: Domain name=LRR_1; Domain location=127-150; Score =17.8; E_value=0.04; Accession=PF00560.23; Description=Leucine Rich Repeat
  Pfam annotation: Domain name=LRR_1; Domain location=152-174; Score =12.8; E_value=1.2; Accession=PF00560.23; Description=Leucine Rich Repeat
  Pfam annotation: Domain name=LRR_1; Domain location=176-198; Score =12.9; E_value=1.1; Accession=PF00560.23; Description=Leucine Rich Repeat
  Pfam annotation: Domain name=LRR_1; Domain location=200-222; Score =16.2; E_value=0.12; Accession=PF00560.23; Description=Leucine Rich Repeat
  Pfam annotation: Domain name=LRR_1; Domain location=224-246; Score =11.9; E_value=1.7; Accession=PF00560.23; Description=Leucine Rich Repeat
  Pfam annotation: Domain name=LRR_1; Domain location=248-270; Score =14.0; E_value=0.54; Accession=PF00560.23; Description=Leucine Rich Repeat
  Pfam annotation: Domain name=LRR_1; Domain location=296-318; Score =19.2; E_value=0.015; Accession=PF00560.23; Description=Leucine Rich Repeat
  Pfam annotation: Domain name=LRR_1; Domain location=320-342; Score =12.4; E_value=1.4; Accession=PF00560.23; Description=Leucine Rich Repeat
  Pfam annotation: Domain name=LRR_1; Domain location=344-366; Score =4.4; E_value=42; Accession=PF00560.23; Description=Leucine Rich Repeat
  Pfam annotation: Domain name=LRR_1; Domain location=396-418; Score =15.0; E_value=0.28; Accession=PF00560.23; Description=Leucine Rich Repeat
  Pfam annotation: Domain name=LRR_1; Domain location=420-442; Score =13.7; E_value=0.67; Accession=PF00560.23; Description=Leucine Rich Repeat
  Pfam annotation: Domain name=LRR_1; Domain location=444-466; Score =8.3; E_value=7.9; Accession=PF00560.23; Description=Leucine Rich Repeat
  Pfam annotation: Domain name=LRR_1; Domain location=468-490; Score =12.8; E_value=1.2; Accession=PF00560.23; Description=Leucine Rich Repeat
  Pfam annotation: Domain name=LRR_1; Domain location=492-514; Score =10.7; E_value=2.9; Accession=PF00560.23; Description=Leucine Rich Repeat
  Pfam annotation: Domain name=LRR_1; Domain location=516-538; Score =17.1; E_value=0.063; Accession=PF00560.23; Description=Leucine Rich Repeat
  Pfam annotation: Domain name=LRR_1; Domain location=540-563; Score =14.9; E_value=0.29; Accession=PF00560.23; Description=Leucine Rich Repeat
  Pfam annotation: Domain name=LRR_1; Domain location=79-101; Score =1.0; E_value=1.9e+02; Accession=PF00560.23; Description=Leucine Rich Repeat
  Pfam annotation: Domain name=Pkinase; Domain location=695-964; Score =107.9; E_value=2.9e-29; Accession=PF00069.15; Description=Protein kinase domain
  Pfam annotation: Domain name=Pkinase_Tyr; Domain location=695-964; Score=94.4; E_value=3.4e-25; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=32-74::103-125::127-150::152 -174::176-198::200-222::224-246::248-270::296-318::320-342::344 -366::396-418::420-442::444-466::468-490::492-514::516-538::540 -563::79-101::695-964::695-964
MRVLFSSMRVFLLLVWLLELVCVSVTAVNPSLNDDVLGLIVFKADIRDPKGKLASWNEDDESACGGSWVGVKCNPRSNRVVEVNLDGFSLSGRIGRGLQRLQFLRKLSLANNNLTGGINPNIARIDNLRVIDLSGNSLSGEVSDDVFRQCGSLRTVSLARNRFSGSIPSTLGACSALASIDLSNNQFSGSVPSGVWSLSALRSLDLSDNLLEGEIPKGVEAMKNLRSVSMTRNRLTGNVPFGFGSCLLLRSIDLGDNSFSGSIPGDLKELTLCGYLSLRGNAFSREVPEWIGEMRGLETLDLSNNGFTGQVPSSIGNLQLLKMLNFSGNGLTGSLPESIVNCTKLSVLDVSRNSMSGWLPLWVFKSDLDKGLMSENVQSGSKKSPLFALAEVAFQSLQVLDLSHNAFSGEITSAVGGLSSLQVLNLANNSLGGPIPAAIGELKTCSSLDLSYNKLNGSIPWEIGRAVSLKELVLEKNFLNGKIPSSIENCSLLTTLILSQNKLSGPIPAAVAKLTNLRTVDVSFNSLTGNLPKQLANLANLLTFNLSHNNLQGELPAGGFFNTISPSSVSGNPSLCGAAVNKSCPAVLPKPIVLNPNTSTDTGPGSLPPNLGHKRIILSISALIAIGAAAVIVIGVISITVLNLRVRSSTPRDAAALTFSAGDEFSRSPTTDANSGKLVMFSGEPDFSSGAHALLNKDCELGRGGFGAVYQTVLRDGHSVAIKKLTVSSLVKSQEDFEREVKKLGKIRHQNLVELEGYYWTTSLQLLIYEYVSGGSLYKHLHEGSGGNFLSWNERFNVILGTAKALAHLHHSNIIHYNIKSTNVLLDSYGEPKVGDFGLARLLPMLDRYVLSSKIQSALGYMAPEFACKTVKITEKCDVYGFGVLVLEIVTGKRPVEYMEDDVVVLCDMVRGALEEGRVEECIDERLQGKFPAEEAIPVMKLGLICTSQVPSNRPDMGEVVNILELIRCPSEGQEELA

SEQ ID NO: 134461 - protein, 114 aa, Glycine max
  Coding DNA Sequence Number=SeqID_17683
MEDQKIEARDCEFHSESTTTPSLSLHSCHIINNIYYARTLPLIHFALDSYVPDSATNTIRHPIQFYTFIKFVSVLLLPWEQGDKMGKNVNGKEMVIKQTSSKRQEIGGVKGPLK

SEQ ID NO: 134462 - protein, 258 aa, Glycine max
  Coding DNA Sequence Number=SeqID_17684
MSSEDITLVPDQRIENGLNSPLVFQDDPLRFNCPTPHHRRVGDPPPKTRELGSFIDDNKMFIDRDRFFAAAHNPEFRRYADCSARRDPRNWNTNGSATEDDDSDDDDEDDDDDEEDDTEVEGLVGDGTKSELKINNNNGAGGGGNLPAVANGKAHSYVAGRQLLVKDGGDIGQLVHSNVSGGDEDHRQEGLGKSQNSVTVAETDCEEYYSHFLQGGEGASGQKVMVDDSGCGFSGRKDAMYSSESGESLRAILSDPVT

SEQ ID NO: 134463 - protein, 64 aa, Glycine max
  Coding DNA Sequence Number=SeqID_17685
  Subcellular localization annotation: CTP_CleavageSite=44; ConfidenceScore=5.29e-01
MGKSRNFWVYQQFSCMHVAMPGHHSSGPMTNCCPRAARQRKRVSCGGRKGIEIGNEIVRMFREK

SEQ ID NO: 134464 - protein, 151 aa, Glycine max
  Coding DNA Sequence Number=SeqID_17686
  Gene Ontology: Mol. function=aminoacyl-tRNA ligase activity
  Homolog annotation: Hit_ID=Q7XJM9; Match level="QueryCoverage=85%, HitCoverage=27%, E-value=5e-26, Identity=48%"; Hit description =Putative methionyl-tRNA synthetase
MSVVPADTSDSDIKSLYLNIIAVSGHGVNHSDEVLKWVAFAEAFPVALDACFENLNRLNDELSEKSVLLGNGLKPSEADVIVYSVIHSSLISLVAYCQINLSDTNKEKLPHVLRWMDYIQHKQEFVGLFEKILLQKPGFEPPVRHHSIVAF

SEQ ID NO: 134465 - protein, 56 aa, Glycine max
  Coding DNA Sequence Number=SeqID_17687
MAAGSSSNWVMESGDVPHVLAVDDNLIDRKLVEKLLRNSSCKELHVSLAERIKSVQ

SEQ ID NO: 134466 - protein, 80 aa, Glycine max
  Coding DNA Sequence Number=SeqID_17688
MRMTSRHFGQTLFQDEFTEIRGKKRIRCKIEVDKNYSKCVRTKDKDVGAGGTTYPVEKRSCVEIAKRFNLSSLTYKFQHN

SEQ ID NO: 134467 - protein, 67 aa, Glycine max
  Coding DNA Sequence Number=SeqID_17689
  Subcellular localization annotation: CTP_CleavageSite=23; ConfidenceScore=5.08e-01
MELSSSNKVINADKKNPHTGVIVKMSNSGPKYNCSLAVSVLCNLNGVQGPQALERLGACDYVSRIRS

SEQ ID NO: 134468 - protein, 328 aa, Glycine max
  Coding DNA Sequence Number=SeqID_17690
  Gene Ontology: Mol. function=sequence-specific DNA binding; Cellular component=nucleus; Biological process=regulation of transcription
  Homolog annotation: Hit_ID=Q9FR28; Match level="QueryCoverage=73%, HitCoverage=62%, E-value=6e-46, Identity=45%"; Hit description =Transcription factor WRKY5
  Pfam annotation: Domain name=WRKY; Domain location=170-232; Score =133.8; E_value=4.9e-37; Accession=PF03106.6; Description=WRKY DNA -binding domain
MEEVINSIRRACVLAQNLEQDLPNLANQPAMMSLSIDQITEAFSGAKEKMLQFSRQNQTSDESPPTLVHETTQLQPQMDATLMQEWLRSSHALTMDQLFQMHQFHAARSTLQIGEMGGRDGEDNFERNKGPEEMQGINESSSRPRRREANQEKRKVMVPAPQFGNTEMPPEDGFTWRKYGQKEILGSKFPRSYYRCTHQKLYECQAKKQVQRLDQNPNIFEVTYRGDHTCHMSSTALSSVPLQQLLVDITQNNSNTISSQLSPTMNLSLHPGGGSGTAASSGGASASRFGGDYPVVDMADAMFNSRSSSNNSMEFLFSPEDKSDPKIE

SEQ ID NO: 134469 - protein, 314 aa, Glycine max
  Coding DNA Sequence Number=SeqID_17691
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-34, Identity=33%"; Hit description= UPI00006A17C9 related cluster
  Subcellular localization annotation: CTP_CleavageSite=27; ConfidenceScore=5.40e-01
ARACSPLKVRTCSPLKVRACSPLKVRTCSHLKVTTYSPLKARACSPQKARACSPLKATTSCPLKARAYSPLKARASSPRKARAYSPPMARACSPLKVRACSPLMERTCSPLKGMHAPLKARTCSPLKVRACSPLKTKTCSPLKVRKCDPLKARTCSPLKVRARSPWKVRACSPLKVRACNTLKARACNPLMARTRSPLKVRACRPLKARTRSPLKVRACSPQMARTCSPLKARVCNPLMARTCSPLKVRACSPLMASACSPLKVRAQSPLKVRACNPLKVRTCSLLKVRACSPVMSRMCSPLKARTYSPMKART

SEQ ID NO: 134470 - protein, 79 aa, Glycine max
  Coding DNA Sequence Number=SeqID_17692
MVDDIFTPSRYKEIIMVQPKPSAGLKGKPHQHALTFMPSCIQKSKAWVPRPKSCFGTYPNFCKLSTHPKMASHMHKPNL

SEQ ID NO: 134471 - protein, 85 aa, Glycine max
  Coding DNA Sequence Number=SeqID_17693
MRIKRSFKVVMGPRTRLTVSFKTRKGKHDSKGLSKELSQGKSIWLEAYKNKIASIISKYACELGRINKNQAKAIVQAINGAKHTK

SEQ ID NO: 134472 - protein, 204 aa, Glycine max
  Coding DNA Sequence Number=SeqID_17694
  Homolog annotation: Hit_ID=Q9M6E0; Match level="QueryCoverage=40%, HitCoverage=18%, E-value=6e-10, Identity=79%"; Hit description=DNA -binding protein 4
MEKVRTKGNPKFSISQKPNSNTETGNQLMQKPELGHFADTLRLLLRILKFTSSISVGVTSGALESLNKVAEQPNKCNGYKRIPIDTLKAPQVVTHSKTWDSFLGPESNVPNEHYSTIGSQSQIVIQEYPNDETDPSDLTDANLWSDLKDFELSNDKPAGLKIAPENADSVYSCTGSRSLDMDFGIFSPHFCSTEDFHFDESQLL

SEQ ID NO: 134473 - protein, 64 aa, Glycine max
  Coding DNA Sequence Number=SeqID_17695
MEKELVELYEAAKKAADAAISGDGEHEESRCIDALEQLKKFPVNYKILVNTQVRVQLETEYISR

SEQ ID NO: 134474 - protein, 76 aa, Glycine max
  Coding DNA Sequence Number=SeqID_17696
MARMGSPTLQPMLRILWLGLASTLTRMLVMEMLELGSEISNNIILFKPNDGENMPVCFFVSAKVTGTWTEWLMSFL

SEQ ID NO: 134475 - protein, 989 aa, Glycine max
  Coding DNA Sequence Number=SeqID_17697
  Homolog annotation: Hit_ID=Q10LU7; Match level="QueryCoverage=26%, HitCoverage=36%, E-value=2e-10, Identity=26%"; Hit description =Expressed protein
  Pfam annotation: Domain name=zf-LSD1; Domain location=14-38; Score =12.5; E_value=0.042; Accession=PF06943.3; Description=LSD1 zinc finger
MSGDLAPKLRVVRCPKCRLLLEEPAGCDLYKCGECGTTLQAKKRTNVAANSKSSVQATDATPRNASDHVSEGKQRNNRNHLVPSREDSLKERETSSGECHVDGNAGRGQNENGDQLVPFILSDEGQETESDIYSLSHRRHRVSIKGGSASNKTTHSEIGEINDGNLEEEAEEESVCALDEDGDNDRSALIGVTSEKEITEGDLEGVEGLNNENLSLEGEKEFISDSDGEDDNEEESALAGAILEVEITESDSVGAEDLNDGNLLPEGAEELSSALERKDANNDKSVIVGENLELETTEKNIAEELNDGKLSEGAEHAPDGEDSNNDPSAIEGAKPEVDTTENASTTDRTSREKGNILHVTPDKVEEGTPANPTSSHKQQKKAKKIIHRGSDRVRSVDTTELIDPSSELSGILAGKLPKSPTTRSSFAYDGSLSSYDGMDEPFPIQHSGSFDNTYTNANGVSEGRTRKGKGLVNSIYGGLETQHQSHMSNAKLHAKKDSRGNQNKVVDSTRNGHQRWMGTKRDEFPPKIPLHRSGSHSYYERGSSSNQMHDALYHSSSFLSPDSSEDTDHEKMKLLRMINKLQDQLSRTLYKGGETNGRLPKGVSYKGNHISAYHSHDFGEGRRFSHSLDYPSCDGRCGHGVNWHQRHHKFSRIPYSAEATRNAHHVDHSCYHCFSQERHFSTDMSMSPHVLFQHEGLHGSCSGQDCCSFSHHSYPSSPQWFIASKLPPIYGRKTKSDEQRRRAPDLKKYLREKKNLVAKRHHRPVAGGAPFVTCHKCLNLLQLPADFLLFERACHQLICGECSEVLKFSMHGSHIDFFSPNNAIGPPSSDLNGRSEVISSRNLPSASHANYYHYSATEAISYYDDYGLSISKSYSSEGEPVSLAHSHHLHSGEYANPSVSHGTFEPSTEKENINPRYSSARKGQVETDASAMFSSNMSGSRKMASEMEARPAPKSSSLHLLMGYSSPSQVIRGTRPSVEAGKSNNGGVL

SEQ ID NO: 134476 - protein, 44 aa, Glycine max
  Coding DNA Sequence Number=SeqID_17698
MGQDIALCVEVEVLLARMTKIINQSMAKINIGCSFANREEIWEW

SEQ ID NO: 134477 - protein, 37 aa, Glycine max
  Coding DNA Sequence Number=SeqID_17699
MQQESSISCLEGKGPDNLVYTLECNKSPRHNLWVPSS

SEQ ID NO: 134478 - protein, 201 aa, Glycine max
  Coding DNA Sequence Number=SeqID_17700
  Gene Ontology: Mol. function=transition metal ion binding; Cellular component=chloroplast; Biological process=iron ion homeostasis
  Homolog annotation: Hit_ID=Q948P6; Match level="QueryCoverage=93%, HitCoverage=76%, E-value=1e-63, Identity=69%"; Hit description =Ferritin-3, chloroplast precursor
  Pfam annotation: Domain name=Ferritin; Domain location=82-201; Score =111.7; E_value=2.2e-30; Accession=PF00210.14; Description=Ferritin -like domain
  Subcellular localization annotation: CTP_CleavageSite=35; ConfidenceScore=5.20e-01
MLLRTASSFSLFNANGDHILLPSSVRYSQGKHLVPCATKNSNNRPLTGVVFEPFEEVKKELDLVPTVPQASLARQKYTDESEATINEQINVEYNVSYVYHAMFAYFDRDNVALKGLAKFFKESSEEEREHAEKLMEYQNKRGGKVKLQSIVMPLTEFDHEEKGDALYAMELALSLEKLTNEKLLNLHSVRYQDCLVLVLDS

SEQ ID NO: 134479 - protein, 482 aa, Glycine max
  Coding DNA Sequence Number=SeqID_17701
  Gene Ontology: Mol. function=kinase activity; Cellular component =nucleus; Biological process=regulation of transcription, DNA -dependent
  Homolog annotation: Hit_ID=Q1SIP3; Match level="QueryCoverage=67%, HitCoverage=51%, E-value=1e-34, Identity=29%"; Hit description=TRNA -binding arm
MEDSEKFDAGSDQGNALVTPYYTPYPKHLLPKSGLQPVNIEFSPSSGGDNSVASMKEGPGSSSSSSSSSTDSEQERKIVGEEKTDNVSLESENRSYNELLKEFLKNKEELKLSNIKLKLSEEKIVKLNVQIEKSEGELNNVLVELKVKEENLEYEKGQVLELQKKTADLETHVPDCSLKIAKLVAQLELAEEQLKISDDEIARLKEELNSRSSGTHELQGQLEVAQEIVAALESQLVSERKQIHDLEGRVTWYKANETNTEHAVQKLKAKMLDAQAQFSLEKDLLHSDIARLSEENKQLGSRLEEYESRSNIIENKSRQLEAEKLKLEELLATQQMDLQGEISCLKEELDQRRHDVEAVNKEFDRHKQKCDVLMTEKDEANAKIHNLMAETRDRNNYIANLERDIILLRGQEAELSTGSAATLRLVKELKLKADGLEKEVILKNAMISDRAEEKREAIRQLCFSIEHYRSGYKELLQAFAGH

SEQ ID NO: 134480 - protein, 305 aa, Glycine max
  Coding DNA Sequence Number=SeqID_17702
  Gene Ontology: Mol. function=transporter activity; Cellular component= mitochondrial inner membrane; Biological process=mitochondrial transport
  Homolog annotation: Hit_ID=O24391; Match level="QueryCoverage=99%, HitCoverage=99%, E-value=1e-148, Identity=84%"; Hit description =Mitochondrial uncoupling protein
  Pfam annotation: Domain name=Mito_carr; Domain location=116-211; Score=111.2; E_value=3e-30; Accession=PF00153.17; Description =Mitochondrial carrier protein
  Pfam annotation: Domain name=Mito_carr; Domain location=12-110; Score= 84.7; E_value=2.9e-22; Accession=PF00153.17; Description =Mitochondrial carrier protein
  Pfam annotation: Domain name=Mito_carr; Domain location=216-303; Score=115.4; E_value=1.6e-31; Accession=PF00153.17; Description =Mitochondrial carrier protein
  Pfam module annotation: Pfam domain module=Mito_carr::Mito_carr::Mito_ carr; Domain location=116-211::12-110::216-303
MVAGGNSKSDISFAGTYASSAFAACFAEVCTLPLDTAKVRLQLQKQAVVGDVVTLPKYRGLLGTVGTIAREEGLSALWKGIVPGLHRQCLNGGLRIALYEPVKNFYVGPDHVGDVPLFKKILAGFTTGAMAIAVANPTDLVKVRLQAEGKLPPGVPRRYSGSLNAYSTIVRQEGVGALWTGIGPNIARNGIINAAELASYDQVKQTILKIPGFTDNVVTHLLAGLGAGFFAVCVGSPVDVVKSRMMGDSSYKSTLDCFVKTLKNDGPFAFYKGFIPNFGRLGSWNVIMFLTLEQAKKFVKTLESA

SEQ ID NO: 134481 - protein, 263 aa, Glycine max
  Coding DNA Sequence Number=SeqID_17703
  Gene Ontology: Mol. function=lyase activity; Biological process =alkaloid metabolic process
  Homolog annotation: Hit_ID=Q9SG92; Match level="QueryCoverage=87%, HitCoverage=58%, E-value=3e-50, Identity=46%"; Hit description =Putative alpha-hydroxynitrile lyase
MPERVEEGVVALNQHFVLVHGIGGGSWCWYKIRCLMENSGYKVSCIDLKSAGIDQSDADSVLSFDDYNKPLMDFMSDLPENEQILNISRDSIAISSCLLIWQQIANKCGVNCSEKQLKNLDVVVILVGHSAGGLSITQACHKFANKIRLAVYVAATMLKFGFLTDQDHKDKWSNLFAFFSFLQSDNPVYSTDLLCPQEGVPDLSEYGDVYELGFGLGHDKPPTSALVKKEFQRKIIYPLSPHEDHLWQFSCEKMKNTENYSSK

SEQ ID NO: 134482 - protein, 134 aa, Glycine max
  Coding DNA Sequence Number=SeqID_17704
SSCVDEEDVPPNAIVEVGDATPNDIVEAEDVAANGIAEAVDAPLNIVVDVVVAIEEATTNNVIGVEGAAPNNVVMVEGVPPKGDTAEDTTTQNDVVIVEEEETLNDATVTLKIEEPVRERKKRPMRRKVRRKKK

SEQ ID NO: 134483 - protein, 248 aa, Glycine max
  Coding DNA Sequence Number=SeqID_17705
  Homolog annotation: Hit_ID=Q8TGM5; Match level="QueryCoverage=15%, HitCoverage=58%, E-value=2e-07, Identity=74%"; Hit description =Uncharacterized protein ART3
LGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIVCKCCVVTTPGDTVSGPPGVALNRLSSLAHEAPGFVFVARTRRPGARGAVVIPSLPTVDE

SEQ ID NO: 134484 - protein, 72 aa, Glycine max
  Coding DNA Sequence Number=SeqID_17706
MASDMYAQAHYYDSSACHLSYPNFVRGPLLDDMRPFFGPCEDMPKNQKNVDAQSVSFRDTSEIKWKHRCIIK

SEQ ID NO: 134485 - protein, 116 aa, Glycine max
  Coding DNA Sequence Number=SeqID_17707
LYRYVHMQYDMKLLAVDVPMASGPDQRLFLIGDEEEYRVGGGLISDLRDPVVRAMAATKEFDDLDEIEEEEDAERERQETERKEREEIEKLEKSSGTYFEFSLDLETLVPQMAKFI

SEQ ID NO: 134486 - protein, 59 aa, Glycine max
  Coding DNA Sequence Number=SeqID_17708
MVMAQRCMSNVDWTRGDCVHFWVLGWWHNCTTSGGMTTKVIRLIVDGGGKRNGVDEKVG

SEQ ID NO: 134487 - protein, 115 aa, Glycine max
  Coding DNA Sequence Number=SeqID_17709
  Gene Ontology: Mol. function=hydrolase activity; Cellular component =cytosol
  Homolog annotation: Hit_ID=Q45NN8; Match level="QueryCoverage=82%, HitCoverage=55%, E-value=1e-37, Identity=78%"; Hit description =Hydroxyacylglutathione hydrolase
MQIVDESTKEGAVVDPVEPQKVLEAANSHGVNNLKLVLTTHHHGDHAGGNEKIKQLVLGMKVYGGSMDNIKGCTDKVENGDKMSLGADINILCLHTPCKLCTAAALLTELCHAAA

SEQ ID NO: 134488 - protein, 224 aa, Glycine max
  Coding DNA Sequence Number=SeqID_17710
  Gene Ontology: Cellular component=mitochondrion
  Subcellular localization annotation: CTP_CleavageSite=83; ConfidenceScore=5.76e-01
MQMSRFTQFRALLRGTTSHQRSPLRHPAVADSSFASKPSVSNASAFRPSSPVFHPQQRLGNSTFRFFSSNFDKGFAQKVFDKPAAAVTSAFSRYREAIGLQIEAFFKRNTLFLWGAGGVVLCAVLWRILFGIANLFVGLSEGMAKYGFLALSSAIVAFTGLYIRTRLTINPDKVYRMAMTKLNTSAGILEVMGAPLSGTDLRAYIIGSEKKGLVSVEVKKKKGQ

SEQ ID NO: 134489 - protein, 59 aa, Glycine max
  Coding DNA Sequence Number=SeqID_17711
  Gene Ontology: Mol. function=hydrolase activity
  Homolog annotation: Hit_ID=Q307X6; Match level="QueryCoverage=100%, HitCoverage=22%, E-value=5e-17, Identity=66%"; Hit description =Hydroxyacylglutathione hydrolase cytoplasmic-like
YAVRNLLFALTIEPDNLRIQQKLTWAKNQQQAGQSTIPSTIEEEMETNPFMRVNLPEIQ

SEQ ID NO: 134490 - protein, 314 aa, Glycine max
  Coding DNA Sequence Number=SeqID_17712
  Subcellular localization annotation: CTP_CleavageSite=67; ConfidenceScore=5.58e-01
MESSPSSSSSSMSSSSGSDTSGGGGGGAVTWFGMSFPFRSPLSLVMDYCAREDSAEPVIIIPRTRPRFQAHAESASASSSDSDENACNGAAEEVAIRIIGAGEQESGSSPSSSSRGRGGEPGCEEAVVGRSGMLSSEARRRMAEERVPLVSLDDGIGGVRESSSSSSSSSSSSSSSSTYQRYDIQQVAKWIEQILPFSLLLLIVFIRQHLQGFFVTICISAVMFKSNEIVKKQTALKGDRKVSVLLGISFAFVLHVISIYWWYQNDDLLYPLAMLPPKTPPPFWHTIFIILVNGMDLFYVHSICDHCIAIVCLH

SEQ ID NO: 134491 - protein, 65 aa, Glycine max
  Coding DNA Sequence Number=SeqID_17713
MVRIVARLPWWHCRMKLPENAQQLPLADMEKSSEQAVATERQRRRRRNDSTWETSSFVRLSVGNQ

SEQ ID NO: 134492 - protein, 141 aa, Glycine max
  Coding DNA Sequence Number=SeqID_17714
MRQVVKILEVEIDSIESDEDNMEMSLLGKIRSATTWSRAECALPYSGYPSFDEVKMFSFNSRTTRSGSNTTKHEDSKSEAQIKHHGFHQVQCTNLDQTLNETDNVAQDDTPLMKDGSRLFPKVVHSLPASQLHQRAPHKPH

SEQ ID NO: 134493 - protein, 78 aa, Glycine max
  Coding DNA Sequence Number=SeqID_17715
  Subcellular localization annotation: CTP_CleavageSite=26; ConfidenceScore=5.38e-01
MTVSKKRRRSSTGGISVIKGFRTTTFAATRRRHPAVVAIPTQSIFSDKDHRLRQPPSRVRCVSFRLKPPPTKEDKLVP

SEQ ID NO: 134494 - protein, 502 aa, Glycine max
  Coding DNA Sequence Number=SeqID_17716
  Gene Ontology: Mol. function=hydrolase activity; Biological process =aromatic compound metabolic process
  Homolog annotation: Hit_ID=Q2QYI3; Match level="QueryCoverage=79%, HitCoverage=75%, E-value=1e-115, Identity=52%"; Hit description =Hydrolase, alpha/beta fold family protein, putative, expressed
  Pfam annotation: Domain name=Abhydrolase_1; Domain location=186-483; Score=78.2; E_value=2.5e-20; Accession=PF00561.10; Description =alphabeta hydrolase fold
  Pfam annotation: Domain name=PGAP1; Domain location=154-352; Score= -91.7; E_value=0.064; Accession=PF07819.3; Description=PGAP1-like protein
  Pfam module annotation: Pfam domain module=Abhydrolase_1::PGAP1; Domain location=186-483::154-352
MMMMVRIGMFYGELGSSTLCLSHRCNNSTLSHIHKHPSPLISPNYAATHTHNKRLVASASSAPSGKVIMVVRLLTQVLYVEPISSEQMVDVGAKKKKKSIAGIDQDELVDPKLLADLDSCFCEFKGVHIHHKICDAESKAQSTPQSRTVSHQIKKLGYPMILLHGFGASVFSWKQVMKPLAEVAGSKVLAFDRPAFGLTSRVNLSRHPSSETEDAKPLNAYSMAFSVLATLHFIKLLNAQKVILVGHSAGSLVAVNTYFEAPERVAALILVAPAIFAPLTTRKVVKENQSGHDNQTEEDNSSIRKNPILGLYKMLSKTTKYIAEAISQMMKWTIDILNFWYRKLLSAILRSSLAIMLVRMAIDKFGTTAVRNAWYDPKQVAEHVLSGYIKPLRIKNWDRALVEYTAAMLLDEESKTKPSLSKRLHEISCPVLIVTGDTDRIVPSWNAERLSRVIPGASFEVIKQCGHLPHEEKVEEFISIVENFLRRLVSDSNEQYLQEATA

SEQ ID NO: 134495 - protein, 40 aa, Glycine max
  Coding DNA Sequence Number=SeqID_17717
MEMTNGGGVIEDKLVTLKGVRGTFRPGVLTGAEKTTLMEV

SEQ ID NO: 134496 - protein, 445 aa, Glycine max
  Coding DNA Sequence Number=SeqID_17718
  Gene Ontology: Mol. function=protein serine/threonine kinase activity; Cellular component=membrane; Biological process=protein amino acid phosphorylation
  Homolog annotation: Hit_ID=Q2R4L1; Match level="QueryCoverage=92%, HitCoverage=67%, E-value=1e-134, Identity=55%"; Hit description =Protein kinase domain containing protein, expressed
  Pfam annotation: Domain name=DUF26; Domain location=11-64; Score =48.2; E_value=2.7e-11; Accession=PF01657.8; Description=Domain of unknown function DUF26
  Pfam annotation: Domain name=Pkinase; Domain location=146-397; Score =109.0; E_value=1.4e-29; Accession=PF00069.15; Description=Protein kinase domain
  Pfam annotation: Domain name=Pkinase_Tyr; Domain location=146-397; Score=123.2; E_value=7.4e-34; Accession=PF07714.7; Description =Protein tyrosine kinase
  Pfam module annotation: Pfam domain module=DUF26::Pkinase::Pkinase _Tyr; Domain location=11-64::146-397::146-397
TKTQLAGGGAIYAIAQCAETATESACLDCLTVGYNNIHICLPNTDGRAFDAGCFMRYSETAFFADNQTIDITPFLKQGGSSNKKGAIIGGVVGGVGLVVILLALFGLLRRYKKPKRVPRGDILGATELKGPVPYRYKDLKTATKNFSDENKLGEGGFGDVYKGTLKNGKIVAVKKLILGQSGKMDEQFESEVKLISNVHHKNLVRLLGCCSKGENKGSLNWKQRYDIILGTAKGLAYLHEDFHVCIIHRDIKTSNILLDDEMQPRIADFGLARLLPEDQSHLSTRFAGTLGYTAPEYAIHGQLSEKADAYSFGVVVLEIISGQKSSELRTDTDGEFLLQRAWKLYVQDMHLELVDKTLLDPEDYDAEEVKKIIEIALLCTQASAAARPTMSEIVAFLKSKNSLGQIRPSMPVFVETNLRTRAETSTSTGSSTSNATASISMLSAR

SEQ ID NO: 134497 - protein, 148 aa, Glycine max
  Coding DNA Sequence Number=SeqID_17719
  Pfam annotation: Domain name=zf-CCHC; Domain location=77-94; Score =26.6; E_value=4.1e-05; Accession=PF00098.13; Description=Zinc knuckle
MELQRLNQNKENDKKKRSITLKASSSMQEENEEEDSNDEEDFSFFVKKFQKFIKKRRIDRRQNFNNGRKSQEDSQFLRCYKCNQIGHIKADFPSNEEWPEKSEKKRFDERRTKKAYIEWDDNDSSDGSEKEINLLTKDYESDENISQE

SEQ ID NO: 134498 - protein, 104 aa, Glycine max
  Coding DNA Sequence Number=SeqID_17720
MDAATSSSENGADVAGCRQHQQRYRATRQCLDQSRHWFLRDQRGPGSSRLDTATTRVLASHDSLGHCLQARAWHAEGSHGYSFIFTCACNYCREDHMLHGVNWL

SEQ ID NO: 134499 - protein, 165 aa, Glycine max
  Coding DNA Sequence Number=SeqID_17721
  Gene Ontology: Mol. function=oxidoreductase activity; Cellular component=membrane; Biological process=electron transport
  Homolog annotation: Hit_ID=Q2QYH7; Match level="QueryCoverage=85%, HitCoverage=27%, E-value=1e-45, Identity=54%"; Hit description =Cytochrome P450 family protein, expressed
MYVHVWFAVKNAATHIPMQIQQTKVAMVIKEVLRLYPPAAFVSREAYEDIQIGNLNVPKGVCLWTLIPTLHRDPDIWGPDANEFKPERFSGGVSKACKFPHAYVPFGLGTRLCLGKNFAMVQLKVVLALIISKFSFSLSPSYRHSPAYRMIVEPGHGVHIIIQKI

SEQ ID NO: 134500 - protein, 234 aa, Glycine max
  Coding DNA Sequence Number=SeqID_17722
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=4e-25, Identity=34%"; Hit description= UPI00006A17C9 related cluster
IVLNLILKSPFASIASYHHDHHQNTKDNCIYIHTLALRGLHLLPFRGLHVIAIRGLHVLDFRGLHVLTFRALHALPFRGLHIFSFRGLHVLPFREDNTSSPSEDNTSLPSESYTSSPSEDYTSSLSEGYSPSPLEDYTTSPSEGYTPSPSEDYTSLPSEGCTPSPSEDYTSSPSEGNTSSHLESYTSSPSEDYMSSPSEDCKSSSSEGYTSLPSEGYVPSASEDYMSSPLEDYT

SEQ ID NO: 134501 - protein, 43 aa, Glycine max
  Coding DNA Sequence Number=SeqID_17723
GSKGSLNCKHHEPHDEGSSIKSMLYKLLVNLRSGVFMLQIDGF

SEQ ID NO: 134502 - protein, 78 aa, Glycine max
  Coding DNA Sequence Number=SeqID_17724
MNSLSQHAVLSKFISTYCIEAFSEELAKRAYCAKRVHPLRMNTHPFAELPVAKRADVQLSRHYPAKPILQKLNFCNFR

SEQ ID NO: 134503 - protein, 248 aa, Glycine max
  Coding DNA Sequence Number=SeqID_17725
  Homolog annotation: Hit_ID=Q2QQD3; Match level="QueryCoverage=54%, HitCoverage=28%, E-value=1e-42, Identity=67%"; Hit description =Expressed protein
MEGGKRITVSPRPCCGRRIVAAKKRPRANDGFVNSVKKLQRREISSKRDRAFTMSDAQERFRNIRLQEEYDTHDPKGPSSMVLPFLRKRSKIIEIVAARDIVFALAQSGVCAAFSRETNQRICFLNVSPDEVIRSLFYNKNNDSLITVSVYASDSYSSLKCRSTRIDYPPIPEWNSGRNCGGGILLLEIEIPKALSPHFRGLFLEPTHRAAILFTAAVIQPAIWSGCSHYTKLVCYSVQGPLCTAPPQ

SEQ ID NO: 134504 - protein, 274 aa, Glycine max
  Coding DNA Sequence Number=SeqID_17726
  Gene Ontology: Mol. function=oxidoreductase activity; Cellular component=membrane; Biological process=electron transport
  Homolog annotation: Hit_ID=Q10LX2; Match level="QueryCoverage=94%, HitCoverage=56%, E-value=3e-62, Identity=47%"; Hit description =Cytochrome P450 family protein, expressed
  Pfam annotation: Domain name=p450; Domain location=1-274; Score= -173.5; E_value=0.0045; Accession=PF00067.12; Description=Cytochrome P450
MKQHLYVNQPDLVREMNQSITLDLGKPTYITNKLAPMLGNGILRANGLSWAQQRKLVAAEFFMDKVKGMVGLMIESAQPLLLKWEQLIESQGSATAEVKVDVNLRGFSADVISRVCFGHSYSKGKEVFSKLRSIQKAMSKHGGFLFGLSSFRDKLKHFSSNKQNEIAGLEKEIESLIWELVEERKRECSETSSSEKDLMQLLLEAAMTDQSLGKDFSKRFIVDNCKNIYFAGHETTAVAASWCLMLLALHPEWQTRIRTEVAELCPNGVPRLPI

SEQ ID NO: 134505 - protein, 66 aa, Glycine max
  Coding DNA Sequence Number=SeqID_17727
MCKKEHESFKVYAQRWRDLAAQVAHPMMEREMITMIVDTLPMLYYEKMVGYMPSSFTNLELMKHWA

SEQ ID NO: 134506 - protein, 60 aa, Glycine max
  Coding DNA Sequence Number=SeqID_17728
MHKLDSTNLSPSSAKQQILILARQQAQREEELAVTAPYFSSSSEVEVLLPVIGMLLQFGP

SEQ ID NO: 134507 - protein, 734 aa, Glycine max
  Coding DNA Sequence Number=SeqID_17729
  Gene Ontology: Mol. function=binding; Cellular component=nucleus
  Homolog annotation: Hit_ID=Q337E1; Match level="QueryCoverage=98%, HitCoverage=90%, E-value=1e-122, Identity=35%"; Hit description=TPR Domain containing protein, expressed
  Pfam annotation: Domain name=SET; Domain location=224-539; Score= -15.1; E_value=0.024; Accession=PF00856.18; Description=SET domain
  Pfam annotation: Domain name=TPR_1; Domain location=106-139; Score =26.4; E_value=0.0001; Accession=PF00515.18; Description =Tetratricopeptide repeat
  Pfam annotation: Domain name=TPR_1; Domain location=155-188; Score =16.9; E_value=0.052; Accession=PF00515.18; Description =Tetratricopeptide repeat
  Pfam annotation: Domain name=TPR_1; Domain location=63-96; Score =17.3; E_value=0.046; Accession=PF00515.18; Description =Tetratricopeptide repeat
  Pfam annotation: Domain name=TPR_2; Domain location=106-139; Score =12.6; E_value=1.1; Accession=PF07719.7; Description=Tetratricopeptide repeat
  Pfam annotation: Domain name=TPR_2; Domain location=155-188; Score =12.7; E_value=1.1; Accession=PF07719.7; Description=Tetratricopeptide repeat
  Pfam annotation: Domain name=TPR_2; Domain location=63-96; Score =22.1; E_value=0.002; Accession=PF07719.7; Description=Tetratricopepti de repeat
  Pfam module annotation: Pfam domain module=SET::TPR_1::TPR_1::TPR _1::TPR_2::TPR_2::TPR_2; Domain location=224-539::106-139::155 -188::63-96::106-139::155-188::63-96
MEILKAAIPENLKRAIADSDVDDLGSTCSSLHRFFLHFHPFHQMITELADPKYALSGKNKDAALKSKQLGNQCFSNADYAKALDCYTQALREAPLDTGDMESNLVATLYINRATVLHKMSLLVECLRDCTRALQVCPSYAKLYTIIEPVESLHLYQAWYRRGKANALLGNYKNAICDLNVAKSVEPSMGGRRQIEGELKILLDQCRSTTAVVQIQHKENNCNTVGEMPHIKLQCVSTPDKGRGMVSSCVISPGSLVHVEEPYAMRLPVVRRQAERSTEDSKSLVENDFCYAYVKNNLSSDTTQRYTIILKQCRETHCHYCLNDLPADRVPCISCSIPLYCSHQCQTRATGQMFKIYPDYNGFFKNLPSDLGEYAAEVIQCNDSEQEIGDITEHKHECQGVHWPVVLPSEIVLAGRILARFLLNSSPEDIINFVERLVVIIISQIKVNCMTVVRLKSIDAHGSGHFGDFPFQSGAHSTSNVEQVRVGKAIYKAGSLFNHSCQPNVHAYFLSRALYLRTTNVVAAGSQLELSYGPQVGLWDCKDRLNFLKNEYAFHCLCTGCSEVNRSDLVLNAFHCVNPNCSGAVLESRVLDCEMQKIKHFPIPDHVDKNDDIYEVCHHVFKQNGKSIHIQPGYCLKCGSYCDLESSHAAVGKALACITRLQDAILSQQISSIIISDALRSLKLLRLNLHAYNKLTAEAEDSIAQAFCLVGELQLSLDHCKASIQVGLFLPLGKN

SEQ ID NO: 134508 - protein, 90 aa, Glycine max
  Coding DNA Sequence Number=SeqID_17730
  Homolog annotation: Hit_ID=Q8GU79; Match level="QueryCoverage=66%, HitCoverage=4%, E-value=2e-17, Identity=66%"; Hit description=MDR -like ABC transporter
MAPQNVLQMVDTNIADEKDEPKKKVVKTLSFFKLMSYADVIDWILMGLGGLGSVVHGMAFPVGYLLLGKALNAFGNNINDIDAMVNALKK

SEQ ID NO: 134509 - protein, 145 aa, Glycine max
  Coding DNA Sequence Number=SeqID_17731
MTFALNSIYHEPLKIASEVALQHWYHLNASIKPQDDSLKRGCIFKELVLHPLVLEVVSPQAYEPSYMSYIVLLRWERIVNGSIVGQCGEGGVGVTESSSSLGHCWFESDAWAGKSSIHIHFIVGTQDCDRSWVTNVEEQSDHPNL

SEQ ID NO: 134510 - protein, 918 aa, Glycine max
  Coding DNA Sequence Number=SeqID_17732
  Homolog annotation: Hit_ID=Q10LY8; Match level="QueryCoverage=96%, HitCoverage=81%, E-value=1e-101, Identity=30%"; Hit description =Expressed protein
MDLRLTALSDKLAETFSKATGATCSPEDLTCLAKFSQHFGATNIEHSLCKFIELTQKSQDVAPLSKETTLHSCDVTKDDANEAVKNLQVSKPLPSDTPVKYGVSPAKAAQVERHSSTESEESSNSSDEDQRSAERSRSLVRSATPRRSASPMRRVQIGRAGPRRAAALTIKSLNYFPGRERITVQDAAENDFEGEVSELPNKKSEIDVKRITVQDAISLFESKQRDQTTDIQKRKSLADVSVSTNKSVLRRWSAGMGETSVQDQPEYVPEDPVPVTSNDVVHAEAPRNSEVGVVSDFISECHNNNEITDHDVKPERQENIGYVAVDNPDETNPTVKQETNKKLAASAEWNQRKQEEFNQILKKMVESKPVLFGKSQPSRNQNISFEQRGGSYDNYKEKRDAKLRGAKAGKQVEKEAQFRQMQRLLDKRKVEMSKSVSASKKSSPRLPQSSLRNSTPPANSPKETSKPSTMKKTSSRTSPMPATRKSWSATPSPRAAGTSPAKARGGISSANSTPTHRKPVSTSVPQPSTQREKSLPRNRNEKEPQTNNARSLKSMNEKRQPAVPNKSKAVKAKVTKASEEASVPSKTSIGNKGTKKSSVVPLESKPFLRKGSRMGHGTADLNKKKGPPKMDKSLRVSADLIEDQESELVVNASDLVSQHSDGDTMTPIHQNAATEPDPQIHNQLQCGETENLDQNPTDGEVLTYTGESSINIRNEEESTISPSAWLETEEDLEMPKPCEDDTFQSASLANAAPVGSASPRVRHSLSQMLQEESSEPDTCEWGNAENPPAMIYQKNAPKGLKRLLKFARKSKGDTGSTGWSSPSVFSEGEDDAEEFKNSNKRNADNLLRKAAQNVKSYGQPKNSVHEGYERNLGRDDGKGSHKMRDGRDLGAGSTTRASRSFFSLSAFRGSKPSESKFH

SEQ ID NO: 134511 - protein, 347 aa, Glycine max
  Coding DNA Sequence Number=SeqID_17733
  Gene Ontology: Mol. function=nucleic acid binding; Cellular component= intracellular; Biological process=meiosis
  Homolog annotation: Hit_ID=Q9FIR7; Match level="QueryCoverage=91%, HitCoverage=86%, E-value=5e-85, Identity=52%"; Hit description =Arabidopsis thaliana genomic DNA, chromosome 5, P1 clone:MXC17
  Pfam annotation: Domain name=DUF1671; Domain location=56-326; Score =115.5; E_value=1.5e-31; Accession=PF07910.3; Description=Protein of unknown function (DUF1671)
MGGSGVKREQAANGSRSGANYSCGGETNSDNGECKVNEKISCLIGSQTRSNFYKVEGGLMALLRCCLESEVGNSYSILSGYVDHFQCLESVDAGWGCGWRNIQMLCSHLLVQRPEARKALFCGSGFVPDILSLQRWLEIAWEKGFDAPGSAQFNHVIWGSKEWIGTTECAALLRSFALQARVVDFGPKDSQSLTGSSVDDMMDKASIHNMVKRKAEKSKGYQVLMDFVWNYFSDKSSIQFGQQHVVISEKTPLYFQHDGHSRTIVGIQVNRQQKGHLQYNLLVLDPAHSTDALERSLRLRVGWEKLIKRGMHTLKKPQYQLCYVDPGIASEEEMEKLKTIDSVFLEF

SEQ ID NO: 134512 - protein, 128 aa, Glycine max
  Coding DNA Sequence Number=SeqID_17734
MRSPMIDGGNECEGSLWESCSSPSELKLNPAAVSSPRRASFFTMKLFGGPVSQRLAWASWGPGKNPFAPFFVSRPARIKRSTNDSPRKKLREVKIRTLISFEQPCYSTEQLAKTKEVNAKKQEDIEVL

SEQ ID NO: 134513 - protein, 53 aa, Glycine max
  Coding DNA Sequence Number=SeqID_17735
MFIERKAFGNLGGVFSKTRKPRKTGAISGPVIFGGELRGKNEPEAQEKEIEVY

SEQ ID NO: 134514 - protein, 124 aa, Glycine max
  Coding DNA Sequence Number=SeqID_17736
  Homolog annotation: Hit_ID=Q2R4L1; Match level="QueryCoverage=90%, HitCoverage=18%, E-value=8e-08, Identity=33%"; Hit description =Protein kinase domain containing protein, expressed
  Pfam annotation: Domain name=DUF26; Domain location=79-124; Score =24.2; E_value=5.5e-06; Accession=PF01657.8; Description=Domain of unknown function DUF26
MSSNSVIDYAVSVMRAGFEGAVGDPQTLLLKQDCSGFTAPNLSNFNQNLNASLADLRAEVSNQRKHFATSQSTTGTSPVYAMIQCRNYLSNTDCAACLAAADAKIRNCSTGANGARVIYDGCFL

SEQ ID NO: 134515 - protein, 118 aa, Glycine max
  Coding DNA Sequence Number=SeqID_17737
MEEKADNKLQGSVARTHSRRLKKGEAQLGEENPKHCKHCDPKHCMTEGVSPMGEARPFSRGYVACLANGNSGTPPRQRVLSVAMAAPSTSAPVSPMAMASHALLPMALAASMQNRPPT

SEQ ID NO: 134516 - protein, 71 aa, Glycine max
  Coding DNA Sequence Number=SeqID_17738
MADAASSRFTTKKYQWIGRALRLHHSPTHLHLHVNLDGATSANNDCQSVHATIADEKERPPGGTEGGCCQG

SEQ ID NO: 134517 - protein, 130 aa, Glycine max
  Coding DNA Sequence Number=SeqID_17739
MKLCLSLFGRAALRIKSWLFRGNFYMTVWQLKKTMIMKGQDIYSRQDEVATSPSSSESEEAKGEESREEIDSQEERDLLMVRRLLGGQSCHLVNRIDAIKLHFIPTNVDEKKLGLRQLNKPSTAINRKQT

SEQ ID NO: 134518 - protein, 228 aa, Glycine max
  Coding DNA Sequence Number=SeqID_17740
MVTRKVLSITHYDAQRSACASEEAQSKGQLTRERMETDLGRCRVVCIGRTTHIPGEKQVPQVTIALEEYSWWTSKEWVKAEAKVVRVSRKGTMGSDWVEAYHAMSNDCLGASLLEAWLTQSLVLGDEAVEEEWRRKTYGVVGQIFKLREGQTLFEMLAGKSAMIVMILEELVDLEDPIERICSVKPWNIQFHAIRGGHWNKGSLLEETLEWVDSTIEEGQREHHNVNT

SEQ ID NO: 134519 - protein, 323 aa, Glycine max
  Coding DNA Sequence Number=SeqID_17741
  Gene Ontology: Mol. function=DNA binding; Cellular component=nucleus; Biological process=regulation of transcription
  Homolog annotation: Hit_ID=Q0PJC4; Match level="QueryCoverage=69%, HitCoverage=95%, E-value=2e-83, Identity=71%"; Hit description=MYB transcription factor MYB117
  Pfam annotation: Domain name=Myb_DNA-binding; Domain location=14-61; Score=44.0; E_value=5.2e-10; Accession=PF00249.21; Description=Myb -like DNA-binding domain
  Pfam annotation: Domain name=Myb_DNA-binding; Domain location=67-112; Score=57.2; E_value=5.4e-14; Accession=PF00249.21; Description=Myb -like DNA-binding domain
  Pfam module annotation: Pfam domain module=Myb_DNA-binding::Myb_DNA -binding; Domain location=14-61::67-112
MVRTPSCDKSGMRKGTWTPEEDMKLIAYVTRYGCWNWRQLPKFAGLARCGKSCRLRWMNYLRPNLKRGNFTQEEEECIIRMHKKLGNRWSAIAAELPGRTDNEIKNHWHTTLKKRSQQNTVTIEETRVSKSKNNESVPNKGVTVTLLATSSQMSDNSSISPVSSSCSEFSSITSYHSTAASCMENLVFEDDDFGFLDSYNESFWTQLNLDDISNNAPCEIFSEDSNGCFQSTDATQIHDSCAKSPTTSESNIVVDNDFVDFQDAYKDATVDNFWSQTYVADMSHVPTELLVHSVAESECFTPIYDDLWGQSYLYHENHHGLFR

SEQ ID NO: 134520 - protein, 473 aa, Glycine max
  Coding DNA Sequence Number=SeqID_17742
  Gene Ontology: Mol. function=DNA binding; Cellular component=nucleus; Biological process=regulation of transcription
  Homolog annotation: Hit_ID=Q0PJC4; Match level="QueryCoverage=48%, HitCoverage=99%, E-value=3e-88, Identity=72%"; Hit description=MYB transcription factor MYB117
  Pfam annotation: Domain name=Myb_DNA-binding; Domain location=14-61; Score=42.8; E_value=1.2e-09; Accession=PF00249.21; Description=Myb -like DNA-binding domain
  Pfam annotation: Domain name=Myb_DNA-binding; Domain location=67-112; Score=55.7; E_value=1.5e-13; Accession=PF00249.21; Description=Myb -like DNA-binding domain
  Pfam module annotation: Pfam domain module=Myb_DNA-binding::Myb_DNA -binding; Domain location=14-61::67-112
MVRTPSCDKSGTRKGTWTPEEDRKLIAYVTRYGSWNWRQLPRFAGLARCGKSCRLRWMNYLRPNVKRGNFTQQEDECIIRMHKKLGNKWSAIAAELPGRTDNEIKNHWHTTLKKWSQQNAITNEEARTSKSKDKVPNKGVTVTLPANSSLMSDNSSSSPVSSTCSEFSSITSDNSTAASMENLVFEDDDFGFLDSYNESFWTELNLDDISFDAPCEMDLGDTNVSFESTSCSNSNTLDSLHGSTSESIVVDNDFGGFLDAYTKAAVDNFWTQPYVADMSHVPSELLVPSMAESEYFTPIYDDLDLDEVLEGPDMMFSSIIPSTTMSVATKASLVVALSPHHYQTRKNVGKKWKKRRRRRKTIILLFVIVMDSRKDLQRMDSEVLDTYHSWWFGVDLPWLRQSQTCYGLWFMPHTMKLALDSRSLEWILLLPYRKILEVKMRIMIKGNVWKNTEDEILKAIVMKYGKNQWARIS

SEQ ID NO: 134521 - protein, 106 aa, Glycine max
  Coding DNA Sequence Number=SeqID_17743
  Homolog annotation: Hit_ID=Q8W149; Match level="QueryCoverage=33%, HitCoverage=4%, E-value=2e-10, Identity=86%"; Hit description=CDC5 protein
MGTTFSVGHPPYYNGLEYIYEDRGESLYKKPFKQKMKTKVVKQRHQRARRVKGHLMLSLQVLLLLNPRNPSIPTEWRREEDDKLLHLAKLMPTQWRTIAPIVGRVG

SEQ ID NO: 134522 - protein, 267 aa, Glycine max
  Coding DNA Sequence Number=SeqID_17744
  Gene Ontology: Mol. function=transposase activity; Biological process= transposition, DNA-mediated
  Homolog annotation: Hit_ID=Q75HL4; Match level="QueryCoverage=94%, HitCoverage=39%, E-value=2e-10, Identity=22%"; Hit description =Expressed protein
MERVLADVLRDQRNLGNKGDGGWKRSALNAATVVLSTSFNVNVTSDNVKNRIKLWRSWYGIVSDILGQSGFDWDGTKHMITVENENAWNEYCTSHKSAKPFRYKVLQNWDDIVDLCAKDRATGHGAETAMDADEAMSRETNEVEFMGLGATAIDLEEPSSNTKGKRQGSTSSGTHPHKRKMGEKEGIAASLDKMANSFNRMVEKMDGKVDDEDIQEVLRETSLIPDLNRQQWAKAIKWLADDPKQLAIVKALPIHQKTNYVLTHLGE

SEQ ID NO: 134523 - protein, 276 aa, Glycine max
  Coding DNA Sequence Number=SeqID_17745
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=58%, HitCoverage=16%, E-value=2e-45, Identity=62%"; Hit description =Lipoxygenase
  Pfam annotation: Domain name=PLAT; Domain location=144-261; Score =62.4; E_value=1.4e-15; Accession=PF01477.13; Description=PLATLH2 domain
MAEILLCLQPTLEGLEKYFQVAYVAVMRNTTTENRTGLESLLSFYRSSIASSADPNVVIEVLNLLLSDAIPDQDIIYVLAGISNEGSEIAWRWLKTTLTVHAKKPLQFKVRAVVTVRNKIKVDFKETMLKHLDAINDSIGTRNVVLELISTEIDPTRCHKLTISFFHHFNELVLLLRNEISKEEQQSSWSKKSIVKAERVNYTTEFIVDSNFGVPGAITVTNKHQREFFLESITIEGFVSGAVHFPCKSWVQGERIFFSNKVTNRSFSNLERSNNY

SEQ ID NO: 134524 - protein, 209 aa, Glycine max
  Coding DNA Sequence Number=SeqID_17746
MDWARLVYGLVMKMDMGVGLLISGQISQMAQSNSSRLGLPALITTICFARGVVPDSLTFESLSPAINLGPSSSAPLALASTPTPSVALALVPTPAGTSTQSSDLISIHNLAQHRSIISMEEFIAQVAWLGVQPSPLGGGGASIAQEPQPQPEVTLEVRPETTPRTSPVTTPLVEVSDEEDVTIDTDHATNMATAQSTWDPWPATAQETS

SEQ ID NO: 134525 - protein, 220 aa, Glycine max
  Coding DNA Sequence Number=SeqID_17747
  Homolog annotation: Hit_ID=Q337D0; Match level="QueryCoverage=66%, HitCoverage=100%, E-value=4e-61, Identity=76%"; Hit description =Expressed protein
MERTSFKLSVRNQHPFLAHRTNACNNENPSTEEERPKLYPLASLSSRAYNSGKGLEVGVCVKDFLGVASVLTEEMEVYGKSMVAGPANVIFLSSILGQEGPVPGHKCDWKCQNEHVCGNMYRCKLTGLTHICDKNCNQRILYDNHSSLCRASGQIFPLSPAEEQAVRGVRRKLDAENSPSESCGFKRRRGDAQIHPSPFERSFSAVSPICSQVGDGMDMS

SEQ ID NO: 134526 - protein, 298 aa, Glycine max
  Coding DNA Sequence Number=SeqID_17748
  Gene Ontology: Mol. function=molecular_function; Cellular component =anchored to membrane; Biological process=biological_process
  Homolog annotation: Hit_ID=Q9FLU2; Match level="QueryCoverage=72%, HitCoverage=86%, E-value=7e-96, Identity=72%"; Hit description =Thaumatin-like protein
  Pfam annotation: Domain name=Thaumatin; Domain location=31-247; Score= 303.6; E_value=3.7e-88; Accession=PF00314.8; Description=Thaumatin family
  Subcellular localization annotation: CTP_CleavageSite=50; ConfidenceScore=5.33e-01
MPTTTSWKLTSLLIFFTFFCCSFSYTFTIINNCPHTIWPGTLSGSGSPPLATTGFRLDTGQSIKLTTVPGWSGRIWARTGCTFDATGVGKCQTGDCGGRLECQGNGAAPPTSLFEITLGAGNGQDFYDVSMVDGYNLPLLALPRGVYGDACNSTGCITDINRGCPKELQLLGGDQNQRVVGCRSACEAFKTDKYCCSGAFANPNTCQPSYYSTIFKKACPRAYSYAFDDGTSTFTCKANEYDIVFCPNSNGMRRPNLAAPPPPIRQPFWKHQQVTSSSNILLPFPAPIFLLVLTLSHL

SEQ ID NO: 134527 - protein, 172 aa, Glycine max
  Coding DNA Sequence Number=SeqID_17749
  Homolog annotation: Hit_ID=Q8LBI3; Match level="QueryCoverage=43%, HitCoverage=23%, E-value=4e-24, Identity=74%"; Hit description =Putative GTP-binding protein
  Pfam annotation: Domain name=MMR_HSR1; Domain location=80-172; Score=- 2.7; E_value=0.0018; Accession=PF01926.13; Description=GTPase of unknown function
MVLFHLPRFPLYLVLPPSLSEPTPKPPSYGHPNPLSPPQNPVLNGFNILLSNYANDAQVLQAEFVKSSVKIEDCPFDGLPEFAIVGRSNVGKSLLLNSLVCRKKLALISKKPGNKENRLDQICIKMWGGSREGSFLEKSILENYWLEEALMAAKTCVLADLVHHPSAHPSSP

SEQ ID NO: 134528 - protein, 183 aa, Glycine max
  Coding DNA Sequence Number=SeqID_17750
  Gene Ontology: Mol. function=GPI anchor binding; Cellular component =membrane; Biological process=cell wall catabolic process
  Homolog annotation: Hit_ID=Q93ZH0; Match level="QueryCoverage=85%, HitCoverage=39%, E-value=3e-53, Identity=66%"; Hit description=LysM domain GPI-anchored protein 1 precursor
  Subcellular localization annotation: CTP_CleavageSite=53; ConfidenceScore=5.82e-01
MGTSALLISNPVRYIISISSEPTHSSKSTPSRFSPRTPTTSLTPTWSTTFSPRSSSSKSPSPALASTAFANSSLLTTRPAPPTPSFITDVAYAGLVSSDQLREANSIFDPSVLDVGQNLVIPLPCTCFNSSDNSLPAIYLSYVVRLVDTLAAIAARYFTMNVNAMGSTAINDDDILTVPIPGN

SEQ ID NO: 134529 - protein, 92 aa, Glycine max
  Coding DNA Sequence Number=SeqID_17751
MSRREKGGAANCICGTRSGVVPHSRLWSWRDSGDVNFRCIIITNEITAGPIAAYVAKASVSRSMLSPIKLLAERVPLLFMLHHLHFLIIYNI

SEQ ID NO: 134530 - protein, 95 aa, Glycine max
  Coding DNA Sequence Number=SeqID_17752
  Gene Ontology: Cellular component=membrane
  Homolog annotation: Hit_ID=Q8H829; Match level="QueryCoverage=83%, HitCoverage=21%, E-value=2e-09, Identity=42%"; Hit description =Nodulin-like protein
MKIVKEWFKWSQTVLSMLLVQVFATGMQILSRVILVEGTFIFALIAYRHAVAAICVAPFAFYFERQAFLPSDSFIDGAKKLRWSIWFWLFLNALV

SEQ ID NO: 134531 - protein, 62 aa, Glycine max
  Coding DNA Sequence Number=SeqID_17753
MDCAHFCGAKGRRRNVCFKHLEKFQQLWQLSLLECTPQPQWYQVFHLGMQFLELKRMTETEK

SEQ ID NO: 134532 - protein, 494 aa, Glycine max
  Coding DNA Sequence Number=SeqID_17754
  Gene Ontology: Mol. function=endonuclease activity
  Homolog annotation: Hit_ID=Q1T6I5; Match level="QueryCoverage=89%, HitCoverage=100%, E-value=0.0, Identity=86%"; Hit description =Calcium-binding EF-hand; Endonuclease/exonuclease/phosphatase
  Pfam annotation: Domain name=Exo_endo_phos; Domain location=78-482; Score=47.5; E_value=4.6e-11; Accession=PF03372.13; Description =EndonucleaseExonucleasephosphatase family
  Pfam annotation: Domain name=efhand; Domain location=394-422; Score =20.4; E_value=0.0066; Accession=PF00036.22; Description=EF hand
  Pfam module annotation: Pfam domain module=Exo_endo_phos::efhand; Domain location=78-482::394-422
MGNLEGKRPGVLEAKGRRGGSNRSGRMSRRMLSGQHWWVGFGRIMRTDRWAKSMGRISRIGSFAISSSIKENQQQPCITCTTFNILAPIYKRINHEDPSCRESDYRAYWLARNHRILDWLLNERSSIICLQEFWVGNEELVNLYEKRLGDAGYVSFKLGRTNNRGDGLLIAVQKEYFNILNYKELHFNDFGDRVAQLLHVELASPFSQWRNSNIRQEILIVNTHLLFPHDSTLSLVRLQQVYKILQYVESYQNDFQLKPMPIMLCGDWNGSKRGHVYKFLRSQGFVSSYDTAHQYTDADAHKWVSHRNHRGNICAVDFIWLLNPDKYRKLLKASWSEAVFGMFKYLLRRASLTESDAFSFLKVDNEDCITYFGFCEALKQLSLTGHCHGLSEEEIKDLWLQADVDGKGVLDFKEFLQQIWSSTAPDRDDNKNGDQDDGSNDAQEQTIGFSVKNAVLFPPEVEKGRWPEDYSLSDHARLTVVFLPIRMPCSQLIC

SEQ ID NO: 134533 - protein, 583 aa, Glycine max
  Coding DNA Sequence Number=SeqID_17755
  Gene Ontology: Mol. function=DNA binding; Cellular component=nucleus; Biological process=regulation of transcription
  Homolog annotation: Hit_ID=Q1SXG6; Match level="QueryCoverage=99%, HitCoverage=98%, E-value=1e-139, Identity=48%"; Hit description=No apical meristem (NAM) protein
  Pfam annotation: Domain name=NAM; Domain location=22-150; Score =287.7; E_value=2.2e-83; Accession=PF02365.6; Description=No apical meristem (NAM) protein
MGSVDCYPSRTDDAAVVSLDSLPLGFRFRPTDEELVNYYLRQKINGNGRQVWVIREIDVCKWEPWDMPGLSVVQTKDPEWFFFCPQDRKYPNGHRLNRATNNGYWKATGKDRRIKSGKDLIGMKKTLVFYTGRAPKGNRTNWVMHEYRPTLKELDGTNPGQNPYVLCRLFKKHDESLEVSHCDEAEQTASTPVAYSTEEIQSDLAVVAGSPSQVTEDDKHQAMIPAHSEEAISNVVTPVVCRSDRYDACHAPNQIVLPTAEEFQPLNYYDPRNELLDDKLFSPVLAHIQPEFHYQANIESDDWYGLQYGTNETNMSDFLNSVVNWDQVSFEDLNCQQQSYPLFNVKDSVLSSDLDSELAIMTCMHAGSAEGPNNGRKPLVITSEFRSTTGIPVDCGGDEQKSNVGLFQNNSQRAFTDVNIGQVYNVVDDYEQRGIYSAVASGNTGIIRRHREVQNEQLSSNSTQGTAQRRIRLSMATHGSNKMVKSGSCAQEELNLKSVIAMEEKASESHISDESSTLTNDGNELPKTSKSSGKRKISRQATKAGSTLGLKDFLLLRRVPYISKASSNRAKCSSVFVVSAFVM

SEQ ID NO: 134534 - protein, 160 aa, Glycine max
  Coding DNA Sequence Number=SeqID_17756
  Homolog annotation: Hit_ID=Q337M3; Match level="QueryCoverage=62%, HitCoverage=20%, E-value=7e-16, Identity=40%"; Hit description =Expressed protein
MKTPTTKVVNLKTKKSLSKRPRLQDVIDIDTPIRAIACLKKIDDMRRFEETEDCFILGFDPYAAVGLSVDSSADDVSVIAEKGKVACRDYPHSRHLCLKFPFKTTPHESYCEKCYCYVCDKVAPCKDWKGWHCNAESGIYWKNQRNVKKIQPARLYYSQP

SEQ ID NO: 134535 - protein, 1133 aa, Glycine max
  Coding DNA Sequence Number=SeqID_17757
  Subcellular localization annotation: CTP_CleavageSite=34; ConfidenceScore=5.24e-01
MKGVGGYHDWPYYASPTSNLSAFAAPFSVNPYTSSEASSQFMDTAESAETLPPIQFQPYRYDFFSGPVRELDSAAQFSHLGLPSYSARSNLVEAQPYTASSAIHDHSSNSAAPYHWSSGAPSSDWPSLREANRSPELGFSGQSAVSWDQFPEFNSRGKGKQVGVGSNLSVKETNAAGSVGEQRRNQGNQDVKDSSNCEVPQIIDWENYNVPASANHIHNTSNWWGTIKPMPVEFSGTSVMQSPSMSLETHHETPLKVVADSGNNHSLNIGSYYKHSSHVDKPSRVDTVSSMPGTMLVTDLNVQDIIADEHVGHDDFYNTKEASHMPSPGTAGLFNPGPIHMHLRRNEPSSSNKAMISDKNVSRNVADYIFRESHEFQNPHANMDNLRLGLSAIEDVNFVEKSFEGGDRCNPAEDSPCWKGASAARFSHFEPSAALSQEYVHKKESSFGSVIKEPQNYLLDTENNMKKSCGNSNGFQMHTGIVYQDRSSAGSPRRFSVTKFAPEYCKSGSALNDGPFQSKPSCDFGLQQYVDITKMKENTVPPAKPTDCESGSSQMGLQLVDLKEFITQKQQALLCTGDVNSGCNVNNCSEYDSSHTAEHVLPLPSSVLDATTPENSAGKASTEKLDVQMLLDRMQNLSELLLSHCLNDACEWKEQDCNVLKNVISNLNTCALKNEQIAPVQECLFNQPETSKHAGESRKFRQLYENVLVVTRILMRLSGDEFGIIMDCSNIAQRVLYLNSCLKRPQLTKIGPESSKIEFENPLVAEANFCFRSGKPHRKLSDSISPRVDTEMTKADNMTKDLKRILSENFHGDDDEGAEPQTVLYKNLWLEAEATLCSVYYRARYNQMKIEMDKHSYKEKVMEKQSKSEVIPTLSQSQSSATKVHYPNPDSSADLKFPVLDVTNLEELSRLNISTDMNKSNAITPEGRGQNLDSFIDNYLVPCSVNKTERNDESSVMMARYQVLKARIDQSSTVTTNLEEPLDVADSSSPRGRDNQNQVNLCQDSPIPEKNSAEYETSVLARFHILKSRDEGSSSISSEGKQLHGDESAAVEGMDGITVATNVSEGKSLDVHANPVVVHLNSYTAVDKSIPKEFHLDSEDNQETQPSGTCEFQPPTYYSDGFASDWEHVEKSL

SEQ ID NO: 134536 - protein, 165 aa, Glycine max
  Coding DNA Sequence Number=SeqID_17758
  Gene Ontology: Mol. function=protein binding; Cellular component =nascent polypeptide-associated complex; Biological process=protein transport
  Homolog annotation: Hit_ID=Q1T6J8; Match level="QueryCoverage=92%, HitCoverage=68%, E-value=5e-42, Identity=62%"; Hit description =Nascent polypeptide-associated complex NAC; UBA-like
  Pfam annotation: Domain name=NAC; Domain location=21-80; Score=81.9; E_value=1.9e-21; Accession=PF01849.8; Description=NAC domain
  Pfam annotation: Domain name=UBA; Domain location=126-163; Score =21.9; E_value=0.0024; Accession=PF00627.21; Description=UBATS-N domain
  Pfam module annotation: Pfam domain module=NAC::UBA; Domain location =21-80::126-163
  Subcellular localization annotation: CTP_CleavageSite=7; ConfidenceScore=5.21e-01
MRHFIAVATLASGAEGSKQSRSEKKSRKAMLKLGLKPVTGVSRVTIKRTKNILFFISKPDVFKSPNSETYVIFGEAKIEDLSSQLQTQAAQQFRMPDMGSVTAKQEDAAAAAVQPEEEEEVDETGVEPHDIDLVMTQAGVSRSKAVKALKTHNGDIVGAIMELTT

SEQ ID NO: 134537 - protein, 67 aa, Glycine max
  Coding DNA Sequence Number=SeqID_17759
MGARSRARLGHYGNWVCVRYAKLVEFMENIVFLEFENLFWSRTGSKGKWMMTGTQVTDEWSSRISQN

SEQ ID NO: 134538 - protein, 96 aa, Glycine max
  Coding DNA Sequence Number=SeqID_17760
MSPGPVVDASPEVEAEQQLPSVDDATQLKKSQPQGFLGWTRFCSSFLSHFRDCCQEDDAPVVEDVRDDDKDDDDEDDDDDDEDDKEDDALGPLLFH

SEQ ID NO: 134539 - protein, 44 aa, Glycine max
  Coding DNA Sequence Number=SeqID_17761
MAGNFELHASVLNYVAFNARSNSGAALPFGYLLCVVSTSFKQCN

SEQ ID NO: 134540 - protein, 83 aa, Glycine max
  Coding DNA Sequence Number=SeqID_17762
MFAFKENIVRATGCGVQWSSSLIHILLPAVGVRDLGMKAEREVEEGWWETATFVGGGGCVSTEPPEAVEEWSETWRTIGEGKR

SEQ ID NO: 134541 - protein, 385 aa, Glycine max
  Coding DNA Sequence Number=SeqID_17763
  Gene Ontology: Mol. function=caffeate O-methyltransferase activity; Biological process=lignin biosynthetic process
  Homolog annotation: Hit_ID=P28002; Match level="QueryCoverage=99%, HitCoverage=100%, E-value=0.0, Identity=84%"; Hit description =Caffeic acid 3-O-methyltransferase
  Pfam annotation: Domain name=Dimerisation; Domain location=34-85; Score=100.9; E_value=3.8e-27; Accession=PF08100.2; Description =Dimerisation domain
  Pfam annotation: Domain name=Methyltransf_2; Domain location=94-360; Score=499.3; E_value=4.4e-147; Accession=PF00891.8; Description=O -methyltransferase
  Pfam module annotation: Pfam domain module=Dimerisation::Methyltransf_ 2; Domain location=34-85::94-360
MGSAAETQITPTHVSDEEANLFAMQLASASVLPMVLKSALELDLLEIIAKAGPGVHLSPTDISSQLPTQNPDAPVMLDRILRLLACYNILSFSLRTLPDGKVERLYGLAPVAKYLVKTEDGVSIAALNLMNQDKVLMESWYYLKDAVLEGGIPFNKAYGMTAFEYHGTDPRFNKVFNKGMADHSTITMKKILETYTGFEGLKSLVDVGGGTGAVVNMIVSKYPTIKGINFDLPHVIGDAPSYPGVEHVGGDMFVSVPEADAIFMKVNFIIRIPFNILPILERPFKWICHDWSDEHCLKFLKNCYEALPDNGKVIVAECILPVAPDSSLATKGVVHIDVIMLAHNPGGKERTEKEFEALAKGSGFQGFRVLCCAFNTYVMEFLKKV

SEQ ID NO: 134542 - protein, 305 aa, Glycine max
  Coding DNA Sequence Number=SeqID_17764
MDLGMPARKKEVVSVFWILPLHGKRSKSGQDLSTRVRPSEAKQEWGGRDAKEALGGKSRSFSKSRRVDMSAPYKVIACAPKREKKIGRNSWKEIITPFIVRGFNEGNTKILQRIRKAWDTVERKNKELRGSSNGPSGEEAKVPKENEEVQALKVKLERRRMVKKKLKMTVIRGSNNKLKLRRAERDESRVESMALKDKLKACHRSKRSLTEQSSGTEENMLTIIDQYKEKVNLAASLRQRLEDEHAKVLTLQMEREARERVIESLRWEAVKWMDRFALTLNGSQELPRLLARTKAMTEVYLTPDE

SEQ ID NO: 134543 - protein, 129 aa, Glycine max
  Coding DNA Sequence Number=SeqID_17765
MEAKKEKMATMMEAMMRMKKIMEVNTTVVATTSTIVEVDLTPPYGLNQINHPTSDMVGLEGKELGAGKIPPAMAEMRKLDHLEEMLRAIEGGKDYAFKSYSKYPMSSPLSSSRSRTLTSTRELLAPRTI

SEQ ID NO: 134544 - protein, 72 aa, Glycine max
  Coding DNA Sequence Number=SeqID_17766
MRTRSPLKARACSSLQARMCSPLMARTYGPRKGDRLTVLLKKLGTYWVKTSNLPLGSLEVFAWGLSFPQCRA

SEQ ID NO: 134545 - protein, 85 aa, Glycine max
  Coding DNA Sequence Number=SeqID_17767
PYELITIHPSSTIEFGAPQIDCLALFVHPPPSSSEPHELIAIHASSTIESGAPQIDLPSAVRASSTIEFGAPRIDCLALLVRPPP

SEQ ID NO: 134546 - protein, 66 aa, Glycine max
  Coding DNA Sequence Number=SeqID_17768
MRYLLVGVSRSTKNEIKMQPKVAWGSKNRESWAPRPGELTCHFFYVVMSMALYGLAFAYSNPLKVD

SEQ ID NO: 134547 - protein, 67 aa, Glycine max
  Coding DNA Sequence Number=SeqID_17769
MEKWLQRNSLRRGLEEMPQEKGSSAAPEFDSHRFQSVEHQQCFEAIRGWSLHRERRVQLRKDEYTDF

SEQ ID NO: 134548 - protein, 97 aa, Glycine max
  Coding DNA Sequence Number=SeqID_17770
MYGFLEPQSIQRSGQSQFESESYIKSWMQSSKHDVYLGAYLNGHWQMVVILPKENLVVWFGSLHNRLDNYLKGIINSIIDKKEALSAAIMSCTGCPR

SEQ ID NO: 134549 - protein, 270 aa, Glycine max
  Coding DNA Sequence Number=SeqID_17771
  Gene Ontology: Mol. function=pyridoxal phosphate binding
  Homolog annotation: Hit_ID=Q5PKH4; Match level="QueryCoverage=56%, HitCoverage=61%, E-value=8e-66, Identity=75%"; Hit description =Hypothetical protein yiiM
  Pfam annotation: Domain name=MOSC; Domain location=154-270; Score =128.3; E_value=2.1e-35; Accession=PF03473.7; Description=MOSC domain
  Pfam annotation: Domain name=Sod_Fe_C; Domain location=4-114; Score =192.8; E_value=7.9e-55; Accession=PF02777.8; Description =Ironmanganese superoxide dismutases, C-term
  Pfam module annotation: Pfam domain module=MOSC::Sod_Fe_C; Domain location=154-270::4-114
LKTGTTLQGDLKAAIERDFGSVDNFKAEFEKAAATRFGSGWAWLVLKGDKLAVVSTANQDSPLMGEAISGASGFPIIGLDVWEHAYYLKFQNRRPDYIKAFWDVVNWDEAAAPRRAAMHYPVNVFVGKIRDYDGSRPSAIGKIQVDGELQLGDLGLEGDEQAEKKIHGGPDRALCHYPREHYLDWIREFPQQADLFCAPAFGENLSTEGLTEKNVYIGDIFRWGEALIQVTQPRSPCFKLNYHFGISDMAQLMQNSSKVGWLYRIIAGGR

SEQ ID NO: 134550 - protein, 115 aa, Glycine max
  Coding DNA Sequence Number=SeqID_17772
MGLCQSYGVPVTSSKATGAPPPPWQVDPAGPLGVEHHLQHLVCQQAANHHGQGQGSSPFVCPTPEHYGADVTWPGDWPNAQAGEESAGSLGEAGESHMDEDMTDLLNFLGESGAT

SEQ ID NO: 134551 - protein, 102 aa, Glycine max
  Coding DNA Sequence Number=SeqID_17773
MSILILRSKKEEKGNFQSKKKRRKISNQRKKGSKGIPNHEWEKENRKERKFPTKGWEKVKKKRRKLLVKETRRNVQRGNNLQSQVMIYLWFRISMKHLPVRD

SEQ ID NO: 134552 - protein, 53 aa, Glycine max
  Coding DNA Sequence Number=SeqID_17774
MAFVDKWVVGKEEVCYWLSNDIVGRPSRMIKFASFRTHIDPFTGEDQIRKALR

SEQ ID NO: 134553 - protein, 366 aa, Glycine max
  Coding DNA Sequence Number=SeqID_17775
  Gene Ontology: Mol. function=hydrolase activity, acting on acid anhydrides, in phosphorus-containing anhydrides; Cellular component =membrane; Biological process=RNA catabolic process
  Homolog annotation: Hit_ID=Q5GUR8; Match level="QueryCoverage=87%, HitCoverage=55%, E-value=1e-167, Identity=94%"; Hit description=ATP -dependent RNA helicase rhlB
AARSHVGGHQDFQLALLEAVEQALTLLLRHVAGQHAHAVAGLFQRTRHTLDEHLGVDEDHGARAFAARQQAQQQRDLLVVGREVDALAHARGGDGLGFDHQLLRLVHVLVGQLQHAMAEGGTEQQGLAGGALRHAAQQEADVLDEAQVEHAVGFVQHADLAGVQRHHLVLLDVVDQAARGGDDHVHALLQQFALLVVIHAAVDQRETQAQVGTELHCILVDLDGQFAGRGEDQRARIFRLAVGQGRTRQQAVHDGDQEGQSLAGAGLGLAGNVTTGQRDGQGQRLDRGATGESGSFKAGLQGRVQLKGGKGQIGQRFVAHESVLVWPPARGAAGTSASRGTVANCGPCGGLAGWDHPVRAPHNAPV

SEQ ID NO: 134554 - protein, 130 aa, Glycine max
  Coding DNA Sequence Number=SeqID_17776
MTKGCTVTIICLCVPSDTTVSEWQKVCGMTIICLRMSSGRRLWMTKGCKMTIICLCVPSDTTVSEWKRGAKSPNFVSACHRACRLWMTKGCRMTIICLCVPSDTTMSEWLKGVRNDHNLSPHVIGPAASG

SEQ ID NO: 134555 - protein, 170 aa, Glycine max
  Coding DNA Sequence Number=SeqID_17777
  Gene Ontology: Mol. function=chitin binding; Cellular component =extracellular region; Biological process=chitin metabolic process
  Homolog annotation: Hit_ID=UPI000044A8F0; Match level="QueryCoverage =74%, HitCoverage=99%, E-value=7e-14, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAEVNEVQELMKADMEAMKEQMVTMMEAMMSMKKIMEVNAAARLHALDFRGLHVLTFRGLHALAFRGLHALAFRGLHVLAFRGLHVLAFRGLHVLTYRGLHALAFRRLRALDFKGLHVLAFRGLHALSFKGIHVLTFRGPYLQRTTSPCLQRAPCPRLQRTTRPCLQRTT

SEQ ID NO: 134556 - protein, 85 aa, Glycine max
  Coding DNA Sequence Number=SeqID_17778
MAKFDPEIVLEFYANAWPMEEGVRDMRSWVGGRWVRIMRTSKTTLTQTWMTLLLNNVLPSDHNSNLPLPKCQLVYGAHQAPCGPR

SEQ ID NO: 134557 - protein, 115 aa, Glycine max
  Coding DNA Sequence Number=SeqID_17779
  Gene Ontology: Mol. function=nucleic acid binding; Cellular component= mitochondrion; Biological process=translation
  Homolog annotation: Hit_ID=P93486; Match level="QueryCoverage=56%, HitCoverage=45%, E-value=1e-23, Identity=77%"; Hit description =Glycine-rich RNA-binding protein PsGRBP
  Pfam annotation: Domain name=RRM_1; Domain location=38-91; Score=9.7; E_value=0.018; Accession=PF00076.12; Description=RNA recognition motif. (a.k.a. RRM, R
MAFCNKVGNVLRQGAARSTHAPVASMLNYIRCMSSSKLFIGGLSYGVDDQSLKDAFSGFGDVVDGKFSLLSLLSYAVQFQSGTELEFVIMVIAVSCVKLLSAHNSTQHTSRKHKV

SEQ ID NO: 134558 - protein, 75 aa, Glycine max
  Coding DNA Sequence Number=SeqID_17780
LRWWSREVFEDLVVPCSVFEILLVAVVPISSEVRNDHFRKKVFRKLRRPIPEEGLPEVFSGSTYSGIGLSNFRKK

SEQ ID NO: 134559 - protein, 91 aa, Glycine max
  Coding DNA Sequence Number=SeqID_17781
VKGRSPEYEEPRDLRSNPFQGGGDDAMSCREKKECYEQQWITHKLSPGQPGGDQHNSPLCLLEDLRDQLEAPKAVQVPEIASRTETRTTSG

SEQ ID NO: 134560 - protein, 100 aa, Glycine max
  Coding DNA Sequence Number=SeqID_17782
MARTKKTWEMTTEVTKEIAKKIDSFEEQATQGSFVPHGRQDVLTAAIGRLEHPGRVRAAGAGVTIKQYFRLAPRTSHNSSLLSPKELQQLTQQIRDQLEE

SEQ ID NO: 134561 - protein, 52 aa, Glycine max
  Coding DNA Sequence Number=SeqID_17783
MGGTNQLCQLRFGENILQRMGRENSEGDSQFTGYKLGIGATSPSSTHLVDFL

SEQ ID NO: 134562 - protein, 150 aa, Glycine max
  Coding DNA Sequence Number=SeqID_17784
  Homolog annotation: Hit_ID=Q1SFS3; Match level="QueryCoverage=72%, HitCoverage=21%, E-value=2e-07, Identity=44%"; Hit description =Lambda repressor-like, DNA-binding
MGSDQVPPFKKRFYHVKVKNLELARLRKLGQWMDQVQCQAFSKMLHFWGLSVSTNHRGVRRDLRMPARGRKPYLFSGFYPSMARIEKMVKISEQELDYVKQNRNGVAGIPRKRLEEKAKALASQGEWAAFINVLALLVFGTILFPNVDGL

SEQ ID NO: 134563 - protein, 139 aa, Glycine max
  Coding DNA Sequence Number=SeqID_17785
  Gene Ontology: Mol. function=protein binding; Cellular component =integral to membrane; Biological process=xylan catabolic process
  Homolog annotation: Hit_ID=Q1SWI7; Match level="QueryCoverage=82%, HitCoverage=18%, E-value=1e-42, Identity=69%"; Hit description =Leucine-rich repeat
  Pfam annotation: Domain name=LRR_1; Domain location=27-48; Score=8.5; E_value=7.5; Accession=PF00560.23; Description=Leucine Rich Repeat
  Pfam annotation: Domain name=LRR_1; Domain location=3-25; Score=14.2; E_value=0.47; Accession=PF00560.23; Description=Leucine Rich Repeat
  Pfam module annotation: Pfam domain module=LRR_1::LRR_1; Domain location=27-48::3-25
MRLLQSIDFSRNQLSGEIPPSIANLSFLSMLDLSYNHLKGNIPTGTQLQTFDASSFIGNNLCGPPLPINCSSNGKTHSYEGSDGHGVNWFFVSMTIGFIVGFWIVIAPLLICRSWRGRVAERKEGKDRRCGEMELRITK

SEQ ID NO: 134564 - protein, 83 aa, Glycine max
  Coding DNA Sequence Number=SeqID_17786
  Gene Ontology: Mol. function=serine carboxypeptidase activity; Biological process=proteolysis
  Homolog annotation: Hit_ID=Q1EP77; Match level="QueryCoverage=80%, HitCoverage=13%, E-value=5e-14, Identity=64%"; Hit description =Serine carboxypeptidase (Carboxypeptidase D), putative
MALCSVFLNLHLLLFVSSYLSQEILAEQEADRVHGLPAQPSVKFNNMVVISLPMKLKEQHCSIGFSRPLTNQNKNSFSYGSME

SEQ ID NO: 134565 - protein, 50 aa, Glycine max
  Coding DNA Sequence Number=SeqID_17787
MAPLWRRCHWKARTKGDAEVAEGVVGVGHVDDKLSVSEGEEEGAEADNGN

SEQ ID NO: 134566 - protein, 91 aa, Glycine max
  Coding DNA Sequence Number=SeqID_17788
MIRGDTLWLFAPFCHPEAAGPMTSRDQVWSFCTLVSSRGGGPDDTRKYPSGADTVFCTFCSSGNNKVIYMRKFHGRPRLSSTEKSEISVIH

SEQ ID NO: 134567 - protein, 225 aa, Glycine max
  Coding DNA Sequence Number=SeqID_17789
MTSIAQSNSSKLGFPALITTLCQARGVVSDSLTFERLSLAINLAYIRKNCWNVDDLTIAFRGARRARARPADIPSTSAAPAPTLASTSTASSIPAHVDTQRFKAMLQSEGPTTQVPQQVQDASSETTIPEPFTLHPKAGEEQVRPGTTATPKRSLEGTSEPPSPVVDLSSPQPAADLSIPRLEILGDLATPVLALNTSPPATLVLHLTDEEDAQTQDTQDLSQGF

SEQ ID NO: 134568 - protein, 106 aa, Glycine max
  Coding DNA Sequence Number=SeqID_17790
MTTFCKSRRKRFLTIQTISPNEKFIFMGNEVKAPVAIVKTYCLKCNTGHRLDLLETPYRNHIVGTGILYDGLYKLKLDSLYAETVLTLHHNVGTKHSLVNERSAFL

SEQ ID NO: 134569 - protein, 163 aa, Glycine max
  Coding DNA Sequence Number=SeqID_17791
MVSNSQQFSARNDAIVIRGVHEVATNSSSSAETKKLEGKLDALVNLVTQLAMNQKSVPVARVCGLCSFADHHTDLCPSMQQSGAIEQAEAYAANIYNRPPQTQQQNQPQQNNYDLSSNRYNPGWRNHPNLRWSSPQQQQQQSAPSFQNAAGPSRPYVPPPMQQ

SEQ ID NO: 134570 - protein, 64 aa, Glycine max
  Coding DNA Sequence Number=SeqID_17792
MAPLFMIHIMSGKQSHFHKFRVVVVRPGSCFTFILGLRLQKVLGKYIGYYESKCVRKKRKVDLE

SEQ ID NO: 134571 - protein, 34 aa, Glycine max
  Coding DNA Sequence Number=SeqID_17793
MENWRTALGNDIRGAPDSKGSRFEGGGHMNGARQ

SEQ ID NO: 134572 - protein, 68 aa, Glycine max
  Coding DNA Sequence Number=SeqID_17794
MASRTTMLATNSKPLVNGRNDEAGIGENLVGNNGFAVRAVEEEETLDDSFDAMRSTVGEIMCGVSEGV

SEQ ID NO: 134573 - protein, 114 aa, Glycine max
  Coding DNA Sequence Number=SeqID_17795
  Gene Ontology: Mol. function=catalytic activity; Biological process =metabolic process
MAQGMTPVLRAGEHLRRVMNSDNCSPDWRVQLYVSPYVHTRLMFHKLRRRFLKKRIIGVREESQVRELDFGNFMIKAMERGSRRLMNSFKGLKTCKLSNWEIVSQERMETIALK

SEQ ID NO: 134574 - protein, 667 aa, Glycine max
  Coding DNA Sequence Number=SeqID_17796
  Gene Ontology: Mol. function=protein serine/threonine kinase activity; Cellular component=cell surface; Biological process =protein amino acid phosphorylation
  Homolog annotation: Hit_ID=Q6UY59; Match level="QueryCoverage=99%, HitCoverage=100%, E-value=0.0, Identity=69%"; Hit description=Lectin- like receptor kinase 7;2
  Pfam annotation: Domain name=Lectin_legB; Domain location=20-256; Score=418.5; E_value=9.2e-123; Accession=PF00139.10; Description =Legume lectin domain
  Pfam annotation: Domain name=Pkinase; Domain location=340-610; Score =165.0; E_value=2e-46; Accession=PF00069.15; Description=Protein kinase domain
  Pfam annotation: Domain name=Pkinase_Tyr; Domain location=340-610; Score=113.8; E_value=5e-31; Accession=PF07714.7; Description=Protein tyrosine kinase
  Pfam module annotation: Pfam domain module=Lectin_legB::Pkinase::Pkina se_Tyr; Domain location=20-256::340-610::340-610
MSLKVVTVVFLLATIVVASDYTSFTYNGFQSSHLYLDGSAEFTTNGMVKLTNHTKQQKGHAFFPSPIVFKNTTNGSVFSFSTTFVFAIRSEFPNLSGHGIAFVVSPTKEVPHSLPSQYLGLFDDTNNGNNSNHVFGVELDTILNTEFGDINDNHVGIDVNELKSVKSASAGYYSDGGFKNLSLISGYPMQVWVEYDGLKKQIDVTLAPINVGKPERPLLSLNKDLSRILNSSMYVGFTSSTGSILSSHYVLGWSFKVNGKAQQLAISELPMLPRLVGKQESKVLIVGLPLILLILILMVALAVVHAIKRKKFVELLEDWEQDYGPHRFKYKDLSLATKGFREKELLGSGGFGRVYKGVMPISKIEVAVKKVSHESRQGMREFVAEIASIGRLRHRNLVPLLGYCRRKGELLLVYDYMPNGSLDKYLYNKPRVTLNWSQRFRITKGVASGLFYLHEEWEQVVLHRDIKASNVLLDAELNGRLGDFGLSRLYEHGTDPHTTHVVGTLGYLAPEHTRTGKATTSSDVFAFGAFMLEVVCGRRPIEQGRESGSEILVDWVYNCWKKGEILEARDPNLGANYRPDEVELVLKLALLCSHSEPLARPSMRQVVQYLEKDVPLPDLSMLSLSSIGLTFGLHEDFQDCPMSYPSSMDRPISHTSSIAESLLSGGR

SEQ ID NO: 134575 - protein, 245 aa, Glycine max
  Coding DNA Sequence Number=SeqID_17797
  Gene Ontology: Mol. function=molecular_function; Cellular component =cellular_component; Biological process=regulation of progression through cell cycle
  Homolog annotation: Hit_ID=Q9LZL8; Match level="QueryCoverage=97%, HitCoverage=81%, E-value=1e-100, Identity=70%"; Hit description =Thaumatin-like protein
  Pfam annotation: Domain name=Thaumatin; Domain location=29-242; Score= 232.2; E_value=1.1e-66; Accession=PF00314.8; Description=Thaumatin family
MARTSSILFYLVAFCSIIIIDGAQLILVNNCGESVWPGILGGAGQQTPKDGGMHLGSGEEVVLDVPEKWSGRIWGRQGCSFDNDGHGHCLTGDCNGMLHCRGQGGVPPATVVEMTLGSSSSPLHFYDVSLVDGFNLPVSMKPVGGGVGCGVASCEVDLNVCCPSALEVKRNGKVVGCKSACLAMQSAKYCCTGSYSDPKTCKPTLFAHLFKAICPKAYSYAYDDSSSLNRCRAPRYVITFCPPPV

SEQ ID NO: 134576 - protein, 128 aa, Glycine max
  Coding DNA Sequence Number=SeqID_17798
  Homolog annotation: Hit_ID=Q2HVW5; Match level="QueryCoverage=47%, HitCoverage=7%, E-value=5e-17, Identity=70%"; Hit description =Nucleoporin interacting component; Protein prenyltransferase
MSSTSSVSFGISSMEIVPLTGIPIVEKKTSVDAEIVKNLNKARESGLPFKLAAVVKDAYENLGINASGGKSVKMDCARLLVGFHSSVGNRKLRVVYQKYFDPKKGAIVVLPLAKGFFLSIELKKQREK

SEQ ID NO: 134577 - protein, 113 aa, Glycine max
  Coding DNA Sequence Number=SeqID_17799
MVRVKEGRWGVFEPCCHCFHRKEEAPPQRRRLKTDEIEPECDTKRAQAMCFKEHEAIKSATRKGNKEGSMMGSMLESEGRVRNIAQVLLTIQTNTSCWDMLGAPSNIAGAPSN

SEQ ID NO: 134578 - protein, 225 aa, Glycine max
  Coding DNA Sequence Number=SeqID_17800
  Gene Ontology: Mol. function=RNA-directed DNA polymerase activity; Biological process=RNA-dependent DNA replication
MVASAPTDFTEMVNMGVRLEEGVREGRLTGESTPAASNAKKFGGHFAKKKDQEVGMVAHGKPQQNFTPYRQVANVASAIPNPSYHQQRPHYPYQYPPQQYPPQQYHPQQYPPQQYHQPQYPQKQQNRPQNPQQPYHSQNRQKTTFDPIPMKYADLLPALLAKNLVQVRTPPRTPDVLPPWFRHDLTCAFHQGAPGHDVENCYVLKNEVQKLVRANLLSFKDQNPN

SEQ ID NO: 134579 - protein, 137 aa, Glycine max
  Coding DNA Sequence Number=SeqID_17801
MNCVFVHVSSTHEFGAMRSDCLVQFSILNPFSEPMNCVFVHVSSTHEFGTMRSDCSVQFSILNPFSEPMDCVFVHVSSTHEFGAMRSDCLVQFSILHLFRRPMNCVFVHASSTHEFGTMRSDCLVQFSILNLFFGAP

SEQ ID NO: 134580 - protein, 83 aa, Glycine max
  Coding DNA Sequence Number=SeqID_17802
  Gene Ontology: Mol. function=oxidoreductase activity
  Homolog annotation: Hit_ID=Q40839; Match level="QueryCoverage=72%, HitCoverage=20%, E-value=9e-09, Identity=49%"; Hit description =Ethylene-forming enzyme
MLELESLAWLASSIPIVNHSIQKELLQGIKNAASEFFKLPTEEKNKYAMASNDIHGQAYVVSEEQTVDWLDALLLITYKNSIL

SEQ ID NO: 134581 - protein, 67 aa, Glycine max
  Coding DNA Sequence Number=SeqID_17803
MESVKFWDVLGTKQPKTRKRGVNLSNTGGALKKLYPEHSRGGLNLSITGALMNLPQEASGRQPSPFC

SEQ ID NO: 134582 - protein, 69 aa, Glycine max
  Coding DNA Sequence Number=SeqID_17804
MWKLSPLDHMIDAQNHPKLYQKVSFSIYEKGLVKFDYSVTWRLTLTRGGNRSGRLTGAYNLAYIKSDLN

SEQ ID NO: 134583 - protein, 79 aa, Glycine max
  Coding DNA Sequence Number=SeqID_17805
MNGFADKGKYPLGTKLTLKASNLSRTIMSLNVDEEDLLTEMEEALTSSPFIPLENVQEVARNSPLQVPKRYVTCNIPFF

SEQ ID NO: 134584 - protein, 78 aa, Glycine max
  Coding DNA Sequence Number=SeqID_17806
  Gene Ontology: Mol. function=protein dimerization activity; Cellular component=nucleus; Biological process=regulation of transcription, DNA-dependent
  Homolog annotation: Hit_ID=Q9C5W9; Match level="QueryCoverage=97%, HitCoverage=12%, E-value=9e-17, Identity=50%"; Hit description=Auxin response factor 18
MDEDAPPQKRLKAPEVAIKGIAVVRAVNLTTLDGYDQLVDELEKMFDIKGQLQNKNKWVVLYADDDGDTILVGDEPWP

SEQ ID NO: 134585 - protein, 672 aa, Glycine max
  Coding DNA Sequence Number=SeqID_17807
  Gene Ontology: Mol. function=protein dimerization activity; Cellular component=nucleus; Biological process=regulation of transcription, DNA-dependent
  Homolog annotation: Hit_ID=Q9XED8; Match level="QueryCoverage=98%, HitCoverage=98%, E-value=0.0, Identity=53%"; Hit description=Auxin response factor 9
  Pfam annotation: Domain name=AUX_IAA; Domain location=498-653; Score=- 80.0; E_value=0.00097; Accession=PF02309.7; Description=AUXIAA family
  Pfam annotation: Domain name=Auxin_resp; Domain location=258-339; Score=157.3; E_value=4e-44; Accession=PF06507.4; Description=Auxin response factor
  Pfam annotation: Domain name=B3; Domain location=131-236; Score =107.3; E_value=4.4e-29; Accession=PF02362.12; Description=B3 DNA binding domain
  Pfam module annotation: Pfam domain module=AUX_IAA::Auxin_resp::B3; Domain location=498-653::258-339::131-236
MSLNCGGCGGEEDELYEQLWKACAGPHVEVPRTGQRVFYFPQGHMEQLEVSTNQELNQRIPLFKLSSKILCRVVNVHLLIFILVLELPTYHAEQETDEVYAQITLVPESNQTEPTSPDPCPAELPRPRVHSFCKVLTASDTSTHGGFSVLRKHATECLPALDMSKSTPTQELVAKDLQGFEWRFKHIFRGQPRRHLLTTGWSTFVTSKRLVAGDTFVFLRGNNGELRVGVRRIAPLQSSMPSSVISSQSMHLGVLATASHAVATQTLFVVYYKPRTSQFIVSVNKYLEAINQKCNVGMRFKMRFEGDESPENDKRFSGTILGVEDISPHWVNSNWRSLKVQWDEPASFPRPDRVSSWEIEHILACVPTTSSQPAVIKNKRPRQASEVPDLGDTPLAAPTFWDAGLTQCDMTQLRVMTESKRSDSSSHMRHHNSKSNNNGISMNQTEASWLSSPQLYQDTTDDNKSILAWPISKPHSERLNNDHFLDQVDKNINKVEAATSYRLFGIDLIDHARNNSLSVENASGVASECKTDVNHESDLSKASKEWNQEQLLVSPKETQSKQVCSRSCTKGVAVGRAVDLTTLDGYDQLVDELEKMFDIKGQLQHRNKWETVFTDDEGDMMLVGDDPWPEFCNMVKRIFICSSQDVHKLSSGSKLPISSMGEIVISLNTTET

SEQ ID NO: 134586 - protein, 274 aa, Glycine max
  Coding DNA Sequence Number=SeqID_17808
  Gene Ontology: Mol. function=helicase activity; Biological process =viral genome replication
  Homolog annotation: Hit_ID=Q1SRJ5; Match level="QueryCoverage=99%, HitCoverage=36%, E-value=1e-61, Identity=41%"; Hit description =Probable helicase [imported]-Arabidopsis thaliana-related
MFQSYIVLDADGFSVYRRRNNGHTIEKNGVIIDNSTSTRDDRVTAVLIHEDNDQTHNGGTHNDEIKEYLDCSYIYLPDRYICPCESTWRIFGFPIHGRKPVVERLHFHLPGQHSVLYEDHDDIDDVLSKPSISDSKFISWMNTNQNSVEGKNLTYAEFVSKFVYNQKKRCWHLRKKGYTIGRLLWVPPITGELFYLRMMLTVYKGPTLFEDLRTIDNVQYPTYKEACFAMGFLQDDKEFIEAIKEAKYWGSAYYIRKLFVLLLLIATMSKPEQV

SEQ ID NO: 134587 - protein, 53 aa, Glycine max
  Coding DNA Sequence Number=SeqID_17809
MDFMGETFVVEWAFSVGWASDWEEPCGSCSYGVGISLFFLSSTHSGPSIASTR

SEQ ID NO: 134588 - protein, 110 aa, Glycine max
  Coding DNA Sequence Number=SeqID_17810
AQLVARTTVLLAEFYVITDNTIIVTQRIIKKLPIEANFRLTNCKSTLAKPPPYTLANLVVDVEASIGGRDSGAQERERGEGEQLVIEVVMEVRGGRARARRVPSRNRDGE

SEQ ID NO: 134589 - protein, 91 aa, Glycine max
  Coding DNA Sequence Number=SeqID_17811
MASKGGSWRSPVVSGGGGGAWVVGGGFRGREEGRRWLFYAAKRICSLQHSPRRAGCYIENPNGQNMENCLRSLLKKIEDDPMVNKSRIEIL

SEQ ID NO: 134590 - protein, 198 aa, Glycine max
  Coding DNA Sequence Number=SeqID_17812
MTGNSTILVMMLAVWFFMTGRLLPGSLTFDCHIMHYIIVRILLPRSSNLAQASEEYLILMWAFLTGRQIDWAHLVRYRMHKALRANAPLPYPQLVTLFLRHFQIPLDDEPFVQVKRSFAIGVGVVTSFGYRKDRNGQWLKKDALPPQDKRTPSPPPQRDDSSALLNEVLLELRGLRTYVGERFNSLDGRFEGMDTRIT

SEQ ID NO: 134591 - protein, 198 aa, Glycine max
  Coding DNA Sequence Number=SeqID_17813
MTSASSTASSKDAIEIPGFYKRQWLPNYPEIVEFKYDGATYKIQVRLRTELQIYESVIINFLACDHHSKFDLHFTPPLHQQTCKRRRASRKHIWTYEITQSMLGAPYPLQLPPSITQCLIHCGDHMTILRIFGPPLQWNVVVLDKGIGDKYITQPWYKFFQEGDFSHGNELSFYYRRAEKIWEVVIRRAIDWDDNDID

SEQ ID NO: 134592 - protein, 34 aa, Glycine max
  Coding DNA Sequence Number=SeqID_17814
MGVKHFKVVKRRSHADKQWSLNEITVEFSPTRGI

SEQ ID NO: 134593 - protein, 68 aa, Glycine max
  Coding DNA Sequence Number=SeqID_17815
MQRGKRRLYEDLGLDREDDFQTDDEENQAQRVFEHLDDDTDSDNNSPTSRNLYNEVSIISWPQSYRYY

SEQ ID NO: 134594 - protein, 68 aa, Glycine max
  Coding DNA Sequence Number=SeqID_17816
MLRCPQHFSAIFYDIKGCGDETAIADSQKLRFRVLQFACGCDEIELGWKTGRWDVLLGWKLGEEEDLV

SEQ ID NO: 134595 - protein, 116 aa, Glycine max
  Coding DNA Sequence Number=SeqID_17817
  Homolog annotation: Hit_ID=Q1SFR5; Match level="QueryCoverage=92%, HitCoverage=21%, E-value=2e-08, Identity=27%"; Hit description =Integrase, catalytic region
MLLGYFESSKAYRVYNSRTLTVEEAIHERFNDNKSDTTMSELDESFAEMKIENIVKFVVAFSQDKHASNSPVDDQPEEVREPTRCLLRKHHPKSHIIGDPKDKVQTRNPLKHTTLL

SEQ ID NO: 134596 - protein, 102 aa, Glycine max
  Coding DNA Sequence Number=SeqID_17818
MGYESCDLWFECVSDFDSVGFFVVDLYGGGWWPEGGCVGGLWWLGGVGCLTQCLWLGRWWWFTEEEGVAEWWLVVAWLFRHSDCSYSPLTRTVINAAFKGQN

SEQ ID NO: 134597 - protein, 416 aa, Glycine max
  Coding DNA Sequence Number=SeqID_17819
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=30%, E-value=1e-129, Identity=54%"; Hit description =Integrase, catalytic region
MSISSTIEPSSYAEAFRHDCWIKAMQAELQALQSNDTWTLTLLPPHKTVIGCRWIYKIKYRADGSIERYKARLVAKGYTQMEGLDYLDTFSLVAKPTTLNVNNAFLHGELTEEVYMQVPLGLSVANPQLVCRLQCSLYELKQASRQWFTRLSSFLISHEFRQSHSDHSLFLRFTGPITTVLLVYADDIILTGNIITEIQGITALLDQTFKIKDLGNLKFFLGLEIARTSKGIHLCQRKYALDILSDSGMLGCRPNSTPMDYSTRLQATSGTPLSAESSSSYRRLVGRLIYLTNTCPDIAYAVQQLSQYMASPTNTHLQAAFHVLRYLKGTPGSSLFFAAIGTPQLRAFSDSEWAGCRDSRRSTTGFLVYFGSSLVSWQSKKQSTVSRSSSEVEYRALASTTCELQWLTYILQDFRV

SEQ ID NO: 134598 - protein, 169 aa, Glycine max
  Coding DNA Sequence Number=SeqID_17820
  Gene Ontology: Mol. function=nucleic acid binding; Cellular component= cytoplasm; Biological process=DNA integration
  Homolog annotation: Hit_ID=Q1S1G2; Match level="QueryCoverage=71%, HitCoverage=12%, E-value=2e-25, Identity=38%"; Hit description =Integrase, catalytic region; Zinc finger, CCHC-type; Peptidase aspartic, catalytic
MSGHVLFVWNGVVVGKKVQLEVHNLKILALWVVLVWSLWVSRVGCRKRIPEMITLSMRFKTNEDAWMCSGIELLAVCFKGVSITQTTKNAKIGYIAWMSMEFFIRGFDTCGLMNDSFRGIIVMHEKLSPIITSYDFYFAIILGFNGCNEVHDDMSGFGFSMHEMYPCKA

SEQ ID NO: 134599 - protein, 442 aa, Glycine max
  Coding DNA Sequence Number=SeqID_17821
  Gene Ontology: Mol. function=peptidase activity; Cellular component =endoplasmic reticulum; Biological process=programmed cell death
  Homolog annotation: Hit_ID=O22282; Match level="QueryCoverage=91%, HitCoverage=90%, E-value=1e-113, Identity=52%"; Hit description =Expressed protein
  Pfam annotation: Domain name=Asp; Domain location=65-429; Score= -104.5; E_value=2e-07; Accession=PF00026.14; Description=Eukaryotic aspartyl protease
MRPKATPTIPYLKFIIFFIIEAPIGIFFNNHCEAKTLALPLKSQVIPSGYLPRPPNKLRFHHNVSLTISITVGTPPQNMSMVIDTGSELSWLHCNTNTTATIPYPFFNPNISSSYTPISCSSPTCTTRTRDFPIPASCDSNNLCHATLSYADASSSEGNLASDTFGFGSSFNPGIVFGCMNSSYSTNSESDSNTTGLMGMNLGSLSLVSQLKIPKFSYCISGSDFSGILLLGESNFSWGGSLNYTPLVQISTPLPYFDRSAYTVRLEGIKISDKLLNISGNLFVPDHTGAGQTMFDLGTQFSYLLGPVYNALRDEFLNQTNGTLRALDDPNFVFQIAMDLCYRVPVNQSELPELPSVSLVFEGAEMRVFGDQLLYRVPGFVWGNDSVYCFTFGNSDLLGVEAFIIGHHHQQSMWMEFDLVEHRVGLAHARCDLVGQKLLGLV

SEQ ID NO: 134600 - protein, 48 aa, Glycine max
  Coding DNA Sequence Number=SeqID_17822
  Homolog annotation: Hit_ID=Q1RSC2; Match level="QueryCoverage=85%, HitCoverage=7%, E-value=2e-11, Identity=73%"; Hit description =Pentatricopeptide repeat
  Pfam annotation: Domain name=PPR; Domain location=11-45; Score=20.4; E_value=0.0063; Accession=PF01535.11; Description=PPR repeat
MENNGCIPDAITFEILIRAFFEEDENDKADKLLREMIAKGLLLLHRDP

SEQ ID NO: 134601 - protein, 247 aa, Glycine max
  Coding DNA Sequence Number=SeqID_17823
  Homolog annotation: Hit_ID=Q1RSC6; Match level="QueryCoverage=59%, HitCoverage=25%, E-value=4e-21, Identity=56%"; Hit description =Pentatricopeptide repeat
MHPMVEDHTTFIVGQSNYCYKVMPFGLNNTSVTYQHLMDKILPDLIGKNIETYVDDIVVKSMKVKVFRLSFHSQVSHFPSSKPLTPNSLSSLSLSPPSFQNVDDVLFQFNRMLCMRHTPPIIQFGKILGSIMKMKHYPTVVFLSKQMELKAIVPNLVTLNILINCFCHLDPQIGLSAKHHNLDNIREPLVEKVLEMPTLECKQLSAVRFVFGNQVLADFFIKSLCLKGQRSRRHCTFMARYWYKDFS

SEQ ID NO: 134602 - protein, 225 aa, Glycine max
  Coding DNA Sequence Number=SeqID_17824
  Gene Ontology: Mol. function=protein serine/threonine kinase activity; Cellular component=nucleus; Biological process=protein amino acid phosphorylation
  Homolog annotation: Hit_ID=Q947K6; Match level="QueryCoverage=94%, HitCoverage=51%, E-value=1e-113, Identity=94%"; Hit description=CDK -activating kinase
  Pfam annotation: Domain name=Pkinase; Domain location=14-221; Score =196.0; E_value=9.1e-56; Accession=PF00069.15; Description=Protein kinase domain
  Pfam annotation: Domain name=Pkinase_Tyr; Domain location=14-221; Score=-38.4; E_value=4.1e-10; Accession=PF07714.7; Description =Protein tyrosine kinase
  Pfam module annotation: Pfam domain module=Pkinase::Pkinase_Tyr; Domain location=14-221::14-221
MAELDLSKKVADRYLKREVLGEGTYGVVYKAIDTKTGQTVAIKKIRLGKQKEGVNFTALREIKLLKELKDPNIIELIDAFPHKGNLHLVFEFMETDLEAVIRDRNIVLSPSDIKSYLQMTLKGLAICHKKWVLHRDMKPNNLLIGSNGQLKLADFGLARVFGSPDRRFTHQVFARWYRAPELLFGTKQYGPGVDVWAAACIFAELLLRRPFLQVPKLIGNFSLGP

SEQ ID NO: 134603 - protein, 232 aa, Glycine max
  Coding DNA Sequence Number=SeqID_17825
  Gene Ontology: Mol. function=GPI anchor binding; Cellular component =anchored to membrane
  Homolog annotation: Hit_ID=Q9SUC9; Match level="QueryCoverage=82%, HitCoverage=55%, E-value=2e-32, Identity=39%"; Hit description =Uncharacterized GPI-anchored protein At4g28100 precursor
MMPLLPDDSETCVNELGKALVVRGVELTKPNETCDVVYCFCGIRLHHLTCPDSFSVGQSGELVGDAIVRRLEKNCLSSSTNVNGLPGLGGCSKCLNTLYLFIIVTWNLMDLIEKLKKIKMLNKKTSNSSKAEDRTTKIHNKDCELMGLTWLLAKNRTAYMHTVSAVLRALMLNTDGSYPQSCSLNSDGMPLAVDSSEISDHSSSNNLQPPISLSLLFLCLLLLPMHLTMLSS

SEQ ID NO: 134604 - protein, 183 aa, Glycine max
  Coding DNA Sequence Number=SeqID_17826
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8VWL8; Match level="QueryCoverage=96%, HitCoverage=34%, E-value=3e-67, Identity=67%"; Hit description=Beta -mannosidase
  Pfam annotation: Domain name=Glyco_hydro_1; Domain location=44-183; Score=-203.3; E_value=1.7e-08; Accession=PF00232.9; Description =Glycosyl hydrolase family 1
MVSLTPLCFFFTVLIAGGSVIRCAAGADAAAEPETVRFDTGGLSRETFPKGFLFGTATSAYQVEGMAHKDGRGPSIWDLFIKKPGIVANNGTGEVSVDQYHRYKEDIDLMASLNFDAYRFSISWSRIFPNGTGQVNWKGVAYYNRLINYLLEKGITPYANLYHYDLPLALEERYNGLLSRQVV

SEQ ID NO: 134605 - protein, 51 aa, Glycine max
  Coding DNA Sequence Number=SeqID_17827
MAGRASSGERKTSPMRNAHSGCEDVLETDWLFIEDYYVISMKMFTGKEFEL

SEQ ID NO: 134606 - protein, 518 aa, Glycine max
  Coding DNA Sequence Number=SeqID_17828
  Gene Ontology: Mol. function=nuclease activity; Cellular component =nucleus; Biological process=DNA repair
  Homolog annotation: Hit_ID=Q54ED2; Match level="QueryCoverage=52%, HitCoverage=27%, E-value=9e-48, Identity=36%"; Hit description=5'3' -exonuclease N-and I-domain-containing protein
  Pfam annotation: Domain name=XPG_I; Domain location=101-216; Score =53.1; E_value=9.2e-13; Accession=PF00867.9; Description=XPG I-region
  Pfam annotation: Domain name=XPG_N; Domain location=1-66; Score=2.1; E_value=0.0012; Accession=PF00752.8; Description=XPG N-terminal domain
  Pfam module annotation: Pfam domain module=XPG_I::XPG_N; Domain location=101-216::1-66
MGIKDLLRFMKPYIEPVHIKKYAGKRVGIDAYSWLHKGAYSCSMELCLDSNSERKLRKRRANRELAMAKLKEGNVGAASELFQRAVSITPVMAHKLIQTLKSEKIEFVVAPYEADAQLAYMSQLGVENGGVAAVITEDSDLIAYGCPAFHRSHAFWIIIRSGFEQIIFKMDRHGNGERIELEKVFSAESGRPSFRSFNMKLLTGMCVLAGCDFLPSVPGIGIARAHALVSKYRNLDRILSVLKIEKGDQMPEDYAKSFQEAVAVFEHAQIEIPPSIVTAIAEGNLNPSTKKAFDKSECSRFPLQPIDLQSIDQVRKAEVPAPSRQGSSFSIITSHYTREMARLSDKDKYSNEALALHKLIMPLGNNGTEEKTIISDFTPLKFPDNNPFRIRKNEGTYQTKDTVQKVSFASNMGYTDLCMSPDDFEEKGSENLSRKRKFQNFCSDKVEATDELFSGVTEVEKSDIPCMAVESPESINSDQTKKIADLKGRSESNKQSKRSNSKKTGSNNITLLSFFSRV

SEQ ID NO: 134607 - protein, 495 aa, Glycine max
  Coding DNA Sequence Number=SeqID_17829
  Gene Ontology: Mol. function=DNA binding; Cellular component=nucleus; Biological process=regulation of transcription, DNA-dependent
  Homolog annotation: Hit_ID=Q0PJF1; Match level="QueryCoverage=42%, HitCoverage=97%, E-value=2e-98, Identity=87%"; Hit description=MYB transcription factor MYB96
  Pfam annotation: Domain name=Myb_DNA-binding; Domain location=303 -396; Score=8.1; E_value=0.83; Accession=PF00249.21; Description=Myb -like DNA-binding domain
  Pfam annotation: Domain name=Myb_DNA-binding; Domain location=402 -449; Score=21.5; E_value=0.003; Accession=PF00249.21; Description =Myb-like DNA-binding domain
  Pfam annotation: Domain name=Myb_DNA-binding; Domain location=455 -495; Score=17.5; E_value=0.047; Accession=PF00249.21; Description =Myb-like DNA-binding domain
  Pfam module annotation: Pfam domain module=Myb_DNA-binding::Myb_DNA -binding::Myb_DNA-binding; Domain location=303-396::402-449::455-495
MTPRADDFEKDNLSATDDDDDDDDGLKEDMDALARACMIAVPRPDDNSTAEDDIPAEDPLLLAGDSIVPAATDDDDDQDDLECLKRVQSLYQPLSILPPLTPPAAGSDDDDVDDLETVRAIMKRFSTYDEGGMEMLVEGDQTSSPGYEGDIANDSIYYESDVGELCPVSQHTNEAATKELIQNVEMKLSDFVESSEPDACGSSKLPQKRLSCPPVAKIEENKKMRNKIKILKDFQASCTRRTGNVLSLKKDPRVQLISSKKSFAPKNSKKPKKASAMCYGPEENSHVANYRMVLERFPLSLDRKKWSNVERESLLKGIKQQFQEMVLQLSLSVDSSEGLPGDANGMDDVIASVKDLAITPERIRQFLPKVNWNLIASMYVGGRTGAECESRWLNCEDPLINQGAWTNEEDKSLLLIVQDIGIRNWFDIATSLGTSRTPFQCLARFQRSLNPSMLNSEWTEEEDSQLCSAVASFGARDWQSVASVLERRTGTQCSN

SEQ ID NO: 134608 - protein, 129 aa, Glycine max
  Coding DNA Sequence Number=SeqID_17830
MKQLSINRKSPKPDCHSESFLTGNIPPHMNKEEKTETPSFLSKNADLKKILLVRDPPCFPCVFVWKLEVDVLLFTLGYKEDYPWHKYIVSLRCGALANDLFFFAKSMLSFRWKKPVDRSVPPTSFPGAT

SEQ ID NO: 134609 - protein, 126 aa, Glycine max
  Coding DNA Sequence Number=SeqID_17831
MAKLMKKQKGSSTTTVAADPKYLDIAFFDDETFECYQVFQNRGLVDFMSLKLPHYLELVRVFYNNLRIQDSTLYFEVHGIPLVIDQSLFFSSTKLPSQGVPFEGTVVDDWKFDYLSHDARRMVCND

SEQ ID NO: 134610 - protein, 82 aa, Glycine max
  Coding DNA Sequence Number=SeqID_17832
MALARDFCKETTHGAFWFRIGSKIPLAIYTLGMIAKYLDVLEIPRCAHVQFLVPQNALSMHVCKFSQGDVCDVSNKYTLEVQ

SEQ ID NO: 134611 - protein, 124 aa, Glycine max
  Coding DNA Sequence Number=SeqID_17833
MLKGMDLKEKNLEERNTLLELEPAAAQVLHELVSLVHNSVSSTQDGQSLSTSINDYELAGNDKHEKIVTSDLKDDPLAKILWDVEPQTLQCVFLAMAAVCVRVYMYVLKHVRLFTIFSITSQEL

SEQ ID NO: 134612 - protein, 119 aa, Glycine max
  Coding DNA Sequence Number=SeqID_17834
  Homolog annotation: Hit_ID=Q1SDP2; Match level="QueryCoverage=26%, HitCoverage=2%, E-value=6e-10, Identity=87%"; Hit description=RNA -binding region RNP-1 (RNA recognition motif); Aldehyde dehydrogenase
MKDLDLTSFIEDMMIQNIGCLILWMCSTGHLGFEIVGYIGHGKAKSEINKQNFSALPKVMGMAHDITCLLGYERMKLSLIAAAGYCSQSPSLLLVVLDLQKQAALRFKKSIMDRKVFGR

SEQ ID NO: 134613 - protein, 476 aa, Glycine max
  Coding DNA Sequence Number=SeqID_17835
  Gene Ontology: Mol. function=transcription factor activity; Cellular component=nucleus; Biological process=regulation of transcription, DNA-dependent
  Homolog annotation: Hit_ID=Q1SDP0; Match level="QueryCoverage=99%, HitCoverage=100%, E-value=1e-136, Identity=57%"; Hit description =Pathogenesis-related transcriptional factor and ERF
  Pfam annotation: Domain name=AP2; Domain location=135-198; Score =102.0; E_value=1.8e-27; Accession=PF00847.10; Description=AP2 domain
  Pfam annotation: Domain name=AP2; Domain location=227-291; Score =80.9; E_value=4.1e-21; Accession=PF00847.10; Description=AP2 domain
  Pfam module annotation: Pfam domain module=AP2::AP2; Domain location =135-198::227-291
MLDLNLTAESTQNDELLVLLDKFPEASSGTSNSSIVNAEGSSNEDSCSTRAGDVFTFNFGILKVEAANDVVAAATKELFPVSSENWQGQSSTSLFQARKSLMDLSLDQQHGEVKVVQVQPQPKVKKSRRGPRSRSSQYRGVTFYRRTGRWESHIWDCGKQVYLGGFDTAHAAARAYDRAAIKFRGLDADINFNLVDYEEDLKQMKNLSKEEFVHILRRHSSGFSRGSSKYRGVTLHKCGRWEARMGQFLGKKYIYLGLFDSEVEAARAYDKAAIKCNGREAVTNFEPSTYESEMKPEAINEGGSHDLDLSLGIATPGHGPKENRGHLQFQSIPYNMHPGRSSMMETNINSVIGDPSLKRLVVTEERPSVWNAAYSTFFPNLERAERMGTDPSKGVPNPNWAWQTHGQVTDTPVPPFSTAASSGFSISATFPSTAIFPTKSINSVPHSLCFTSPSTPGSNAPQFYNYYEVKSPQPPS

SEQ ID NO: 134614 - protein, 203 aa, Glycine max
  Coding DNA Sequence Number=SeqID_17836
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=1e-27, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LTFRGVHVLAFRGVHALTFRGLHVLAFRGLHVLAFRGLDVLIFRGLHVLVFIGLQALAFRGLHVLTFRGLHALTFHGQHFLTFRGLHVLTFVGLHVLAFIGLHVLAFGGLHTLAIRGLHVLTFRGLHDLTLLHALAFRGLHTLNFRGLHAFAFKGQHVLTFRELHVLAFRGLHALSFRGLHVLAIGGLSTTCPVFKRTTHPRF

SEQ ID NO: 134615 - protein, 328 aa, Glycine max
  Coding DNA Sequence Number=SeqID_17837
  Gene Ontology: Mol. function=signal transducer activity; Cellular component=membrane; Biological process=signal transduction
  Homolog annotation: Hit_ID=Q6D1S3; Match level="QueryCoverage=84%, HitCoverage=52%, E-value=1e-27, Identity=28%"; Hit description =Putative signaling membrane protein
MLNKPPLKSLLCLLSLSCILITAILLVTITVFVLKIFTEERILESNTAYARKLADSADNLFRTAQQELAFSASQITSFADSQALRYETDRLRLQSDMFGSVLVLSPEGQVIITSPLNFIPSGASLNVAPEQLQAVKKGPFVSEPLTPYTGNYLVFLSAPLHSSTGKYLGYLAGSIYLKKESMLSRLLSEHFYADKTVVSIVSDIGEVVYSTDESLTGQTLNLSSYLSAQLKRHRYGSLKTTLNQQRCLLGYSDVVKTNWHVFVCVSPDVTSNVLDHVVRDVILYGLVLALLLVSASMYISARISQPLEKLARLTGTGTTERLTGKIGE

SEQ ID NO: 134616 - protein, 81 aa, Glycine max
  Coding DNA Sequence Number=SeqID_17838
  Gene Ontology: Biological process=pathogenesis
  Homolog annotation: Hit_ID=Q05459; Match level="QueryCoverage=63%, HitCoverage=68%, E-value=1e-20, Identity=92%"; Hit description =Virulence-associated protein vagC
MAIAKLSGTPIVAKNEAGNGTASEFRPEGGVSELEIVREGDSIILRPVRPTWGSFLEFEKADPDFMAEREDVVSDEGRFDL

SEQ ID NO: 134617 - protein, 193 aa, Glycine max
  Coding DNA Sequence Number=SeqID_17839
MSENIEKDEKGFTRTLTVRNIPLSIDIEISEQATAAGKSKGDFLREFLAASFGDLIGNFMRSNGLLALMDRDVAKMMNARLADYWFDAAQTLAENRAWCRLLGINKEEDLQRIMRDGVPLLEIRARQLADVTHIPNGSSLAFALFAEAARRDLRTLLQVHRALFFLQKEEDFLDMVDQIREAQRLPPTERPVF

SEQ ID NO: 134618 - protein, 371 aa, Glycine max
  Coding DNA Sequence Number=SeqID_17840
  Gene Ontology: Mol. function=RNA binding; Biological process =translation
  Homolog annotation: Hit_ID=Q284T1; Match level="QueryCoverage=40%, HitCoverage=65%, E-value=4e-14, Identity=32%"; Hit description =Hypothetical protein mex02
  Pfam annotation: Domain name=DUF1526; Domain location=52-258; Score =53.5; E_value=6.8e-13; Accession=PF07512.2; Description=Protein of unknown function (DUF1526)
MRLLGHNLTPPSTRLVSYLREEGNPMAQIDEFINAKRLDIYVKHLKVKKSQAMAAYHWNKHLAAAIMPALQCMEVTLRNAIDLAVQTAPPKGAVGLWQTDRWWVSILPEYMGNTLIQPTDRYKLARNAHDRQDAQGFQLNSRGRRVLNRKLTEETQPEQAKNQIRAEGKAITSERIIAGLTFGFWTTLMTDKYEDLSSDRLLWPGLFSEVFPHAPAGFGREDVKKVIFRIKDLRNRVSHHEAVWKFSKDNPATGRPDPSRPVYGAAASCSLLNKHYDDILDVIGWINPDRLKNFLSHGADRRFRALCSVDGLNAYCDPAKISQTAVIPDDNPAEAICQALLNSGYTRLIRTDGSELIVAGTDIPAARHPVQ

SEQ ID NO: 134619 - protein, 187 aa, Glycine max
  Coding DNA Sequence Number=SeqID_17841
MSELKIDNPAQRLLDILEAGKTHSQAANCRAVWVSLLQAHQNNEQHLLSRLARVMELPGRIVQHAAIQSEEIDALLERLTELRNEIREADLPVTMKTLLLKQLSQIQEALETYGISGVEPVMDAVQSTLGLAVLNPEYRQEISKGTNSRFGEKISDLLSDVANVVTVAGALPALTVAVSNALTYIGQ

SEQ ID NO: 134620 - protein, 371 aa, Glycine max
  Coding DNA Sequence Number=SeqID_17842
  Gene Ontology: Mol. function=ATP binding; Cellular component =chromosome; Biological process=DNA metabolic process
  Homolog annotation: Hit_ID=UPI00006717D5; Match level="QueryCoverage =89%, HitCoverage=37%, E-value=5e-91, Identity=51%"; Hit description =PHP N-terminal domain protein
MTAAQQSFDDAVTDLLEKSTLTLNAIRSGEHFLTLEQTVEREQASVTREAESLRAQGLNPDTLDELMQRCERLRNELKEYEGLDAAVSASELRISTLLDEMVAHRMALTERRREFLSSLTLPGLEIKILPLCAPPEATVEDYQTLTGINSFGDRIYDGEEQSGLLHAFISNRPFSPLPAAAEAKYALLDALKNLHQAIKCDEKDAGQDLHGTFRNRIRSLPDETLDSLRCWYPEDGIYIRYRSPGGQMEDIASASPGQKGASMLQFLLSYGTDPLLIDQPEDDLDCLMLSQSVIPAIVANKKRRQLIIVSHSAPIVVNGDAEYVICMTYDRSGLRPGLSGALQQKEMKALICSQMEGGEKAFRSRFERILS

SEQ ID NO: 134621 - protein, 734 aa, Glycine max
  Coding DNA Sequence Number=SeqID_17843
  Homolog annotation: Hit_ID=Q849X3; Match level="QueryCoverage=12%, HitCoverage=47%, E-value=2e-28, Identity=74%"; Hit description=Int
  Pfam annotation: Domain name=DUF1173; Domain location=166-528; Score=- 136.4; E_value=0.00069; Accession=PF06666.2; Description=Protein of unknown function (DUF1173)
MAVKDNEKTGFNHDGITDPSRYSRRGGLRNGRLFARGLGAGSDTAVHRQRASERRRGALGFHQPAGGTGALACAGVDVRLNGMYSIMHNKFIVADGSAVETGSFNYTSSAEKRNAENAPVIKDEPDIARQYQAEFNRLWNESSPGVMMAAKKTYPVRFTGLRGSRECGADFRSAEPEQWQRWLKHARDNKATTVVTCLCHPPEEDAQRRRLKVHLSQKTDQCWLASWAFSGHEHAPDCRFYSVWPDERQAAIYAPDVVRAAADGRLVVRLPTGLQKKDVPDKTRDAPPAGAGPALDAPAGYRGRLSIGSWQGNPWRYDNSNHHVELWLPWRIGFVKGGNHSLAAGILAGEGTLLPDRVFDMDDLLRRAGQLTVSAVILIARQPRIVGRETSRRTKMEIKDLLTPAFTVMGVCLAAHFALRNERRKKALEIETSQLDRLSVLVLSSLDNFAQYAGALAGIIDAQITILTEQLPPPNRDNAEISVADLHNWLDQIDSHPAWGLNRSELQNASHGLRFHREADWLRWQEAVPQLQREIYAFFMITLPGEENIELMRRGRTAAEARAFARTMRIRVSELRSLQEALLSSMKDDFSKLLIPEQTTTFCSMTNSLCDRNTAAASAPSLLNGTASVAAMSSANTQHVHDIGVAEGVQRHWAGKMHAVIIRPLYGSLQPVTHCLIGRGPQRFAAPGAFGGYPAPDLMHVAGRDAVCGGHTPERHRGGKVRVLRKRQRGDVFW

SEQ ID NO: 134622 - protein, 311 aa, Glycine max
  Coding DNA Sequence Number=SeqID_17844
  Homolog annotation: Hit_ID=UPI00005F7DD5; Match level="QueryCoverage =58%, HitCoverage=93%, E-value=4e-57, Identity=57%"; Hit description =COG0265: Trypsin-like serine proteases, typically periplasmic, contain C-terminal PDZ domain
MDEALLAMMRSNGRNKAWAETMVNLEARKLIETANRVAGFHIRDGLTRLQFVQEIRDVIEGQFAIARRAKTDEECMACIKNLREESENLAEQDRLLRIKTAQLYAKVEFVWQNNKIVGYTLSAVHIAISGIALFTGLAMITSMPAIGMLAGAVLVSDGINGLSQEIINHFSPPGSAHSEGIFGDAAMAGAEFLGFRPETGLAIYNAATLSASVYGVFGAARKAGAWRLFRWMPRDYYRKVDSISKPKLTMRIAGYGLKAKKNRYRPEHSVKSPCQVMDSKLKRPAITFDVVFNCLQFRRTEAGTQQPLFTD

SEQ ID NO: 134623 - protein, 463 aa, Glycine max
  Coding DNA Sequence Number=SeqID_17845
MTSRGDIPGAFSLIRNWSENVARKIMRKAGYPVTPHTGRAFWTWVQETLIRAARERRCGYRARAERQAPVRRWRQQAAEDYDAWAQMMASEAAPQAEAAPPGTPLPARAVPVLQFQHAAGRIVARAAKQLRRHFMPVHSVVPVRAIAHVAAVRKICEVRYLSDPASRSAESVREQKMQMFIRTSGRSPAPARTLQQLIQRGQVAGDARRQGTTLPAVLVKAVIQCAAPEGVLEPIQVVLRLQVAVSCAPQVIQLAGQVGAQALLSPFLQQPADVAGQRPGKATLFFSGGQPAGQKQRNQAAPGQVADVQIVVIHKPRGSAARPDFIRLAPQVFSPPNQGGSRRNESGPGSNNLGMKVMLVSEEGLLRSGFSSAELQAVKNNVESYGGTLELAIHDLARRFNRMLWTFRDKNNCRRHIFPVGYWLYDTQPAPGALLQVMAILAGCAVLVRRVIDRQQVKNYLRF

SEQ ID NO: 134624 - protein, 424 aa, Glycine max
  Coding DNA Sequence Number=SeqID_17846
  Gene Ontology: Mol. function=ATP binding; Cellular component =chromosome; Biological process=DNA metabolic process
  Homolog annotation: Hit_ID=UPI00006717D5; Match level="QueryCoverage =99%, HitCoverage=46%, E-value=1e-134, Identity=56%"; Hit description= PHP N-terminal domain protein
  Pfam annotation: Domain name=PHP; Domain location=10-217; Score=-3.5; E_value=0.007; Accession=PF02811.9; Description=PHP domain
MSVGSRWYKFDFHNHTLASHDYAKPDVTDREWLLAYMRQKVDGVIISDHNSGARIDSLKNELQQMARDARTGDLQDYRPLALFPGVELTATGNVHILAVFHTDSTSADVERLIGQCNNSFPVPREALNHQLVLQTGPAGIISLIRNNPDALCILAHIDAPKGILKSMTNQGELEAAFLAQPHAVEIRFDPADISDGTHKRLIKNLPWLRGSDAHHPDHAGARTCWLKMSTPDFDGLRHALLDHENCVLFDLPPPEEPALQLRSLSLRTKLCTPPDGEMASVAFSPFYNAIIGSRGSGKSTLIESIRLAMRKTEKLSPGLDKKLNQFRQTGQGMDADSVIECVFRKDGADFRLSWRPGDVCVLHTLSEGEWIEESGWASDRFPISIFSQKMLYELASDNGAFLRVCDESPMVNKRTWAERQNELT

SEQ ID NO: 134625 - protein, 84 aa, Glycine max
  Coding DNA Sequence Number=SeqID_17847
MAQQQHGELERVYTMIGAVVMAMAGDGLETTRLRIAGFIRGELARTQAWSPEMETAMLSAIETLEIYPDQEVVERHRDGGDWVL

SEQ ID NO: 134626 - protein, 456 aa, Glycine max
  Coding DNA Sequence Number=SeqID_17848
  Gene Ontology: Mol. function=DNA binding; Cellular component=nucleus; Biological process=regulation of transcription, DNA-dependent
  Homolog annotation: Hit_ID=Q6R029; Match level="QueryCoverage=64%, HitCoverage=33%, E-value=3e-46, Identity=39%"; Hit description=MYB transcription factor
  Pfam annotation: Domain name=Myb_DNA-binding; Domain location=24-69; Score=38.0; E_value=3.3e-08; Accession=PF00249.21; Description=Myb -like DNA-binding domain
  Pfam annotation: Domain name=Myb_DNA-binding; Domain location=75-120; Score=42.0; E_value=2.1e-09; Accession=PF00249.21; Description=Myb -like DNA-binding domain
  Pfam module annotation: Pfam domain module=Myb_DNA-binding::Myb_DNA -binding; Domain location=24-69::75-120
MEYLVIYNLVSSGRWKKSLCPEKKGSFTREEDIRITVAVMLFGRKWNQIANYVPGRIQSQCRDRYLNCLDPSLKWGGWTEEEDLRLEAAVVKHGYCWSKIAEEVPPRTDSQCRKRWKVLCPEYVPLLQEARKKQRSIIGCNFVDRESERPAITLNDFLPLPVPAPKSDVGASNLRKKAKSSNVPKKMSKKLAKRARLHTKEVQDTEVYSDDGIKTYGEVSACSNVPKKMRSKRHTKKTRNCPKEVVDIYCSEKVKTCIESSESQSTCIASSGNQDSDNITIACFLRDKSKEMLSRFTKDLSQASFSSRSIDVSNKQVESQDPFDDQIGLSKSFDTVGTENLFVQQNVASDRRVGKPEDANTLTGGDHEEMTLACFLGNKSKKGSQAANGRGACSSTIIIPDDSGLSMSKHVEKETVLHGGVAEPMDIVVEEKDDELLTSFLQNRPTRQRKRPSRFL

SEQ ID NO: 134627 - protein, 89 aa, Glycine max
  Coding DNA Sequence Number=SeqID_17849
  Subcellular localization annotation: CTP_CleavageSite=35; ConfidenceScore=5.44e-01
MAPVRSGGVTPAFGPPDSESSAKLIKQSQGVFAFRARSAPGGTLKRQRARGTGNFSLFSGTIADDRYSGDGQGIQAEAYHSGARNEQPE

SEQ ID NO: 134628 - protein, 629 aa, Glycine max
  Coding DNA Sequence Number=SeqID_17850
  Homolog annotation: Hit_ID=Q65AF8; Match level="QueryCoverage=39%, HitCoverage=93%, E-value=9e-50, Identity=44%"; Hit description=BcfH protein
  Pfam annotation: Domain name=DSBA; Domain location=465-624; Score =29.3; E_value=5e-07; Accession=PF01323.10; Description=DSBA-like thioredoxin domain
  Pfam annotation: Domain name=TraI; Domain location=1-124; Score=84.3; E_value=3.7e-22; Accession=PF07057.2; Description=DNA helicase TraI
  Pfam module annotation: Pfam domain module=DSBA::TraI; Domain location=465-624::1-124
DHVQIVTDDRAGWMETLGVRKNGPATAHDALMPEPERDQARRIWAMGQAASKTAIGRAYLRSNGLSGSPVTARIIPPTRKFPEPHLALPVFDGNGKPAGLTMVPLRPGSGDVDRGAERRIVTDGAQAALVQKSRNGETLVVATLEEALSAARKYPTSGILLRTGDAAPSPQLLKVSGGLEPLAGAAVEEAVRSLQSPPPVPDEPVTPAAPAGIGDETIRDLVRQDAHQPDVPDAPEVQISVRDGRADVAAEEKLAADLSRAVPQEAADIEQPVDPVAKPAVDETDLAGRVLEGSRQAYPEVRMPEESREQPVPSGKGESELATELAAGSRTDKEIAAGISMPAQHEGPERLPPELSHEPHAREIMKQILKLAAIALAMSTALPSAPSNAAEAADFTPAQQARIGEIAADYLVAHPDVLIEVSKKLQARQQAMQQQAYVQSALKAHRLLMQLDGVPVKGLADSKVIVTEFFDYECIACSMMEPVMEKVMAANAGVRFAFRDWTIFAARYPESRLASHRGLGIYSRQGAEAYMAFHNGIYRTGHNEGKLTAEDIEKVATAAGAGTASGDDSAASDRLIENNDALAEMLGLTGTPGIIVMPAENATADNTTVIPGVVSEEVLQQAIVRAGGN

SEQ ID NO: 134629 - protein, 340 aa, Glycine max
  Coding DNA Sequence Number=SeqID_17851
  Gene Ontology: Mol. function=protein kinase C binding; Cellular component=cell soma; Biological process=protein kinase C activation
  Homolog annotation: Hit_ID=Q8LAF2; Match level="QueryCoverage=98%, HitCoverage=98%, E-value=1e-102, Identity=55%"; Hit description =Guanine nucleotide-binding protein, putative
  Pfam annotation: Domain name=WD40; Domain location=102-139; Score =34.0; E_value=5.3e-07; Accession=PF00400.22; Description=WD domain, G-beta repeat
  Pfam annotation: Domain name=WD40; Domain location=147-187; Score =45.6; E_value=1.7e-10; Accession=PF00400.22; Description=WD domain, G-beta repeat
  Pfam annotation: Domain name=WD40; Domain location=197-235; Score =40.5; E_value=5.9e-09; Accession=PF00400.22; Description=WD domain, G-beta repeat
  Pfam annotation: Domain name=WD40; Domain location=239-275; Score =9.0; E_value=3.3; Accession=PF00400.22; Description=WD domain, G -beta repeat
  Pfam annotation: Domain name=WD40; Domain location=300-337; Score =20.1; E_value=0.0078; Accession=PF00400.22; Description=WD domain, G- beta repeat
  Pfam annotation: Domain name=WD40; Domain location=60-98; Score=38.1; E_value=3.1e-08; Accession=PF00400.22; Description=WD domain, G-beta repeat
  Pfam annotation: Domain name=WD40; Domain location=7-50; Score=32.8; E_value=1.2e-06; Accession=PF00400.22; Description=WD domain, G-beta repeat
  Pfam module annotation: Pfam domain module=WD40::WD40::WD40::WD40::WD4 0::WD40::WD40; Domain location=102-139::147-187::197-235::239 -275::300-337::60-98::7-50
MTEAEVFVFRGTLRGHTDTVTAIATPENNNNNSDKIIVSSSRDNSLIVWRLTKEYSNSYGVLHRRLTGHSHFVSDVALSSDADFAVSASWDGELRLWDLSTGATKLRFIGHAKDVLSVALLNDSVIISGSRDHTIKAWNTCGTCMSTVDNGSGDGHTDWVSCVRFIPDAAPPRLVSASWDGSVRVWDVDVDVDKGALRKRFTLSGHEGYVNVVAVSPDASLVASGGKDGVVLLWDMAGGVKIYEFEVGSVVHGLWFSPNRYWMCIATDESVRVWDLESNSIIKDLNVNGNNDHYNYVNGGTEITANNKDIYCTSMNWDADGNTLFCGYTDGLIRIWEVIS

SEQ ID NO: 134630 - protein, 266 aa, Glycine max
  Coding DNA Sequence Number=SeqID_17852
  Gene Ontology: Mol. function=RNA-directed DNA polymerase activity; Cellular component=chromatin; Biological process=chromatin assembly or disassembly
MVFYVGQKRHSTMVVDRRRNQQHFQRRGEQLKMINRCLETFLQCFIADQPKTWVLWLPWAEYWYNITFHVSTGTTPFLYGQKPQMLILFLIGETKVEAVQRDLLDKDEALRPVKYHLQRHQCRMKSYVDRKRTEKVFEIGDWNFLKLRSQGQQTVEAGIWPKLAPCYYGLYQLPETARIQGRGGHSLCEPEAILAGELVSQLLIHWKGKLLKKQPKKRSSIFGVRFCGSDLRTNLFLKEGTMLAPQMWTQRPNLRVYSRRNKKRNE

SEQ ID NO: 134631 - protein, 123 aa, Glycine max
  Coding DNA Sequence Number=SeqID_17853
  Gene Ontology: Mol. function=sequence-specific DNA binding; Cellular component=nucleus; Biological process=regulation of transcription, DNA-dependent
  Homolog annotation: Hit_ID=Q1SSB6; Match level="QueryCoverage=88%, HitCoverage=31%, E-value=5e-47, Identity=84%"; Hit description =Homeodomain-related
  Pfam annotation: Domain name=Homeobox; Domain location=17-78; Score =64.1; E_value=4.4e-16; Accession=PF00046.19; Description=Homeobox domain
MAEQNKREFNGAAPVVVSSRWNPTPEQLRALEELYRRGTRTPSAEQIQHITAQLRRFGNIEGKNVFYWFQNHKARERQKRRRQMESDAETPEKKDLAASRTVFEVERTKNWTPSTNCSTIAEV

SEQ ID NO: 134632 - protein, 74 aa, Glycine max
  Coding DNA Sequence Number=SeqID_17854
MGRIRNTIVTDEVKELEAVAGHMWCRPYGQGTLMALPPAKHKQSKFCMVVAEKVVLFIAKIEGAGAGLIVSLST

SEQ ID NO: 134633 - protein, 119 aa, Glycine max
  Coding DNA Sequence Number=SeqID_17855
  Homolog annotation: Hit_ID=Q9C9U9; Match level="QueryCoverage=51%, HitCoverage=23%, E-value=3e-19, Identity=62%"; Hit description =Thaumatin-like protein; 9376-10898
MMIRLIRAESDQIVSLRASNKAGGVIKGIGVHLRTRALEDSGIHCGPTGPRASITASATVPQSSEMTNSKGEIFSKRVQETAWRCRKQHPALKGYPSHTKPSVSCSPTRDLPNPFAISL

SEQ ID NO: 134634 - protein, 177 aa, Glycine max
  Coding DNA Sequence Number=SeqID_17856
  Gene Ontology: Mol. function=nucleic acid binding; Cellular component= nucleus; Biological process=DNA integration
MSAMDMIKSLSSKPEKFTGENFFCWQQQMKFWLTELDLYSVISKREIKTSTSSTDIVQTDATIKHDVSDKDILCHGRILSALADNIYKIFCHTKTSVELWEALELKYGSAEKGLSRYSCEKMIEFQMIDGKSISDQIHEFENIVYDMKLKGIVLPDIMLVAFMISKCLLRGLILLEA

SEQ ID NO: 134635 - protein, 87 aa, Glycine max
  Coding DNA Sequence Number=SeqID_17857
VAWPGAQPSPSGGGGASTAQEPEPEEPAVAEGEDELTPPEPFYFDAGVHMAQEEETSTDQIPEPSPVPIPDDAIPFAPSSELEQPIP

SEQ ID NO: 134636 - protein, 74 aa, Glycine max
  Coding DNA Sequence Number=SeqID_17858
MAHASGIKLLNLVVILYMRYFCWSSEYAMSLAELVGPAGIGKTQESDGQVDPAELYPGQSQELEIQFEMFGSGM

SEQ ID NO: 134637 - protein, 345 aa, Glycine max
  Coding DNA Sequence Number=SeqID_17859
  Gene Ontology: Mol. function=oxidoreductase activity; Cellular component=mitochondrion; Biological process=fatty acid biosynthetic process
  Homolog annotation: Hit_ID=Q1SQN2; Match level="QueryCoverage=82%, HitCoverage=77%, E-value=1e-132, Identity=82%"; Hit description =Alcohol dehydrogenase superfamily, zinc-containing
  Pfam annotation: Domain name=ADH_N; Domain location=49-124; Score =6.7; E_value=0.00014; Accession=PF08240.2; Description=Alcohol dehydrogenase GroES-like domain
  Pfam annotation: Domain name=ADH_zinc_N; Domain location=155-305; Score=58.6; E_value=2.1e-14; Accession=PF00107.16; Description=Zinc -binding dehydrogenase
  Pfam module annotation: Pfam domain module=ADH_N::ADH_zinc_N; Domain location=49-124::155-305
MSVITLQHTVSSNDTLAQAPFPEPPTEREKLTETESDRNVATLGRSRAAFGLQLQVEFNSRIQGVYPVRPEPPAVGGYEGVGEVHSVGSSVTSLSPGDWVIPSPPSFGTWQTYIVNDEKVWHKIEKGVPMEYAATITVNPLTALLMLEHCVTLNSGDAIVQNGATSMVGQCVIQIAKSRGIHNINIIRDRPGVDEVKERLKNLGADEVSTESELEVKNVKSLLGGIPEPVLGFNCVGGNAASLVLKFLRQGGTMVTYGGMSKKPVSVSTSSFIFKDISLRGFWLQKWLSTDKAEESRGMIDRLLSLVQEGKLKYKMDLAPFEDFNTALDKALGKLGSQPKQVIKF

SEQ ID NO: 134638 - protein, 387 aa, Glycine max
  Coding DNA Sequence Number=SeqID_17860
  Gene Ontology: Mol. function=hydrolase activity; Cellular component =mitochondrion; Biological process=metabolic process
  Homolog annotation: Hit_ID=Q1SQN1; Match level="QueryCoverage=92%, HitCoverage=100%, E-value=1e-161, Identity=76%"; Hit description =Peptidase S26A, signal peptidase I; HAD-superfamily hydrolase, subfamily IIA
  Subcellular localization annotation: CTP_CleavageSite=49; ConfidenceScore=5.16e-01
QKYGEVSNKLLLSHSADSEVAKGKTVAAMSFQLLTKARKRTVFSYLLSRAFSHRSERPTFGIAFDIDGVLLLGNSPVGGSPGALKRLYDADGGGYPEAKRAFELSKLLGINVTPSQGHSPFKQLVKRFENDLIVAVGKGEPAAVMTEYGFRYVLSIDEYASCFENIDPLAPYKKWTTKLAVTQNAKFNESVPRNDVFSKRVQAAFVVSDPVDWSRDIQVLCDILKTGGLPGRNVGPQPHIYFANDDLEYQTKFPSERLGMGAFRIALESIFNRIHPQSLEYTSFGKPHPSVFKNAEILLEKLVASLYDDFYDINHDNTSYFKTLYMIGDNPAVDIKGARQTGHPWFSILTRTGVFKGKENHDKFSADLVVDTVEEAVDYILTKECAS

SEQ ID NO: 134639 - protein, 151 aa, Glycine max
  Coding DNA Sequence Number=SeqID_17861
MSIKRYQWKARNQRIVHLLVWGGKDTKIEAKSTQWWPRVSKNQNLVSACVLKCFDDNKDDDKGDDKKLKGQSKNEFKMFKIESRTLQDSRGKLKNTSRFKRKVKFKNQESRFKDQAFKTQDSRIKRRLNQDKYEKVFLKVITLPNGSLDQT

SEQ ID NO: 134640 - protein, 323 aa, Glycine max
  Coding DNA Sequence Number=SeqID_17862
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=83%, HitCoverage=38%, E-value=3e-54, Identity=37%"; Hit description=Zinc finger, BED-type predicted
MVHELPFSIVKDEVWMWAFQYANSKFQKISRKTVRSWNLQKKVLSFVKVPAPQRGIDVADAIFKCLKARGIEDKVFFVSVDNASYNDSCLKNLKENLSLSKMLILNGDLFHVRCCAHILNLLVQDGLSKIKDIIQNVRESVKYINHNDSRLKAFCDVVEQKHIKERKLIIDCPTRWNSTFQMLSTILKFKTAFSAYNERDPHYTYAPSHEDWEKVQKVCTLLEVFNVATHIISGSEYPSTNLYLVEVWRVKQLIDNALEDTTFFMREMAGSMKVKFDKYWGECNMLMSITSVLDPRCKFHVVNICFPLIYKSEEIAKENIEKV

SEQ ID NO: 134641 - protein, 139 aa, Glycine max
  Coding DNA Sequence Number=SeqID_17863
MGEVDELQEWMKADMEAMKEQITTMMETMMSMKKMMGVNTATVTATSAIVEVEPTPPSGLNQINHPTSNMVGQGGKELGSTGSPHFVQIQNKHAFPPYGLPPNYTPPNENVNNSTPILIESQQPQSDHAHVSQPMGGDT

SEQ ID NO: 134642 - protein, 67 aa, Glycine max
  Coding DNA Sequence Number=SeqID_17864
MDAASSTGEKLVPPLLMTREHDAEPMPPFVLAGHANVDSPAIGSCKTNREKKKLKQRRIRHWLLRDQ

SEQ ID NO: 134643 - protein, 86 aa, Glycine max
  Coding DNA Sequence Number=SeqID_17865
  Gene Ontology: Mol. function=nucleotide binding; Cellular component =membrane; Biological process=small GTPase mediated signal transduction
  Homolog annotation: Hit_ID=Q40196; Match level="QueryCoverage=90%, HitCoverage=36%, E-value=4e-35, Identity=92%"; Hit description=RAB11F
  Pfam annotation: Domain name=Ras; Domain location=16-86; Score=-36.8; E_value=1.6e-06; Accession=PF00071.12; Description=Ras family
MAVADAFDEQCDYLFKAVLIGDSGVGKSNLISRFAKDEFRLDSKPTIGVEFAYRNIKVRDKLIKAQIWDTAGQERLTKLPNSCAKK

SEQ ID NO: 134644 - protein, 260 aa, Glycine max
  Coding DNA Sequence Number=SeqID_17866
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=93%, HitCoverage=22%, E-value=3e-90, Identity=67%"; Hit description=CTR1 -like kinase kinase kinase
  Pfam annotation: Domain name=Pkinase; Domain location=1-225; Score =54.4; E_value=3.7e-13; Accession=PF00069.15; Description=Protein kinase domain
  Pfam annotation: Domain name=Pkinase_Tyr; Domain location=1-225; Score=67.7; E_value=3.8e-17; Accession=PF07714.7; Description =Protein tyrosine kinase
  Pfam module annotation: Pfam domain module=Pkinase::Pkinase_Tyr; Domain location=1-225::1-225
MKRLRHPNVVLFMGAVTRPPNLSIVTEFLPRGSLYRLLHRPNSQLDERRRLKMALDTARGMNYLHNCTPVVVHRDLKSPNLLVDKNWVVKVCDFGLSRMKHSTFLSSRSTAGTAEWMAPEVLRNEPSNENFGVILWELSTLQQPWGGMNPMQVVGAVGFQHRRLDIPDDMDPAIADIIRKCWQTKKKDNREQYILSDLTITPNCGRTVEVDPKLRPTFAEILAALKPLQKSVIGSQVPRPSASGKHEKVQSLRVAEDSAR

SEQ ID NO: 134645 - protein, 169 aa, Glycine max
  Coding DNA Sequence Number=SeqID_17867
  Gene Ontology: Mol. function=nucleic acid binding; Biological process= DNA integration
  Homolog annotation: Hit_ID=Q1S4N1; Match level="QueryCoverage=99%, HitCoverage=17%, E-value=9e-34, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKSYMESFDLWNVVEEDYEVSLLPENSSMAQIKHHREKKTKKEEYEGDDHVRGMQVLNMMREFEEQKMKEFETIKRIPVFRIVEKILVRVPRRYEAFIITLDITKDLTKISLTEVIHSLQVRDKRRLTREESTVEGALPTKHQNATKYKKNKNFDGTQSSSTSTNAKGN

SEQ ID NO: 134646 - protein, 58 aa, Glycine max
  Coding DNA Sequence Number=SeqID_17868
  Gene Ontology: Cellular component=chloroplast
MEGAGRSRNENVSLSNANIDENLMPRKPKGSSARFIHGGPLKVVPTCTATNVTDCHMK

SEQ ID NO: 134647 - protein, 448 aa, Glycine max
  Coding DNA Sequence Number=SeqID_17869
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=99%, HitCoverage=42%, E-value=5e-74, Identity=40%"; Hit description=CTR1 -like kinase kinase kinase
MVLADSLGIPCRLVKGLQYTGSDDVAINFVKIDDGREYIVDLMADPGTLIPSDATGSHIDYDESSYVASPSSRDLDSSHVASSSSGVGSSYEETSDLGMLDKGNRSKHFCHTGKEYDVSRPSTGNEGSMRPLNEFKSPYNVEKITGQEAPGRPNHPHVHARSPWTEGISSPAVRRMKVKDVSLYMIDAAKENPHLAQKLHDVLLESGVVAPPNLFSEIYDEELGSSTEANLLTEEKDEHKQGSGLQEAEIYGNLSPAQILPPRALPKASSSSQLEHSKPVEGLGINLPLHTREATGQHIPTQVKYGQNVPVAAAAAAAAAVVASSMVVAVAKSSIDSNIELPVAAAATATAAAVVTAAVSRQYEQGSRSDGDTDSAGYDLKGSGDGEHIALGANSEGDRRSDRSVVSNDSTKSDSALDDHEVAEVDIPWEEITLGSYGEVYHGEWHGT

SEQ ID NO: 134648 - protein, 326 aa, Glycine max
  Coding DNA Sequence Number=SeqID_17870
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=76%, HitCoverage=23%, E-value=3e-73, Identity=61%"; Hit description=CTR1 -like kinase kinase kinase
  Subcellular localization annotation: CTP_CleavageSite=94; ConfidenceScore=5.54e-01
MKNLLKKLHIMSNRSENEQGSCSSKGNKSNLGSSSSSNKKVLGSKSPQSSGLSSWLHSVANRQSAGPPPSLTQARGERMEPSDAVSSGGFDAVSDSARLDSGSSASRDPEVEEEYQIQLALELSAKEDPEAAQIEAVKQISLGSCDPGYTPAEVVAYRYWIREVCLWTSELRFIRASQNYNALGYDDKTLDGFYDLYGSLTESTPARMPSLVDLQLQGTPISGSGTWEAVLVNRAADSNLLKLVQKAQELTDKSSPDFEVVIDSNLVRKLAIFVADYMGGPVGDPESMTRAWRSLSYSLKATLGSMVLPLGSLTIGLARHRALLFK

SEQ ID NO: 134649 - protein, 53 aa, Glycine max
  Coding DNA Sequence Number=SeqID_17871
MANLSSNGKLPVASPEEACKRCGDSRVLQRSFSSFSLRHTHTIKSSSGLLISM

SEQ ID NO: 134650 - protein, 85 aa, Glycine max
  Coding DNA Sequence Number=SeqID_17872
MYKDNWTQPWPMGSEIYPKVHENPRAFFSSSSPIFLEPLAHGSSDWSLPREDCISKIPWTCMASPLSPNRWPNPDIYHDQPFYKP

SEQ ID NO: 134651 - protein, 173 aa, Glycine max
  Coding DNA Sequence Number=SeqID_17873
  Gene Ontology: Cellular component=microtubule; Biological process =microtubule cytoskeleton organization and biogenesis
  Homolog annotation: Hit_ID=Q45NK4; Match level="QueryCoverage=51%, HitCoverage=48%, E-value=6e-38, Identity=87%"; Hit description =Putative ABI3-interacting protein
MRCTWFYANPTDKSTLKVKIYIFSMNIPNYLLLPQIDVNDRELIALKAVIKCIEDHKLDDQYPLDPLQKRATQLEKAKADKKRVTEATKPQPKRPRANGVGYGPRVTNILSDKTSYARVADRYPQYVYDRPYMYPAPTDNHCPPLMGSATYNISPNPGNYFGNGYQYQATYLH

SEQ ID NO: 134652 - protein, 86 aa, Glycine max
  Coding DNA Sequence Number=SeqID_17874
  Subcellular localization annotation: CTP_CleavageSite=56; ConfidenceScore=5.13e-01
MTILVSACHRTCHLWMTKGRLQQSRLSINDRGLLTPMKDRQRALSPLKVRTLSPLKARTLSPLKARTLSPLKARTLGPLKARTLVL

SEQ ID NO: 134653 - protein, 126 aa, Glycine max
  Coding DNA Sequence Number=SeqID_17875
MTMKTYEQGRWVMKLRERSSQMPKGMGKGCKSLTSHQVTGLNCGNVLAIPKWAIEVYAMGSPKLKQASIENLGSPEGVRGKVKELLPRRKMHGSRHQHSFEENVRKIKKRSANIENKGLGVVYAWG

SEQ ID NO: 134654 - protein, 70 aa, Glycine max
  Coding DNA Sequence Number=SeqID_17876
  Gene Ontology: Mol. function=chromatin binding; Cellular component =chromatin; Biological process=chromatin assembly or disassembly
  Homolog annotation: Hit_ID=Q1SAV4; Match level="QueryCoverage=74%, HitCoverage=13%, E-value=4e-13, Identity=71%"; Hit description =Integrase, catalytic region
MESKEFTASLLDDPPPDVMLMRKEVPLSLKSSLLKELMKMGSRSETRLQGRPWSLQTVPRNRVATLNTVN

SEQ ID NO: 134655 - protein, 139 aa, Glycine max
  Coding DNA Sequence Number=SeqID_17877
TYQGNPCGVYPDLSSFTGSGVIQISVACIKRSAPTQVHITSPPPQRDDSSTLMNEVLLELRGLRPYVGERFDSLNGRIDAIDARFEGMDTRITQLEEDELNCHHQKGGDCRSKDFDVLMMPCDHVLLKFNSRGSCASQV

SEQ ID NO: 134656 - protein, 353 aa, Glycine max
  Coding DNA Sequence Number=SeqID_17878
  Gene Ontology: Mol. function=hexokinase activity; Biological process =glycolysis
  Homolog annotation: Hit_ID=UPI00006DA4E0; Match level="QueryCoverage =98%, HitCoverage=67%, E-value=1e-135, Identity=66%"; Hit description= COG3517: Uncharacterized protein conserved in bacteria
  Pfam annotation: Domain name=DUF877; Domain location=40-353; Score =404.4; E_value=1.6e-118; Accession=PF05943.2; Description=Protein of unknown function (DUF877)
MLMSVNNENATGGESVVLERPAAGGVYATLFEKINLNPVSELSALDIWQDAQAMSDATADERLTAGMQVFLECLKKSGAKVEKLDKNLIDHHIAALDHQISRQLDAVMHSEEFQAVESLWRGVKSLVDKTDFRQNVKVELLDMSKEDLRQDFEDSPEIIQSGLYKHTYIDEYDTPGGEPIAALISAYEFDASAQDVALLRNISKVSAAAHMPFIGSAGPQFFLKDSMEDVAAIKDIGNYFDRAEYIKWKSFRETDDSRYIGLVMPRVLGRLPYGPDTVPVRSFNYVEEVKGPDHDKYLWTNASFAFASNMVRSFINNGWCVQIRGPQAGGAVQDLPIHLYDLGTGNQVKIPSE

SEQ ID NO: 134657 - protein, 43 aa, Glycine max
  Coding DNA Sequence Number=SeqID_17879
MASHSNSGMHFSQVFVFQRSKAEFPESFMGFPELGYQKTQVVI

SEQ ID NO: 134658 - protein, 238 aa, Glycine max
  Coding DNA Sequence Number=SeqID_17880
  Gene Ontology: Mol. function=polygalacturonase activity; Cellular component=cellulose and pectin-containing cell wall; Biological process=carbohydrate metabolic process
  Homolog annotation: Hit_ID=Q2KMJ7; Match level="QueryCoverage=97%, HitCoverage=59%, E-value=2e-59, Identity=49%"; Hit description=PGN
  Pfam annotation: Domain name=Glyco_hydro_28; Domain location=1-234; Score=123.6; E_value=5.5e-34; Accession=PF00295.8; Description =Glycosyl hydrolases family 28
MQVLIINSCNSVSVTNLNMINSPKSHIHVNGCEGATFSHINISAPGDSPNTDGFDISTSKNIMIEDSTIATGDDCIAISGGSSYINVTGIACGPGHGISLGKKFDTVQEVYVRNCSFIRTTNGARIKTFPNGMGYAKQITFEDITLEQTRNPIIIDQEYRDLTNQAVEVSDVTYRGIHGTSLDGRAITLDCGESGCYGIVLDQINIVSCLTGKSASCFCNNAHGTATATNPNCTCLLP

SEQ ID NO: 134659 - protein, 87 aa, Glycine max
  Coding DNA Sequence Number=SeqID_17881
  Subcellular localization annotation: CTP_CleavageSite=49; ConfidenceScore=5.00e-01
MLLSSNVIHIYVRVVMPVCMIRTRLLAAVGLNLAQMWSPLKARTCSPLKAMTSSPLKARACSPLKARACSPLKVRTCSPLKVRGGIL

SEQ ID NO: 134660 - protein, 113 aa, Glycine max
  Coding DNA Sequence Number=SeqID_17882
MPISPCRRILPTRHPVDSKESNKALRFPALVTGLYQSYRVPVPPARSCHRDIGIAPARCPVDPKKSNKVLGFPALITGLCQFYGVPIAPSKVIRPPTNRAFIKKYLRPQAGAG

SEQ ID NO: 134661 - protein, 151 aa, Glycine max
  Coding DNA Sequence Number=SeqID_17883
SFGVPVTPSKVIQPPITRSFIEKYCIARQAQGGDPQAPDALPPPPQADPAGSFDTERYLRQLVRQQAANHRAHVQTHGCLYQLSLSLQSQGFPPFPCPTPDQFRAEVAWPGDWPEAQAGEAPTEALGEADEARMDEEITDLLDFLGGSGAT

SEQ ID NO: 134662 - protein, 75 aa, Glycine max
  Coding DNA Sequence Number=SeqID_17884
MPPHKTFHNHCMQFKRGILRLSISGLHNVPVPFLSVVIDYTPLVIDYQKPSWLPDLVFKPGNRLHPVVIDYQRPS

SEQ ID NO: 134663 - protein, 99 aa, Glycine max
  Coding DNA Sequence Number=SeqID_17885
  Gene Ontology: Mol. function=hydrolase activity
  Homolog annotation: Hit_ID=Q2QRA2; Match level="QueryCoverage=70%, HitCoverage=19%, E-value=6e-15, Identity=75%"; Hit description =Amidohydrolase family protein, expressed
MQIQHVNSSIELCCSISCLNKQARSRVHDLPNLEPDSDAALGCIVWLEWPRMVAMVEWVKQARKPSKSTALGIPENIFYQDIHWGSRSPFEVPCLHRSE

SEQ ID NO: 134664 - protein, 607 aa, Glycine max
  Coding DNA Sequence Number=SeqID_17886
  Gene Ontology: Mol. function=transmembrane receptor activity; Cellular component=exocyst; Biological process=exocytosis
  Homolog annotation: Hit_ID=Q9FFX6; Match level="QueryCoverage=96%, HitCoverage=86%, E-value=1e-117, Identity=41%"; Hit description =Putative leucine zipper protein
  Pfam annotation: Domain name=Exo70; Domain location=45-596; Score =272.6; E_value=7.7e-79; Accession=PF03081.6; Description=Exo70 exocyst complex subunit
MAMSSRNDDIGIREGEKEEVLQVVEDVDTFLRSGGDHVPDCVHVLPKLLERIVDKYNDGRKKLGEEPEDDKSFLNVVERIFKLSTCDTCDIALDQTSSVLEKAMSLLEKDLCSLLEEPKQKAPKKSFSFGSRSDLSLIPSKSPFLEQDQDNHDFPFNFSSQKISILNKITTTMITTGYQIECCMTFANFRRSAFTTALQRFGHRNMKMEDVYKMPWESLEGEIATWNQVVWHCTTVLFNAEQRLYDSIFPNQPSISQKLFGDLARYVIIRLLNFAQGAVLTKWSAEKLFKFLDMYETLREDIVGGSYLESCAKELAYETSTTKDMIIEAIVAMFCDLKTSIKNDNERIPVPNGAVHPLTRYVMNYLKYACEYKDTLEQVFTQGQGANIEGIEIQNHKSIHEEVEDVGMPKNSPFALQLITIMDLLDANLERKSKLYRDLALHYFFLMNNKRYIVQKVKGCVELHELMGDNWCRRRQSGLRLYHKCYQRETWSKILQCLKPEGLQGTRNKVSKQLVKERFKCFNSMFEEIHKTQCTWMVSDEQLQSELRVSISTLVIPAYRSFVGRFKQHLESTRHIDKYIKYHPEDIELLIDDLFGGNATSMTRRRT

SEQ ID NO: 134665 - protein, 511 aa, Glycine max
  Coding DNA Sequence Number=SeqID_17887
  Gene Ontology: Mol. function=sugar porter activity; Cellular component=integral to membrane; Biological process=carbohydrate transport
  Homolog annotation: Hit_ID=Q9FMX3; Match level="QueryCoverage=98%, HitCoverage=98%, E-value=1e-176, Identity=61%"; Hit description =Sugar transport protein 11
  Pfam annotation: Domain name=Folate_carrier; Domain location=48-427; Score=-189.5; E_value=0.07; Accession=PF01770.9; Description=Reduced folate carrier
  Pfam annotation: Domain name=MFS_1; Domain location=44-448; Score =83.2; E_value=8.1e-22; Accession=PF07690.6; Description=Major Facilitator Superfamily
  Pfam annotation: Domain name=Sugar_tr; Domain location=26-487; Score =526.9; E_value=2.2e-155; Accession=PF00083.14; Description=Sugar (and other) transporter
  Pfam module annotation: Pfam domain module=Folate_carrier::MFS _1::Sugar_tr; Domain location=48-427::44-448::26-487
MAGGGYVDSGNAKQFEGKVTAFVLVTCFVAAMGGLLFGYDLGITGGVTSMEPFLIKFFPGVYKQMQDDVGHRSQYCKFDNELLTLFTSSLYLAALVASFFASSTTRMMGRKASMFLGGLFFLVGALLNGFAVNIEMLIIGRLLLGFGVGYCNQSVPVYLSEMAPAKIRGALNMGFQMMITIGILAANLINYGTSKLENGWRISLGTGAIPAVMLCVGALFLGDTPNSLIERGQKEEAKKMLQKIRGIDNVEEELQALIDASESAKEVEHPWKNFTQAKYRPQLIFCTLIPFFQQLTGINVVMFYAPVLFKTLGFGNDASLMSSVITGGVNVVATLVSIFTVDKVGRKILFLEGGVQMFICQIATGVMIAMKFGVSGEGSFSSGEADLILFFICAFVAAFAWSWGPLGWLVPSEICSLEIRSAGQATNVAVNMLFTFAIAQVFLAMLCHLKFGLFFFFAAFVLIMTLFIALLLPETKNIPIEEMHLVWRSHWFWSKIVPQVDNDRKPTTAQS

SEQ ID NO: 134666 - protein, 519 aa, Glycine max
  Coding DNA Sequence Number=SeqID_17888
  Gene Ontology: Mol. function=binding; Cellular component =mitochondrion; Biological process=regulation of transcription
  Homolog annotation: Hit_ID=Q1RX00; Match level="QueryCoverage=98%, HitCoverage=92%, E-value=0.0, Identity=82%"; Hit description =Pentatricopeptide repeat
  Pfam annotation: Domain name=PPR; Domain location=102-136; Score =25.5; E_value=0.00019; Accession=PF01535.11; Description=PPR repeat
  Pfam annotation: Domain name=PPR; Domain location=137-171; Score =26.6; E_value=8.8e-05; Accession=PF01535.11; Description=PPR repeat
  Pfam annotation: Domain name=PPR; Domain location=172-206; Score =14.0; E_value=0.17; Accession=PF01535.11; Description=PPR repeat
  Pfam annotation: Domain name=PPR; Domain location=210-244; Score =22.8; E_value=0.0012; Accession=PF01535.11; Description=PPR repeat
  Pfam annotation: Domain name=PPR; Domain location=277-311; Score =40.1; E_value=7.8e-09; Accession=PF01535.11; Description=PPR repeat
  Pfam annotation: Domain name=PPR; Domain location=312-346; Score =31.6; E_value=2.7e-06; Accession=PF01535.11; Description=PPR repeat
  Pfam annotation: Domain name=PPR; Domain location=347-381; Score =38.6; E_value=2.2e-08; Accession=PF01535.11; Description=PPR repeat
  Pfam annotation: Domain name=PPR; Domain location=382-416; Score =37.9; E_value=3.4e-08; Accession=PF01535.11; Description=PPR repeat
  Pfam annotation: Domain name=PPR; Domain location=417-451; Score =38.0; E_value=3.3e-08; Accession=PF01535.11; Description=PPR repeat
  Pfam module annotation: Pfam domain module=PPR::PPR::PPR::PPR::PPR::PP R::PPR::PPR::PPR; Domain location=102-136::137-171::172-206::210 -244::277-311::312-346::347-381::382-416::417-451
MEVVCRGMLKPRKFMQRRRKFEVFKDAADEADQKNWRRIMTEIEESGSAVSVLSSEKINNQNIPKDLLVGTLIRFKQLKKWHLVVEILDWLRTQNWWDFGKMDFFMLITAYGKLGDFNGAEKVLGLMNKNGYVPNVVSQTALMEAYGKGGRYNNAEAIFRRMQKWGPEPSAFTYQIILKTFVQGNKYREAEELFDNLLNDENSPLKPDQKMFNMMIYMYKKAGSYEKARKTFALMAERGIQQTTVTYNSLMSFETDYKEVSNIYDQMQRADLRPDVVSYALLVSAYGKARREEEALAVFEEMLDAGVRPTRKAYNILLDAFSISGMVEQAQTVFKSMRRDRYFPDLCSYTTMLSAYVNADDMEGAEKFFKRLIQDDFEPNVVTYGTLIKGYAKINDLEMVMKKYEEMLVRGIKANQTILTTIMDAYGKSGDFDSAVHWFKEMESNGIPPDQKAKNVLLSLPKTDEEREEANELVGHFSENNSLSKVNGIVKLVDEDEENKYEYFDAQLERAYEHSTELS

SEQ ID NO: 134667 - protein, 46 aa, Glycine max
  Coding DNA Sequence Number=SeqID_17889
MEEMERLQFLNITHNPKYHFLNEGFGHGGGSGDALMMVSRCCTYYV

SEQ ID NO: 134668 - protein, 185 aa, Glycine max
  Coding DNA Sequence Number=SeqID_17890
  Gene Ontology: Mol. function=transcription regulator activity; Cellular component=nucleus; Biological process=regulation of transcription
  Homolog annotation: Hit_ID=Q7XE15; Match level="QueryCoverage=95%, HitCoverage=36%, E-value=3e-52, Identity=57%"; Hit description =Pentatricopeptide, putative
  Pfam annotation: Domain name=PPR; Domain location=120-154; Score =39.3; E_value=1.3e-08; Accession=PF01535.11; Description=PPR repeat
  Pfam annotation: Domain name=PPR; Domain location=17-51; Score=41.0; E_value=4.1e-09; Accession=PF01535.11; Description=PPR repeat
  Pfam annotation: Domain name=PPR; Domain location=52-86; Score=0.4; E_ value=6.6; Accession=PF01535.11; Description=PPR repeat
  Pfam module annotation: Pfam domain module=PPR::PPR::PPR; Domain location=120-154::17-51::52-86
MVMAQKVFESMLEKDVRSWSSLLDGYVKAGEYREAMAVFEKMQAVGPKANEVTTVSVSCACAHLGALEKGRMIHKYIVDNGWPLTLVLQTSLVDMYAKCGAIEEALLIFHCVSKSQTDVLIWNAVIGGLATHGLVEESLKLFKEMQIVGICPDEVTYLCLLAAYGHGGIVKEEAWYSLRVLVNVA

SEQ ID NO: 134669 - protein, 315 aa, Glycine max
  Coding DNA Sequence Number=SeqID_17891
  Gene Ontology: Mol. function=carboxypeptidase activity; Cellular component=membrane; Biological process=electron transport
  Homolog annotation: Hit_ID=Q9LI65; Match level="QueryCoverage=96%, HitCoverage=93%, E-value=9e-67, Identity=40%"; Hit description =Nodulin-like protein
  Pfam annotation: Domain name=DUF6; Domain location=21-152; Score =46.8; E_value=7.3e-11; Accession=PF00892.11; Description=Integral membrane protein DUF6
MMLTHCHELCKPVSIMILVNLTLAFVNLLLKKVLNEGMDYMCIITYRQAISFIFMAPIACIYERKYKLEVHIISLLFLSALLGVTIPQYLFLLGLKYTSATFSCAFLNMVPVFTFIMAVPFGIEKVNVQSKSGKAKVMGTFVCIGGALLLVLYKGVPLINPQSQHIANKITSTPPTAKLEKWIIGSILLTLGCLLWSSWFIIQAKISKKYPCQYSSTAILSLFAAIQSAILSLVFKRNNASWILKGKLEIISVAYAIPPFLLSTASNVSPSAMSSVAGSTLVIAGMYILLWGKSKEEEGQHVLKDTQTNQDVECQ

SEQ ID NO: 134670 - protein, 114 aa, Glycine max
  Coding DNA Sequence Number=SeqID_17892
  Gene Ontology: Mol. function=RNA binding; Cellular component =mitochondrion; Biological process=embryonic development ending in seed dormancy
  Homolog annotation: Hit_ID=Q1SMD0; Match level="QueryCoverage=99%, HitCoverage=63%, E-value=1e-14, Identity=29%"; Hit description =Tetratricopeptide-like helical
  Pfam annotation: Domain name=PPR; Domain location=11-45; Score=25.5; E_value=0.0002; Accession=PF01535.11; Description=PPR repeat
  Pfam annotation: Domain name=PPR; Domain location=46-80; Score=2.5; E_ value=3.8; Accession=PF01535.11; Description=PPR repeat
  Pfam annotation: Domain name=PPR; Domain location=81-114; Score=26.1; E_value=0.00013; Accession=PF01535.11; Description=PPR repeat
  Pfam module annotation: Pfam domain module=PPR::PPR::PPR; Domain location=11-45::46-80::81-114
MVQQGFLPDVVSYSASIRGLIKIQEVDRALKLFTDLCSRGHRPDERALQGQQNSWCKNGFVDKIMALLSRMSGEDREPNVISYSTLVEGLCRAERPDDALLVWNEMERKGCSPN

SEQ ID NO: 134671 - protein, 227 aa, Glycine max
  Coding DNA Sequence Number=SeqID_17893
MSNKFSNVLSGRLICIDSRERQDKESKFQGLIFFLSPATTTTLFPLHFNSCSASHAASTLILTHSSINGFLFLFTPTLAQISCTANYPQTASLTEWTTSNGVAASEYSGNGFVNGYVNGVSGVMEIFTIFVLLRFLSFPLCSAASLLTRCSSSFTDFSFARFNFISLGLRKNLGKRLVWCSISHILPSLPQNKKLVANESLVKYVNGNGVAAGVMEDFAGSFEAEGR

SEQ ID NO: 134672 - protein, 223 aa, Glycine max
  Coding DNA Sequence Number=SeqID_17894
MEDLPFRKFRFVDFSTVIVGDLEIGLLVGSYLASVSNFLKASKLIINGLVFEIQQFRDRLLDSGIEVRSILIPSGQGSSQVSRYRIEVMVDHRGEQTKFLLWDHECAELIGQSTDEVNRLKIADGDVHLNASPQALDRLLGCFLAFKVKPSCKMESSMLESTDAAKLESQYVFVTADHDPLLRVPLTPTKCLSSDELDDEPKNLEISPAQVSSNKVARHYQPE

SEQ ID NO: 134673 - protein, 209 aa, Glycine max
  Coding DNA Sequence Number=SeqID_17895
  Homolog annotation: Hit_ID=Q1T493; Match level="QueryCoverage=97%, HitCoverage=48%, E-value=2e-14, Identity=26%"; Hit description =Nucleic acid-binding, OB-fold, subgroup
MACLPDKIKSIDGSREALKLIVRITDLWFIGIPHKIEQAEMGDEIHVVCKQDQLKVWKADLKENCIYVMHNFKVLKNNDVIGVVDEVVFRYVSSKNTRVVLKVKDLSGQILSCTLWGDYCLQFLAYLDVVENNGPVVILLTYARIKEVEGSYPPSVSNSLKASKLMINELVMEKQEFKERLANSGIEVRSVLTLVGQGASEVSGSSQMS

SEQ ID NO: 134674 - protein, 211 aa, Glycine max
  Coding DNA Sequence Number=SeqID_17896
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=46%, E-value=1e-107, Identity=82%"; Hit description =Photosystem II P680 chlorophyll A apoprotein
  Pfam annotation: Domain name=PSII; Domain location=1-210; Score=97.9; E_value=3.1e-26; Accession=PF00421.9; Description=Photosystem II protein
LYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQV

SEQ ID NO: 134675 - protein, 204 aa, Glycine max
  Coding DNA Sequence Number=SeqID_17897
  Gene Ontology: Mol. function=pyridoxal phosphate binding; Cellular component=cellular_component; Biological process=metabolic process
  Homolog annotation: Hit_ID=Q26FG9; Match level="QueryCoverage=53%, HitCoverage=23%, E-value=3e-14, Identity=39%"; Hit description =Cysteine desulfurase
MLAQFGKDVPDQCYRVEAWLLRGQADPANAGTTVDIASPDFSPLVRCQQLTHRASSAGVECAISVQEAQGLAAFTAAKAEFLAEYPGFPDASVEKMRNEEYARLDEQHVTYLDHVGGTLPPESLLEQDLQALKHAILGNPHSGSKASQAAYQEARDAIYAFFDCSPDEYEVIFTANASSAIRLVAESFPFQPFTQLLLPRTITR

SEQ ID NO: 134676 - protein, 119 aa, Glycine max
  Coding DNA Sequence Number=SeqID_17898
MAFVDNWAVGKEKVCYWLSNDIVALVGNLAVLEWQSQHGMTKFAFFQTHINPFTGKDQIRKALKVPLELPGMDSGRFQVSVPGNNYPSVAGGDTEGLPKFFQGVYHQLLALHWHIRAKA

SEQ ID NO: 134677 - protein, 174 aa, Glycine max
  Coding DNA Sequence Number=SeqID_17899
MDFFSDESFKCIQAFHNSNLIPFMSLKLPVYSELVKAFYSNHEIQESTLISKVYGIKMVIDQSLFYDLTQLSSDGVTFEGALDDDWKFDFSVHDARRLPNDDEGHLPVEGDSSLLQSILDRFDGLQTYVGERFDSLERQVGARFEEMNSRIAKVEEDVTIIHDCLGLPPPPPPV

SEQ ID NO: 134678 - protein, 119 aa, Glycine max
  Coding DNA Sequence Number=SeqID_17900
MWAIINQYKEKLNLASTHEQRSKDEYAKVSVLQAKREAREKVIDSLNREAIMWMDRFSFTLNGSQELPRLLAKAKAMMDICHYQHRRGGGSKPSIRHKPSQPTHPGHGGSRRRGVGQHR

SEQ ID NO: 134679 - protein, 82 aa, Glycine max
  Coding DNA Sequence Number=SeqID_17901
MQEITWLQKLKLSSEEEAETPKESEKVQALKVELEKVQAVKERFKTTAIKVRKEVDELRDINMATTEALERETKRARKEEWG

SEQ ID NO: 134680 - protein, 583 aa, Glycine max
  Coding DNA Sequence Number=SeqID_17902
  Homolog annotation: Hit_ID=P0A927; Match level="QueryCoverage=44%, HitCoverage=91%, E-value=1e-128, Identity=79%"; Hit description =Nucleoside-specific channel-forming protein tsx precursor
  Pfam annotation: Domain name=Channel_Tsx; Domain location=354-505; Score=314.6; E_value=1.8e-91; Accession=PF03502.4; Description =Nucleoside-specific channel-forming protein, Tsx
  Pfam annotation: Domain name=HATPase_c; Domain location=154-267; Score=91.2; E_value=3.2e-24; Accession=PF02518.16; Description =Histidine kinase-, DNA gyrase B-, and HSP90-like ATPase
  Pfam annotation: Domain name=HisKA; Domain location=44-109; Score =56.9; E_value=6.5e-14; Accession=PF00512.15; Description=His Kinase A (phosphoacceptor) domain
  Pfam module annotation: Pfam domain module=Channel_Tsx::HATPase _c::HisKA; Domain location=354-505::154-267::44-109
SRQIAAQETLHPHSVSPDGLPDEVLPLVDAYNSLLDKLRAAWSSQRQFLEDAAHELRTPVTAVTLQLENLRQHILPGEASRQFDQLEAGVTRTRHLVTQLLNISRQEDQSVVASVETIELDDLLKESIEQLMVVADKRGIDIGFNGTAHYRLHASRSDLRSLFDNLIGNAMLHTPEGSLVDVLLHRVGHHTVVDIVDNGPGMPESFIERAFDRFTRSPDVQAQGSGLGLSIVRSVAQKHQMQVALSNCLNPQGEVCGLQFSAYPDNVNGCGVPFVTRPLCDQAHYAGLKIRRVRPATTAHCPSPGIDFTRSQHLRGDHEQVAAESDPQYLSDWWHQSVNVVGSYHTRFGPQFNNDVYLEYEAFTKKDWFDFYGYLDLTNFFGVGNSNANGIFDHGSPMFMEIEPRFSIDKLTGTSLAFGPFKEWYFANNYIYDMGRNSDSRQNTWYMGLGTDIDTHSDIGLSLNVYAKYQWENYGAANENSWDGYRFKVKYFVPITDLWGGKLSYIGFTNFDWGSDLRDKSDRSRTSNSIASSHILSLNYDHWHVSTVARYFHNGGQWADGQELNFGNGPFEVKSTGWGYYLV

SEQ ID NO: 134681 - protein, 144 aa, Glycine max
  Coding DNA Sequence Number=SeqID_17903
MDFVKDLGTLGGKVVGSKGIKEVAMRAWGENKVQVAIVDVYNPCELNRKKEGGYGVRRDWVKKSLVGRWGIDKPSTWEAFLRIKEGSFLGKLEEESFLEKLEGATHTPPIAKFTPMPKYMKIQWEASLRSKEGSFLGKQGRKIP

SEQ ID NO: 134682 - protein, 92 aa, Glycine max
  Coding DNA Sequence Number=SeqID_17904
MSQIAYESMVNLTFINTPNLEPCLSSSNPKLNKLTTQCGACRPWIFFINGILCFFNIMAEEWRRKKYDWRCHFKEKMSQEEVHHHRKPRIRA

SEQ ID NO: 134683 - protein, 92 aa, Glycine max
  Coding DNA Sequence Number=SeqID_17905
MSSDSDRDIYNKFLRFLWLQCEGYSSKLRNDFKILNGENARNWAENMVLKFHDDPTVNESEIIFFLRYVWWSVGKERLRRENEIERRRRRQS

SEQ ID NO: 134684 - protein, 122 aa, Glycine max
  Coding DNA Sequence Number=SeqID_17906
MAERGCSQKYWYIDPQLKEPKTAWCCLHIFTYLQLIQQGEETPINKRLNATWQSEVMVETKCVHSRHNSHRTGANDVSAEPVERQAFDQVNREGNCCINVPYNLEMTIRVDADSFLIINGQD

SEQ ID NO: 134685 - protein, 111 aa, Glycine max
  Coding DNA Sequence Number=SeqID_17907
DGDVNLNVSPQALDRLLGCLLAFKVKVQPKFGNAVVLKYSPDLDLINFVLDMLPDIVVVLAIYWTFIILNLRVAMHVHMSYVEKPRQWWWCCCGLGMTALKSVLPFIYPEE

SEQ ID NO: 134686 - protein, 273 aa, Glycine max
  Coding DNA Sequence Number=SeqID_17908
  Gene Ontology: Mol. function=calcium-dependent phospholipid binding; Cellular component=cytoplasm; Biological process=vesicle-mediated transport
  Homolog annotation: Hit_ID=Q941L3; Match level="QueryCoverage=82%, HitCoverage=39%, E-value=1e-101, Identity=81%"; Hit description =BONZAI1
  Pfam annotation: Domain name=Copine; Domain location=57-203; Score =281.7; E_value=1.4e-81; Accession=PF07002.6; Description=Copine
MVEVQHKFTITALVEEPGCVLFTLRNHLWVPQNANPLRPLLSGSTAASNGNPRLPDSLHYIDPSGRPNAYQRAIVEVGEVLLLYDSDKRFPTWGFGARPIDGPVSHCFNLNGSSHYCEVEGIQGIMMAYTSALLNVSLAGPTLFGPVISTAALIASQSVANGGRKYFVLLIITDGVVTDLQETKDAIVKASDLPLSILIVGVGGADFKEMEVLDADKGERLESSYGRVASRDIVQFIPFREVQSGLSVVQAFLAELPAQFLTYVRSRNIQPNL

SEQ ID NO: 134687 - protein, 121 aa, Glycine max
  Coding DNA Sequence Number=SeqID_17909
  Gene Ontology: Biological process=auxin mediated signaling pathway
  Homolog annotation: Hit_ID=Q1S8P2; Match level="QueryCoverage=98%, HitCoverage=97%, E-value=1e-41, Identity=70%"; Hit description=Auxin responsive SAUR protein
  Pfam annotation: Domain name=Auxin_inducible; Domain location=2-85; Score=96.2; E_value=9.9e-26; Accession=PF02519.5; Description=Auxin responsive protein
MACMWLKNARGGSGKKPPTDVPRGHLAVIVGEAKRRFVIRADYLNHPLLQQLLDQLYEGYGFNKSGPLAIPCDEFLFEDIIQTLRDGTSSSHVPLKKLDFGFSKDSMPLLQGLESKRRSSN

SEQ ID NO: 134688 - protein, 651 aa, Glycine max
  Coding DNA Sequence Number=SeqID_17910
  Gene Ontology: Mol. function=binding; Cellular component =intracellular; Biological process=protein amino acid phosphorylation
  Homolog annotation: Hit_ID=Q94DV3; Match level="QueryCoverage=85%, HitCoverage=86%, E-value=1e-113, Identity=37%"; Hit description =Pentatricopeptide (PPR) repeat-containing protein-like
  Pfam annotation: Domain name=PPR; Domain location=133-167; Score=6.0; E_value=1.5; Accession=PF01535.11; Description=PPR repeat
  Pfam annotation: Domain name=PPR; Domain location=199-233; Score =41.9; E_value=2.2e-09; Accession=PF01535.11; Description=PPR repeat
  Pfam annotation: Domain name=PPR; Domain location=269-303; Score =17.7; E_value=0.043; Accession=PF01535.11; Description=PPR repeat
  Pfam annotation: Domain name=PPR; Domain location=410-444; Score =39.8; E_value=9.3e-09; Accession=PF01535.11; Description=PPR repeat
  Pfam annotation: Domain name=PPR; Domain location=445-479; Score =15.3; E_value=0.12; Accession=PF01535.11; Description=PPR repeat
  Pfam annotation: Domain name=PPR; Domain location=481-515; Score =12.3; E_value=0.26; Accession=PF01535.11; Description=PPR repeat
  Pfam annotation: Domain name=PPR; Domain location=547-581; Score=4.5; E_value=2.2; Accession=PF01535.11; Description=PPR repeat
  Pfam annotation: Domain name=PPR; Domain location=98-132; Score=31.9; E_value=2.2e-06; Accession=PF01535.11; Description=PPR repeat
  Pfam module annotation: Pfam domain module=PPR::PPR::PPR::PPR::PPR::PP R::PPR::PPR; Domain location=133-167::199-233::269-303::410-444::445 -479::481-515::547-581::98-132
MNGRTLLRAVIPKPQQHHHHCRGFSTYDLGTCIATLQSCAHNANLSKGKELHTHLLKNAFFGSPLAITSLINMYSKCSLIDHSLRVFNFPTHHNKNVFAYNALIAGFLANALPQRALALYNQMRHLGIAPDKFTFPCVIRACGDDDDGFVVTKIHGLMFKVGLELDVFVGSALVNTYLKFRFVGEAYRVFEELPVRDVVLWNAMVNGFAQIGRFEEALGVFRRMGGNGVVPCRYTVTGVLSIFSVMGDFDNGRAVHGFVTKMGYESGVVVSNALIDMYGKCKCVGDALSVFEMMDEIDIFSWNSIMSVHERCGDHYGTLRLFDRMMGSSRVQPDLVTVTTVLPACTHLAALMHGREIHGYMVVNGLAKEESHDVFDDVLLNNALMDMYAKCGNMRDARMVFVNMREKDVASWNIMITGYGMHGYGGEALDIFSRMCQAQMVPNEISFVGLLSACSHAGMVKEGLGFLSEMESKYGVSPSIEHYTCVIDMLCRAGQLMEAYDLVLTMPFKADPVGWRSLLAACRLHNDTDLAEVAASKVIELEPDHCGNYVLMSNVYGVVGRYEEVLEWRYTMKQQNVKKRPGCSWIELVNGVHVFITVECTMQQSQLKRQQNGRSSLQQREASVRIKTKKPQMFHCDTELAEGNMSERALN

SEQ ID NO: 134689 - protein, 238 aa, Glycine max
  Coding DNA Sequence Number=SeqID_17911
  Gene Ontology: Mol. function=protein binding; Biological process =ubiquitin cycle
  Homolog annotation: Hit_ID=Q6EP91; Match level="QueryCoverage=57%, HitCoverage=48%, E-value=2e-33, Identity=52%"; Hit description=F-box protein-like
  Pfam annotation: Domain name=F-box; Domain location=14-61; Score =28.6; E_value=2.2e-05; Accession=PF00646.23; Description=F-box domain
MGASLSSNGSSIGPGLGDIPESCVACVFLHLTPPEICNLARLNRAFRGAASSDSVWEAKLPRNYQDLLDLVPPERHRSLSKKDIFALLSRPLPFDHGHKVGAALQEVWLDRVTGKVCMSISAKAMTINGIDDRRYWNWIPTEESSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 134690 - protein, 727 aa, Glycine max
  Coding DNA Sequence Number=SeqID_17912
  Gene Ontology: Mol. function=protein serine/threonine kinase activity; Cellular component=membrane; Biological process=protein amino acid phosphorylation
  Homolog annotation: Hit_ID=Q1RX25; Match level="QueryCoverage=83%, HitCoverage=81%, E-value=0.0, Identity=71%"; Hit description=Protein kinase; Amino acid-binding ACT
  Pfam annotation: Domain name=ACT; Domain location=208-271; Score =29.8; E_value=9.8e-06; Accession=PF01842.15; Description=ACT domain
  Pfam annotation: Domain name=Pkinase; Domain location=323-602; Score =244.1; E_value=3e-70; Accession=PF00069.15; Description=Protein kinase domain
  Pfam annotation: Domain name=Pkinase_Tyr; Domain location=323-602; Score=282.3; E_value=9.4e-82; Accession=PF07714.7; Description =Protein tyrosine kinase
  Pfam module annotation: Pfam domain module=ACT::Pkinase::Pkinase_Tyr; Domain location=208-271::323-602::323-602
  Subcellular localization annotation: CTP_CleavageSite=28; ConfidenceScore=5.08e-01
MVMMVTEGNDSSCGSGVQHHTMSSSSSPAQSRQQRQKVEVYNEILRRLKDSGHEEAMQPGFHDQLWAHFNRLPTRSVILGFGERFEDILQCRYALDVNVERAADVLMHKRLLHLAHDPANRPSIEVRLVQVYPITDGNSADTFESDDPGIESGQSSSKYSSRQSIHPPPAFGSSPNLEALALEANNSEEDIEEEQSVHANVQYSRPMHEITISTDDKPKLLSQLTALLAEIGLNIQEAHAFSTTDGFSLDVFVVEGWPYEETEKLKAALESEVLKKIERQVRSSPQSVSSVDEPDQAKLYSELDHLTIPNDGTDVWEIDPKHLKYGTQIASGSYGELFKGVYCSQEVAIKVLKAEHVDSELQREFAQEVYIMRKVRHKNVVQFIGACTKSPRLCIVTEFMSGGSVYDYLHKQKGFFKFPTLLKVAIDVSKGMNYLHQHNIIHRDLKAANLLMDENCVQCFLYLLFLKMNSINWAYRTESSTFVPLQTVKVADFGVARVKAQSGVMTAETGTYRWMAPEVIEHKPYDHKADVFSFGIVLWELLTGKLPYEYLTPLQAAIGVVQKGLRPTIPKNTHPKFVELLERSWQQDPTLRPDFSEIIEILQQLAKEKCTRHGNNFAPCFRSKLFPSSLSDWCFDKFSIDNENNHQKKGGMVVETDRSGGGLELRRTKDYVLDWVRSETKERPKREWVDSFSSPGYSRKTGFVQVPKVEAKVCWKGKVLWGASQEE

SEQ ID NO: 134691 - protein, 336 aa, Glycine max
  Coding DNA Sequence Number=SeqID_17913
  Gene Ontology: Mol. function=kinase activity; Cellular component =nucleus; Biological process=amino acid biosynthetic process
  Homolog annotation: Hit_ID=Q1SN30; Match level="QueryCoverage=78%, HitCoverage=51%, E-value=1e-104, Identity=71%"; Hit description =Aspartate/glutamate/uridylate kinase; MADF; Homeodomain-related
MASCDDDDDFSLLRDDSHHHLHQPYAPHHHHFSPSAVAASVPPKPVAEAEDFANPFEDDDGSASEKRKECDEIGEGAASYGFNNKRSKATPSNGAVSGGAEYRKDREEWSDTAIVCLLEAYTEKFTQLNRGNLRGRDWEEVAAVVSERCENQSKSVEQCKNKVDNLKKRYQLERHRLSSGCISTSHWPWFKQLEQIVGNLFRRSSPTRIKRWFPPELLPGNRRVATPSTGGQANSMKSKAFSNRWRRVVFKISGAALTGSDTCNIDPKVAMLVSREVSIASHLGVEVAIVVGGRNFFSGDAWVNATVLEKATAGERTLTWPVWDIGSGIVEHLSGS

SEQ ID NO: 134692 - protein, 2237 aa, Glycine max
  Coding DNA Sequence Number=SeqID_17914
  Gene Ontology: Mol. function=phosphotransferase activity, alcohol group as acceptor; Cellular component=chromosome; Biological process= response to DNA damage stimulus
  Homolog annotation: Hit_ID=Q9FKS4; Match level="QueryCoverage=98%, HitCoverage=86%, E-value=0.0, Identity=58%"; Hit description =Serine/threonine-protein kinase ATR
  Pfam annotation: Domain name=FAT; Domain location=1636-2031; Score =226.9; E_value=4.6e-65; Accession=PF02259.13; Description=FAT domain
  Pfam annotation: Domain name=HEAT; Domain location=1097-1133; Score =0.0; E_value=43; Accession=PF02985.12; Description=HEAT repeat
  Pfam annotation: Domain name=HEAT; Domain location=1210-1247; Score =6.3; E_value=7.4; Accession=PF02985.12; Description=HEAT repeat
  Pfam annotation: Domain name=HEAT; Domain location=2069-2104; Score =4.3; E_value=13; Accession=PF02985.12; Description=HEAT repeat
  Pfam annotation: Domain name=HEAT; Domain location=598-635; Score =10.2; E_value=2.5; Accession=PF02985.12; Description=HEAT repeat
  Pfam annotation: Domain name=UME; Domain location=935-1041; Score =110.0; E_value=7e-30; Accession=PF08064.3; Description=UME (NUC010) domain
  Pfam module annotation: Pfam domain module=FAT::HEAT::HEAT::HEAT::HEAT ::UME; Domain location=1636-2031::1097-1133::1210-1247::2069 -2104::598-635::935-1041
MGKANLSSLVHELRIAAASSSTPSPNNTSDDDALEVRFRTVLPNLLHAYVLPSSSSSGNEREVIAVVKLISHTARNFPGVFYHGKATSSILPILARILPFFAEPLFRSRHGVFFEATGSLLSLLRSGARDAYRQFFVDSMSLIQDIPYVASLSVNVNGSSRSRVTLKCFCDSFSGVEDLPSTNRLVDGCGLLIDLTARTRWQPFATWILKLASKCLTEGTLYVEGLIHASFISAVCSLLCYGDADLHVACFDFVHIIGTVTNYDVIPYQNLILSIATILNLDKEGLPVFRNMAYDSSLGICLNTLYSSCPEDVVKLTAADLVSVFLQSMWRTKSQQLKAANGSRGSNSIPFQVALCGAYARIAQCFHVALSTLGPHLVGGIRGNIKDLTILASGDKSTESMRICQKRPIQDIDNLSIKRQKLNEEIVVADASLEVECKSSYIVTYQRVEGYASHMNKSLLSFVESLNAPTIRPGSLRPDIALSALSMLCIAFSIYPETDLSLRIFEQMLAWLPWIADQAKQGNSITIDISTYLEGIHSVLLVQNASLKEHNPLDDENYHVDLILVLKLPWTHMLVGIDNNCPWKTKCLSLQVVSKLGPSLNSKVVREVLDLGLHDEAEEVRTEAAISIPVMVSAVQNAIAILFAISMSSKLQSFIDLSSEDVQISCVRVIHRILAHGASDILLKTRSKELREAFCSQIRFFVDDLILSSIFSGNADKSKEQKFLDTIKHAMTVADGPHILETLMECTAEIMVAVSIDSKLFLCSLILLVDQLDSTHVTVRMNASRLASRPVLVREFAEAVFGVETKELVKKMIPFVLPKLVVSQHYNSQAVDTLYELAKCLNTDMVPLIVNWLPKVLAFALHQTDDQQLISAVQFYHAQTGSDKQEIFAAALPALLDELVCFTDCGDSEEINRRLARVPQMIKGIAKVLTGAEDLPGFLRNHFVGLLNSIDRKILHADDFMLRRQALDRIEMLIRMMGSHLNTYVPKLMVLLMYSIDKEPLQKEGLSVLHFFIKQLAKVSPSSIKHIISQVFASLLPFLERDKENPSIHLDKVVTILEELVLKNRVILKQHICEFPPLPCIPALIEVNKAIEDARGTMTLKDQLRDVVDGLNHENLNVRYMVVCELRKLLNSRWKDVTALITAEAGSDLDVLSSLITSLLRGCAEESRTTVGQRLKLVCADCLGALGAVDPAKVKGFSCQRFKIQCSDDDLIFELIHKHLARAFRSAPDTVIQDSAALAIQELLKFAGCEASLDENASTTTSQAQKDEDNHKAVSSKIKSTNGSKGMNNRGQKLWDRFSNYVKEIIAPCLTSRFQLPKVADSTSAGPIYRTSMSFRRWIFFWIRKLTAHATGSRASIFNACRGIVRHDMQTAIYLLPYLVLNAVCHGTQEARQGITEEILSVLDAAASENSGASVHGFSGGQSEVCIQAVFTLLDNLGQWVDDVEQDLALSSSQPMVSRQQKSKGLSSNSLTDQDQLLVQCKYVSELLCAIPKVTLARASFRCQAFARSLMYFESYVREKSGAFNPAAERSGIFEDQDVSHLMEIYSCLDEPDGLSGLSCLSKFLRLQDHLLMNKKAGNWADVLTSCEQALQMEPTSVQRHSDVLNCLLNMCHLQAMVTHVDGLISRIPQYKKAWCMQGVQAAWRLGRWDLMDEYLGGAEEDGLVCCSSESNASFDLNVAKILQAMMKRDHFSVAEKIALSKQSLIAPLAAAGMDSYMRAYPFVVKLHFLRELEDFHSILGDDSFLEKSFDLDHQAFSKLVDNWDNRLRFTQSSLWAREPLLAFRRLVFGVSSLGAQVGNCWLQYSKLCRLAGHYETANRAILEAQSSGAPNVHMEKAKLLWSTRRSDGAIAVLQQSLLNMPVEVLGSKTISSITSLSLLPLNPQPIVCESQAMNENRDIAKTLLLYSRWTHYTGQKQKEDVISLYTRVRELQPKWEKGFFYIAKYCDEVLGDARKRQEELLGDARKRQEENSKLGPRRVPSATIAVGSSNLNGEKPWWSDVPEVLLFYAKGLHRGHKNLFQALPRLLTLWFDFGSMYQSSGSSNKDLKDVHAKVMSIVRGCLKELPPYHWLTVLPQLVSRICHQNEEIVRLVKLIITSVLRQYPQQGLWIMAAVSKSTVPSRREAAAEIIQAARKGFSPGSKENSLFVQFTTLIDHLIKLCFHAGQSRAKTINLSTEFSSLKRMMPLGIIMPIQQSLTVNLPTYDGNLGDSPAKKMLKFSTFLIFADLDRESLICE

SEQ ID NO: 134693 - protein, 478 aa, Glycine max
  Coding DNA Sequence Number=SeqID_17915
  Gene Ontology: Mol. function=DNA binding; Cellular component=nucleus; Biological process=regulation of transcription
  Homolog annotation: Hit_ID=Q1S8N2; Match level="QueryCoverage=86%, HitCoverage=87%, E-value=1e-134, Identity=61%"; Hit description =Homeodomain-like
MEPNGLGSGMFSGLVGVENPLQQQQQQQQQQQQQQQQNLHHLQHHHPQMVPYATHHDTENPHHPHLHQSIKQGYPPFSSQTKQQQSPLSDDDEPGFPADEDPKRKVSPWQRMKWTDTMVRLLIMAVYYIGDEAGSEGTDKKKSSGLMQKKGKWKSVSRAMMEKGFYVSPQQCEDKFNDLNKRYKRVNDILGKGTSCRVVENQSLLDSMDLSPKMKEEVKKLLNSKHLFFREMCAYHNSCGHGNNNAPQQGESGGEVSQPQAQPHHHQQQQQQPQQRCFHSSEVGNLGGSGVEGLRMLKVGNGEEGDDDSEDDDDSEDDSDEDEDDSGEGGSRGHVGHGHEDIEDENDGRSMRKRARKVGGVSMSPQLMQQLSAEVSGVFQDVGKSAWDKKQWMRSRIMQLEEQQISYHTQAFELEKQRLKWARFSSKKEREMETAKLENERRRLENERMVLLIRQKEFELMSLQHQQQQQHQQQHSST

SEQ ID NO: 134694 - protein, 273 aa, Glycine max
  Coding DNA Sequence Number=SeqID_17916
  Gene Ontology: Mol. function=oxidoreductase activity; Biological process=electron transport
  Homolog annotation: Hit_ID=Q9FLC2; Match level="QueryCoverage=96%, HitCoverage=67%, E-value=4e-66, Identity=47%"; Hit description =Monooxygenase
MPFTETGNQQRDREIRCVKRKLLLEALANELPSGTIRYLSKVVAIVESGFYKILHLADGTTIKSKVHGCLQLKKILIGFDGVNSVVAKWLGFKNASFTGRYSVRGFAEVQNNHRLEPRFLVMGRLFTDKELEDNPTKLKEYVLNTLEKMPSDVRYYIEKIKLDVFLLAPLGYRHPWELMFGNISKGNACVGGDAFHPMTPDLGQGGCCALEDGVVLSGCLAEAFSKPSTHIKENDKEANQYRRIEESLKKYANERRWRSIDVNATTYMVGYIQ

SEQ ID NO: 134695 - protein, 350 aa, Glycine max
  Coding DNA Sequence Number=SeqID_17917
  Gene Ontology: Mol. function=phosphotransferase activity, alcohol group as acceptor; Cellular component=chromosome; Biological process= response to DNA damage stimulus
  Homolog annotation: Hit_ID=Q5Z987; Match level="QueryCoverage=84%, HitCoverage=10%, E-value=1e-152, Identity=88%"; Hit description =Serine/threonine-protein kinase ATR
  Pfam annotation: Domain name=FATC; Domain location=269-304; Score =19.5; E_value=0.0015; Accession=PF02260.10; Description=FATC domain
  Pfam annotation: Domain name=PI3_PI4_kinase; Domain location=1-231; Score=204.6; E_value=2.3e-58; Accession=PF00454.17; Description =Phosphatidylinositol 3- and 4-kinase
  Pfam module annotation: Pfam domain module=FATC::PI3_PI4_kinase; Domain location=269-304::1-231
MEFTAMINRLLSKYPESRRRKLYIRTFAVIPLTEDCGMVEWVPHTRGLRQILQDIYITCGKFDRQKTNPLIKQIYDQCQGKRPEDEMLKNKILPMFPPVFHKWFLTTFSEPAAWFRARVAYAHTTAVWSMVGHIVGLGDRHGENILFDSTSGDCVHVDFSCLFDKGLQLEKPELVPFRLTQNMIDGLGITGYEGIFLRVCEITLSVLRTHRETLMSVLETFIHDPLVEWTKSHKSSGVEVQNPHAQRAISNIEARLQGVVVGVGAAPSLPLAVEGQARRLIAEAVSHKNLGKIFGWVEKFLPYYFRQQSKEGMKWHTECTGLEEAKLLEAEIRPHHKVGQGVAEREVDAS

SEQ ID NO: 134696 - protein, 192 aa, Glycine max
  Coding DNA Sequence Number=SeqID_17918
MLTALSAKNKVEFIDGSISKPAMTHALFSMWKRCNNMVIIIRRRIVRKSMVIIPISLLAEEEKGLEVLVEEILEVEVITMVKCAHVVELIGTPVEECYRKHGYPPGHKLYRTQNGSINNAMREESNASDLNDSQETQNQNIRVMPQQYQVLMSLLQHQSNNGGFTSGTSHINQVGTVTKPHIGTLQIDVAVC

SEQ ID NO: 134697 - protein, 399 aa, Glycine max
  Coding DNA Sequence Number=SeqID_17919
  Gene Ontology: Mol. function=tetracycline:hydrogen antiporter activity; Cellular component=integral to membrane; Biological process=tetracycline transport
  Homolog annotation: Hit_ID=O22994; Match level="QueryCoverage=79%, HitCoverage=76%, E-value=1e-56, Identity=41%"; Hit description =Putative tetracycline transporter protein
  Pfam annotation: Domain name=MFS_1; Domain location=39-391; Score =60.5; E_value=5.4e-15; Accession=PF07690.6; Description=Major Facilitator Superfamily
MEAKRDVHTKVKVACDCCLLNAPHNAMPTQYGLGGLGHLFVTMFVTGFGGVIVLPAITDVTMAALCPGQDQCSLAIYLSGFQQAMAGVGSVVMTPLIGNLSDRYGRKALLTLPLTVSVIPQVILAYSRDTQFFYAYYVVKTLAAMAGEGSFHCLALAYVADKVPDGKRTSAFGILAGVGSASFVGGTLAARFLSTALTFQVASVLSMVALVYMRIFLKDSVPGGAIRQPLLKVVEESCAEDDSTPKSAGTFKKLPSLGDFICLLKCSPTFSQAAIVSFFNSLADGGLMAVLLARFQFNKNQFADLLMITGIGATLAQVFVYSIAWTAWVPYALAGCSVFAVFVRPSSNVPWASTGKIIFPPQHSSFNVGALIIDSLMIRAVPPIAGGKISGNRCTDTLV

SEQ ID NO: 134698 - protein, 64 aa, Glycine max
  Coding DNA Sequence Number=SeqID_17920
MSRGVGGVGGVKGLVGEGLMMPMMVCHSHNKGAQCGVHWPHIEGGEGPPQERSDAACCGLNCHC

SEQ ID NO: 134699 - protein, 485 aa, Glycine max
  Coding DNA Sequence Number=SeqID_17921
  Gene Ontology: Mol. function=binding; Cellular component=nuclear pore; Biological process=protein import into nucleus, docking
  Homolog annotation: Hit_ID=Q8GTE6; Match level="QueryCoverage=96%, HitCoverage=99%, E-value=0.0, Identity=76%"; Hit description =Transportin-like protein
  Pfam annotation: Domain name=HEAT; Domain location=14-49; Score=13.0; E_value=1.1; Accession=PF02985.12; Description=HEAT repeat
  Pfam annotation: Domain name=HEAT; Domain location=199-236; Score =22.1; E_value=0.002; Accession=PF02985.12; Description=HEAT repeat
  Pfam module annotation: Pfam domain module=HEAT::HEAT; Domain location=14-49::199-236
MSGLQGIGHPKGYEQFDNVLMGLLRRILDDNKRVQEAACSAFATLEEEAAEELAPRLEIILKHLMTAFGKYQRRNLRIVYDAIGTLAEAVGGELNQPVYLDILMPPLIEKWQQLSNSDKDLFPLLECFTSISHALGTGFTQFAEPVFRRCINIIQTQQFAKVLADPAATTGVQYDKEFIVCSLDLLSGLAEGLGSGIESLVAQCSLRDLLLHCCVDDAPDVRQSAFALLGDLARVCSVHLDSRLSEFLEAAAKQLEISKVKEAISVANNACWAIGELAVKAWVPIKTAASLIWNLVLDIINLGADKTVPQTLLIEILRVHQEISPVVLTVISCLVPILQHAEGLNKSLIENSAITLGRLAWVCPELVSPHMEHFMQSWCTALSMIRDDVEKEDAFRGLCAMVKANPSGALSSLVCMCKAIASWHEIRSEDLHNEVCQVLHGYKQMLRNGAWDQCMSALEPPVKEKLSKYQEVPQAFKISFDGSFP

SEQ ID NO: 134700 - protein, 280 aa, Glycine max
  Coding DNA Sequence Number=SeqID_17922
  Gene Ontology: Mol. function=amino acid transporter activity; Cellular component=membrane; Biological process=amino acid transport
  Homolog annotation: Hit_ID=Q10HT5; Match level="QueryCoverage=90%, HitCoverage=50%, E-value=3e-86, Identity=56%"; Hit description=Amino acid permease family protein, putative, expressed
MGTMFPETGGYVAWVSSNWAFQLAIPRIKPTRWIMVDLNKVNWGLYMNTLFWNLNYWDSISTLSGEVDNPGKTLPRSLFYAVMLVVLGYFLPLLVGTGVMLVNREIWYDGYFSEVARVIGGVWLRSWVHAASALSNMGMFVAEIFWEWQKEAWFLSILFSASGVVLLSWLSFQEIVAAENFLYCFGMLMEFVAFVKLRRKFPYAERLYKVPVGETGAILMCVLPSLLIFVVLALASFKVSIISFSAVITGLVLRPCLKYLEQKRWLRFSDNPDLPDIYAT

SEQ ID NO: 134701 - protein, 134 aa, Glycine max
  Coding DNA Sequence Number=SeqID_17923
MELKAASLRRGYELLKGHQKQKKNRLAKGVLESNIVNPKGNGGVGVVSCTEEVGGVVRMKIVVRKSELKQLVEVMNGGVKSKMSVSCSVEQRLNLLRKKKYLSRANGNHQKCWSPGILDVPVPDLTFTITVQLK

SEQ ID NO: 134702 - protein, 192 aa, Glycine max
  Coding DNA Sequence Number=SeqID_17924
  Gene Ontology: Mol. function=nucleic acid binding; Biological process= DNA integration
  Homolog annotation: Hit_ID=Q1RWN2; Match level="QueryCoverage=94%, HitCoverage=13%, E-value=4e-54, Identity=56%"; Hit description =Peptidase S8 and S53, subtilisin, kexin, sedolisin; Integrase, catalytic region; Zinc finger, CCHC-type
MAESNNNKNVQPAILIFDGHYDHWAKLMENFLRSKEYWHLVEHGISIVTNKTTASEAELKAMEEQQLNDMKIKNYLYQAIDREILDTILNDDTSKDIWDSMKQKFQGSTRVKRAQLQALRQEFEMLQMKEDETVNSYFARTLKIAKSMKACEERMRENIIAAKILRSMIPKFNYVVCLIEASNNLDTMTIDR

SEQ ID NO: 134703 - protein, 124 aa, Glycine max
  Coding DNA Sequence Number=SeqID_17925
  Gene Ontology: Mol. function=nucleic acid binding; Cellular component= nucleus; Biological process=DNA integration
  Homolog annotation: Hit_ID=Q1S9A8; Match level="QueryCoverage=100%, HitCoverage=69%, E-value=1e-39, Identity=55%"; Hit description =Integrase, catalytic region
  Pfam annotation: Domain name=rve; Domain location=35-124; Score= -12.8; E_value=0.069; Accession=PF00665.16; Description=Integrase core domain
MVNGLPTVKVPREICTHCLVGKQHRKPMPRKSLWRASNKLQLVHADICGPINPISSSNKRFKVLVEKEVGVSIGCLRTNRGGEFTSNEFGEFRKNHGIRRQLTVAYTPQQNGVVERKNKTVMNM

SEQ ID NO: 134704 - protein, 524 aa, Glycine max
  Coding DNA Sequence Number=SeqID_17926
  Gene Ontology: Mol. function=protein phosphatase type 2A regulator activity; Cellular component=protein phosphatase type 2A complex; Biological process=signal transduction
  Homolog annotation: Hit_ID=Q7XJ10; Match level="QueryCoverage=80%, HitCoverage=92%, E-value=3e-97, Identity=42%"; Hit description =Serine/threonine protein phosphatase 2A-like protein
  Pfam annotation: Domain name=B56; Domain location=97-510; Score =475.9; E_value=4.8e-140; Accession=PF01603.10; Description=Protein phosphatase 2A regulatory B subunit (B56 family)
MCYYEDTFTTQERGSSNDFDNRSGIPTLLVQRHRRFWLFHGRKKQVWFLANSEISCSERRNKGKKKNMLSQKVSPTPSSTSSPKKNPKTLHEMFLQESPHFIIPSSPSGNEELLSAISYCTFVFTFSDPSESPAQRDSKRLQLTRLVSILKSSKKPVHEKVLGPLVAMISANLFRPLPPPSNPTSNSITELPEEEDPISIFSPLWSHLQIVYEILLKLVNSTDQKVLREHMNHCFLRNLQALFQSEDPRERESLKNVYHKIYSKFIADRSLMRKWMTEVLLNYVFETEKHPGIGDLLEIWGTIINGFTVPLKEEHKLFLMRVLIPLHKTKGMQVYHRQLAYCVSQFVQKEPMLGGVVVRGILKYWPVTNCQKEILLIGELEDLVENLDPDQYRKLALPLCTQITKCINSWNSQVAERALYVWNNEQFVKMALIGTVEVFTVIVEGMEKNLKWHWSKSVRQLTESVKVMLEEMEPDLYSKGLMDMEAKESVAHQEDIKRKKRWERIELEAAKNQFLNPRYIRVSY

SEQ ID NO: 134705 - protein, 108 aa, Glycine max
  Coding DNA Sequence Number=SeqID_17927
  Gene Ontology: Mol. function=nucleic acid binding; Biological process= DNA integration
  Homolog annotation: Hit_ID=Q1RWN2; Match level="QueryCoverage=76%, HitCoverage=7%, E-value=3e-19, Identity=52%"; Hit description =Peptidase S8 and S53, subtilisin, kexin, sedolisin; Integrase, catalytic region; Zinc finger, CCHC-type
MKIGEEEDEDEEEVLSVAEEEGDNQSTKLKLNASSVTNLDIFNMNVLSGKKLNYAEVEDKQGTTEEWFLDSRCSNHMSGNKDWFSELDENFRHAVKLGNDTRIVVKGK

SEQ ID NO: 134706 - protein, 99 aa, Glycine max
  Coding DNA Sequence Number=SeqID_17928
  Homolog annotation: Hit_ID=Q1SWX1; Match level="QueryCoverage=79%, HitCoverage=15%, E-value=8e-08, Identity=36%"; Hit description=IMP dehydrogenase/GMP reductase
MGPLQMQAFRKVYEKILDLTIAEISTEAIASLTQYYDQPLRCITFGDFQLVPTVEEFEEILGCPLGGRKPYLFSGFLHSLSKIAIVQREPGGSCLGGLI

SEQ ID NO: 134707 - protein, 82 aa, Glycine max
  Coding DNA Sequence Number=SeqID_17929
MLSKSRSYLRLGRGSKMPLPHYQLAQQKPFFSDYKANQNIKPEPEIGKMCEDVQGISKAAKEKVKRDGEGGFKTAKADVQER

SEQ ID NO: 134708 - protein, 319 aa, Glycine max
  Coding DNA Sequence Number=SeqID_17930
  Gene Ontology: Mol. function=heat shock protein binding; Cellular component=integral to membrane; Biological process=protein folding
  Homolog annotation: Hit_ID=Q10S35; Match level="QueryCoverage=86%, HitCoverage=94%, E-value=1e-44, Identity=42%"; Hit description=DnaJ domain containing protein, expressed
  Pfam annotation: Domain name=DnaJ; Domain location=6-73; Score=79.2; E_value=1.3e-20; Accession=PF00226.21; Description=DnaJ domain
  Pfam annotation: Domain name=Phycoerythr_ab; Domain location=149-191; Score=-4.7; E_value=0.054; Accession=PF02972.5; Description =Phycoerythrin, alphabeta chain
  Pfam module annotation: Pfam domain module=DnaJ::Phycoerythr_ab; Domain location=6-73::149-191
MEAEIDHYAVLGLPSGEEGAKLTDKEINKAYRWKALELHPDKRPDDANAAANFQQLRTSYDILRDDKARKLFDDLLRVKRDRELRNSQRDGKRRKMVSDLERRERDANAPDPAAKEREEEARIARQLKEEIARIRAMHGKKEEAAVKPAAKKKESGGGGGGGGVDQEKVLKVSWEKVGEDYAADKLRELFSKFGAVEDVVIKGSKKKGSALVVMATKEGAVSATGSVIGHLANPLLVLPLKPATVADSSSVPKSAETTRMSNLVGAGYQAFEDSVLKKLQKESVGGSVLNVFTLVLMNKLIFSVIGVPVPPNTIYDTCH

SEQ ID NO: 134709 - protein, 62 aa, Glycine max
  Coding DNA Sequence Number=SeqID_17931
MESVMEGKVTILGTNMGAIQIRTGQKDCKIAQSYNLDINLVTFSMNLKLQLAEKESQACNSD

SEQ ID NO: 134710 - protein, 122 aa, Glycine max
  Coding DNA Sequence Number=SeqID_17932
MGAYSRDEKLLMHFFQESLARVAVVWDLAAQVAPPMVEREMTTMIVDTLPVFYYEKLVGYMPSSFTDLVFVGERIEVGLKRGKFDYVAPTNMSNRRFGASGAKKKEGDAHAVTSAPTWPKPQ

SEQ ID NO: 134711 - protein, 67 aa, Glycine max
  Coding DNA Sequence Number=SeqID_17933
  Gene Ontology: Mol. function=glutathione transferase activity
  Homolog annotation: Hit_ID=Q9FQF3; Match level="QueryCoverage=77%, HitCoverage=20%, E-value=4e-11, Identity=62%"; Hit description =Glutathione S-transferase GST 5
MNGRKVLDEVKNPALAKWAETFVDPVVKGLLPQTDKLIEFAKALIKNMLQSKWNYISCKMTWNFEVV

SEQ ID NO: 134712 - protein, 345 aa, Glycine max
  Coding DNA Sequence Number=SeqID_17934
  Gene Ontology: Mol. function=hydrogen ion transporting ATP synthase activity, rotational mechanism; Cellular component=proton -transporting two-sector ATPase complex; Biological process=energy coupled proton transport, ...
  Gene Ontology: Biological process=against electrochemical gradient
  Homolog annotation: Hit_ID=Q40079; Match level="QueryCoverage=74%, HitCoverage=47%, E-value=1e-116, Identity=85%"; Hit description =Vacuolar ATP synthase subunit B isoform 2
  Pfam annotation: Domain name=ATP-synt_ab; Domain location=142-345; Score=99.5; E_value=9.7e-27; Accession=PF00006.15; Description=ATP synthase alphabeta family, nucleotide-binding domain
MKWRKASGMLCDAKVPIKLKGKFYRTAVRQAILYGTECWAVKSQHETKVGVAEMRMLRWMCGKTRQDKIRNGAIRERVGVAPIVEKMVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKRLEKSDNLLEGGEEDNFAIVFAAMGVNMETAQFFKRDFEENGSMERVTLFLNLGLKVVTKKRIYDLKNFKVDYHIVYVELKANDPTIERIITPRIALTTAEYLAYECGKHVLVILTDMSSYADALREVSAAREEVPGRRGYPGYMYTDLAQFMNEAGRIEG

SEQ ID NO: 134713 - protein, 110 aa, Glycine max
  Coding DNA Sequence Number=SeqID_17935
  Subcellular localization annotation: CTP_CleavageSite=62; ConfidenceScore=5.70e-01
MTAIPTRPSFPPTQQCHYSTNNNPSPYPPPNHPQRPSLNQPQSLLSQPTLLRVSKARLTGVSSKKGKCTESPPTFIERKTLGKPKDNSLSHLRKGSCSYVPSIEEEIRPT

SEQ ID NO: 134714 - protein, 327 aa, Glycine max
  Coding DNA Sequence Number=SeqID_17936
  Homolog annotation: Hit_ID=Q5G7N2; Match level="QueryCoverage=38%, HitCoverage=81%, E-value=4e-13, Identity=34%"; Hit description =Putative phage lysozyme
  Pfam annotation: Domain name=Phage_lysozyme; Domain location=23-136; Score=10.7; E_value=0.0066; Accession=PF00959.10; Description=Phage lysozyme
MPLRPSKRNQGYREAPYLDTQGFPTIAGGIRIGPKGASLSHYIFRVPRRVGDVWKQCIVEGKVQEMQQRALVQQALSQCNEARSDVLISMAYQMGVDGLALFRGMLTAVTQRDFDAAANAMLDSLWARQTAGRARRGCYEHALAVVRYRRAGGHHPAAVAAALHHAGRLGAVVSLVSAGCMERAASGYQRDSAAQLSRPDRRLHGGDGRTGAVRASEEPGGAEKNAGGQTMSFLLSQLAGSWHWLAAIGGVIAALIASYAGGKKIGKVQQQAKADVAQAEKTAAQAVEVNQQQQQLREEARRVETRNGNLDDAAARDKLQQSKYHQP

SEQ ID NO: 134715 - protein, 78 aa, Glycine max
  Coding DNA Sequence Number=SeqID_17937
MNVGQTAVIKAGVVVAGPRGRQYCAVYPGADFPLADALGGAQGDLITLQAQGTVDAALQAAERLTPPVATGARVSAKD

SEQ ID NO: 134716 - protein, 129 aa, Glycine max
  Coding DNA Sequence Number=SeqID_17938
MQSGSQSESFDVEMGDRLEDIIYDLGQESFQQAHARMYDTLKANSKKPLYMGCNNSLTLLSTNLHRLEASIVERYIPEEAIEFCSEYIERAKPVGLPESRHEERVRGKGSRGLHVITPSVEDLQLAYLY

SEQ ID NO: 134717 - protein, 108 aa, Glycine max
  Coding DNA Sequence Number=SeqID_17939
  Subcellular localization annotation: CTP_CleavageSite=55; ConfidenceScore=5.63e-01
MGVQIKIFKFSNLGPFKTFLKLGCLRRKQPTSPGRAGRQLPPPFPINRRMGVVPKAIMGEKRVFREENPSRGASVMLLRRFREQFREDFPPFFTVLRSFFVRSSFFNR

SEQ ID NO: 134718 - protein, 64 aa, Glycine max
  Coding DNA Sequence Number=SeqID_17940
  Subcellular localization annotation: CTP_CleavageSite=39; ConfidenceScore=5.56e-01
MSAFTFSCTSSGFTHYSSSSTGSDMGLNQFRFSTWSMISCQGGTGSNRDIDIPKMCLAVDEAAM

SEQ ID NO: 134719 - protein, 74 aa, Glycine max
  Coding DNA Sequence Number=SeqID_17941
MALVMGPLLGRIASDFMRGRQSFTTSLCAMIKSRLVLRKLEMQMLPFLYPLKRDLWDRRNLQIDRIMMSMISYI

SEQ ID NO: 134720 - protein, 274 aa, Glycine max
  Coding DNA Sequence Number=SeqID_17942
MGLFVVVGQNTMLAGLGKVFENSSTIHNVRYENDVVKVQVVRTYMPHAEVPIPTSEVHYLEQAVGTFVAWPTHLVREVTNEVVVGPDKPPSKSVGEPNRLTYVATDDPLGELVKKSYVVYTKPMELAWDGAKFGLPNATNGFFVTHAAVTEIILGDRCLNISVLQLWMMFMNDCSTNIGFSPVYGFLEPQSIRCTKDTREECQKYIETWVKESHREIYLGPYFNHAMKKICSNLQGKDNAPPPPPQWIEAKHLLSAYIACRAMYNKEHMSVDIM

SEQ ID NO: 134721 - protein, 98 aa, Glycine max
  Coding DNA Sequence Number=SeqID_17943
MTIVVVSVITVTTINDGDCDSNDDNRHDNKGAYTLGKLMNVKEDECHDDFFYNSCKISKDNHSEVKMENGTCRHNLQIVAHPNREYIRVLQEILNVRH

SEQ ID NO: 134722 - protein, 361 aa, Glycine max
  Coding DNA Sequence Number=SeqID_17944
  Homolog annotation: Hit_ID=Q10S29; Match level="QueryCoverage=83%, HitCoverage=88%, E-value=7e-59, Identity=45%"; Hit description =Expressed protein
  Subcellular localization annotation: CTP_CleavageSite=54; ConfidenceScore=5.29e-01
MAAATLSVRPDRLSPGAAFPRPPVQPPLRKPIAAPEPWRAVPPRIRIRTVAPVQASSRADDSAPFEMSVENALKLLGVSEGASFDDILRAKNAIVANCNDDQDAIAQESEYVNITFLGLVDILYFYGMNNICGHNIDGNVISGNAYYTLKQTPHKEKIKKVEAAYDMLLMQSLTQRRAGKVVNSSVRYADVKRVKSPAGGSMPQWLKNSPVSIESPSTSDLGLQAGVYGVLMGLTYLNGASAPAAGYAGADVPGLLLAGSFGASLYFMTKKNVKLGKATVITIGGLVAGAVVGSAVENWLQVDIVPFLGIHSPAAVVSEIIIISQFLVSLYLRTRSWPPVVVSAGENCYTIAGHTLSCFFC

SEQ ID NO: 134723 - protein, 73 aa, Glycine max
  Coding DNA Sequence Number=SeqID_17945
MDANQRCLVMMSVRMHNGANGGAKLRGHAVFRCCSGWERCMRLLGQWAMSDVQHCCSGIGVIGFRFAAELVWW

SEQ ID NO: 134724 - protein, 500 aa, Glycine max
  Coding DNA Sequence Number=SeqID_17946
  Gene Ontology: Mol. function=binding
  Homolog annotation: Hit_ID=Q6AVK0; Match level="QueryCoverage=97%, HitCoverage=99%, E-value=1e-124, Identity=45%"; Hit description =Expressed protein, having alternative splicing products
MEGVKLEDRWGYQVATSSQACVSAINSYYHQVLIYGRERSVILEAVAHDKHCVLANILAAHFLYSSGSSRALTCLHAAKSHLEHATLYEKLVFDAISYMLSEDRDDDVAVELHSKEVCPLGHWIVDRVGAIRLGSDRYLLVQISFLLLKEFPRDLLSLKRAQVLCFYMGLPGLSLSLIQQILPHNEGENYIYGMLAFPLLELGRMEEAEEAAKRGFEINKQDCWSQHALCHVLQYKCCFREAVKFMEECSSSWGSSSSFMLTHNWWHVALCYLEGNAPRQRVLEIYDNYIWKELERNDSMSADVYLNAAALLLQLYVRGELDIVGDRLKILSECLTNQENWYMEWHFDVLIVWTLAKTGEISKAEDLLKGLKNRLLRMTKKKQQRMQRGMMLAEALYAYGRDDDNRGLELLDPNFDATDYKIIGASDEQVDVFNEVWYNMLLNTGKPLKAIEVLEKQIKKRDGVPYLWRLLERAYKLANKEEEERIANEKATALESRYFN

SEQ ID NO: 134725 - protein, 767 aa, Glycine max
  Coding DNA Sequence Number=SeqID_17947
  Homolog annotation: Hit_ID=Q7X997; Match level="QueryCoverage=94%, HitCoverage=93%, E-value=1e-129, Identity=50%"; Hit description=Bzip- like transcription factor-like protein
  Pfam annotation: Domain name=DUF630; Domain location=1-61; Score =106.2; E_value=9.4e-29; Accession=PF04783.3; Description=Protein of unknown function (DUF630)
  Pfam annotation: Domain name=DUF632; Domain location=275-616; Score =319.2; E_value=7.3e-93; Accession=PF04782.3; Description=Protein of unknown function (DUF632)
  Pfam module annotation: Pfam domain module=DUF630::DUF632; Domain location=1-61::275-616
MGCVASKLEEEEEVVAICRERKRLLKQAVEKRYALAEAHCKYFHSLNAVAAAIKLFVARHSSPSSPFLITFPPPCPSSPSPPTENVITNPMFLQQTPSENKHQAIAACDSCISSTTSESSEEESEEKREGEEGEEGKGEEDQHQQQPCGYYCMPMTMSMSMSMSMSMPMPPSMPSPQRDFGWDFFYPLDSMRSEVMSGYHRNSDDDLRAVREEEGIPELEEEVEREEVQHKVVSVEENNSNNHNNKSNNEGAVEQVLSGVEAVKVVDVATENQGEQRGLAVLDTPAEGRELLEALKDIEDHFLKAYDSGKEVTRMLEANRTPLHSSLDEIKESSTKLILAITWKSISSRQSSCKSLMVPNVKNSSTRVEYKNDLFDDYGGMDSGSHLLTLGRLYAWEKKLFEEVKAGDSTRKNYEKKCTQLRSKNVRGDDLLSTDKTKTEVKDLYAGILVAIRRAESISKRIEKMRDEELQPQILELLKGLTQSWKIMLESHETQKKILSEVKYFTCATYGKFCNQSHGFATLQLEAQLQNWRDCFKEYTAAQKAYVEALHGWLSKFIVPEVEFYSRSKNVAMQYQVNGPPLLVICNDWLASLQKLPDKMVTVALKSVVKDVRTLWLQQNKEKQQKRKVDRLTRDLERRYSSASSHKVVETRMLEYHVTDRESEAGNDHHQEEEECMMEKSDHLETLRRKVEAEKEKHHSCMQETQRITLHGLQSGFSLVFESLTEFSKASQKMYNGLITYSENSDKVGNITYIEGGGCNVENCNGQ

SEQ ID NO: 134726 - protein, 122 aa, Glycine max
  Coding DNA Sequence Number=SeqID_17948
  Gene Ontology: Mol. function=protein phosphatase type 2C activity
  Homolog annotation: Hit_ID=Q9M3V0; Match level="QueryCoverage=70%, HitCoverage=21%, E-value=7e-36, Identity=86%"; Hit description =Protein phosphatase 2C
GSARRLVKAALQEAAKKREMRYSDLKKIDRGVRRHFHDDTTVIVVYLDSNLVSRASTVKFPGISVRGGGINLPHNTLAPCTTPTEIGDCDVGSVAVLLRMFLVIDNAINAFRCWRGERKIVM

SEQ ID NO: 134727 - protein, 232 aa, Glycine max
  Coding DNA Sequence Number=SeqID_17949
  Homolog annotation: Hit_ID=Q1SWU3; Match level="QueryCoverage=86%, HitCoverage=81%, E-value=4e-38, Identity=44%"; Hit description=Actin- crosslinking proteins
  Pfam annotation: Domain name=DUF569; Domain location=1-146; Score =245.1; E_value=1.5e-70; Accession=PF04601.4; Description=Protein of unknown function (DUF569)
MEFFTKTSVVKLRSHLDKYLVADADGARVRQSRRSSGRGTWWTVEEVAAEGGINNKVRLRSCHGRLLTATETPFLLGMTGKTVLQTEFEAGADFKHEWEVIRDGFQVRLRSWSGKFLRANGGTPPWRNTVTVDEPHSSATRDWVLWDVEPVEAMEELVDEFLCENDDVVSSFASDDVLSVDSEPASPMSVFSLRSPPVRRNSKLLLMQPLKLKTEQTEKEYYFQPSIFWERN

SEQ ID NO: 134728 - protein, 478 aa, Glycine max
  Coding DNA Sequence Number=SeqID_17950
  Gene Ontology: Biological process=regulation of transcription
  Homolog annotation: Hit_ID=Q8LP36; Match level="QueryCoverage=17%, HitCoverage=57%, E-value=6e-30, Identity=80%"; Hit description =PlCYC4 protein
  Pfam annotation: Domain name=TCP; Domain location=33-274; Score =171.8; E_value=1.8e-48; Accession=PF03634.4; Description=TCP family transcription factor
MEEEDEIQAQKVRRRRGSDGESTNRFHSSWHHHHHHSSRIIRVSRASGGKDRHSKVMTSKGLRDRRVRLSVTTAIQFYDLQDRLGYDQPSKAVEWLIKSASDSISELPSLNNFPDTPKSDDHEKRANTDVAAGAVDGENYENENGNNNNQSQNMSLSKSGCSSTSETSKGSGLSLSRSDIRVKARERARERTTKEKEKEKNESHHHHSNVVVPHHRHHHHHNPVSQTASFTELLTGGIPKGCDDEEPNNMMMFNKEAAAASSGRQQWCSSSSAAAAAPMDYFLGPSSSRTTTTPPHNHHHHHHQYSSSGGFSLAQIQLGHSLPEAMNHNVSAFNNNVSGENQNHSSSDPHLQQQQHFSFIPDHLMSAVVTSSSHHQPSGSDYNLNFTMSSGLAGYNRGTLQSNSPSLLPHLQRFSPLDGSTVPFFIGAAPSAAVAAPAMENNTTTTNNHHHHQFSSGFDGSRLQLYYGHSDQKGKAKN

SEQ ID NO: 134729 - protein, 281 aa, Glycine max
  Coding DNA Sequence Number=SeqID_17951
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9ZSQ7; Match level="QueryCoverage=85%, HitCoverage=61%, E-value=1e-107, Identity=78%"; Hit description =Protein phosphatase 2C homolog
  Pfam annotation: Domain name=PP2C; Domain location=49-269; Score= -54.9; E_value=0.0093; Accession=PF00481.12; Description=Protein phosphatase 2C
MLSGLMNLLRACFRPGSDGFTLAGSDAGGRQDGLLWYKDSGQHLSGEFSMAVIQANNLLEDQSQIESGCLSSNESGPYGTFVGIYDGHGGPETSRFINDHLFHHLKRFTSEQQSMSVDVIRKALQATEEGFISVVARQFSLSPQIAAVGSCCLVGVICNGTLYIANLGDSRAVLGRAVKATGEVLAMQLSAEHNASIESVRQELHASHPDDPNIVVLKHNVWRVKGLIQDMKNYFRKTELCRALVKQTWVGVERERDKVNFKFICGKDLFFSTSLEFYVIE

SEQ ID NO: 134730 - protein, 1179 aa, Glycine max
  Coding DNA Sequence Number=SeqID_17952
  Gene Ontology: Mol. function=ATP-dependent helicase activity; Cellular component=nucleus; Biological process=RNA-mediated posttranscriptional gene silencing
  Homolog annotation: Hit_ID=Q8VY00; Match level="QueryCoverage=87%, HitCoverage=98%, E-value=0.0, Identity=67%"; Hit description =Putative RNA helicase
  Pfam annotation: Domain name=AhpC-TSA; Domain location=15-106; Score=- 21.5; E_value=0.052; Accession=PF00578.11; Description=AhpCTSA family
  Pfam annotation: Domain name=DEAD; Domain location=553-713; Score =0.7; E_value=4.9e-06; Accession=PF00270.19; Description=DEADDEAH box helicase
  Pfam annotation: Domain name=DUF1605; Domain location=1067-1167; Score=126.6; E_value=6.8e-35; Accession=PF07717.6; Description =Domain of unknown function (DUF1605)
  Pfam annotation: Domain name=HA2; Domain location=941-1033; Score =110.5; E_value=4.9e-30; Accession=PF04408.13; Description=Helicase associated domain (HA2)
  Pfam annotation: Domain name=Helicase_C; Domain location=786-880; Score=58.4; E_value=2.3e-14; Accession=PF00271.21; Description =Helicase conserved C-terminal domain
  Pfam annotation: Domain name=Thioredoxin; Domain location=19-125; Score=89.9; E_value=7.7e-24; Accession=PF00085.10; Description =Thioredoxin
  Pfam module annotation: Pfam domain module=AhpC-TSA::DEAD::DUF1605::HA 2::Helicase_C::Thioredoxin; Domain location=15-106::553-713::1067 -1167::941-1033::786-880::19-125
MGANLSNVENAHKSSGHLLTFHSTAKWKTHFDASKQTNKLMVIDFTATWCGPCKSMDPIIQEYAAKYTNVEFIKIDVDELMEVSQEFKVQAMPTFILIKKGKVVDKVSVRASLSKLHLTPPLYRRVWGFATTAAEGCCRRRRRRRVTMDNDDSLKNWVSDKLMSLLGYSQPTLVRYMIGLSHQASSPAHLVDKLVEFRIPSSSDTRAFAEEIFSRVPRVPSSLNQYQKQEREAAILARKQKTYTILKADDNSDHAYAYKSRKPDNRSKRFRKKSEVHDDEGIARKERGRQVKRRISPHKDNHSDSEEEEEILEDQREKKELERHMRERDEAVTRKLVTEPRLTRKEKEEAIRRSNAAENDDIQTLRNFSRQEYLKKREEKKLLQLRDDIEDEQYLFEGVELSEAELCKLRYDKEMYELVKKRSKEDDNVNEYYRMPEAYDHEGGVNQEKRFSVAMQRYRDPNAEDKMNPFAEQEALEERQIRKATLKFDSRNRKQAFDEYQFVFDDQIDFVKTSVIDGDKFDYEEMVEDSHEKSRAKTAREALQEEREKLPIYPYREQLLQAVHDHQVLIIDGETGSGKTTQIPQYLHEAGYTKHGMVACTQPRRLAAISVAARVSKEMGVKLGHEVGYSIRFEDCTTDKTVIKYMTDGMLLREFLGEPDLASYSVLIVDEAHERTLSTDILFGLVKDIARFRPDLKLLISSATLDADKFSDYFDSAPKFKIPGRRYPYEIFNFTEAPSDYLDAAIEASLKIHVTEPPGDILVFLTGQEEIETAEENLKHRIRGLGTKIGELKICPIYANLPTELQAKIFDPTPERVRKVVLATNIAETSLTIDGIKYVIDPGYCKMKSYNPRTGMESLKVTPISKASAMQRAGRCGRTGPGKCFQLYTAYTFHKEMDDNTVPEIQRTNLANVVLTLKCLGIDNVMHFDFMDPPSDDALLKALELLYALSALNKFGELTKVGRRMAEFPLDPTLSKMIVASEKFKCSDDIISIAAMLSVGKSIFYRPKDKQVYADNAMRNFHTGNVGDHIALLRVYNSWKETNYSTQWCYENYIQVRSMRQARDIRDQLAGLLERVEIELTSNSSDFDAIKKSITSGFFPHSARLQKYGIYKTVKQSQNVRIHPGSGLAQVLPRWVVYHELVLTTKEYMRQVTEINPGWLAEIAPHYYQLKDVEDSYSN

SEQ ID NO: 134731 - protein, 277 aa, Glycine max
  Coding DNA Sequence Number=SeqID_17953
  Gene Ontology: Mol. function=heat shock protein binding; Cellular component=cellular_component; Biological process=protein folding
  Homolog annotation: Hit_ID=Q6EIX9; Match level="QueryCoverage=96%, HitCoverage=97%, E-value=1e-90, Identity=58%"; Hit description =Potyviral capsid protein interacting protein 1
  Pfam annotation: Domain name=DnaJ; Domain location=5-71; Score=119.0; E_value=1.3e-32; Accession=PF00226.21; Description=DnaJ domain
  Pfam annotation: Domain name=DnaJ_C; Domain location=150-272; Score =21.9; E_value=3e-08; Accession=PF01556.9; Description=DnaJ C terminal region
  Pfam module annotation: Pfam domain module=DnaJ::DnaJ_C; Domain location=5-71::150-272
MVAGDYYRILKVKHDATDEELKKAYKKLAMKWHPDKNLEDPLRKEEFEAKFKQVSEAYDVLSDPKKRQIYDLYGHYPLNSQRFTKEYGGGNMKDAGVVESSLLCTLEELYNGCKKKLKVSRIVAPDEFGELKSVEEILKIDIKPGWKKGTKITFPGKGNQEPGFAPADLIFVLDESPHAIFKRDGNDLVAIQKILLVDALIGKTLNLATLDGRDLTIQMADIVKPGYELVILNEGMPISKEPGKKGNLRIMFDVIFPSRLTTQQKCDLRRILSDVYY

SEQ ID NO: 134732 - protein, 245 aa, Glycine max
  Coding DNA Sequence Number=SeqID_17954
  Gene Ontology: Mol. function=pyridoxal phosphate binding; Biological process=arginine metabolic process
  Homolog annotation: Hit_ID=Q38IW9; Match level="QueryCoverage=92%, HitCoverage=31%, E-value=1e-53, Identity=90%"; Hit description =Ornithine aminotransferase
MKAKTNNAEAFFFSVIVDSTFGGNPLASAVAIASLEVIKNERLVERSAQMGEELAGQLLKIQQQYPDYVKEVRGRGLFIGVEFNSKNLFPVSGYELCKKLKYRGVLAKPTHDTIIRFTPPLCIRGSSLCEGMREGCCTQPYSCICKEAVSGFEPMTNKSPRHNFTAAPGLALHVHGKTLGKKKSADKHGSMGLHFKFVKQLKYSLDEIQQGSKVLADVLEIDLPKLQKTKPKDAAPVASSACDRC

SEQ ID NO: 134733 - protein, 100 aa, Glycine max
  Coding DNA Sequence Number=SeqID_17955
MEKRVVHQHTKFLNNVCNTNRCAYWVPTDPIIKNTDKEHRKEKEMKGFAQLMQLNLWGILKSQEIALRFRFWNIIVDSDSASRIATLSSVVFLFEEQNLA

SEQ ID NO: 134734 - protein, 161 aa, Glycine max
  Coding DNA Sequence Number=SeqID_17956
  Pfam annotation: Domain name=DUF1723; Domain location=25-59; Score =14.8; E_value=0.0091; Accession=PF08330.1; Description=Protein of unknown function (DUF1723)
IHHERPKVKLVRHGVQVLPYPTHPQETSSFHLPVGEMNITLDDVSYLLHLIVTDKSIDHVASLFDKEVVKILLMSHLGILTETKASIAANASVRSWVFAHLSTIGYLESGDYVVEDLVATRWKSLRGTGPYCPEKVLRKFDHVQTILRRPPPRPTYQLCDR

SEQ ID NO: 134735 - protein, 231 aa, Glycine max
  Coding DNA Sequence Number=SeqID_17957
  Homolog annotation: Hit_ID=Q59K46; Match level="QueryCoverage=78%, HitCoverage=9%, E-value=1e-08, Identity=22%"; Hit description=Likely vesicular transport factor Uso1p
MELLKLSKLKLQLQALVAEVRDLRKLKRNEEECGRKIQELQDELASVKEERQKLERKVIYLENDNVLLENKQKELKGTLNNLLQSRENFVNAYEESTSQMKRSIEAKDRMLGVLSEKISSYVALFDSIEKEAFSIKQIVDKVQNVVNDREGIVASLRNKMDWVSASEKEFVENISDLRNKLENNEAELRRKDRIISELEAKLDVAKVCNHNLAKMEDISIPALNICLYQIP

SEQ ID NO: 134736 - protein, 97 aa, Glycine max
  Coding DNA Sequence Number=SeqID_17958
MECALFVCYRAEQELELASLKLLKLKIVIFESLLLLLLPVESFGFEDGITSQSCLCSTVAYLDTNQGNTLQLKVLPPMIMYYITHAHIWLMGKITQP

SEQ ID NO: 134737 - protein, 824 aa, Glycine max
  Coding DNA Sequence Number=SeqID_17959
  Gene Ontology: Mol. function=RNA-directed DNA polymerase activity; Biological process=RNA-dependent DNA replication
HCCIDLFHVIVVFIVVLIMVSTDKRQSFILFQNMDAAAESTAATEEGLESGLRNDAPDSAIAMRQKWRLCEIGLEDYSFVLLSRTHVAKSMGYLLTIKTVDTWGGHKGGVMFVFVNIQNLFDFDGVIDRSLGSTLTSEHMNRFLNEFEVMGGAHRLAESIQSKNLNSWNDPLGALIIGVHQLKLSGWKPEECGAIENELITWSKRGLSETEGNEDGKTIWTLRLKATLDRSKRLTDEYTEELLKIFPQKVQVSKLCTLLLKAVRNTLGSQGWDVLVPGTALGKLVQGPSHNYDGKWYSQRAAWKGAARQRDVEISNWRDATDVHSFYFTRFPEEMGEKDMWLKFKTWGDLDSMVIGGLKLHAILPKHGRQRTTAGKSNSKGGVQASNINNISLITAVEHTHGTGVKPNYLGDDMVLVNGLINGRVEDGRLDRILDQRRGPSRLLVDGCWIEDPNRIKEEVHQFFRKRFEESEEVRPRLDGDGLFGGQHSGALYVSLVPLEFWDVIKPEVLRFLDEFYVNGRFSKETNASFLALIPKVQDPQNLNQYRPISLIDYIYKIDIANEAVEEVKRGSKSCLVFKVDYEKPYDSVSWDFLVYMLWRMGFCPKWITWIEGCLRSASISILINGSPSAEFIPQKGLRQRDPLAPFCLILWQRVEISIMQYTDDTIFFGEASIENVRVIKVMLRSFEMMSGLKINFAKTQFRVIGMPLHWTKNVATYLSCSLLSIPFTYLGIPIGANPRSSVTEDPIVKKCERKLISKKVVHKLVKLQRWFLWGGDTEQKKIAGISWESACGICFIIKESYGLECWIQNMVGGGTGMRIEGIP

SEQ ID NO: 134738 - protein, 890 aa, Glycine max
  Coding DNA Sequence Number=SeqID_17960
  Homolog annotation: Hit_ID=Q9SLT5; Match level="QueryCoverage=47%, HitCoverage=84%, E-value=1e-153, Identity=64%"; Hit description=CW14 protein
  Pfam annotation: Domain name=DUF1336; Domain location=298-532; Score =411.1; E_value=1.6e-120; Accession=PF07059.3; Description=Protein of unknown function (DUF1336)
  Subcellular localization annotation: CTP_CleavageSite=17; ConfidenceScore=5.25e-01
MGACVSTPQGCVGGRLSSSKKKTRKRRREGLRRRVTSRLCKESLEKIDVAGLPDCSFANPTFQVGELEFYTLGNVVGGVDHFVCIGLGGVEIQLLECDERNKTSGSIEEAWFDSVAVFDSDCDDDYQSVPDDVVSLSGIEGGSVSSFPSSGDANHGVSTDHVQKQKELLAGSEAARSSDVQYFVVDAIDSQHEPVFLDEISSVDANSNKDDGLLDNCGILPNNCLPCLVSTIPSVEKRRSTSSSPPNARKKPTTKLSFKWKEGHGNATLFSSKMLLQRPIAGSQVPFCPIEKKMLDCWSQIDASTFKVRGVNYFKDKKKDFAPNYPAYYPFGVDVFLSPRKVDHIARFVELPVMSSSAKFPPILVVNVQVPLYPATLFQGETDGEGMSIVLYFKLSESYSKELPQTFQESIRRLMDDEVEKVKGFPVDTIAPFRERLKILGRVINLEDLHLSAAERKLMQAYNEKPVLSRPQHEFYMGENYFEIDLDMHRFSYISRKGFEAFLDRLKVCTLDVGLTIQANSIKNMVNKIKIEKFTGKNKFDLRHIKMRALLKEQGIWAPFFGQLLKIDKSTLGLQEEEANSLILLSLSDEEGTPLKEHLHELNFVLMELRNIDVKIEDEDLTTILLVSLPPFYENFVSSFSIELRLKAFRNGDEAFTFELLVTNSSKGQKEKKDKCGKKSKAYPKDICNYCKESAIWFWLLVNNYNNILNNGYWTQQSVELSPNQYDEFYDELKRRQVKGKLIKFDAQTLNAFLETPIIIPKGEQLASYAQYLHTYLDHHTITVMLCTLGDGLGFGQPHLFPDYTDCPAQFIAVGLPCADHNSLRCKGATLDVPPVAPPPVVPTPAVSPLPADPPSLLSSQPDQLLPMLQSLQLQSPSLSCSQILRYVFD

SEQ ID NO: 134739 - protein, 750 aa, Glycine max
  Coding DNA Sequence Number=SeqID_17961
  Homolog annotation: Hit_ID=Q75HJ9; Match level="QueryCoverage=96%, HitCoverage=94%, E-value=0.0, Identity=56%"; Hit description =Expressed protein
  Subcellular localization annotation: CTP_CleavageSite=14; ConfidenceScore=5.10e-01
MDQSPFLAQRGSVSSSLGNSAELDANLTLSDKLKVFKSSTFDPNNYVASKSRSMNEKEIRHLCAYLVDLKKASAEEMRKSVLANYSAFIRTSKEISDLEGELLSMRNLLNTQAALVHGLAEGCMLSSMISGNEDSDMDDLLAEKTDISNTEKWLIGYLETLEVLLAEKRVDEAMTALDEGEKMAKEISEGKTLSPSLFQALQDAINEHRKKLADQLAETICQPSTHSAEIRSTALALKNLGDGPRAHTLLLNSHQETLQRNMKNLQSSNSGGVGAFTATLSQLVFSTISQAASDSLSVFAEEEPAYTSELVTWAVTQAEKYAVLLKKCILASTAAAGGLRVASECVHVCMSHCYQLEASGLALSPILIKYFRPFVKQALNTNLRRIEQSSSALAAADDWFLAYAPTSSRHSGLPPSSSHSNLSFQPKLSRSAHKFNSMVQELFEDVGPLEILQLDVLAVEGLLQVFNFYVNLLINALPGSVVTENLEGHKIVKIAETEEQQIALLANAMLLADELLPRAVIKLSNSTRGDDSHRRGSDKQRELKKRLQREVDRLRDSFCRQHALELIFTEEGEARLNALIYLGMDGNVEQPEWFPSPIFQEIFAKLTDVASIAADLFVGRERFATVLLMRLAETVILWLSDDQTFWEEVETGSTPLGPIGLQQLYLDMQFVMIFSSQGRYLSRHLHQAIKNIIERAINAVAATGLDPNSVLPEDEWFVEVCEIAIKMLTGRAAFDNVEDDVASPTSSVQT

SEQ ID NO: 134740 - protein, 587 aa, Glycine max
  Coding DNA Sequence Number=SeqID_17962
  Gene Ontology: Mol. function=carbohydrate binding; Cellular component= chloroplast; Biological process=carbohydrate metabolic process
  Homolog annotation: Hit_ID=Q6ZY51; Match level="QueryCoverage=69%, HitCoverage=35%, E-value=1e-144, Identity=64%"; Hit description =Phosphoglucan, water dikinase, chloroplast precursor
  Pfam annotation: Domain name=PP2C; Domain location=381-587; Score= -13.0; E_value=3.4e-05; Accession=PF00481.12; Description=Protein phosphatase 2C
  Pfam annotation: Domain name=PPDK_N; Domain location=82-426; Score= -29.4; E_value=2.6e-11; Accession=PF01326.9; Description=Pyruvate phosphate dikinase, PEPpyruvate
  Pfam module annotation: Pfam domain module=PP2C::PPDK_N; Domain location=381-587::82-426
EKVIFVTCEDDEKVADIQRLIGSYVRLEASTAGVNLKLSSSVDIEDNSSIRSSSDDCVSGVEVPSFSSGRISNFDQGASSGRVILLPDAELQTSGAKAAACGHLSSLSAVSDKVYSDQGVPASFRVPSGAVLPFGSMELELEKSNSTEAFRSILEKIETAKLEGGELDVLCHQLQELISSLKPSKDIIQSIGRIFPSNARLIVRSSANVEDLAGMSAAGLYESIPNVSPSNPTVFGNAVSQVWASLYTRRAVLSRRAAGVPQKEASMAILIQEMLSPDLSFVLHTVSPTNQDNNCVEAEIASGLGETLASGTRGTPWRISSGKFDGQVQTLAFANFSEELLVRGAGPADGEVIRLTVDYSKKPLTVDSVFRGQLGQRLCAVGFFLERKFGCPQDVEGCLVGKDIFIEAHAYLLHQSYVLQHVRDGNGMKFDFDKLLDMKSAVTVERKPNLKDLNRFGLIEGIEDKKLRELWEGQDLVIVNVDDSRAVLAAQDRSNGSLIAVQLSTDHKPHLPREAERIRICKGRVFAIKNEPGIARVWLPNIDSPGLAMSRAFGDFCLKDFGVISAPDFSYHRLTQRDQFVVLATDG

SEQ ID NO: 134741 - protein, 96 aa, Glycine max
  Coding DNA Sequence Number=SeqID_17963
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q0KJ40; Match level="QueryCoverage=75%, HitCoverage=11%, E-value=2e-22, Identity=69%"; Hit description=Ku70 homolog
MQKKQRECKHSFILEEVIQSGGQIEPPGMHIIYLPYSDDIRLVEEHYSDTSGMVNIASDDQIKKAADLIKLIDLKDFSVCQFTNPGLTCNIPIFCK

SEQ ID NO: 134742 - protein, 99 aa, Glycine max
  Coding DNA Sequence Number=SeqID_17964
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q0KJ40; Match level="QueryCoverage=92%, HitCoverage=14%, E-value=4e-28, Identity=65%"; Hit description=Ku70 homolog
  Pfam annotation: Domain name=Ku_C; Domain location=9-88; Score=29.4; E_value=1.3e-05; Accession=PF03730.4; Description=Ku70Ku80 C -terminal arm
MILVVNKKFYFSALQRHYAVLQALALEEDDIPEMKDETLPDEEGLARPAVVRALEEFKTSVYGDNYEEENKPGTGKPTEASKKQKAIAEFATKECENYD

SEQ ID NO: 134743 - protein, 206 aa, Glycine max
  Coding DNA Sequence Number=SeqID_17965
  Gene Ontology: Mol. function=galactosyltransferase activity; Cellular component=membrane; Biological process=protein amino acid glycosylation
  Homolog annotation: Hit_ID=Q10BV0; Match level="QueryCoverage=100%, HitCoverage=29%, E-value=2e-65, Identity=58%"; Hit description =Galactosyltransferase family protein, putative, expressed
MQWGSALRCEGWKSRADEETVDPTSSPSGIKFLLVLTKGALFYIGVDFGVGTVCAWIRDDNNRSEEWKATWWLNRLIGRKKKVTVDWPYPFAEGKLFVLTISAGLEGYHGFALEDATGLSINGDVDVHSIFAASLPTSHPSFAPQMHLELLPQWKALPLRNMNVELFIGILSAGNHFAERMAVRKSWMQHKLIQSSHVVARFFVAL

SEQ ID NO: 134744 - protein, 123 aa, Glycine max
  Coding DNA Sequence Number=SeqID_17966
MFQPYGISIDLKEHSNPVTPKAYTPKSPSGPLPPDSDSSGFLRERKRLQCEGFFSQFRHDIEIPNGENARNCVANMILKFHDDPTVNGFEIVVFLRLVWWAAGKRKGFERRRGKTKMRPKGGS

SEQ ID NO: 134745 - protein, 180 aa, Glycine max
  Coding DNA Sequence Number=SeqID_17967
  Gene Ontology: Mol. function=galactosyltransferase activity; Cellular component=membrane; Biological process=protein amino acid glycosylation
  Homolog annotation: Hit_ID=Q6ZKZ3; Match level="QueryCoverage=99%, HitCoverage=27%, E-value=7e-80, Identity=73%"; Hit description =Putative beta-1,3-galactosyltransferase 5
  Pfam annotation: Domain name=Galactosyl_T; Domain location=1-139; Score=-57.9; E_value=0.01; Accession=PF01762.12; Description =Galactosyltransferase
MDHYDLVVLKTIAICEYGIHTVASKYIMKCDDDTFVRVDSIINEARQIQSRSLYMGNMNYHHRPLRHGKWAVTYEEWVEEEYPIYANGPGYIVSADIAQFIVSEFEKRKLKLFKMEDVSMGMWVEQFNSTRPVEYVHNLKFCQFGCFEEYYTAHYQSPRQMTCMWEKLQHQGKPLCCNMR

SEQ ID NO: 134746 - protein, 246 aa, Glycine max
  Coding DNA Sequence Number=SeqID_17968
MERRSLGVTPRRRSGCGAQGELSLLLQISLIAQSNSSRLGFPTLITALCKARGVTSNSLTFESLSPAINLAYIKKNCWNLDEPSITFPGTQKSRARRSEASSSSAAHAPPTLAPSTSALPSVPAAPVLPGPSVQSLEPFMSMLQSLHQGELLIMQSLQDVVQQRPVMSLKEFVQKVAWPGVQPSPLGGVAATPQVTPEPSTTVLDMSSSQPESSAPVPYLPLSQDSPSGTTALDLNKHAMDSAQDH

SEQ ID NO: 134747 - protein, 427 aa, Glycine max
  Coding DNA Sequence Number=SeqID_17969
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=26%, E-value=1e-150, Identity=58%"; Hit description =Chromo
  Pfam annotation: Domain name=RnaseH; Domain location=25-144; Score= -25.0; E_value=0.012; Accession=PF00075.14; Description=RNase H
  Pfam annotation: Domain name=rve; Domain location=274-426; Score =83.6; E_value=6e-22; Accession=PF00665.16; Description=Integrase core domain
  Pfam annotation: Domain name=zf-H2C2; Domain location=214-255; Score =7.0; E_value=0.043; Accession=PF09337.1; Description=His(2)-Cys(2) zinc finger
  Pfam module annotation: Pfam domain module=RnaseH::rve::zf-H2C2; Domain location=25-144::274-426::214-255
DKAFEALKLALTTAPVLAIPNFAAPFVLETDASGSSIGVVLSQNKHPIAYFSKKLSLRMQKQSAYAREFYAITESLSKFRHYLLGQKFIIKTDQKSLKELLDQTLQTPEQQQWLPKFIGYDFIIQYSPGKENIPADALSRSFAMAWSEPSNTWLQTVAAATKNDESLMKIYQLCSNNAGKSGDYVLHQDVIIWKGRIMLPNDSQLLKMIMTEFHASKVGGHAGTTRTIVRINAQFYWPKMREDIRKFVQECVICQQAKVTHSLLPAGLLQPLPIPNMIWDEIAMDFITNLPLSHGYSNIMVVVDRLSKFVHFIPLKPGFNSKIVAEAFIHNIVKLYGFPKSIVSDRDRVFISSFWKQMFKSQGTNLAMSSSYHPQSDGQTENLNKRLEMYLRCFVFVHPKNWLEMLPWAQYWYNSSFHHSIRSLHTK

SEQ ID NO: 134748 - protein, 180 aa, Glycine max
  Coding DNA Sequence Number=SeqID_17970
  Subcellular localization annotation: CTP_CleavageSite=72; ConfidenceScore=5.28e-01
MNCVFVHVSSTFEFGAMRSDCLVNFSILNLFRSPMNCVFVHASSTFDFGVMRSDCLVQFSILNLFRSPMNCVFVHVSSTFEFGAMRSDCLVQFSILTLFRSPMNCVFVHVSSTFEFGAMRSDCLVQFSILTLFRSPMNCVFVHVSSTFEFGVVLHDCLSADPQGNSPFSPFFRSPMNVIA

SEQ ID NO: 134749 - protein, 38 aa, Glycine max
  Coding DNA Sequence Number=SeqID_17971
MKYDSGIVQVLSSSSLCGDEGWEAEPRGVGLGHLRNLV

SEQ ID NO: 134750 - protein, 173 aa, Glycine max
  Coding DNA Sequence Number=SeqID_17972
SYRFILLARSGALAEFEQKATTSWPHKPYETTRFTSEGAWERYSQNIHSRNILSERNVNLFVTEYDEFRRELIRRNCHKALTQHMDGHIDVALVKEFYSNLYNPKDKSPKQVQVRRKLIKFDAASLNAFLETPPLIQPGEQSTLEALEEGSDYTSPDLECVIILQPCPNFSYV

SEQ ID NO: 134751 - protein, 235 aa, Glycine max
  Coding DNA Sequence Number=SeqID_17973
  Gene Ontology: Mol. function=D-alanyl-D-alanine endopeptidase activity; Cellular component=integral to membrane; Biological process=cytochrome complex assembly
  Homolog annotation: Hit_ID=Q53P98; Match level="QueryCoverage=90%, HitCoverage=39%, E-value=2e-71, Identity=61%"; Hit description =Signal peptide peptidase, putative
  Pfam annotation: Domain name=Peptidase_A22B; Domain location=1-220; Score=222.3; E_value=1.1e-63; Accession=PF04258.4; Description =Signal peptide peptidase
MHNCIVSLALRKRPKCGQKTLNLPMFGEVSIFSLVVLLFCVIFAVVWVATRRESFSWFGQDALGIGLMITVLQLARLPNIKVATVLLCCAFVYDIFWVFISPVIFQKSVMITVARGDKAGGEAIPMLLRFPRLSDPWGGYDMIGFGDILFPGLLVSFTRRFDKANKKGVVSGYFLWLVVGYGFGLFFTYLGLYMMNGHGQPALLYLVPCTLGVHLYSLPDPIMNRSNCGIGMQKR

SEQ ID NO: 134752 - protein, 91 aa, Glycine max
  Coding DNA Sequence Number=SeqID_17974
  Homolog annotation: Hit_ID=Q1S3D5; Match level="QueryCoverage=59%, HitCoverage=52%, E-value=3e-07, Identity=49%"; Hit description=Plant lipid transfer/seed storage/trypsin-alpha amylase inhibitor
MRMQNCRYSSSVGDDSGCGIGGGGGGGGVDFGEWAKQYMQRIDVRFTDMQTSGDASKSTATHPRVLFCTLTCRLALPLPLQELPTLAFSRN

SEQ ID NO: 134753 - protein, 326 aa, Glycine max
  Coding DNA Sequence Number=SeqID_17975
  Gene Ontology: Mol. function=kinase activity
  Homolog annotation: Hit_ID=Q9FGR6; Match level="QueryCoverage=73%, HitCoverage=73%, E-value=3e-22, Identity=32%"; Hit description =Arabidopsis thaliana genomic DNA, chromosome 5, TAC clone:K6A12
MDFTYPSLLSIFLLLLLPSLISSQICQKNCGKETVKYPFGSGPGCGDPRFQPHVTCSNQKLTFTTHTGSYPVTSIDYTNQVIYISDPTMSTCSCTVPSKGFGLNWDAPFTFADSTIFALVDCSMNSSSICQSNGYDDGSNSKLLCDQGTPICSLLYSCRPISTINLPISTCCVYTPVNLGPAFEMDLQKLQCPSYTGFYNFNDQQTDPEKWNYGIALKYKFSVTNDYPGSCDACERSHGVCGYGGAYNSFVCNCPNGINTTTDCFFISSYNKGFRNGVAWLIYPVAWFLVWFFLWKLRGPSSAIELVIYSQYISESLKCEHVEVED

SEQ ID NO: 134754 - protein, 169 aa, Glycine max
  Coding DNA Sequence Number=SeqID_17976
  Gene Ontology: Mol. function=D-alanyl-D-alanine endopeptidase activity; Cellular component=integral to membrane
  Homolog annotation: Hit_ID=UPI0000162C76; Match level="QueryCoverage =80%, HitCoverage=31%, E-value=3e-25, Identity=41%"; Hit description =D-alanyl-D-alanine endopeptidase/ peptidase
  Pfam annotation: Domain name=PA; Domain location=63-158; Score=67.2; E_value=5.2e-17; Accession=PF02225.12; Description=PA domain
MASSPSLAVAVVVLLLFAAAAAADDASCHHSLQLTKIKSWIDGNKDVDYNGMTAKFGSYLPEDADQAAKTPALFSDPIDCCSASASKLSGSVALCVRGTCDFTTKAAFAQSAGATAALMINDADELFEMECSNDTSVNISIPVVEITKSTGDALNKLLTSKRKGQSCNF

SEQ ID NO: 134755 - protein, 61 aa, Glycine max
  Coding DNA Sequence Number=SeqID_17977
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=peptidyl -proline hydroxylation to 4-hydroxy-L-proline
MAPAMRIVFGLLTFVTVGMIIGVPFWNNDKEAEILRLGYVKPEVLNWSPRIILLHNFLSME

SEQ ID NO: 134756 - protein, 174 aa, Glycine max
  Coding DNA Sequence Number=SeqID_17978
SAKVDVSLSELNALSECHPLSEASTPLADRRNLEGNLSRRHALCDILEFLPGIFLKIIVLRATKNLTKPTSEPCSGFHSERFDIYIAYFQKRAPTSAEKCEELEPERRNFSSSSSPFHVAFLLPSSPPLKPPLKLQNCSSFLLQNAKRSHFRSLEAHLYFMRLQISSMGGLLLT

SEQ ID NO: 134757 - protein, 179 aa, Glycine max
  Coding DNA Sequence Number=SeqID_17979
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=peptidyl-proline hydroxylation to 4-hydroxy-L -proline
  Homolog annotation: Hit_ID=Q337H1; Match level="QueryCoverage=85%, HitCoverage=49%, E-value=2e-31, Identity=48%"; Hit description =Prolyl 4-hydroxylase alpha subunit, putative, expressed
  Pfam annotation: Domain name=2OG-FeII_Oxy; Domain location=63-175; Score=7.3; E_value=0.023; Accession=PF03171.10; Description=2OG -Fe(II) oxygenase superfamily
MGSLASMNMCFFMKHDISILYRESRVMSGLSSGMFLNSKERKYPMVQAIEKRISVYSQIPIENGELMQVLRQFNLKRGGQRIATMLMYLSDNIEGGETYFPLLLRNGMPNYYDARDYVYCCGGKLVKGLSVKPIKGNAVLFWSMGLDGQSDPNSVHGGCEVISGEKWSATKWLRQTTHT

SEQ ID NO: 134758 - protein, 96 aa, Glycine max
  Coding DNA Sequence Number=SeqID_17980
MAGVDGDPVLRGTRIRATWGYVSSVEELICAIARSPPSTTYDGVVPGDMSRGSGDLGDVRRAPGSQPIKEQRPQSKEACVVAGQLWILSDIWNMTS

SEQ ID NO: 134759 - protein, 93 aa, Glycine max
  Coding DNA Sequence Number=SeqID_17981
  Gene Ontology: Mol. function=magnesium ion binding; Cellular component=chloroplast; Biological process=metabolic process
  Homolog annotation: Hit_ID=Q6EJ97; Match level="QueryCoverage=74%, HitCoverage=11%, E-value=3e-30, Identity=88%"; Hit description =Isoprene synthase
MGLTSKLEFVRDRLMEVYFWVLGMAPDPQFSECRKVVTKMFGLVTIIDDLYDVYGTLDEIQLFTDAIERGFRSMTKQCHAAKLFSKHMKFDEQ

SEQ ID NO: 134760 - protein, 429 aa, Glycine max
  Coding DNA Sequence Number=SeqID_17982
  Gene Ontology: Mol. function=triacylglycerol lipase activity; Biological process=lipid metabolic process
  Pfam annotation: Domain name=Lipase_3; Domain location=16-181; Score =34.1; E_value=4.7e-07; Accession=PF01764.16; Description=Lipase (class 3)
MGCGCGWVGVLVCSGVIAIRGTETPEDLITDGLCKECTMSVDDLAGLINCNYIHSNIKKNVTSPFPHYGHSGIVEAARELFMQIEGNPEGPDSESYGLLSKLLGFGCECFGYNVCIVGHSLGGAIAALLGLQLYNRYPNLHVYSYGPLPCLDLVVANACSEFVTSIIFGNEFSSRLSTVRLRAAAITSLSQDPKADSAMIFKLAHRFLDVSKYQRNKSKAEDEPEYHSGAIQADLNHQIRRSQCETDNKAGSIEQEVQAIRRDLVTADYGEYMNPFGSEDCLNNGHEQCSLWSDTRARDHIIEIDSSEFPNPFAIDAHSNHDPVSQFIDTVPNSENPSADDPPELYLPGFVIHVVLEKKRPQTDLKTSWRMLEREKCYRAYIANRESFKDIIVSPSMFLDHLPWRCHDALQKILKAQTAKDQVTEPHII

SEQ ID NO: 134761 - protein, 132 aa, Glycine max
  Coding DNA Sequence Number=SeqID_17983
MSRQEKYFVEVEAQEESPVKEHESREKDEEQVQQQWEKYSTVENQQESILQINNLPHQLIVKKGRQGEHEETLSAILSLITNTFLEMIWNVLPDYMKFMEFLAKSPFAKCQLHAKRILGHALCQESKALSPQ

SEQ ID NO: 134762 - protein, 161 aa, Glycine max
  Coding DNA Sequence Number=SeqID_17984
  Gene Ontology: Mol. function=carboxypeptidase activity; Cellular component=membrane; Biological process=auxin mediated signaling pathway
  Homolog annotation: Hit_ID=Q8S6X8; Match level="QueryCoverage=99%, HitCoverage=48%, E-value=1e-32, Identity=42%"; Hit description =Putative nodulin-like protein
  Pfam annotation: Domain name=DUF6; Domain location=1-111; Score=16.8; E_value=0.0073; Accession=PF00892.11; Description=Integral membrane protein DUF6
MAGNYIFGKDVLNHGMSRFVFIVYRNAMATIALAPFAFFIERPVFNQSFNYLGMKYTSASFTSTIVNAVPSITFVLAVFVRLEHLRLREVRSQAKVIGTLVTFGGALLMAIYKGPAFNLFQSGSTTHHENGSTSSHNSHQTAGAIYILMGCVALSSFYILQ

SEQ ID NO: 134763 - protein, 69 aa, Glycine max
  Coding DNA Sequence Number=SeqID_17985
SHMLSNWGAGCICFALWNTFSGNVMDLINDAHKWFERKHGNSLRNLGIPVGTVSFGVLRSEKNSPWGQG

SEQ ID NO: 134764 - protein, 164 aa, Glycine max
  Coding DNA Sequence Number=SeqID_17986
  Homolog annotation: Hit_ID=Q10X65; Match level="QueryCoverage=45%, HitCoverage=72%, E-value=8e-08, Identity=44%"; Hit description =Glutaredoxin 2
  Pfam annotation: Domain name=DUF836; Domain location=45-159; Score =53.2; E_value=8.8e-13; Accession=PF05768.4; Description=Protein of unknown function (DUF836)
  Subcellular localization annotation: CTP_CleavageSite=56; ConfidenceScore=5.60e-01
MVVGSALGAFAVARPSSPLFLLRGQTAFKFRPLSSSSFGAAPSRKLVLYSKPGCCLCDGLKEKLQAAFLLLGTDSLHGVDLQATLFLSRTLDITTNPEWENAYQYEIPVLAKVLSDGTEEPHSHDKVNIGGKIIPERRQGNMIRDNSSQNRDDVLRLLSQVVFT

SEQ ID NO: 134765 - protein, 184 aa, Glycine max
  Coding DNA Sequence Number=SeqID_17987
  Gene Ontology: Mol. function=nucleic acid binding
  Homolog annotation: Hit_ID=Q9M3Y5; Match level="QueryCoverage=97%, HitCoverage=86%, E-value=9e-66, Identity=74%"; Hit description=25.7 kDa protein
MFHCYWIKGSSLRSTASSIHCPMTCLYANPKVGKDQPPDLAALVPSGLIVLPDQPQKQSSSQVPEDANHVSMDNGTNTVSAKVVKPSSGRKSSKGTPAKNVNSSGSFADAGQFVEEILQKTSQLLLSEVKDENIKLHGEQLGTVLSDKLLKNLNAEFKNLAMIFKNTAYTEGFHAGTHYRPPLM

SEQ ID NO: 134766 - protein, 524 aa, Glycine max
  Coding DNA Sequence Number=SeqID_17988
  Gene Ontology: Mol. function=RNA-directed DNA polymerase activity; Cellular component=chromatin; Biological process=chromatin assembly or disassembly
  Pfam annotation: Domain name=Chromo; Domain location=427-482; Score =23.1; E_value=0.001; Accession=PF00385.14; Description='chromo' (CHRromatin Organisation MOdifier
  Pfam annotation: Domain name=zf-H2C2; Domain location=266-307; Score =18.6; E_value=0.0012; Accession=PF09337.1; Description=His(2)-Cys(2) zinc finger
  Pfam module annotation: Pfam domain module=Chromo::zf-H2C2; Domain location=427-482::266-307
  Subcellular localization annotation: CTP_CleavageSite=28; ConfidenceScore=5.23e-01
MNENTELFPLAFFFSSSSSGGVGPRSQLCKLNVSFWCFLGLAGFYRRFIRGYTSIAAPLVHLTTLDHFEWTPQAQTTFDQLKHALFEAPVLALSDFQFPFTIDKNASSVGMRAILSQCNHPIAFFSKPFSPKFQRALAYVHELFAITATVKKWHQYLLGHRFTIITDHRSLKELLTQVIQKLEQHMYLARLMGYDYQIQYHFGVHNQAADALSRCFDHDSSTLMSLSVPCPLFFEELRRQLDDHSEGRIWLPKGLSLIPTLLIEYHSTPAGGHMGIAKTIARLLENFDWPGLRENVTNFVSQCIDCQFPIGIHLGMLPPTHTSHAVVFLFMEIMGKLHGLPRSLVIRKKLLKVQERMKTIANAKPREVTYQPDDWVMLKLRPHRQASAKGPHAFMGKLVKRFYDPFQVLERIGTIAYCLNLPEGPVITPLAILDYRRTSAQGPWEVLVQWEGLSPDDTSWEDWTQLCEDYHLEDKVRIEGKAKRAITKPSYSDRKKVLQKEETSLLRPKRKTESRLSWKWDLVV

SEQ ID NO: 134767 - protein, 236 aa, Glycine max
  Coding DNA Sequence Number=SeqID_17989
  Gene Ontology: Mol. function=transcription factor activity; Cellular component=nucleus; Biological process=regulation of transcription, DNA-dependent
  Homolog annotation: Hit_ID=Q8LDL8; Match level="QueryCoverage=82%, HitCoverage=77%, E-value=1e-24, Identity=39%"; Hit description=TINY -like protein
  Pfam annotation: Domain name=AP2; Domain location=38-102; Score =122.6; E_value=1.1e-33; Accession=PF00847.10; Description=AP2 domain
MPSIMVKLEHKIKTEPSSKEMRLSSLSSSASTSSDCKKKKYKGVRMRSWGSWVSEIRAPNQKTRIWLGSYSTPEAAARAYDAALLCLKGSSANLNFPLSSSQQYIPGEAVMSPKSIQRVAAAAANSFIDNANTPPSPPPASNPSSLASSPSLVSSPSDQIDDNASLISSFEAYTSCDQANQPMTMNVMEPWYTFADGLQSPKYVDQMLSGAFFDFDSSHLFDDLYEESDIRLWSFC

SEQ ID NO: 134768 - protein, 333 aa, Glycine max
  Coding DNA Sequence Number=SeqID_17990
  Gene Ontology: Mol. function=metal ion binding; Biological process =cell redox homeostasis
  Homolog annotation: Hit_ID=Q6Z303; Match level="QueryCoverage=73%, HitCoverage=66%, E-value=2e-34, Identity=34%"; Hit description=Zinc finger-like
  Pfam annotation: Domain name=PHD; Domain location=220-264; Score= -2.4; E_value=0.099; Accession=PF00628.19; Description=PHD-finger
  Pfam annotation: Domain name=zf-C3HC4; Domain location=221-261; Score= 39.0; E_value=1.6e-08; Accession=PF00097.15; Description=Zinc finger, C3HC4 type (RING finger)
  Pfam annotation: Domain name=zf-MIZ; Domain location=217-264; Score= -10.6; E_value=0.03; Accession=PF02891.10; Description=MIZ zinc finger
  Pfam module annotation: Pfam domain module=PHD::zf-C3HC4::zf-MIZ; Domain location=220-264::221-261::217-264
MSLSPPRERNNNGNAQARTFQLYYCFQCNRTVRAAPDNNNPTQITCPRCFGQFICEINMPRPRLVVDFTTPDPSPEARLLEALSLMMDPPIRRFPGLIQPQPEELPVYHRHRRPRRRHPEPEPEPQHRPRTWIVFQPMDPSNPFEPINIPNRRGPGPIHGPGPIPRGLDARDYFFGPGLNELIEQITENDRQGPAPAPERAIEAIPTVKIESAHLKENSQCPVCQEEFEVGGEARELQCKHIYHSDCIVPWLRLHNSCPVCRHEVPVPSSSSSSEGDECVGDGGEGRLQRCLRWTRRFTSLWPFNARYRRRVHPQGNNTTVAASSSRGESYFI

SEQ ID NO: 134769 - protein, 65 aa, Glycine max
  Coding DNA Sequence Number=SeqID_17991
  Homolog annotation: Hit_ID=Q948Q7; Match level="QueryCoverage=89%, HitCoverage=16%, E-value=3e-11, Identity=55%"; Hit description =Anthocyanin-related membrane protein 3
MWAVLIRIFAYHEKVDWMYYVAFGAVVVGLIIYSGGDGDENQDPHHVAEDASQRQHDEEATSENL

SEQ ID NO: 134770 - protein, 653 aa, Glycine max
  Coding DNA Sequence Number=SeqID_17992
  Gene Ontology: Mol. function=protein binding
  Homolog annotation: Hit_ID=Q93YP4; Match level="QueryCoverage=77%, HitCoverage=59%, E-value=2e-55, Identity=33%"; Hit description=Epsin- like protein
MVAGTENRTSNSDAWWCLAQTLEEEQWLGIGHSGVIRLTWWLKEGGRERGSSAKAEDHSLEGRLERKLSEQNVDAPPSYEEAVSQSPLHYERDGEISAASAPKGSSPKSDNPHQKTSAPTGSSLVSDNPIEATAAASTGTSENREVEAFDEFDPRGHLVSAAPAPANNVEMDLLGSLSYSFSSNALALVPSASETTTSQGNANLESTASFALPPSASNNFNPVFEDPFGDSPFKAGPSTETAPSHPQTHQGLAPSLSSGPNTESVSNFRFGVSFSVPSANETKLLSMSPPSQETDILADILPPAPLPGTTSQQNFSAPPDAQFLSSFSASSGQMAPQSFFTQSGQHVQQDFSAVTSQPAAQSFSAPGGQPLQPPPSVPTSQHAQQPFPSHTDQSAQSVSHIYGGFPSLAAGSMTQEASSAMFPQSQGGHMNQTYEQGSMPLIPLHTAPQASTGQSANYLSSQSPIDQASQFNSGNLSGQSFNHQPLGQGVHASQNAVSQPPKDKFETKSTVWADTLSRGLVNLNISGPKINPLADIGVDFDAINRREKRMEKPTTTTVTSTVTMGKAMGSGSGMGRAGVGALRPPPNPMMGPGVGMAHMGMGGYGGMNVPMGMVQMQPPPFGFPPGSNMPGNYNSMMRRGGYPQHPYSGGGYR

SEQ ID NO: 134771 - protein, 241 aa, Glycine max
  Coding DNA Sequence Number=SeqID_17993
  Gene Ontology: Mol. function=hydrolase activity
  Homolog annotation: Hit_ID=UPI00005FAA28; Match level="QueryCoverage =96%, HitCoverage=91%, E-value=1e-70, Identity=58%"; Hit description =COG3228: Uncharacterized protein conserved in bacteria
  Pfam annotation: Domain name=DUF980; Domain location=1-236; Score =194.6; E_value=2.4e-55; Accession=PF06167.2; Description=Protein of unknown function (DUF980)
MAVACTKRCCRDCPALATGAGAADLFSAEQRRTAGAGSAGATLPAAEKNHPAARTGTQRAAPDSPVVAVLPAVLIYPEPFSVDDRWEDDSGLVHHAPAVHAGQSWTQGPVVLNALDIQDSYDLSGYNLVIHEVAHKLDARGSGYTSGIPAIALRDVASWEKDLLQAMAEIEAEVELVGEQAATLDPYAASDPAECFAVLSEYFFSAPDLLASRFPAMYRHLQQFYHQDPLARLAQQAPESA

SEQ ID NO: 134772 - protein, 78 aa, Glycine max
  Coding DNA Sequence Number=SeqID_17994
MAEGVQTDSHFLNNFFTMNMNSESPKEAYRKAWQKQYGATSWEPLPPRRRDSAPPFPPRQFAIPVTDKSAANRLNKRL

SEQ ID NO: 134773 - protein, 166 aa, Glycine max
  Coding DNA Sequence Number=SeqID_17995
MKYRITQCFDQEYKRIPRKGAKGYFLVFSGPQVAQVLLAWASCNYPQSDPLPINRRPRGVLKGSKGQKWRQLREERKKKKERRGNEAEALPNRNCDHSPRRFLVLCSSCDRRLVLFLGIECDLCTLMMQSYPARALDRRPQVEWAKDAREGPRVLMSLRVDFGPMG

SEQ ID NO: 134774 - protein, 140 aa, Glycine max
  Coding DNA Sequence Number=SeqID_17996
MLQCEGYFSYLIRDIEITNGENARKWVVNLLFKFHEDPSVNEFEIVIFLRQTSMSSVIYAFKDYIVFIYISKTSMSSFIYAFKDYNVFIYISKTSTSSIIYAFKDYNVFMSSVIYAFKDYNVFIYIYKTSMSSFFYIYKT

SEQ ID NO: 134775 - protein, 81 aa, Glycine max
  Coding DNA Sequence Number=SeqID_17997
MENWRTALGNQFAGLQTRWWRMHECYNQFMGLRIKGSRLVGGGCMNDNQFMGLRIKVENGELANSARQSIRAAPDSLVEDA

SEQ ID NO: 134776 - protein, 87 aa, Glycine max
  Coding DNA Sequence Number=SeqID_17998
  Gene Ontology: Mol. function=RNA-directed DNA polymerase activity; Biological process=RNA-dependent DNA replication
MVNLAVGKKLWKPIQISRGDLTFSHLAFTYNLILFAKASVDQVDVINFAIRNFCESSGAKIKEKISADFGFQCTDNLGKYLDVPIFH

SEQ ID NO: 134777 - protein, 507 aa, Glycine max
  Coding DNA Sequence Number=SeqID_17999
  Homolog annotation: Hit_ID=Q10MF5; Match level="QueryCoverage=37%, HitCoverage=42%, E-value=4e-17, Identity=32%"; Hit description =Expressed protein
  Pfam annotation: Domain name=DUF247; Domain location=39-475; Score =98.3; E_value=2.2e-26; Accession=PF03140.6; Description=Plant protein of unknown function
MTELVKNTEQFQTMGEDANLKRWRETTKSLLDAVDNLYCQPYSICVVPEELRKQNESAYEPKVVSIGPRFKGKRELQQMEEIKWRCMLCLLSRTKGDGTKILETCMREMLELDATVRACYGEEIKLNRYDLATIMVYDGCFLLELAISKEKDWSAVFPQQSVSVSVSDLGTKVGEMEAVLTDLTLLENQIPFFILDKLFQILFPGSNLSSSIEIMVLLLWQQQLPKRIYPAHVVELVHSTFLWMHDIPIRDASSVVVDVDDYSVIIKQVKLNRCAARLIAAGVTIRLHPGSDNSIMFRIHDFSVQFSYNNGVLLIPHLRITQTTEPKWRSFIAWEHHRNKSKNEEFGNSTEQDGIEYANVFTFLALLFNDLICCASDVQILKNKGIIKDELGMSNHEVVDFFGSVANGIDRGHVGSGYSNIIDALNTFSATNFVTRFPIIACHDLSRITEWIYGLQKFLRRGYNFAAALITLLTVVQTCYAVLAYHYPHEDDNKNLFNTTQIHAKIN

SEQ ID NO: 134778 - protein, 195 aa, Glycine max
  Coding DNA Sequence Number=SeqID_18000
  Gene Ontology: Mol. function=ribonuclease H activity; Biological process=RNA-dependent DNA replication
  Homolog annotation: Hit_ID=Q1RYI2; Match level="QueryCoverage=57%, HitCoverage=17%, E-value=4e-12, Identity=38%"; Hit description =Ribonuclease H
MKIIRILYSRQFGDGRDPKGLGFTCGKLLGVLLMNNNRHGRVISNSALCPMCNVESESILHCLRDCVIAKDVWSKISDNWLNEDFFLMSLKEWLLFNFANQKEINNAAWSTIFGVNGCPCSHNCYYQLVKAIHDVSSECVILGCRHIYGKANQMADVLSKHGLTLMGSRIFEWVPDFLSVCVLANVISTSFPSGF

SEQ ID NO: 134779 - protein, 122 aa, Glycine max
  Coding DNA Sequence Number=SeqID_18001
MGLGLGLGLGLGLNVGFLGLLILVIVVVNIEEELLFVFVFVFVLGDDGREAVNGGTEKGGVGSESESDQVFRSAPATSTGTIQLSPHCTKWEELRFIIRRWMLRFWPLDPGLDGYIWSSDRD

SEQ ID NO: 134780 - protein, 123 aa, Glycine max
  Coding DNA Sequence Number=SeqID_18002
  Homolog annotation: Hit_ID=Q948Q9; Match level="QueryCoverage=78%, HitCoverage=19%, E-value=3e-16, Identity=51%"; Hit description =Anthocyanin-related membrane protein 1
  Pfam annotation: Domain name=DUF914; Domain location=2-123; Score= -175.9; E_value=0.00069; Accession=PF06027.3; Description=Eukaryotic protein of unknown function (DUF914)
  Subcellular localization annotation: CTP_CleavageSite=74; ConfidenceScore=5.13e-01
MATFEQFWSRKTLLGLALGQFLSLLITSTGFTSSLLAKKGINAPTSQSFLNYVFLAIVYGIIVLYRREALKIRRQEAIGGGMFIIINPFILNDKHLVKQGLILVAKWYYYILLGLVDVEANFL

SEQ ID NO: 134781 - protein, 55 aa, Glycine max
  Coding DNA Sequence Number=SeqID_18003
MTINKNQTVNNPVPGSGKCDDLKREKRLNLQRLLRFVDDGVVLSGKSGHGSGNGR

SEQ ID NO: 134782 - protein, 98 aa, Glycine max
  Coding DNA Sequence Number=SeqID_18004
MTKKVIEIDEVAIQDVVSLFEGDVDDDDVDAIFYQWFEKVVAILKGLESYDDDGAEKCGVVSNSEDEFSWTEILDIGPRSLDNPILYSSYTICLGQCS

SEQ ID NO: 134783 - protein, 34 aa, Glycine max
  Coding DNA Sequence Number=SeqID_18005
MSAENISRGNVRSASSDDASVLNLDRLTFLADVG

SEQ ID NO: 134784 - protein, 301 aa, Glycine max
  Coding DNA Sequence Number=SeqID_18006
  Gene Ontology: Mol. function=protein dimerization activity; Cellular component=nucleus; Biological process=regulation of transcription, DNA-dependent
  Homolog annotation: Hit_ID=Q1S0T5; Match level="QueryCoverage=94%, HitCoverage=71%, E-value=1e-105, Identity=67%"; Hit description=BZIP transcription factor, bZIP_1
  Pfam annotation: Domain name=bZIP_1; Domain location=43-100; Score =23.6; E_value=0.0004; Accession=PF00170.11; Description=bZIP transcription factor
  Pfam annotation: Domain name=bZIP_2; Domain location=43-93; Score =24.1; E_value=0.00048; Accession=PF07716.5; Description=Basic region leucine zipper
  Pfam module annotation: Pfam domain module=bZIP_1::bZIP_2; Domain location=43-100::43-93
MADASPRTDISTDVDTDDKNPRFDRSQSLVAVASDSSDRSKDKSDQKSLRRLAQNREAARKSRLRKKAYVQQLESSRLKLTQLEQELQRARQQGIFISNSGDQAHSMSGNGDTELRMIIDGIMAHYDEIFRLKANAAKADVFHLLSGMWKTPAERCFLWLGGFRSSELLKLLVNQLEPLTEQQLVGITNLQQSSQQAEDALSQGMEALQQSLSETLSTGSLGSSGSSGNVANYMGQMAMAMGKLGTLEGFIKQADNLRQQTLHQIHRILTTRQSARALLAIHDYFSRLRALSSLWLARPRD

SEQ ID NO: 134785 - protein, 507 aa, Glycine max
  Coding DNA Sequence Number=SeqID_18007
  Gene Ontology: Mol. function=oxidoreductase activity; Cellular component=membrane; Biological process=electron transport
  Homolog annotation: Hit_ID=Q9LF95; Match level="QueryCoverage=98%, HitCoverage=98%, E-value=0.0, Identity=62%"; Hit description =Cytochrome P450-like protein
  Pfam annotation: Domain name=p450; Domain location=32-497; Score =316.0; E_value=6.8e-92; Accession=PF00067.12; Description=Cytochrome P450
MEYEVVSLLALTILILVWRMLMDRRRQHGKLPPGPRCWPVVGNIFQLAGWLPHESLAKLAHKHGPIMTLWLGSMCTVVISSSQVARHMFKNHDVILAGRKIYEAMRGDHGSEGSLITSQYNSHWRMLKRLCTTELFVTTRLDAMQGVRAKCIHRMLHLIQQAGQSGTCAVDVGRFFFLMDFNLIGNLIFSKDLLDSEMERGDCFYYHALKVMEYAGKPNVADFLPILKGLDPQGIRRNTQFHVNQAFEIAGLFIKERMENGCSETGSKETKDYLDVLLNFRGDGVTEPYTFSSRTINVIVFGIGTDTTTSTIEWAMAELLHNPKALKKVQMELRSKIGPDRNMEEKDIENLPYLQAVIKETLRLHPPLPFLVPHMAMDSCNMLGYNIPQGSQILVNVWAIGRDPKVWDAPLLFWPERFLKPNTMDYKGHHFEFIPFGSGRRMCPAMPLASRVLPLAIGSLLHSFDWVLPDGLKPEEMDMTEGMGITLRKAVPLKVIPVPYKEPAANE

SEQ ID NO: 134786 - protein, 136 aa, Glycine max
  Coding DNA Sequence Number=SeqID_18008
  Homolog annotation: Hit_ID=Q1SPB5; Match level="QueryCoverage=21%, HitCoverage=20%, E-value=8e-08, Identity=80%"; Hit description=ENT
MMIFLLPINVEIDFNDKNMLLELEMEWRKGNGLQPGTVSTAQKVHDRNTSPTVSASHKKQKTSKSVASLSLGALSPAVDPSMQPSSFALKHGPPSGTKTKKQKSQKDLLKQLLMIPELEAKFGQGGLKTTTSMKLL

SEQ ID NO: 134787 - protein, 55 aa, Glycine max
  Coding DNA Sequence Number=SeqID_18009
MDHVGVDTEGFLDRPQDASVLTSYADYMLKLASRGRKVEKFGRPAHEIEGIMTAT

SEQ ID NO: 134788 - protein, 595 aa, Glycine max
  Coding DNA Sequence Number=SeqID_18010
  Gene Ontology: Mol. function=transporter activity; Cellular component= membrane; Biological process=oligopeptide transport
  Homolog annotation: Hit_ID=Q1T4L2; Match level="QueryCoverage=97%, HitCoverage=90%, E-value=0.0, Identity=69%"; Hit description=TGF -beta receptor, type I/II extracellular region
  Pfam annotation: Domain name=MFS_1; Domain location=51-522; Score =0.5; E_value=0.0003; Accession=PF07690.6; Description=Major Facilitator Superfamily
  Pfam annotation: Domain name=PTR2; Domain location=113-510; Score =328.9; E_value=9e-96; Accession=PF00854.12; Description=POT family
  Pfam module annotation: Pfam domain module=MFS_1::PTR2; Domain location=51-522::113-510
MATSFSANSPNIAANKLIEGDSSNREESVIMKRSSRAGEKKTGGAKVARLLLVNQALATLAFFGVGVNLVLFLTRVLGQDNVNAANNVSKWIGTVYMFSLIGAFLSDSYWGRYLTCTVFQLVFVLGLALSSLSSWRFLINPVGCGDGHTLCKPSSIGDEIFYLSIYLVAFGYGGHQPTLATFGADQYDEKNPKEKSSKVAFFCYFYFALNVGSLFSNTVLVYYEDTGMWTMGFLVSLVSAVIAFLAFLLGTPRYRYVKPCGNPVVRVAQVFTAVFRKWKVSPAKAEELYEVDGPQSAIKGSRKIRHTDDFEFMDKAATIKETEEHSPKNPWRLCTVTQVEEAKCVLRMLPVWLCTIIYSVVFTQMASLFVEQGDVMNSYIGSFHLPAASMSAFDIFSVLVCTGIYRQILVPLAGRLSGNPKGLSELQRMGIGLIIGMLAMVASGATEIARLRRISHGQKTSSLSIFWQIPQYVLVGASEVFMYVGQLEFFNGQAPDGIKSFGSSLCMASISLGNYVSSMLVNMVMIITARGQNKGWIPENLNTGHMDRFFFLLAGLAAFDFVLYLFCAKWYKNINIEDSDMGDQEEELEDVNSKV

SEQ ID NO: 134789 - protein, 371 aa, Glycine max
  Coding DNA Sequence Number=SeqID_18011
  Gene Ontology: Mol. function=protein binding; Cellular component=Smc5- Smc6 complex; Biological process=double-strand break repair via homologous recombination
  Homolog annotation: Hit_ID=Q9LT44; Match level="QueryCoverage=75%, HitCoverage=71%, E-value=4e-71, Identity=49%"; Hit description =Arabidopsis thaliana genomic DNA, chromosome 3, P1 clone: MOE17
  Pfam annotation: Domain name=Nse4; Domain location=22-302; Score =10.5; E_value=1.6e-13; Accession=PF08743.1; Description=Nse4
MTGSRRGNGDGGENVRKAASEQNPATRRVIRSQFLQLKNLINEKRDDLMNTESDKFDTILDEFDKLHLHTTSTWTFAVEKPREQVADAEALLDLTRTLVGSVKSLANEGVTPSQFVSSLLIRYAHTQHSIDWHKLGLAASPIFLSVHGSSTMLGPMDNQFKQRKMGVRRNRDPRQIATTRPQQLDEAVTEEKTDTDKNMATMFHILRRTKRVPLENLILNRESFAQSVENLFALSFLVKDGRAEISLDENRLHYVSPKNAPAANLVSSKEVSYTHFVFRYDYQDWKLMKDVVPDGKELMPQRTQICTVVASQEGMGGDDSQPALAVTPIRKLSRNRGRVVQEEGVVEESPECDEENASREGAIRRCKRRLR

SEQ ID NO: 134790 - protein, 77 aa, Glycine max
  Coding DNA Sequence Number=SeqID_18012
MEQPIDQQNKEIHVEDQTNLSLIVRRIQTQVSKMQMDHTEEVISLWRKNAHLRECHRSWQPEANLPEEGEAELTTVN

SEQ ID NO: 134791 - protein, 160 aa, Glycine max
  Coding DNA Sequence Number=SeqID_18013
MDYPDPSFHDAKVESNKVGSTNIQRLSIASRLIQGCFNKHSKNTCLLPLPNWYYLFLYGSGLTGKRTRSPRSSFYTEEEESREIACLQRSGMSPPPLGISQSLKNSLISLKDENLAPCSALRSLKFTLFRPLSSEQFSFHSPCSVQIRLKKYWNKWSWNN

SEQ ID NO: 134792 - protein, 38 aa, Glycine max
  Coding DNA Sequence Number=SeqID_18014
MAFVHSRSKESFINMAAGANEEATHRVGHDERQPLLPS

SEQ ID NO: 134793 - protein, 339 aa, Glycine max
  Coding DNA Sequence Number=SeqID_18015
  Gene Ontology: Mol. function=protein-tyrosine kinase activity; Cellular component=membrane; Biological process=protein amino acid phosphorylation
  Homolog annotation: Hit_ID=Q84P43; Match level="QueryCoverage=90%, HitCoverage=91%, E-value=1e-150, Identity=81%"; Hit description =Protein kinase Pti1
  Pfam annotation: Domain name=Pkinase; Domain location=70-325; Score =20.2; E_value=9.2e-10; Accession=PF00069.15; Description=Protein kinase domain
  Pfam annotation: Domain name=Pkinase_Tyr; Domain location=58-325; Score=31.1; E_value=2.2e-14; Accession=PF07714.7; Description =Protein tyrosine kinase
  Pfam module annotation: Pfam domain module=Pkinase::Pkinase_Tyr; Domain location=70-325::58-325
MGCYGIQIVECFSIAAFVAAIGAFHLPFCHGNQKGSKVSAPVKPETQKAPPPIEAPALSLDELKEKTDNFGSKALIGEGSYGRVSMVSRLKNGNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPDFFCVAKLYRYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAPAAPES

SEQ ID NO: 134794 - protein, 559 aa, Glycine max
  Coding DNA Sequence Number=SeqID_18016
  Gene Ontology: Biological process=nuclear mRNA splicing, via spliceosome
  Homolog annotation: Hit_ID=Q53MI2; Match level="QueryCoverage=48%, HitCoverage=59%, E-value=9e-54, Identity=44%"; Hit description =Survival motor neuron (SMN) interacting protein 1 (SIP1), putative
  Pfam annotation: Domain name=SIP1; Domain location=160-431; Score =180.8; E_value=3.3e-51; Accession=PF04938.3; Description=Survival motor neuron (SMN) interacting protein 1 (SIP1)
MADVSDSREHPVLGSAQLLVELESALGGEKTVTAQASSSSLGLGIEVIDETALLDSVAKKNGGTKNNHQKSQPSNKIGNRKYSRKELEGLRFLNMARQRKFWKAIHAAFQSTVAIEDSEKGTPVDPSCSHNLVSEDGCSVAKECSEEYDGSDDDYASIQRPAFMVDGEPNFDSGPPEDGWEYLRRVRWEAHQIPKVKVAKLDRGKLNKEQSAYMPQIPDIANCPEYLLPLKEWEDVFLAEFSALRRNFSCLDGSSAIHSENLHVHSSQLVGNNCGEFSSAMSRDVLLNNHLRIGKTNDQPSNSTAENNDRTLSPENPEAKSSADQTCSSSSPTLPLLSVILAMDSVARVSSLLKRIRLLEAAGTMTRNDCMWLFALCATVDAPLDADTCASLRSLLRKCASIRAGKAGLDEEVVMLNILATISGSRRCDNKLSLPTSTSSSFEPKLEAVIDLTLLTAFQSKLGRFLSSGRDAYHKRRLVVSCRPSTLHFLGTSAALTFLAVSVFTVLAQLISRFSSWRRNASSYMPVLVRRDRSLGGKEVVVAWGQRSDTNPLSPPRIR

SEQ ID NO: 134795 - protein, 142 aa, Glycine max
  Coding DNA Sequence Number=SeqID_18017
  Homolog annotation: Hit_ID=Q1SYR3; Match level="QueryCoverage=48%, HitCoverage=2%, E-value=3e-12, Identity=50%"; Hit description=RNase H, putative
MVGQGGKVLGRETHKVPYHTVANFEPHLEYAIEWQTFGGIPLLNTLGGLQYRPQPQPLHFAVGKLPPAMVEREEFDHIEERLRAIEGGRDYAFAGMAKLCLVFDVVIPPKFKVPDFDKYKETTCPKNHLKMYRRKMGAYSKN

SEQ ID NO: 134796 - protein, 305 aa, Glycine max
  Coding DNA Sequence Number=SeqID_18018
  Gene Ontology: Cellular component=integral to membrane
  Homolog annotation: Hit_ID=Q018D5; Match level="QueryCoverage=79%, HitCoverage=95%, E-value=1e-40, Identity=40%"; Hit description=[R] KOG4758 Predicted membrane protein
  Pfam annotation: Domain name=TMPIT; Domain location=1-296; Score= -37.5; E_value=2e-08; Accession=PF07851.3; Description=TMPIT-like protein
MKNLSANVSVPSIPESIRYLDEDLQRARCIIVDGDASSLLPGHAQGSFLRMFLGPINVRASRKDVQLKVKEEYNSYRDRTALLFLLFPATLLILRSWIWSGCLPTFPVQMYQAWLLFLYTGLALRENILRVNGSDIRPWWIYHHYCAMVMALVSLTWEIKGQPDCAKKQRGVQLFLQWAMMQGVAMLLQNRYQRQRLYTRIALGKAKRMDVVWGETAGVDGQLWLLCPILFTLQGFEAYVGLLLLRTAVVGVVSEWQKLFGQVIFCGVLLVLMAVGNFANTVQTLMAKSRFKAKMRRSKSKQRLN

SEQ ID NO: 134797 - protein, 95 aa, Glycine max
  Coding DNA Sequence Number=SeqID_18019
MLRRYEDTGFINCKPAILPMDPNLKCIIYSQRRTLTKVSYFPLHPLWHLKAYADADRRNRPDTHRLTTDSCIFFLGIHSLPGNLRSNTVTRSSDR

SEQ ID NO: 134798 - protein, 79 aa, Glycine max
  Coding DNA Sequence Number=SeqID_18020
MESVIEESILKVMNDYRVPTIHHGEGVLLTIIQAKKPKTIVIWEFKWQWANQKLTHTIKIFSGHHGTTKVEVPHHNVDA

SEQ ID NO: 134799 - protein, 78 aa, Glycine max
  Coding DNA Sequence Number=SeqID_18021
MDVDEGMSRKTNEVEFMGLGVTAAIDLEEPSSNTKEKRQGSTSFGTHSHKRKIGEKEGIVASLDKMTNSFDRMVEKMD

SEQ ID NO: 134800 - protein, 432 aa, Glycine max
  Coding DNA Sequence Number=SeqID_18022
  Gene Ontology: Mol. function=transferase activity, transferring acyl groups, acyl groups converted into alkyl on transfer; Cellular component=intracellular; Biological process=carboxylic acid metabolic process
  Homolog annotation: Hit_ID=Q30DX9; Match level="QueryCoverage=89%, HitCoverage=62%, E-value=1e-155, Identity=71%"; Hit description=2 -isopropylmalate synthase 1
  Pfam annotation: Domain name=HMGL-like; Domain location=85-361; Score= 373.8; E_value=2.6e-109; Accession=PF00682.9; Description=HMGL-like
  Subcellular localization annotation: CTP_CleavageSite=34; ConfidenceScore=5.83e-01
MATVIRNPILFPSTSHHPNQNHTFLTLRFSQTLRSSLRSKSRFAVSCSQSEPPPPHPSSSRRRPPYIPNLIPDPSYVRIFDTTLRDGEQSPGASMTSKEKLDVARQLAKLGVDIIEAGFPAASKDDFEAVKMIAQAVGNAVENDGYVPVICGLSRCNEKDIRTAWEAVKYAKRPRIHTFIATSPIHMEYKLRMSKDKVVDIARNMVKFARSLGCDDVEFSPEDAGRSDREFLYEILGEVIKVGATTLNIPDTVGITMPSEFGKLIADIKANTPGIENVIISTHCQNDLGLSTANTIEGARAGARQLEVTINGIGERAGNASLEEVVMALRCGAHVNGNLYTGINTKHIFLTSKMVEEYTGLQIQPHKALVGANAFAHESGIHQGETLRIMMILGLLYFDAQKHPTCSSYLFHAWWLTIRNVLVLTLDSSVED

SEQ ID NO: 134801 - protein, 117 aa, Glycine max
  Coding DNA Sequence Number=SeqID_18023
  Gene Ontology: Mol. function=aldehyde dehydrogenase [NAD(P)+] activity; Cellular component=chloroplast; Biological process =aldehyde metabolic process
  Homolog annotation: Hit_ID=Q70DU8; Match level="QueryCoverage=55%, HitCoverage=13%, E-value=9e-12, Identity=55%"; Hit description =Aldehyde dehydrogenase 3H1
  Subcellular localization annotation: CTP_CleavageSite=24; ConfidenceScore=5.32e-01
MSSSTPDSDKTTTSSKKSAFDALAASRLVTELRGNFASGKTRSYEWRLLQLNAIAKLVVDHEQEIVDALRNDLGKPPLETVAYEGNFCLIRLVGDLSAWIAVRVSLCLRWRTRCRLV

SEQ ID NO: 134802 - protein, 78 aa, Glycine max
  Coding DNA Sequence Number=SeqID_18024
MDGKTDQAAPQRIEAKSHVQSGGYECSYYVMHWMWNIVSGGLKNDWAMWFSDGTPLDNETITTICNKWTTYFVKVKVN

SEQ ID NO: 134803 - protein, 498 aa, Glycine max
  Coding DNA Sequence Number=SeqID_18025
  Gene Ontology: Mol. function=aldehyde dehydrogenase [NAD(P)+] activity; Cellular component=chloroplast; Biological process =aldehyde metabolic process
  Homolog annotation: Hit_ID=Q70DU8; Match level="QueryCoverage=78%, HitCoverage=80%, E-value=1e-169, Identity=72%"; Hit description =Aldehyde dehydrogenase 3H1
  Pfam annotation: Domain name=Aldedh; Domain location=1-370; Score =98.7; E_value=1.8e-26; Accession=PF00171.12; Description=Aldehyde dehydrogenase family
IAMLKNSCRIALKELKHWMTPEKVKTSIATFPSSAEIVSEPLGVVLVISAWNYPFLLSLDPVIGAIAAGNAVVLKPSEIAPATSSLLAKLLGDYLDNSCIKVVEGAVDETSALLQQKWDKIFYTGNGRVARIVMAAASKHLTPVVLELGGKSPVVVDSNINLKVATRRIIAGKWGSNNGQACISPDYIITTKDYAPKLVDALKTELEKFYGKNPLESKDLSRIVNSNHFNRLTKLLDDDKVSGKIVYGGEKDESKLKISPTVLLDVPRDSLIMNEEIFGPLLPILTVDKIEESFDVINSGSKPLAAYIFTNTKKLKEQFVMTISAGGLVVNDTTLHLAVHTLPFGGVGESGVGAYHGKFTFEAFSHKKAVLYRRFIGDAPVRYPPYTNTKMRLLKALIGGGILGIIRALNQIAIEAERRPPMLSVFEQQGRPSGKELIHWLTDDEKDSVIGGVEEVNPANLLTNEEESTNLNGESNNIEQDNEGELEDDFEVYNSEEN

SEQ ID NO: 134804 - protein, 81 aa, Glycine max
  Coding DNA Sequence Number=SeqID_18026
MVEQRSREAQRDEDVREVRDALTCGARTRKGSKKYLRSTKLRQERGLRAIGQFELVYGRVEVEAARVLDLATLGIRIAFDR

SEQ ID NO: 134805 - protein, 250 aa, Glycine max
  Coding DNA Sequence Number=SeqID_18027
  Subcellular localization annotation: CTP_CleavageSite=44; ConfidenceScore=5.58e-01
MSSGGTDPPRPPSHDSSGKGTTAKKRRYIVRLLPSRDSLTSFTPSSSSMSILVRPPDVAHTPSPPPPPTEARPSSSHVNTRGPSSVSASTPSPSSIDARGPSPVPTSTTSPSPPTGNMPTNEDATNLAMEDPPLMIVLWFHPSKVVAKAVTLSIRQQFGQPWPTWGKEFEARLSQARSDVASSVGESQLTPLDPIEEQKLKIRCWVTIVGPKRKGRLYGIGDLAHTYKYRTCSICKNLPIALKMLQRLTA

SEQ ID NO: 134806 - protein, 95 aa, Glycine max
  Coding DNA Sequence Number=SeqID_18028
MGKFLLIGKERKAQTGKEESVKWRALTEEHARDSFENLLFSVCRFRELTGTYPQNITVFRDGKPSGSVGEIGQRSRGETDRCDVTLPTSRTICER

SEQ ID NO: 134807 - protein, 197 aa, Glycine max
  Coding DNA Sequence Number=SeqID_18029
MGEVEEVLEQMKADTEALKEQMATMIEAMMSIKEIMEHHCWGGPDPPIWPQPNKSSNLRYGRSGRQRVGRYGRPSFSAKNKHAFPPYGLPPNYTPPNVAYTPSEDVNNSAPILIESQQPQSDHAHVSQPMGETHETPHHNLADFEPCLGFATEGQAIGDIPLQNTLESPRYHPQPHLLHSTTSKGLESFKEYVQKGA

SEQ ID NO: 134808 - protein, 145 aa, Glycine max
  Coding DNA Sequence Number=SeqID_18030
WATGDGGFICGCGESTCTIARSPPSTTYDGVVPGDMSRGSGDLGDVRQAPGSQPIKEQRPQSKEACVVAGQLWILSDNWNMASVPRESLGDPQRQCKVPIPGHDSIHGYFIGTSRGTSTHASAHCGVDITYTNSISTSGASPSDR

SEQ ID NO: 134809 - protein, 342 aa, Glycine max
  Coding DNA Sequence Number=SeqID_18031
  Gene Ontology: Mol. function=transferase activity, transferring glycosyl groups; Cellular component=intracellular; Biological process=glycogen biosynthetic process
  Homolog annotation: Hit_ID=P0A6U8; Match level="QueryCoverage=99%, HitCoverage=71%, E-value=1e-149, Identity=76%"; Hit description =Glycogen synthase
  Pfam annotation: Domain name=Glyco_transf_5; Domain location=2-234; Score=395.6; E_value=7.4e-116; Accession=PF08323.2; Description =Starch synthase catalytic domain
MQVLHVCSELFPLLKTGGLADVVGALPQAQIAEGMDTRVLIPAFPDLRKGIPDTEVVAELQTFAGPVRLLFGPFNGVGIYLIDAPGLYDRPGSPYHDTSQFAYVDNYLRFALLGWMAAELASGLDTYWQPDIVHAHDWHAGLAPAYIAARGRPAKTVFTVHNLAYQGLFSARHLDEIQIPRAYFEMHGLEFYGQISYLKAGLFYADHITAVSPTYALEITRPEFGYGMEALLEQRLREGRLSGILNGVDPGIWDPAHDLLLTARYDRDTLESKAENKRQLQIAMGLKVDDKVPVFCVISRLTKQKGLDLVLEALPGLLAQAGNWCCWARRCGTAAGLPRRSR

SEQ ID NO: 134810 - protein, 176 aa, Glycine max
  Coding DNA Sequence Number=SeqID_18032
  Gene Ontology: Mol. function=ATP binding; Cellular component =chloroplast
  Homolog annotation: Hit_ID=Q2PMM5; Match level="QueryCoverage=94%, HitCoverage=7%, E-value=2e-83, Identity=90%"; Hit description =Protein ycf2
MEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLDHKKMGPDLLRE

SEQ ID NO: 134811 - protein, 80 aa, Glycine max
  Coding DNA Sequence Number=SeqID_18033
  Homolog annotation: Hit_ID=Q2HSN5; Match level="QueryCoverage=87%, HitCoverage=25%, E-value=2e-09, Identity=43%"; Hit description =Transposase
MTFSTGFAYLEGECLNNVVWALEQFRGIFLRHDALPVVTGRDLALMNAVKTVFPECTNFLCRFHIDKNVKAKWLNLLIEL

SEQ ID NO: 134812 - protein, 144 aa, Glycine max
  Coding DNA Sequence Number=SeqID_18034
  Gene Ontology: Mol. function=chitin binding; Cellular component =extracellular region; Biological process=chitin metabolic process
  Homolog annotation: Hit_ID=UPI0000612705; Match level="QueryCoverage =84%, HitCoverage=92%, E-value=5e-13, Identity=28%"; Hit description =UPI0000612705 related cluster
MDTSEPYTGAMRGIMHEPQDGPLGTSTLTFRGLHVLAFRGLHVLAIRGLDVLAFRGLHILTVRGLHVLTFRGLRALTFRGLHVLAIKGLHVLHFRGLHILHFRGLHILTFRGLHAFRGLHVLAVRGLQVLTIRGLHVLIFRGLQ

SEQ ID NO: 134813 - protein, 264 aa, Glycine max
  Coding DNA Sequence Number=SeqID_18035
  Homolog annotation: Hit_ID=Q1SJY6; Match level="QueryCoverage=55%, HitCoverage=22%, E-value=3e-11, Identity=27%"; Hit description =Glucoamylase s1/s2
GYHYLHTLCATGIVIGSLKKRDVVKEEKSKKKRKRLEYRAPTFFTNKKLKEKFDRRWVGKEVNEPFYLRWVRAFFTTTKVDSSNFTLKATLKGIEILILEQLIAYLLGVLVDSSRLYDDWFEIMGLKMNEIRKKASTFQEVNDHDLLIIYYLWRKIPLSLPYLIINHMIKVSKRIKSTSSVPYGMLMTMIFKHFGVSLKDEPRYNEASKKEKVSFKEDNSKKNRSSKDYYEVVEAHNPKGSAPTQEDLNVEIIDDVLAKLKTDD

SEQ ID NO: 134814 - protein, 140 aa, Glycine max
  Coding DNA Sequence Number=SeqID_18036
  Homolog annotation: Hit_ID=Q3SYU1; Match level="QueryCoverage=33%, HitCoverage=6%, E-value=2e-08, Identity=57%"; Hit description =Nucleolar complex protein 2 homolog
  Subcellular localization annotation: CTP_CleavageSite=52; ConfidenceScore=5.31e-01
MWRGNLLFFSVPLSKLQPYPSSPPPPASNRFLIQPTWTQKMIQRGIWMERTVLDEGAAKKSMSGSGAREHKDQLHKLQEKDPEFYEFLKEHDKELLQFSDDDIDYVMSSNAIFVKGVSTKHHRELDYFNPYLYQMPFGNI

SEQ ID NO: 134815 - protein, 190 aa, Glycine max
  Coding DNA Sequence Number=SeqID_18037
  Subcellular localization annotation: CTP_CleavageSite=61; ConfidenceScore=5.60e-01
MGRHSSNHSPSSRRHRSSISPPPRDKHEYSGRSTAKPVRPGSPDSPPCSRSPSPRTKRLKKAQSEREREPRESERNHGGSRGRGSERGAGERREKKRTENDEGNGRSNKSGKRMEYEDSGGRSSKSEKGTENEDGGGRSNKSSRSRQERSPERDRNGRSRHRSESPPRHHASAADAKPRDEVSGDIQPPL

SEQ ID NO: 134816 - protein, 74 aa, Glycine max
  Coding DNA Sequence Number=SeqID_18038
  Subcellular localization annotation: CTP_CleavageSite=45; ConfidenceScore=5.23e-01
MAEQAPTIFISKGVVFGTDYSARPKGHTGLTSSLLGPRKSFRPKKATHLGELMTSSLSKQLTWESLPCTKWLFL

SEQ ID NO: 134817 - protein, 100 aa, Glycine max
  Coding DNA Sequence Number=SeqID_18039
  Gene Ontology: Mol. function=protein binding; Cellular component =nucleus; Biological process=regulation of transcription, DNA -dependent
  Homolog annotation: Hit_ID=Q9LJU3; Match level="QueryCoverage=68%, HitCoverage=13%, E-value=5e-17, Identity=66%"; Hit description =Arabidopsis thaliana genomic DNA, chromosome 3, TAC clone: K10D20
MKAAEEALEEKQKMFVKEPHLTKVSFFFMGARVRHPGETLPFKRKIERHQKPSFELSGKLASETNRVRGVTLLFNEPAEARKPDIKWRLYVFKAGEVLNG

SEQ ID NO: 134818 - protein, 76 aa, Glycine max
  Coding DNA Sequence Number=SeqID_18040
MDVILARSGAKLEADTMCLRGVKQETRLVIEEGRGTSPGREGDDGMWAEASAGLKGTSACNWTGRPNWEKDIMKEA

SEQ ID NO: 134819 - protein, 299 aa, Glycine max
  Coding DNA Sequence Number=SeqID_18041
  Gene Ontology: Mol. function=microtubule motor activity; Cellular component=microtubule associated complex; Biological process =microtubule-based movement
  Homolog annotation: Hit_ID=Q8W5R6; Match level="QueryCoverage=81%, HitCoverage=25%, E-value=3e-76, Identity=63%"; Hit description =Kinesin-related protein
  Pfam annotation: Domain name=Kinesin; Domain location=5-86; Score= -169.0; E_value=0.001; Accession=PF00225.13; Description=Kinesin motor domain
MVSKFHDDPTVDESGIVVLLGQVIAKLTDENATHIPYRDSKLTRLLQSSLSGHGRIFLICTVTPASSSSEETRNTLKFAHRSKHVEIKASQNKIMDEKSLIKKYQKEISELKQELQQLKHGMVENPNMATSSQEDLANLKLQLEAGQSKLKSRLQEEEQAKAALMGRIQRLTKLILVSTKNVMSSSIPERPSHRRRHSFGEDELAYLPDRKRETWINDDAGSHASVLSPEEKDDITNLDELGKDYRRSKRRGMLGWLKLREDMHKLKGEISQKKNQIRILEQRMIGSIGPAPRNCEMSQ

SEQ ID NO: 134820 - protein, 291 aa, Glycine max
  Coding DNA Sequence Number=SeqID_18042
  Subcellular localization annotation: CTP_CleavageSite=32; ConfidenceScore=5.34e-01
MASLHHGLPCCRFSSPYSHRYTMMTLMVLFSKCNSEVRSIVRFKPFNPYRFPRSLLWPSFRKISCTITIMLVVAHIFLRNLLYLNQPLLREVQAGRARIDLALPFLLSSFISGITPELRCEVQALQPLSLPQLHDRRCAGRGSYFPPQPTSSRPTPPRSPRVPVKCLSSEEIAVHRDKGLCYHCDDKWTMGHHCKPHIQLFIDNDDSDNPYSSPNSESPDVLPTPTPLPRDPPHLSLNALLGMLTLETVCVYGYINHHRVTILVDDGSTHNFVQTRIAKFLELASSPITPF

SEQ ID NO: 134821 - protein, 160 aa, Glycine max
  Coding DNA Sequence Number=SeqID_18043
  Gene Ontology: Mol. function=RNA-directed DNA polymerase activity; Cellular component=chromatin; Biological process=chromatin assembly or disassembly
MGLRETSDKVEGKVLPNRRGNWKRLKETGRFFGLVFLLLTDEALGYITVDIIHHSSPEEILLEPLQGFCNSHVAAQRGGMEFPKQYGSEGANLAGIGSSNHSPTTWINKSIAPVVSPLAGRGCDNMQFADICGSLLQSRTKEFAIEHDGVSLLEENCSHG

SEQ ID NO: 134822 - protein, 111 aa, Glycine max
  Coding DNA Sequence Number=SeqID_18044
MDPNHQIVEHLASYEAGWVEVKVGTVTEGISERAGTEKRGTGEGVLALSQACHCFFKMIHGGLAGVMLGHDGEGSSKMSTVTQRPAALEDKHQEFSKPELCNNITELGKYQ

SEQ ID NO: 134823 - protein, 81 aa, Glycine max
  Coding DNA Sequence Number=SeqID_18045
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q6WGM8; Match level="QueryCoverage=84%, HitCoverage=3%, E-value=3e-29, Identity=78%"; Hit description=Beta 1, 3 glucan synthase
LEVALLLIVYLAYGSNEGGALSYILLSISSWFMALSWLFAPYLFNPSGFEWQKDWTNWLLYRGGIGVKGEESWEAWWEEEL

SEQ ID NO: 134824 - protein, 248 aa, Glycine max
  Coding DNA Sequence Number=SeqID_18046
MKLPFYPELVEAFYSNLEIQEDSLIFEVYGIKMVIDQSLFFELTQLSSDGVPFEGTLDDEWNFDFSVSDARRMLCTNQTDMTGRLLVGSLAFECRIMHYLIMRILLPRSSNLAQVSEEDLIIMWVFLTGRQINWAHLRSFSIGANVISSFGYRKERDGSWVKKDAPVQAAEDRSPSPHSHRDDSSSLMHNILDRLDGLHTFVGERFDSLDSRIDAMDARFAGMDTRITKLEEDVSYVRQCFDLPPPSS

SEQ ID NO: 134825 - protein, 114 aa, Glycine max
  Coding DNA Sequence Number=SeqID_18047
  Gene Ontology: Mol. function=RNA-directed DNA polymerase activity; Biological process=RNA-dependent DNA replication
  Homolog annotation: Hit_ID=Q1SX46; Match level="QueryCoverage=53%, HitCoverage=32%, E-value=6e-10, Identity=52%"; Hit description=RNA -directed DNA polymerase (EC 2.7.7.49) (Clone AmLi2)-garden snapdragon-related
MVQCTHIRVQIHTSSSCVLVANEVADDAKRRKKCCLLFKADFEMAYNSISWDFLLYMLKRLSFHDTWDLIDAILPRRGPITRAMARRLQEDWARDAREDPWVLMSLRVDFGPMG

SEQ ID NO: 134826 - protein, 152 aa, Glycine max
  Coding DNA Sequence Number=SeqID_18048
  Homolog annotation: Hit_ID=Q1SRP0; Match level="QueryCoverage=77%, HitCoverage=25%, E-value=1e-42, Identity=69%"; Hit description =Putative callose synthase catalytic subunit-related
MASLRYWYPDLHLNPAYWWPALCVARLSTKAPIKDNVANQHEHIVHLLANEQSRLRIPEDAEPDPLFYTIIALENVGYGLKLDEAAVQAIFLKSLQNYINWCDYLGIQPVWSSLEAVSKEKKLLYVSLYFLIWGEASNIRFLPECLCYIFHH

SEQ ID NO: 134827 - protein, 284 aa, Glycine max
  Coding DNA Sequence Number=SeqID_18049
  Homolog annotation: Hit_ID=Q1SRP0; Match level="QueryCoverage=58%, HitCoverage=39%, E-value=2e-73, Identity=85%"; Hit description =Putative callose synthase catalytic subunit-related
MQVHDPKEITRAVEIACAIEWVGKERWLATIMLHNRIQAPRLGGSTEPHSDHSKGAKQLPYNQYMHRMEEGEDEQEGEGINNHIVEILGSEDIVQDGGIESTQKLTKREAGTIDRSQDIARLQEFYKSYREKHNVDKLCEEEMKLRESGAFSRDLGELERKTLKRKRVFATLKVLGTVLEQLCEEEIPDELKRLMDSDSALTEDLIAYNIIPLDASSSTNAIVYFPEVQAAVSALKYFNGLPELPRGYFIQPTRNATMFDFLQCTFGFQVCIPGFLCAVMSRLV

SEQ ID NO: 134828 - protein, 384 aa, Glycine max
  Coding DNA Sequence Number=SeqID_18050
MGGERRIKGNILLTKASRREEQTRMTEQQQLHNQRHTLWHLKGHTRVLLLHAQTRSDKEGTPSPPRLKKHEPFERVDEEIPWILGSDEIPKYLGDDMVLLLGLTNTKAEEMITEEIEHGASLFHTLEKWNPDMRPGNRMVRIQCWGIPLLAWDIGNISKIVAAICDLVDIDDDVEERRRLDRARILIRTPWQPLIHHSVAVLIGGETHIVQLVEETHSAEGRRTRHWRSFFGSSEEIISDGSDFDTPLTGYSSPSPRFLAADSMDGSNIRWVQKIPSGLPGNEYPAGIEGSSKAHGSILDMRMTECDKGTTTVLEAGPMSEEIAISGEGAGGNAKSTANVGEKKESVLCELAGCRESIYGKAEHVLETGQQEVEGQNLNGSQKT

SEQ ID NO: 134829 - protein, 56 aa, Glycine max
  Coding DNA Sequence Number=SeqID_18051
MSSFRDLEQKWAPKVEALFGASMENEGERKATSSRFSASVGASFRKQAIYISKRSE

SEQ ID NO: 134830 - protein, 2252 aa, Glycine max
  Coding DNA Sequence Number=SeqID_18052
  Gene Ontology: Mol. function=binding
  Homolog annotation: Hit_ID=Q2R9P0; Match level="QueryCoverage=93%, HitCoverage=95%, E-value=0.0, Identity=61%"; Hit description =Armadillo/beta-catenin-like repeat family protein, expressed
  Pfam annotation: Domain name=Arm; Domain location=121-162; Score =11.8; E_value=0.41; Accession=PF00514.13; Description=Armadillobeta -catenin-like repeat
  Pfam annotation: Domain name=Arm; Domain location=1264-1304; Score =6.1; E_value=2.1; Accession=PF00514.13; Description=Armadillobeta -catenin-like repeat
  Pfam annotation: Domain name=Arm; Domain location=1306-1346; Score =3.7; E_value=4.2; Accession=PF00514.13; Description=Armadillobeta -catenin-like repeat
  Pfam annotation: Domain name=Arm; Domain location=1349-1387; Score =3.2; E_value=4.9; Accession=PF00514.13; Description=Armadillobeta -catenin-like repeat
  Pfam annotation: Domain name=Arm; Domain location=1433-1473; Score =2.8; E_value=5.4; Accession=PF00514.13; Description=Armadillobeta -catenin-like repeat
  Pfam annotation: Domain name=Arm; Domain location=1474-1514; Score =8.7; E_value=0.99; Accession=PF00514.13; Description=Armadillobeta -catenin-like repeat
  Pfam annotation: Domain name=Arm; Domain location=1602-1642; Score =4.0; E_value=3.8; Accession=PF00514.13; Description=Armadillobeta -catenin-like repeat
  Pfam annotation: Domain name=Arm; Domain location=163-203; Score =19.8; E_value=0.01; Accession=PF00514.13; Description=Armadillobeta -catenin-like repeat
  Pfam annotation: Domain name=Arm; Domain location=1643-1683; Score =5.5; E_value=2.5; Accession=PF00514.13; Description=Armadillobeta -catenin-like repeat
  Pfam annotation: Domain name=Arm; Domain location=1766-1807; Score =9.3; E_value=0.83; Accession=PF00514.13; Description=Armadillobeta -catenin-like repeat
  Pfam annotation: Domain name=Arm; Domain location=1849-1890; Score =9.4; E_value=0.82; Accession=PF00514.13; Description=Armadillobeta -catenin-like repeat
  Pfam annotation: Domain name=Arm; Domain location=1892-1932; Score =12.6; E_value=0.32; Accession=PF00514.13; Description=Armadillobeta -catenin-like repeat
  Pfam annotation: Domain name=Arm; Domain location=210-252; Score=3.4; E_value=4.6; Accession=PF00514.13; Description=Armadillobeta-catenin -like repeat
  Pfam annotation: Domain name=Arm; Domain location=254-294; Score =20.2; E_value=0.0076; Accession=PF00514.13; Description =Armadillobeta-catenin-like repeat
  Pfam annotation: Domain name=Arm; Domain location=296-337; Score =24.3; E_value=0.00042; Accession=PF00514.13; Description =Armadillobeta-catenin-like repeat
  Pfam annotation: Domain name=Arm; Domain location=339-388; Score =16.5; E_value=0.095; Accession=PF00514.13; Description=Armadillobeta- catenin-like repeat
  Pfam annotation: Domain name=Arm; Domain location=512-552; Score=3.5; E_value=4.4; Accession=PF00514.13; Description=Armadillobeta-catenin -like repeat
  Pfam annotation: Domain name=Arm; Domain location=554-594; Score =35.9; E_value=1.4e-07; Accession=PF00514.13; Description =Armadillobeta-catenin-like repeat
  Pfam annotation: Domain name=Arm; Domain location=596-636; Score =24.7; E_value=0.00032; Accession=PF00514.13; Description =Armadillobeta-catenin-like repeat
  Pfam annotation: Domain name=Arm; Domain location=675-715; Score=9.3; E_value=0.83; Accession=PF00514.13; Description=Armadillobeta-catenin- like repeat
  Pfam annotation: Domain name=Arm; Domain location=717-757; Score =11.1; E_value=0.51; Accession=PF00514.13; Description=Armadillobeta -catenin-like repeat
  Pfam annotation: Domain name=Arm; Domain location=762-802; Score =16.5; E_value=0.099; Accession=PF00514.13; Description=Armadillobeta- catenin-like repeat
  Pfam annotation: Domain name=Arm; Domain location=803-843; Score=1.9; E_value=7; Accession=PF00514.13; Description=Armadillobeta-catenin -like repeat
  Pfam annotation: Domain name=C2; Domain location=2067-2158; Score =52.4; E_value=1.5e-12; Accession=PF00168.20; Description=C2 domain
  Pfam annotation: Domain name=HEAT; Domain location=129-164; Score =2.9; E_value=19; Accession=PF02985.12; Description=HEAT repeat
  Pfam annotation: Domain name=HEAT; Domain location=1353-1389; Score =0.2; E_value=41; Accession=PF02985.12; Description=HEAT repeat
  Pfam annotation: Domain name=HEAT; Domain location=1481-1516; Score =0.8; E_value=34; Accession=PF02985.12; Description=HEAT repeat
  Pfam annotation: Domain name=HEAT; Domain location=1608-1644; Score =5.3; E_value=9.5; Accession=PF02985.12; Description=HEAT repeat
  Pfam annotation: Domain name=HEAT; Domain location=169-205; Score =19.1; E_value=0.016; Accession=PF02985.12; Description=HEAT repeat
  Pfam annotation: Domain name=HEAT; Domain location=1903-1934; Score =1.8; E_value=26; Accession=PF02985.12; Description=HEAT repeat
  Pfam annotation: Domain name=HEAT; Domain location=260-296; Score =1.9; E_value=25; Accession=PF02985.12; Description=HEAT repeat
  Pfam annotation: Domain name=HEAT; Domain location=302-339; Score =12.5; E_value=1.3; Accession=PF02985.12; Description=HEAT repeat
  Pfam annotation: Domain name=HEAT; Domain location=681-717; Score =3.9; E_value=14; Accession=PF02985.12; Description=HEAT repeat
  Pfam annotation: Domain name=HEAT; Domain location=723-759; Score =7.5; E_value=5.2; Accession=PF02985.12; Description=HEAT repeat
  Pfam annotation: Domain name=HEAT; Domain location=809-845; Score =6.5; E_value=6.8; Accession=PF02985.12; Description=HEAT repeat
  Pfam annotation: Domain name=HEAT_PBS; Domain location=1333-1369; Score=14.4; E_value=0.43; Accession=PF03130.6; Description=PBS lyase HEAT-like repeat
  Pfam annotation: Domain name=HEAT_PBS; Domain location=1586-1624; Score=3.6; E_value=32; Accession=PF03130.6; Description=PBS lyase HEAT-like repeat
  Pfam annotation: Domain name=HEAT_PBS; Domain location=1835-1871; Score=3.3; E_value=35; Accession=PF03130.6; Description=PBS lyase HEAT-like repeat
  Pfam annotation: Domain name=HEAT_PBS; Domain location=324-361; Score= 12.1; E_value=2; Accession=PF03130.6; Description=PBS lyase HEAT-like repeat
  Pfam module annotation: Pfam domain module=Arm::Arm::Arm::Arm::Arm::Ar m::Arm::Arm::Arm::Arm::Arm::Arm::Arm::Arm::Arm::Arm::Arm::Arm::Arm::Ar m::Arm::Arm::Arm::C2::HEAT::HEAT::HEAT::HEAT::HEAT::HEAT::HEAT::HEAT:: HEAT::...
  Pfam module annotation: Pfam domain module=HEAT::HEAT::HEAT_PBS::HEAT_ PBS::HEAT_PBS::HEAT_PBS; Domain location=121-162::1264-1304::1306 -1346::1349-1387::1433-1473::1474-1514::1602-1642::163-203::1643 -1683::1766-1807::...
  Pfam module annotation: Domain location=1849-1890::1892-1932::210 -252::254-294::296-337::339-388::512-552::554-594::596-636::675 -715::717-757::762-802::803-843::2067-2158::129-164::1353-1389::1481 -1516::1608-1644::...
  Pfam module annotation: Domain location=169-205::1903-1934::260 -296::302-339::681-717::723-759::809-845::1333-1369::1586-1624::1835 -1871::324-361
MWHFNQGFKFWSPSVALFDIVGTFEQISVYGHNCGFAQVSCKEGKLANWCKCQSLPLMNNGSPIILPPRLGQEFNEATGMDDPESTMATVANFVEQLHANLSSPVEKEIITAHLLGMARRRKDARALIGSHAQAMPLFISILRNGTPLAKVNVASTLSVLCKDEDLRLKVLLGGCIPPLLSLLNYESTDARKAAAEAIYEVSSGGLSDDHVGMKIFVTEGVVPTLWNQLNPKNKEDKIVEGFITGALRNLCGDKDGYWKATLEAGGVDIIVGLLSSDNAVSQSNAASLLARLMLAFSDSIPKVIDSGAVKALLQLVGQENDISVRASAADALEALSSQSTKAKKVIVNADGIPILIAAIVAPSNECMQGDGGQALQEHATRALANICGGMSALILYLGELSRSPRPDSPVGDIIGALAYTLMVFEEKVDVDEKHFGATQIEDILVTLLKPWDNNLIQERVLEAMASLYGNVCLSKWLIQADSKKVLIGLITMAATDVQEYLILSLTSLCCDKIGLWEAIKKREGIQLLISLLGLSSEQHQEYSVQLLAILTDQVDDSKWAITAAGGIPPLVQLLETGSQKAREEAANVLWSLCCHSEDIRACVESAGAIPAFLWLLKSGGPRGQEASAMALTKLVRVADSATINQLLALLLGHSPSSKTHIIRVLGHVLTMASQNDLLEKGSAANKGLRSLVQVLNSSNEETQEYAASVLADLFITRQDICDSLATDEIVLPCVKLLTSKTQVVATQSARALSALSRPTKNKAANKMSYIVEGDVKPLIKLAKTSSVDAAETAVAALANLLFDPFIAAEALAEDVVSALTRVLAEGTLEGKRNASRALHQLLKHFPVGDVLKGNAQCCFTVLALVDSLRAMDMDGTDAADALEVIALLARTKQGVNFTYPPWSALAEIPSSLELLVCFLAEGHSLVQDKAIKILSRLCGDQPVVLGELLSASSKSIGSLANRIMNSSSLEVKIGGSSLLICAAKEKKEFSMDSLDASGYLKPLIYSLVEMIKQNCSYSSLEIEVVTSKGFMERNSFQEVDEFDIPDPATSLGSTIAMWLLSVIASFHIKSKLTIMEAGGLEALFDKLARHTSNPQVLTSIPAEYEDTEGIWINALLLAILFQDENVILSPVTMRIIPSITLLLRSDEVIDKYFAAQTMASLVCNGNKGIDLAIANSGAVAGLITIIGHVESDMPNLMALSEEFSLVQNPDQVVLDHLFEIEDVKVGSTARKSIPLLVDLLRPIPERPSAPPVAVRLLLSIADGSDSNKLILAEAGALEALNKYLSLSPQDSTEAAISELLRILFCNSDLIKHEASTNSLNQLIAVLRLGSRNARYSAARALHELFDAGNIRDSELAKQAIQPLVDMLNTTSGNEQEAALMALIKLTSGNSSKVSLLTDVEGNPLKCLYKILSSASSLELKSHAAQLCFALFGNSKIRADPVASECLEPFISLMQSNSETAIVSGVCAFERLLEDEQQVELAAAYNVVDLLVSLVSGTNYQLIEAAISTLIKLGKDRTPIKLDMVKAGIINNCLNLLQLAPSSLCSTIAELFRILTNSSAIARSSDAAEIVEPLFHVLLRRDFNLWGQHSALQALVNILEKPQSLATLKLTPSQVIEPLISFLESPSQAIQQLGTELLSHLLAQEHFQQDITTKNAVVPLVQLAGIGILNLQQTAIKALEKISTSWPKAVADAGGIFELAKVIIQDEPQPPHALWESAALVLSNVLHSNADYYFKVPVVVLVKLLHSTLESTISIALNALIVHDRSDASSAEQMMEAGVIDALLELLRSHHCEEASGRLLEALFNNVRVREMKVSKYAIAPLSQYLLDPQTRSQSGKLLAALALGDLSQHEGHARSSASVSACRALISLLEDQPTEEMKVVAICALQNFVMNSRTNRRAVAEAGGILVIQELLLSPNTEVSAQAALLIKFLFSTHTLQEYVSNELIRSLTAALERELWSTATINEEVLRTLHVIFMNFPKLHTSEAATLCIPHLVGALKSGGEAAQDSVLDTFCLLRQSWSTMPIDIAKSQAMIAAEAIPILQMLMKTCPPSFHERADTLLHCLPGCLTVTIKRGNNLKQTMGSTNAFCRLTIGNGPPKQTKKLHVSTIPSFHVVNHSTSPEWKEGFTWAFDVPPKGQKLHIICKSKNTFGKTTLGRVTIQIDKVVSEGVYSGLFSLNHDGFPMMTFEKYSKLLFGWKHRKRQQAFEKDAPTVKSKNVCNCTGQSTVSDVGMYTSICCKVALFYVCKPQEMIN

SEQ ID NO: 134831 - protein, 92 aa, Glycine max
  Coding DNA Sequence Number=SeqID_18053
  Gene Ontology: Mol. function=nucleic acid binding; Biological process= DNA integration
  Homolog annotation: Hit_ID=Q1SS67; Match level="QueryCoverage=87%, HitCoverage=27%, E-value=7e-17, Identity=53%"; Hit description=Zinc finger, CCHC-type
MKMRVLLVHHGLEQALKREKGLPATMSERENKEVLDKAHSALILSLGDKVLREVSKEKSTVVIWNKLENLYKTKSLANKLYNNNNNNNALSH

SEQ ID NO: 134832 - protein, 77 aa, Glycine max
  Coding DNA Sequence Number=SeqID_18054
  Subcellular localization annotation: CTP_CleavageSite=49; ConfidenceScore=5.48e-01
MPQSSFLLALPPMPPHPQFTSNFPRNRSDRAKNPAKPTPDQTRDRVQIFAKNNWKKSDPTSRDRLQKLGHSEREREE

SEQ ID NO: 134833 - protein, 915 aa, Glycine max
  Coding DNA Sequence Number=SeqID_18055
  Gene Ontology: Mol. function=Rab GTPase activator activity; Cellular component=intracellular; Biological process=regulation of Rab GTPase activity
  Homolog annotation: Hit_ID=Q5QMF8; Match level="QueryCoverage=88%, HitCoverage=87%, E-value=0.0, Identity=53%"; Hit description =RabGAP/TBC domain-containing protein-like
  Pfam annotation: Domain name=TBC; Domain location=233-494; Score =42.8; E_value=1.1e-10; Accession=PF00566.9; Description=TBC domain
DAYGFTVRPQHLQRYREYANIYKEEEEERSDRWNSFLDRQAESSELVTDGLIVGEGGEKVLGDEAAEQEADASSEKGVDGHEASNQVPGGSDSAAEHGSQKEEVLLSEETKVHRVQLWTEIRSSLQTIEDMMSVRVKKNTGSVKDERVKKGLLKDEQIIETAKSPSHSDDVKSPKGAACEEDSEEEFYDVERLDPSPDMPVVDGTNALANGITADAAQPEASFPWKEELEVLVRGGVPMALRGELWQAFVGVKARRVEKYYQDLLSSESDSEVKTDQQSMESTDSNGKTGADFGHMPEKWKGVKGQIEKDLPRTFPGHPALDEDGRNALRRLLTAYARHNPSVGYCQAGAVLRLDARLKVHRALMPRGHLSYAMNFFAGLLLLLMPEENAFWTLMGILDDYFDGYYSEEMIESQVDQLVFEELVRESQSSRLSGSAGGMGYWTMVPVHFCEHASLGKWSVLRVWDVLLFEGNRVMLFRTAVALMELYGPALVTTKDAGDAVTLLQSLAGSTFDSSQLVLTACMGYQNINETRLQQLRNKHRPAVIASVEERSKGLKAWKDSQGLASKLADMQVLGNLSRTESGSTNADEILISLTGEGEIDSVPDLQEQVVWLKVELCRLLEEKRSAILRAEELETALMEMVRQDNRRQLSAKHIECHHHHVFSTIFQMVEQLDEEVAQLQQALADKQEQETAMLQVLMRVEQEQKVTEDARRFAEQDAAAQRYAAQVLQEKYEEATAALAEMEKRAVMAESMLEATLQYQCGQVKVLQSPRSSQLDSPVSRNNQEPDIPARRISLLSRPFGLGWRDRNKVSFISHSGRGNPLMKSQLRESPALRNKIRSVNKTSMALKYRRRVEKKSVPRFSLYASQDNLTRKKLVPSSLSNNSNWKNKLYDGDGNILSMFGWSTKRNRGGGKY

SEQ ID NO: 134834 - protein, 36 aa, Glycine max
  Coding DNA Sequence Number=SeqID_18056
MATSIPTLKDLPYSVVVYLRKYIRKFILASSFSFDD

SEQ ID NO: 134835 - protein, 100 aa, Glycine max
  Coding DNA Sequence Number=SeqID_18057
  Subcellular localization annotation: CTP_CleavageSite=38; ConfidenceScore=5.16e-01
MSVDHVPGNMAFSMIFFVQKYHSFLLLLGINHKIRRVRGGTNREQLMPRGSSFGGSVGRRSDKERQQVSTTEDNLVAKKMRSISDSWRKVKVEKTKRDED

SEQ ID NO: 134836 - protein, 69 aa, Glycine max
  Coding DNA Sequence Number=SeqID_18058
  Pfam annotation: Domain name=EGF_CA; Domain location=10-52; Score =20.5; E_value=0.0015; Accession=PF07645.6; Description=Calcium binding EGF domain
MGYFLREKNDIDECKTKSHTFITENHCRNTDGSYECFCPRGQVGDGKFNKGCRPIQRKNILTKYVIDKV

SEQ ID NO: 134837 - protein, 119 aa, Glycine max
  Coding DNA Sequence Number=SeqID_18059
MEDIAPNKLWLSVRMEEGHFLMLGHDAYPCMLHMWFVLVMILNLVYEEANDVQICNKGGLLHVLQPTRLETNSACDAWLSLVQGNLTHSGNGTQVFLLNRSFPTYEHNEILRHYVDLMG

SEQ ID NO: 134838 - protein, 174 aa, Glycine max
  Coding DNA Sequence Number=SeqID_18060
  Gene Ontology: Mol. function=protein binding; Cellular component =integral to membrane; Biological process=regulation of GTPase activity
  Homolog annotation: Hit_ID=Q1S8S5; Match level="QueryCoverage=96%, HitCoverage=97%, E-value=3e-58, Identity=64%"; Hit description=C2
  Pfam annotation: Domain name=C2; Domain location=9-91; Score=93.7; E _value=5.6e-25; Accession=PF00168.20; Description=C2 domain
MDNSILGLLKLRIKRGTNLAIRDAIKMHASDPYVIINMGEQKLKTGVVKDNCNPEWNEEFTLSIKDVKTPIHLSVYDKDTLSGDDKMGEADIDLKPYVQCVQMGLNERPDDSSVKRIQPDDTNCLAEESNCIWQNGNIIQEMILKLRNVESGEVVVEIEWVDVIGCKGLSQVEL

SEQ ID NO: 134839 - protein, 142 aa, Glycine max
  Coding DNA Sequence Number=SeqID_18061
MKAQVEKDEGLEAEALSRQLMLLKAETNLKTQFLSGFLVEPISDLSSGVYPDLSSFTGSGVYPDLSSFTGSGVYPDLSSFTGSGVIQIFVACIKRSAPTQCNKQKESTECKDYIMHWMSTKILGSFKNNCILMMQDHWNQRE

SEQ ID NO: 134840 - protein, 198 aa, Glycine max
  Coding DNA Sequence Number=SeqID_18062
IVLGSTGSFVIMKGSFIAGFNGSCGATDILHAEILALYHGIHICNWNNLEIPEDLLAKLGTSTEAEFLPSSCPDIESLVQLKDVLGFSIIRIQSLFLIMPKVDAQVPDWCNNIRGFMGFKFPSRCGLFGGLGIKLFLRRRWGQLLSDMRKAVTLKVDGSMMGSPPRTGFGGLCRVHHGSFLVGLYGHVGGQEILYAEI

SEQ ID NO: 134841 - protein, 44 aa, Glycine max
  Coding DNA Sequence Number=SeqID_18063
MAKERQGGRRKRPCSNEPVSPVIFLDSLTCKHETDHLWRVSRLS

SEQ ID NO: 134842 - protein, 258 aa, Glycine max
  Coding DNA Sequence Number=SeqID_18064
  Gene Ontology: Mol. function=calcium ion binding; Biological process =positive regulation of cell proliferation
  Homolog annotation: Hit_ID=Q9FQ22; Match level="QueryCoverage=95%, HitCoverage=99%, E-value=1e-95, Identity=69%"; Hit description =Tonneau 1
MDDYTREMMDLKTLVTRTLEKKGVLARIRAELRASVFEAIEEEDRVIEKEQGLPPALLGSCNDRAKQLHASPPGRLLTAMICEYLDWAQLSHTLKVYLPECNLEKDFWKTELKEFSTKNGYDLNRNRDSPLLLDVLEGFLKLENLSQARASGRRFATSETEPLPNSESQNPRRHSSSSVAGGLPPLGRAVPSSQASGGYFLKDEYNWRYDSDELPEDIIQASSALENLQLDRKARNLTSSWRHAGDGINEDDGRADHV

SEQ ID NO: 134843 - protein, 147 aa, Glycine max
  Coding DNA Sequence Number=SeqID_18065
  Gene Ontology: Mol. function=membrane alanyl aminopeptidase activity; Biological process=proteolysis
  Homolog annotation: Hit_ID=Q84TA3; Match level="QueryCoverage=91%, HitCoverage=30%, E-value=7e-40, Identity=53%"; Hit description =Putative leukotriene A-4 hydrolase
MAKIKSFTTYAERRIVEAVQGEQRATLNIGIGWRGLNEDVERFKDNLEFTKLKNNQEGIDPDNVYSQVPYEKANIRGIENQIDLVLWTKGTGIPPDAYEPESTAYKTIVSLANEFTNGRMKLLAGSSTWTTYQNPLKLLSLILFSQL

SEQ ID NO: 134844 - protein, 94 aa, Glycine max
  Coding DNA Sequence Number=SeqID_18066
  Gene Ontology: Mol. function=oxidoreductase activity
  Homolog annotation: Hit_ID=Q8LBR3; Match level="QueryCoverage=51%, HitCoverage=12%, E-value=4e-14, Identity=71%"; Hit description =Alcohol dehydrogenase, putative
MGITDFINPRDDEKPVYERIREMTCGGVHYSFECTGNLNVLRDAFLSAHELKISKNLDAVVTIMVGDYFLKSWYMLQYFFTNIASLLTPKYNDE

SEQ ID NO: 134845 - protein, 117 aa, Glycine max
  Coding DNA Sequence Number=SeqID_18067
  Subcellular localization annotation: CTP_CleavageSite=101; ConfidenceScore=5.28e-01
MEFLKYSITTSLSPPLQGVTCPPTSTWFALKSHRTRGEVCSDTICSAPNCRPLSDSHTTTLHTVTLYSTLRSRKWLPPKGFDRWRVSKFRVGLGFDEEDVVVVVVDNDDFMEAFNNL

SEQ ID NO: 134846 - protein, 102 aa, Glycine max
  Coding DNA Sequence Number=SeqID_18068
  Gene Ontology: Mol. function=oxidoreductase activity; Cellular component=cytosol; Biological process=retinoid metabolic process
  Homolog annotation: Hit_ID=Q8LBR3; Match level="QueryCoverage=80%, HitCoverage=21%, E-value=8e-29, Identity=66%"; Hit description =Alcohol dehydrogenase, putative
MTSGDVHYSFECAGNLNVIRDAFLSAHMDWGLTVILGIHPSPKLLPIHPMELFQGRRIVGSVFGGFKGKTQLPRFAKECMDGVWTTVLYMCSLGFNSLLISK

SEQ ID NO: 134847 - protein, 137 aa, Glycine max
  Coding DNA Sequence Number=SeqID_18069
MSTRSHFRLIMLECLSRLKLAAVRCSYAYSSPRMEFVTRYNNPKILWPKKGICQWNLRVEDAGKNGDNLVTVAPSGRPVRGSSGTSGRILPEDFRKKGSSGSCETSSRSTGLSESSQNTSSGKFSEEVVLPESFRKK

SEQ ID NO: 134848 - protein, 73 aa, Glycine max
  Coding DNA Sequence Number=SeqID_18070
MAHKYEITAEHKAYLFVICVCAYLFKRPISVITSSLNNNNNNNESWTRCLKRIGGEWKNLREENISWTILPKL

SEQ ID NO: 134849 - protein, 436 aa, Glycine max
  Coding DNA Sequence Number=SeqID_18071
  Homolog annotation: Hit_ID=Q2HRX8; Match level="QueryCoverage=67%, HitCoverage=57%, E-value=4e-16, Identity=33%"; Hit description=IMP dehydrogenase/GMP reductase
  Pfam annotation: Domain name=DUF1723; Domain location=164-213; Score =60.3; E_value=6.4e-15; Accession=PF08330.1; Description=Protein of unknown function (DUF1723)
MARTRGLGRAIGRLVGRDRHDDHDAADVPERSRPTALARTQRVQHMIAEGRDMAEDVADMTDDVPVLAAEAPEMHADIEGADGAEGSDADDAAEGFPGGPRDSSVLTSFAEHVAHAVWSEQERPDLKLMSHGRKVTLIGRLVPEIEGLVAATGLSPLIDCSVITGDPGLISAFVERWNGETSTFHLPVGDLTITLDDVSSLLHLPITGALHSFHAFSTEEARFLLTGLLEVSTEEARAETTLTRGAYCWIYEHFPSVHQCVTDDTYQETSPRASRWLTSKAHMKRITGAPYRARCDGLTVTDVSWLLYTEHRGVRAFQEISSFQGQLRWGPMVFGYIQSIPPPPVGARLSHDEIDDRWMQFAEHLLPAGQLCLVPEQDDYDGYEAIAQRLERVLNLRIVTADTELYDIMQDCLTIVRRGSSADGTVRARQRRCMDH

SEQ ID NO: 134850 - protein, 96 aa, Glycine max
  Coding DNA Sequence Number=SeqID_18072
MGFFWFYFRHGVVLYVNSAPCRTQTAIANGEFGVTEQAANGTGETCLNRHYRWRFVQAQNRQSNWRVPLSARLQGCRSCVFSECITSSRNSLDERL

SEQ ID NO: 134851 - protein, 123 aa, Glycine max
  Coding DNA Sequence Number=SeqID_18073
MTCLMKKYKKDSNFLLHEVLSWPSPPLSHAKLNVPQMQVFFCHICLLSISIFFVLFAFPLSPLFTATAISANSDKCRHSIRVSTTEIHRAEIMVRSRGLGRTLDRVIGRALGREVNGDVDEAP

SEQ ID NO: 134852 - protein, 155 aa, Glycine max
  Coding DNA Sequence Number=SeqID_18074
  Gene Ontology: Mol. function=oxidoreductase activity; Cellular component=cytoplasm; Biological process=retinoid metabolic process
  Homolog annotation: Hit_ID=Q10A46; Match level="QueryCoverage=97%, HitCoverage=42%, E-value=6e-38, Identity=51%"; Hit description =Alcohol dehydrogenase 2, putative, expressed
  Pfam annotation: Domain name=ADH_N; Domain location=2-108; Score =81.9; E_value=1.9e-21; Accession=PF08240.2; Description=Alcohol dehydrogenase GroES-like domain
MEVRIKILFTSISHTDLSSWQGENEAHRAYPRIFGHEASGIVESVGEGVSEMKEGDLVVPIFNGGCRDCKYCMCEKTNMSQRFGVNPMKKVMASDEYTVVDSACVVKIHIDGDGDLNPYIKIKDLPYSVVAYLRVLGLLGIPLMSILVQLYQRKQ

SEQ ID NO: 134853 - protein, 270 aa, Glycine max
  Coding DNA Sequence Number=SeqID_18075
  Gene Ontology: Mol. function=nucleic acid binding; Cellular component= cytoplasm; Biological process=DNA integration
MAQYTMLGSPNQNGVTERRNQTLMDMIRIMLSNSKLPCSLWNEALKIATYILNRVPTKAVPKTPFELLKGWKPSLKQVRVWGFPTEVRIYNPNEKKLDPMTISAYFIGYAERSKGYRFYRPTHDTRIVESRNAKFLENDVASGSDLTQGIGLEKNQCEGAVPTSSYKLVIFGDTHQNRVTQAPHQVDPILEDPVEQHQTPNVKQPKQHQTQDVEQQPEGVDVTLRRSTRIKKPAVPSDYQLYLQESQYDFGVENDPKSFLQAINSCNSML

SEQ ID NO: 134854 - protein, 65 aa, Glycine max
  Coding DNA Sequence Number=SeqID_18076
MEIYMHTMLPMSGFSHRLHRSVNSAWGQSPELALFDGFLLLHPRYFTTTRSPFVGCFSPESAAAR

SEQ ID NO: 134855 - protein, 127 aa, Glycine max
  Coding DNA Sequence Number=SeqID_18077
MPFREDHFRKTLFPETFRKNLLPEEDFVIPEELRKTFRKNVIRNVSRRRCSVFEVLLVVVLPISSEYRRKKFRNENVVFPEILLPELLPEVTMAHSGRSSSGSTSSGMSLSNLRKHFFRNVTGMLHY

SEQ ID NO: 134856 - protein, 307 aa, Glycine max
  Coding DNA Sequence Number=SeqID_18078
IETLMRAQAQFPNTTPPFPTRDIYGSVHRPRECTVDYELVVAMDEINFVTDSDEKKHSPKDANDVLTEKDQASEKVEVPTDGNSMLKKEGDNKKEILISPLPTNISLHLADRSVVYPRRAIKDVLVKADEDVPTIFRRPFPLVIYLLRLGLGAFPSVGTPNPFERILTNEDLDWELNLKVEEILSLHHSHHSPKSSNFERLEYDYGTKTKPSVEEPLELDLKPLLSNLKYVLRDNKEVFGWSIHDIRLNPNMMEVVKGKVSPVQCVPKKGGTTNVAPYGACRPWVFFINGVICFLKINGGGMETEER

SEQ ID NO: 134857 - protein, 217 aa, Glycine max
  Coding DNA Sequence Number=SeqID_18079
  Homolog annotation: Hit_ID=Q010T6; Match level="QueryCoverage=19%, HitCoverage=20%, E-value=2e-14, Identity=78%"; Hit description =Homology to unknown gene
MASVIPRCLPPPIPIAHRRKAQVVKSCHQNESSASAHTDHSSNPKQLKVHPLMQELRVTVSRRNCLSCLCSTIVLISDCAMPIFLPKASAADGNGIMEKPVCRNCLGSGAVLCDMCGGTGKWKALNRKRAKDVYEFTECPNCYAIRGDDNGMCYQWRKAEISPSKHAIASYGAAMMGLPSQIVYGSWQKIIYAIPPWLLFNNTGVNQNHEPGTDLEP

SEQ ID NO: 134858 - protein, 204 aa, Glycine max
  Coding DNA Sequence Number=SeqID_18080
  Gene Ontology: Mol. function=DNA binding; Cellular component =intracellular; Biological process=regulation of transcription, DNA -dependent
  Homolog annotation: Hit_ID=Q1SCS8; Match level="QueryCoverage=87%, HitCoverage=44%, E-value=4e-44, Identity=53%"; Hit description=High mobility group proteins HMG1 and HMG2; AT-rich interaction region
  Pfam annotation: Domain name=HMG_box; Domain location=83-150; Score =52.1; E_value=1.9e-12; Accession=PF00505.9; Description=HMG (high mobility group) box
MATSSSADSTVIGVIDQKFEGGYVVTVTMGSEQLNGVLYYAQEDSVLLPAPSHNNNNAAAASLQKKKRRRSKSEIKRRNPALPKPKKTGYNFFFAEEHARLKPYHQGKETDIGRMIGENWSKLTESEKMVYQEMANKDKERYLKEMEEYVEKLKADQVIVDAVPLRQWPPQQDTDIQMEEAEAGEGSFDMNAMSLMDSEERFSY

SEQ ID NO: 134859 - protein, 45 aa, Glycine max
  Coding DNA Sequence Number=SeqID_18081
MGEKHLLKKALVHWFHVAMLFSALTVVGIGILQGRSEVPSMSEPN

SEQ ID NO: 134860 - protein, 416 aa, Glycine max
  Coding DNA Sequence Number=SeqID_18082
  Gene Ontology: Mol. function=formate-tetrahydrofolate ligase activity; Cellular component=mitochondrion; Biological process=folic acid and derivative biosynthetic process
  Homolog annotation: Hit_ID=Q1SCS3; Match level="QueryCoverage=99%, HitCoverage=61%, E-value=0.0, Identity=83%"; Hit description=Formate- tetrahydrofolate ligase, FTHFS
  Pfam annotation: Domain name=FTHFS; Domain location=16-416; Score =563.6; E_value=2e-166; Accession=PF01268.9; Description=Formate- -tetrahydrofolate ligase
MNSSTTVRKLQVVSPVPADIDIANSVEPVHISQIAKELNLSPNHYDLYGKYKAKLKSDLDAHAQVLLSVLDELQGSEDGYYVVVGGITPTPLGEGKSTTTVGLCQALGAFLDKKDVGIVRSFRSSQVVTCLRQPSQGPTFGIKGGAAGGGYSQVIPMDEFNLHLTGDIHAITAANNLLAAAIDTRIFHESTQSDKALFNRLCPPNKEGKRSFSDVMFRRLKKLGISKINPDDLTPDEVNKFARLDIDPNSITWRRVMDINDRFLRKITIGQGPDEKGMVRETGFDISVASEIMAVLALTTSLADMRERLGKMVIGNSRSGDPVTADDLGVGGALTVLMKDAIHPTLMQTLEGTPVLVHAGPFANIAHGNSSIVADKIALKLVGPGGFVVTEAGFGADIGAEKFMNIKCRYSGLTPQ

SEQ ID NO: 134861 - protein, 155 aa, Glycine max
  Coding DNA Sequence Number=SeqID_18083
MSMKKEHGGIDFKQLHGFNLAMLGKQSWCLMSDQDTMNHYVTSTSNNGNQNLRVGDLIDHDLHTCKINEVAANFNPNDAQQIQSIPVLNTKRMNDIFFACDFAKEVGTTGNLLHLVDNCWTTTDNFHDFVFKLLQDSILSIRSRIRVILCWNNSL

SEQ ID NO: 134862 - protein, 95 aa, Glycine max
  Coding DNA Sequence Number=SeqID_18084
MALELLEEIERQVKELQETGLASSSPGPPEDFNLKEPARFGEPITSGVSLGSPSSEGNSENLERRKRNEVEALSNHDCDKPLHHSSFGVLCAIVD

SEQ ID NO: 134863 - protein, 182 aa, Glycine max
  Coding DNA Sequence Number=SeqID_18085
  Gene Ontology: Mol. function=ATP binding; Biological process=defense response
  Subcellular localization annotation: CTP_CleavageSite=21; ConfidenceScore=5.31e-01
MATAPVSPPPPPPSDASASPSTMKRTQRPVVNVDPATSKADGPHKKKLRAYLGIVACDKVDVTYETWKEVPAAHKDLIWEDIQAKFQIPEASDSRTKKKILQTVGERWRQFKSDLTRKWALAANQDGVDDTVCEKCDISKEKWAMGPILSDTQRPFLGGCAEKGTGHPEAKHCPPRVVSWGL

SEQ ID NO: 134864 - protein, 115 aa, Glycine max
  Coding DNA Sequence Number=SeqID_18086
MTNIQSQIPLSKHKGLGGVLDSTKRKHHFGIPITPMRLGFSEGHKNNINEKGLEIKITSEKLCNGGLGDFLHRILGEDSKDFTPIKVFLLVWGSTARNDGSRWPPVVVGGGKMRC

SEQ ID NO: 134865 - protein, 166 aa, Glycine max
  Coding DNA Sequence Number=SeqID_18087
MAYIQEFFAHLRPSKDCWDDLFVVNKGEGGDQFKSNFELYWSSTHYNKLVNFNGKQEEELSTKKLASTNSIVELVNEKGDAITCKLLLQTVDEDWKSVLEVLMGKSKNKPMSIAPLYTENRGDKKKLLNKSKASDRGKGLAMEIHSKASHDIPHPPSSKRKKGRQY

SEQ ID NO: 134866 - protein, 251 aa, Glycine max
  Coding DNA Sequence Number=SeqID_18088
  Gene Ontology: Mol. function=protein serine/threonine kinase activity; Cellular component=anchored to membrane; Biological process=protein amino acid phosphorylation
  Homolog annotation: Hit_ID=Q1T3J4; Match level="QueryCoverage=93%, HitCoverage=37%, E-value=6e-23, Identity=29%"; Hit description =Protein kinase; EPSP synthase
  Pfam annotation: Domain name=DUF26; Domain location=163-217; Score =42.2; E_value=1.8e-09; Accession=PF01657.8; Description=Domain of unknown function DUF26
  Pfam annotation: Domain name=DUF26; Domain location=53-107; Score =55.3; E_value=2e-13; Accession=PF01657.8; Description=Domain of unknown function DUF26
  Pfam module annotation: Pfam domain module=DUF26::DUF26; Domain location=163-217::53-107
MKSSSQCSQADNYSDSESTFQTNLRTLLDSLASNVVQNHGFYQTIVGKKANRVYGTVLCRGDISASNCSDCTLNSTRVASNDCPMSKDVSIWFRWCFLRYSNVSFFGDMQQTAVAITNETDFDDPSVVSEGLPFMSGLAAVAPDKSFMFHTEVLNTSQSGQKRYGMAQCTRDISRVDCRRCLDSQLENFRTVIGNKRRWEIYGSNCFMWYNDYQFYSNGSTLLSAAWRPSSYTTLIIGMTLAVSAALFMLF

SEQ ID NO: 134867 - protein, 265 aa, Glycine max
  Coding DNA Sequence Number=SeqID_18089
  Gene Ontology: Mol. function=transcription regulator activity; Cellular component=nucleus; Biological process=regulation of transcription
  Homolog annotation: Hit_ID=Q1SGR4; Match level="QueryCoverage=52%, HitCoverage=76%, E-value=9e-46, Identity=64%"; Hit description =Prefoldin; Helix-loop-helix DNA-binding
  Pfam annotation: Domain name=HLH; Domain location=115-163; Score=2.4; E_value=0.081; Accession=PF00010.16; Description=Helix-loop-helix DNA- binding domain
  Pfam annotation: Domain name=Thioredoxin; Domain location=17-121; Score=98.2; E_value=2.5e-26; Accession=PF00085.10; Description =Thioredoxin
  Pfam module annotation: Pfam domain module=HLH::Thioredoxin; Domain location=115-163::17-121
ELDERMEATTEQNNSKVVLIDSLQSWEFHVNQASNQNSPVVVHFTASWCMPSVAMTPVFEELASSYPDVLFLTVDVDEVKEVATKMDVKAMPTFLFLKDCAVVEKVVGANPEEIKKRIDGLAESTRVSLAFMELWSIVGPGMPLKMDKAVILSDAVRVVSQLQEEAQKLRESSENLQEKINELKAEKNELRDEKQRLKAEKDSIEQKLIALSSQPSFLPAFPSAGQVVGSKLVPFMGYPGVAMWQFLPPAAVDISQDHVLRPPVA

SEQ ID NO: 134868 - protein, 279 aa, Glycine max
  Coding DNA Sequence Number=SeqID_18090
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=98%, HitCoverage=32%, E-value=1e-118, Identity=70%"; Hit description =Lustrin A-like
  Pfam annotation: Domain name=DUF231; Domain location=121-279; Score =209.1; E_value=1e-59; Accession=PF03005.6; Description=Arabidopsis proteins of unknown function
FKANDMLEMLRGKRLIFVGDSLNRNMWESLVCVLRNSVEDQSRLFEASGREEFRTEGSYSFIFQDYNCSVEFFRSVFLVQEWETPDLKGSTKETLRLDVLERSCDKYKDADVLIFNTGHWWTHEKRIEGKGYYQEGNHIYGQMNVEEAFHKALLTWAQWIDSNIDPKKTTVFFRGYSPSHFRGGEWNSGGKCDNETEPLESESDLETPEMMMTIDSVIKKMKTPVFYLNITKMTYFRRDAHPSLFRNENMTEETKRHMLIHQDCSHWCLPGVPDLWNEL

SEQ ID NO: 134869 - protein, 354 aa, Glycine max
  Coding DNA Sequence Number=SeqID_18091
  Gene Ontology: Mol. function=ATP-dependent peptidase activity; Cellular component=integral to membrane; Biological process=ATP -dependent proteolysis
  Homolog annotation: Hit_ID=Q5ZAW6; Match level="QueryCoverage=96%, HitCoverage=70%, E-value=1e-65, Identity=39%"; Hit description =Membrane protein-like
  Pfam annotation: Domain name=DUF81; Domain location=20-328; Score= -25.2; E_value=0.00027; Accession=PF01925.9; Description=Domain of unknown function DUF81
MCITSPKFGGKSLIDYDIALSSEPCMLLGVSLGVICNLVFPEWLITVLFAIFLAWSTSKTCKSGLLFWKAESEVIRKNGLINEELEKGLLENETIEQRKVYIENNEPKSIEVSLLAPQGNSKVRIPWFKLAVLLLIWFSFFSVYLLRGNRYGEGIIPMEPCGVGYWILSSVQVPLAVVFTAWIVFRKESLRDRTLIPKLPDMKVPGLTKKRPSNILVFPLMALLAGILGGVFGIGGGMLISPLLLQVGVTPEVTAATCSFMVLFSATMSGLQYLLLGMEHVQAALVLAIMCFVASLLGLLVVQRAIRKYGRASIIVFSVSIVMFISNVLMTSFGAIKVWTDYESGEYMGFKLPC

SEQ ID NO: 134870 - protein, 283 aa, Glycine max
  Coding DNA Sequence Number=SeqID_18092
MSQQQNQNQNLPAVSQSLPQQTVSEADVKPFSIRQYVLASRHINILHNWPFPEKHLQLCFKDGLKEVLPPFGGQTSLDEPLKGCSNLMHSLNDNNKEADSCIAEVPHLIDDDHRQSTTNNECVYKVTNHPSSHGEENHSNQHSCSISDNLSQPADTCTLLSSIHVSKSLPSSKEVKDKRKKRKGRCKKRSMVDILAVAQHSTLEEIHRMNKFYYAETVINGCQQTVPHENIPRSEVVGVDSCRKAGSEDHGVANVDMTPKRPLLLKFKLNGCNVNRNCKLSMN

SEQ ID NO: 134871 - protein, 75 aa, Glycine max
  Coding DNA Sequence Number=SeqID_18093
MERIMKVIGEFASCIPKSPVSHSLQFAATQRTFLVSLKCAKAKECSISWSKIVLLSWPFSYTDTGQNFPLLHFFH

SEQ ID NO: 134872 - protein, 160 aa, Glycine max
  Coding DNA Sequence Number=SeqID_18094
MVIFSHGVATEDKGEEPRSLAHGSFLEKQGGVPLINGQNTRPKRRKTYYNIYNEKWTLPWQIGSEIYPEVHKNPRAFFSSSSPILLEPFAQGSGDWSFPREDCISRSLHTAFENEIPYPNQGDCNRQGRPKASMTMLCKQPEGSTLSSHQEVCQASPHNN

SEQ ID NO: 134873 - protein, 316 aa, Glycine max
  Coding DNA Sequence Number=SeqID_18095
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=83%, HitCoverage=37%, E-value=3e-31, Identity=29%"; Hit description =Protein kinase; Type I EGF
MNLAKYQDLFFKAMHTQIALVLVLALVNVAIIVSDITLNGCMDNCGNVSIPYPFGVGTSKETSENCFLEDKMNLTCQNNNLYLGVNLLVLEHVMDVLFYVSKICNTPNRVANDLFLRTPSNFTISSKENNFISVGCETYGYLNSFNNGVQYSTECLTRCSKFPNDVVTNGDCSGIGCYEVDIPPNMKNITIEAYRFDVSSNYFQSCGHSFAAKRGSYSFDISHLENLQFDTIPMVVDWSVGDELGCEDFRKGFRKGACMNNSYCHDIDISYGYQCKCEEGYDGNPYHPNGFQVNNYMMPGNGGKDHYAIEIEQLVT

SEQ ID NO: 134874 - protein, 128 aa, Glycine max
  Coding DNA Sequence Number=SeqID_18096
MPIKPKVSSLTATTTTKVQGQGSTGQDDIPPDWLARPSTRGKLNDLEAVATLEEEPRSFEASSSFPIPGQSHTDLIEEVIMAEEPRRVTLEDYSSSKAKRWLHLFKGNSLKTWDEVVEKFSEEVFPGV

SEQ ID NO: 134875 - protein, 96 aa, Glycine max
  Coding DNA Sequence Number=SeqID_18097
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=30%, E-value=4e-33, Identity=57%"; Hit description =Integrase, catalytic region
MRDRRGRFAVNHLEWSHAGARVDGRVVLFQDAVEDLRLAIRLWVVRGTQLDFGATQLKQLMPEVADKNGVSIRHQALQKSMKLADNVNEKKSDLVS

SEQ ID NO: 134876 - protein, 255 aa, Glycine max
  Coding DNA Sequence Number=SeqID_18098
  Gene Ontology: Mol. function=aspartyl esterase activity; Cellular component=cell wall; Biological process=cell wall modification
  Homolog annotation: Hit_ID=O04887; Match level="QueryCoverage=99%, HitCoverage=50%, E-value=1e-115, Identity=76%"; Hit description =Pectinesterase-2 precursor
  Pfam annotation: Domain name=Pectinesterase; Domain location=1-241; Score=553.5; E_value=2.1e-163; Accession=PF01095.10; Description =Pectinesterase
  Subcellular localization annotation: CTP_CleavageSite=69; ConfidenceScore=5.20e-01
MLVGDGIGKTIITSSKSVGGGTTTFRSATVAVVGDGFITQDITFRNTAGATNHQAVALRSGSDLSVFYRCSFEGYQDTLYVYSDRQFYRECDIYGTVDFIFGNAAVVFQNCNIYARNPPNKVNTITAQGRTDPNQNTGISIHNSKVTAASDLMGVRTYLGRPWQQYSRTVFMKTYLDSLINPEGWLEWSGNFALSTLYYGEYMNTGPGSSTANRVNWLGYHVITSASEASKFTVGNFIAGNSWLPATSVPFTSGL

SEQ ID NO: 134877 - protein, 207 aa, Glycine max
  Coding DNA Sequence Number=SeqID_18099
  Gene Ontology: Mol. function=chromatin binding; Cellular component =chromatin; Biological process=chromatin assembly or disassembly
  Homolog annotation: Hit_ID=Q1SAV4; Match level="QueryCoverage=77%, HitCoverage=45%, E-value=4e-28, Identity=39%"; Hit description =Integrase, catalytic region
MLTDRDILHVVLQRRLRKAQEAMKLTANKHRQDVQFSLGDWVYVKLRPHCQTFVAQAHTKLSKRYFGPFQVAERIRPVAYKLHLLASSRIHPVFHVSLLKPHLGPVLETPARLPPSTADDHPLLVPLSFLNWNWDTSVSPLDKLVLVQWEVSHNLEDKVVFGYEGVDSITPISDNTREATPDNIPEENNINRPRRTIKKPNYLKDYA

SEQ ID NO: 134878 - protein, 257 aa, Glycine max
  Coding DNA Sequence Number=SeqID_18100
  Subcellular localization annotation: CTP_CleavageSite=34; ConfidenceScore=5.10e-01
MSQQQNLSSVSQSLLQQTISGADVKPFSIRQCVLASRHTNILQSWPFHEKHLQLSLNQGLKEVLPPFGRQTSPAESLQGCSNFLMHFRNVNDDKEPDFCKAEEVPQNIKNEYCDYKVTNQPSSHEEGNQQHKCGISSSSNVHKSNPVVLLPPSKAVKDKRRRRRGRCKKRSIVDILAEARHSTLEEIHRMNKFYYDATVIEGCQQTVAYENISKSELAGEDGSEDRGMPNNVHMAPNGPFLLKFKLNGCSVNRNFRT

SEQ ID NO: 134879 - protein, 966 aa, Glycine max
  Coding DNA Sequence Number=SeqID_18101
  Gene Ontology: Mol. function=GTPase activity; Biological process =immune response
  Homolog annotation: Hit_ID=Q1SCR5; Match level="QueryCoverage=97%, HitCoverage=98%, E-value=0.0, Identity=63%"; Hit description=Moesin; Prefoldin
  Subcellular localization annotation: CTP_CleavageSite=10; ConfidenceScore=5.38e-01
MKKFFFFKSSASSSGSNNDAAPPKSTNKQTAWDSFSDIGVNNNRAYGKTEDYFQSPKGFFSKSRKHVSDTQSSSAGPDLRRSRSLSSSAYQFRDPTRSPSSSIVSDPYQQVGHSSRSQAPNYEKPKRDKPAQVAVSSVQNSHRYERPGSSSSSRSHHESSGNSSSTCSSNISSKIVDRYIDGEQHPEESRPKNNSQRSNSRHGNYGVKRPPKVQLTAPNSPTHGVKDKPRTHSFREAKATRLRFSSRDWTENGFGPESPRSLAKNVIERLSQSCDLPKPCSKNVNIDNPITIEDIYSRSVNGHYDSDFDDAQAKNDLSDEPYRMANGYHGMDVNFEGLSCDEPEEDADAELIRRSKEAEERVILLSKKLERDSFFPDDGYDVSALIRTIRHLLEEKISLALEVSTHLRSQIADRVSARDELSRVKTELEFRTQRLEKEKNEMQSALEKELDRRSSDWSFKLEKYQLEEQRLRERVRELAEQNVSLQREVSSFSEREMESKSVMAYTDQQLKGLTDKTEIMKKEILDLQQNLLELQEKYKIAEENRDCFLRNFEEKEEECKELHKSLTRLLRTCSEQEKSIAGLQDGFSEELHKNHPMESVDKHIANHHMENVDKHIAKMRMEQMRLTGVELALRKELESCRFQADSLRHENIILLNRLKGDGKESVAATYRLDKELWARIYCLQNQGLTMLNESTYLCSKLLEFVKRKGSHLRQNVQLDREVIGNGLDGQFIVESETKIQGLKSGTEGLTRSLQLMSSLLKDKSNPLTSKFQSEIIDAGKLATLNDQSSEDILRTELKAECLVTSLLREKLYSKELQVEQMEAELATAVRGNDILRSEVQNALDNLSSVTHKLKDHELQMLKKDESRNCLQNDLQESNRELTIMRGKLPKVTEERDYMWEQVKQYSEQNMLLNAEVNVLKKKIETLEENNLEKEGQISILQDSLAKRSYDDLLGSPAHDFFSTKLL

SEQ ID NO: 134880 - protein, 587 aa, Glycine max
  Coding DNA Sequence Number=SeqID_18102
  Gene Ontology: Mol. function=nucleic acid binding; Cellular component= intracellular; Biological process=regulation of transcription
  Homolog annotation: Hit_ID=Q1SGQ8; Match level="QueryCoverage=66%, HitCoverage=98%, E-value=1e-86, Identity=44%"; Hit description=Zinc finger, C2H2-type
  Pfam annotation: Domain name=zf-C2H2; Domain location=341-364; Score =17.8; E_value=0.039; Accession=PF00096.16; Description=Zinc finger, C2H2 type
MALLTLLCFRLINRHFHLGRPLPLSLRTIHCRYCHDHCHEIPYTNDAILLDDAAVVHQIHPRWVLVISAPKTRLCSVSHQRRHPSPHLPPYPSSPSKPQPKGDYAAAEIVDGLKLKGLRCGRGLLLLAEMSSAGNLAKGDYTATIVKITEDHSDFIIGFISVNPTYGQGHLYILLSFWQPLEFKCIRKKGRDRMLEAWLSLKKTLQCKPQPNQVHDPKTTRQQKGNQRTKLSNLESSNTKDFIQGSKGHLKKSLSYRGDIDITSPITNEIVLDSSNNGTSRCCPCPQSNSGNKASEGSHRTRRSATSSKITMTYHVDYNEANVSSNTSTLVQMDSDGCSTLTCHKCGKKLKNLDAVEAHHISEHSVTELEEDSSRQIIETICGSGTSSINNSENMVGQIDCILKVLNVPKTLACFEEYRAKVKDNAEKLQKKHPRCVADGNELLRFHGTTISCSLGTNSSSLCTLDYCGICQILRNGFFTNKEFHGASGVYTTSTSRKAFESISIMTSHERPFARKSVIVCRVIAGRIYSPLEEIEEERADSEFDSLSENTNGHSDAEELYVLNPKALLPCFVIIYKQQTDKARRLG

SEQ ID NO: 134881 - protein, 66 aa, Glycine max
  Coding DNA Sequence Number=SeqID_18103
MVGSRVDVGAVVNGDLGEDGVSVRADSRSRMTLSLTVICKVLVVISRVSVAMAVHGGVVAVVSEHD

SEQ ID NO: 134882 - protein, 74 aa, Glycine max
  Coding DNA Sequence Number=SeqID_18104
MSSRIVADNATPSPYFDLMELDDLTRRPRHSHARTTPQARSPSQLPLYFSEFANWKVPPAERRVWSSSTSHGRA

SEQ ID NO: 134883 - protein, 216 aa, Glycine max
  Coding DNA Sequence Number=SeqID_18105
  Gene Ontology: Cellular component=nucleus
  Homolog annotation: Hit_ID=Q1SCQ5; Match level="QueryCoverage=99%, HitCoverage=44%, E-value=9e-53, Identity=56%"; Hit description =Nuclear protein SET
MPFRVRTATASRWWSLHTVFNTHCLCRNLYYSALSKRQWLERKAACSISSSLFIGNSSYGRSLFASKIIQTGDCILKVPYRVQITADNLLPEIRSLIGEEVGNIAKLATVILIEKKLGQGSEWYPYISCLPQQGELHNTASFCSFSYFEWCLFLVFWTESELEMIRPSSVYQETIDQKSQIEKDFLAIKHLGIKFLNVPIKVLEILPTRTSCMHAH

SEQ ID NO: 134884 - protein, 175 aa, Glycine max
  Coding DNA Sequence Number=SeqID_18106
  Gene Ontology: Cellular component=nucleus
  Homolog annotation: Hit_ID=Q1SCQ5; Match level="QueryCoverage=91%, HitCoverage=36%, E-value=1e-57, Identity=71%"; Hit description =Nuclear protein SET
MLDFGFTIPYNIYDQVQIQFDIPKHDPLRDMKLELLHQYFIPPPEDMKGLSHPVNSFSIKEVKSDSGKGKGLPQSLRALARVLSCTTSQEIDNLIAEAAQTDGRLARRPLQDISKEIQAHMMLLSLFIQLIEERSVAIMSLDSLSLCGRFSVRKLMAQDLLQATGLSKRLSFQQM

SEQ ID NO: 134885 - protein, 78 aa, Glycine max
  Coding DNA Sequence Number=SeqID_18107
MPDFGISVSLGGNSFYKNWVQLKGVIHSIGSTTLDNQVNRYSKKDFADGMYNPSSTTTVSPTMPTMLNFSSGCIHRQL

SEQ ID NO: 134886 - protein, 487 aa, Glycine max
  Coding DNA Sequence Number=SeqID_18108
  Gene Ontology: Mol. function=receptor activity
  Homolog annotation: Hit_ID=UPI0000D9EDA5; Match level="QueryCoverage =53%, HitCoverage=33%, E-value=1e-55, Identity=46%"; Hit description =PREDICTED: similar to leukocyte receptor cluster (LRC) member 8
  Pfam annotation: Domain name=SAC3_GANP; Domain location=214-409; Score=229.0; E_value=1e-65; Accession=PF03399.6; Description =SAC3GANP family
MSSAKDSLLPKYKKSPRRSKSRWEPMPEEKPVDNPMLISNDTVKYNSWVPTEKDRKVAVENKESKDGFRNTKFSPLLHRLSSKALQRPFKKQRVTDASIASENGDASSDSDKEQSLTAYYSAAMAFSDTPEERKRRENRSKRFDLGQGYRTENNHSRKKHAGAGSFYNRRASALVLSKSFEDGASKAVEDIDWDALTVKGTCQEIEKRYLRLTSAPDPATVRPEEVLEKALLMIQNSQKNYLYKCDQLKSIRQDLTVQRIRNQLTVKVYETHARLALEFGDLFEYNQCQSQLQTLYAEGIEGSDMEFAAYNLLCVIMHSNNNRDLVSSMARLSHEAKKDEAVKHALAVRAAVTSGNYIAFFRLYKTAPNLNTCLMDLYAEKMRYKAANCMCRSYRPTLPVSYISRVLGFSTGMATNGASDEGETDALEECSEWLKAHGASIITDNNGDMLLDTKVSSSNLFVPEPEDAVAHGDANLAVDDFLARAPL

SEQ ID NO: 134887 - protein, 485 aa, Glycine max
  Coding DNA Sequence Number=SeqID_18109
MANEGSNTETLPPAEPHLFENRHVDASQHHPTSYAPTTTGSEAAPWTVHSSTGNGVYSNPTYLYDQHPQPPGRSIQDGQNVSSVAGNSSNLGTANVTQDYNAYASYPSSSNPYGYGSMGFSGYYNNYQQQQPNHTYSQPVGAYQNTGAPYQPISSFQNTGSYAGSASYSSTYYNPADYQTTGGYQNSSGYGNQATMWNNGSYSSHPYTNYTPDSSGSYSSGAATTSVQYQQQYKQWADYYNQTEVSCAPGTENLSVTSSSTLGCPIPAVTGAYATPNSQPPQSYPPFWRQESSSSSIPFQPAAVNSGDHDGYWKHGAQSSQIQQTNPIQPNYQSPLDLKSSYDKFQDQQKTVSSQGTNLYLPPPPPLPLPSQQVNMAPVQSVPSPDAKRPKAEKDSSTTSSVPKPAYIAVSLPKPSEKVSSNDAANSILKPGMFPKSLRGYVERALARCKDDKQMAACQAVMKELMHTYDVFETQDDLCVYITLF

SEQ ID NO: 134888 - protein, 1463 aa, Glycine max
  Coding DNA Sequence Number=SeqID_18110
  Homolog annotation: Hit_ID=Q9FNB4; Match level="QueryCoverage=31%, HitCoverage=38%, E-value=7e-27, Identity=28%"; Hit description =Arabidopsis thaliana genomic DNA, chromosome 5, P1 clone:MSH12
MSVENGVQRPPATCSCSANSEWHCRTSGRRHEGVGKKQTKKSRLYIERSRSEDKKHGGKRATWKERTHGDASRRESKARIVLLGKEKRFRRYKCLPMTDYFGIMPVSGHEETGVKSYAGQFSGLIAGVPIKKRRFPTFQPSSSPVSGEPCSLTEETELQRKENSITSQGSALPNAAGAPIKKRRFPCLPPSLEEASRSEESDALRKEHSSTSPGSTLSPSSSGLSDANGISAFEDKKASIDVTNANMVQSNSCFLTPKLEQSNVGTQSCTLNVMDSKEKVILSEGSNKKLESQTIKGNPELLLAAKEGLALSIGADEHLFPAVASMENNPQKIEKAQPVSLELSLSKEDCSTHSLNTDPKTDSDTTRVHSNRANWDLNTTMDAWEESGTEAGSVKTSIDGLKISDSSLDEKQLVCSPGMTSPASVVSVKPMCEESQKKTFTFPSGLCGPQFKFVDSSNLSLAPFIQKYTEEPSRLSVKLNSGSAIPNVSLSSVASTVGDANTSSFRLVKPEPFDENSKRDLKDVNASTVGSLDSVTVKQELVQASAANSSKLSNVSNLLKVDAASVKQEPDHKGNQEGSNAAVSKMDQLNKDSRQELDNSSPSMAMPVMPDTTQISAEPACAPVKPMCTAELSTSENTVSQIENSSPTEGVNVEKVCDGACLNAEQVIIETVAMPMVDNGLVLNNPGLQTSSVSTEEENAADRDACRLKLMNEPPPASRGNGEGCASDEEKITLSTDMLEDDSYDSDSESDENHAVTIAVDTECYVEDDDYEDGEVREPLDPSTAEDVCEVREVEHPDSNFVNKQMEKGMVSGDCPTSYQVVEKNNMTAIQSEINNEVVDMDIEMHERSGKVVDKNVCVQESLDDEKCNIATHGNKPVNVLQMKALDLLEGKNVCEALVTESPSNQATNGSHGVDVQCADEVVKTTDIVKQTDLDFETMEVSANADDAAKDVNNGGNLGRIIDLSRATSSSSPGKTRPMSGRSLSSRAGRDVLSDTLDGDKLHRGRDEVYIDGPHKFSRERHQDISPRKTRMNFVRGRGRLNNRLDSVRNDWESDREFSGEFYNGPSQFRGPRPKYASAFADTDMEYNNVAPDGSYVGNGRLGRKPLNDGSYIAPRRRSSGGRDGIQIGHRNPRNISPNRCIGDGSDLVGVRHNEKFMRSLPEDNMDAMFTRPQTFEGMDGRFTRGSRNFSSMQRRGPPQIRSKSPIRSRSRSPGPWSSPRRRSPRRRSPDGFGGHPELTHRRSPFYRVDRMRSPDRPVFPAERVVRRHGSPSFMSRPSNDMRDMDSARDHGHPRSGRILIRNRRFDVVDPRDRVDNDDEYFGGPMHSGRLLELSGEGNGEDRRRFGERRGPVRSFRPPYNNNNVGESFHLNAEDGPRHYRFCSDDSDFHERGGNNLRERDFERRIKGRPANVPPRRTRNMDEQEENFRHGGGGGGGGGGQVKGVEQELDAEDDGAALSGQMK

SEQ ID NO: 134889 - protein, 354 aa, Glycine max
  Coding DNA Sequence Number=SeqID_18111
  Gene Ontology: Mol. function=actin binding; Cellular component =cytoskeleton; Biological process=erythrocyte maturation
  Homolog annotation: Hit_ID=Q1SCR2; Match level="QueryCoverage=99%, HitCoverage=100%, E-value=1e-145, Identity=67%"; Hit description =Lissencephaly type-1-like homology motif; CTLH, C-terminal to LisH motif
  Subcellular localization annotation: CTP_CleavageSite=59; ConfidenceScore=5.06e-01
MEMDSLPNGNNTSGTPISATATANPAQPPSSNLPQLTESLKLEHQFLRVPFEYYKKTLRANHRAVEKEMSAVISGVNEAAATDLSPDDAVNHLNSLVSRLQGLKRKLEEGSRAEHLQAQKCRVRLDHLESADAENMSEWNNTRMKRILVDYMLRMSYYDTAVKLAESSNLQDLVDIDVFQEAKKVIDALQNKDVAPALAWCADNKSRLKKSKSKLEFQLRLQEFIELVRAENNLRAITYARKYLAPWGATHMKELQRVIATLAFKRDTECATYKEAFRTLAMPLPYSKQHHSKLVCYITKELMDTENPPQVLPNGYVYSTKALEEMAKKNNGTIICPRTGLVCSYTELVKAYIS

SEQ ID NO: 134890 - protein, 450 aa, Glycine max
  Coding DNA Sequence Number=SeqID_18112
  Gene Ontology: Mol. function=signal transducer activity; Biological process=response to light stimulus
  Homolog annotation: Hit_ID=Q7XIJ3; Match level="QueryCoverage=78%, HitCoverage=76%, E-value=4e-62, Identity=38%"; Hit description =Putative phototropic response protein family
  Pfam annotation: Domain name=NPH3; Domain location=121-349; Score =140.4; E_value=4.7e-39; Accession=PF03000.5; Description=NPH3 family
MEMTPSNLAMLCSAAHFLEMECDDDDGPAGTPNLKPQIEKFLDGIRFWTWSELLEALKLCQGLFSFKGYLEILDRIVDNLIERLASPGITSPNTCSSNRSSFQFSCATSSNNSWRNNCSGATWWFEHLLFLKIDLLDKVIRTMISYDFDHGVVSRFLFHYHNSSCLGAAQAEKMESTKVVIDLVLLLESRSISCKDLFNLNRSAVSLKMSRSCINKIESLIGPLLDQTTIDYLLLPSPHGKGQAYDVDFVLRLVHIFFFGGSFELTSNRLMRVAKMMDLFLVEVAPDPHLKPFEFEALITVLPDAARESHDQLYLAMDMYLKVHAGLSEKEKISICSTLNHEKLSAELLRHLTRSLVFPSDAKPRAYVTRQSRMKTLLQENDHLKNFFESMFRKSFKNMEANEDVEKRSYDAEELRGDWEGMQNGTQMASMKKSGTHIMSNAMYLPKLCS

SEQ ID NO: 134891 - protein, 507 aa, Glycine max
  Coding DNA Sequence Number=SeqID_18113
  Gene Ontology: Mol. function=magnesium ion binding; Cellular component=chloroplast; Biological process=metabolic process
  Homolog annotation: Hit_ID=Q1SMG8; Match level="QueryCoverage=96%, HitCoverage=94%, E-value=0.0, Identity=67%"; Hit description=Terpene synthase-like; Terpenoid synthase
  Pfam annotation: Domain name=Terpene_synth; Domain location=1-165; Score=8.8; E_value=8e-08; Accession=PF01397.11; Description=Terpene synthase, N-terminal domain
  Pfam annotation: Domain name=Terpene_synth_C; Domain location=168 -438; Score=246.3; E_value=6.4e-71; Accession=PF03936.6; Description =Terpene synthase family, metal binding domain
  Pfam module annotation: Pfam domain module=Terpene_synth::Terpene _synth_C; Domain location=1-165::168-438
MESMYMVDTIQRLGIEHHFEEEIEAALQKQHLIFSSHLSDFANNHKLCEVALPFRLLRQRGHYVLADVFDNLKSNKKEFREKHGEDVKGLISLYEATQLGIEGEDSLDDAGYLCHQLLHAWLTRHEEHNEAMYVAKTLQHPLHYDLSRFRDDTSILLNDFKTKREWECLEELAEINSSIVRFVNQNEITQVYKWWKDLGLNNEVKFARYQPLKWYMWPMACFTDPRFSEQRIELTKPISLVYIIDDIFDVYGTLDQLTLFTDAIKRWELASTEQLPDFMKMCLRVLYEITNDFAEKIYKKHGFNPIETLKRSWVRLLNAFLEEAHWLNSGHLPRSAEYLNNGIVSTGVHVVLVHSFFLMDYSINNEIVAIVDNVPQIIHSVAKILRLSDDLEGAKSEDQNGLDGSYIDCYMNEHQDVSAEDAQRHVAHLISCEWKRLNREILTQNQLPSSFTNFCLNAARMVPLMYHYRSNPGLSTLQEHVKLLSNNAVAGAERHVVHILCLQFVIE

SEQ ID NO: 134892 - protein, 163 aa, Glycine max
  Coding DNA Sequence Number=SeqID_18114
  Gene Ontology: Mol. function=GTPase activator activity; Cellular component=cytoplasm; Biological process=regulation of GTPase activity
  Homolog annotation: Hit_ID=Q5W7F2; Match level="QueryCoverage=89%, HitCoverage=29%, E-value=2e-38, Identity=61%"; Hit description=ARF -GAP
  Pfam annotation: Domain name=ArfGap; Domain location=112-163; Score= -17.1; E_value=0.00073; Accession=PF01412.9; Description=Putative GTPase activating protein for Arf
MLSWIENNNHNSTMQLTSYRGTGKGGSLFLIAGECCITIVNSAANLLIISPTKNYTLQVESALEQMDWIEKITGVIASLLSSQIPQREVLLLYILSAPQGVCSCNKTGLKSEKPIHVLRRVCGNDKCADCGAPEPDWASLNLGVLVCIECSGVHRNFGVHISK

SEQ ID NO: 134893 - protein, 224 aa, Glycine max
  Coding DNA Sequence Number=SeqID_18115
  Homolog annotation: Hit_ID=Q10N63; Match level="QueryCoverage=91%, HitCoverage=29%, E-value=9e-46, Identity=50%"; Hit description =Expressed protein
MSSWLRSAVNKAVEVGNKNNLTRTVKNYADTVVQHAGQAVAEGAKILQDRISARNYRSVAQTIKRLEEAAVSYRGPERVQLLRRWVVVLQEIQKLSEASLAEGKERTLEQHLAVEEAKENPRKPSLVLYYDSDVGGEPLNFRDVFLQSQALEGITLSMIIHAPNEEEVSLLLEMFGLCLTGGKEVHNAIVSSLQDLATAFSSYEDEVLVDIFFSINAMYAFFSL

SEQ ID NO: 134894 - protein, 87 aa, Glycine max
  Coding DNA Sequence Number=SeqID_18116
  Homolog annotation: Hit_ID=Q10N63; Match level="QueryCoverage=93%, HitCoverage=12%, E-value=3e-17, Identity=60%"; Hit description =Expressed protein
MKWCSRLQKEEALKVRVTKDGEASEKEKELVTEISELQCKKEDLEAELKKVSTTLAAAQARLWNVREERDQFEEANNQIVEHLKIKV

SEQ ID NO: 134895 - protein, 624 aa, Glycine max
  Coding DNA Sequence Number=SeqID_18117
  Gene Ontology: Mol. function=zinc ion binding; Cellular component =integral to membrane; Biological process=regulation of apoptosis
  Homolog annotation: Hit_ID=Q9LHH2; Match level="QueryCoverage=92%, HitCoverage=51%, E-value=0.0, Identity=69%"; Hit description=Ankyrin- like protein
  Pfam annotation: Domain name=7tm_1; Domain location=452-622; Score= -104.8; E_value=0.055; Accession=PF00001.12; Description=7 transmembrane receptor (rhodopsin family)
  Pfam annotation: Domain name=Ank; Domain location=129-158; Score =20.4; E_value=0.0067; Accession=PF00023.20; Description=Ankyrin repeat
  Pfam annotation: Domain name=Ank; Domain location=164-196; Score =21.1; E_value=0.0041; Accession=PF00023.20; Description=Ankyrin repeat
  Pfam annotation: Domain name=Ank; Domain location=198-230; Score =19.4; E_value=0.013; Accession=PF00023.20; Description=Ankyrin repeat
  Pfam annotation: Domain name=Ank; Domain location=232-264; Score =33.7; E_value=6.3e-07; Accession=PF00023.20; Description=Ankyrin repeat
  Pfam annotation: Domain name=Ank; Domain location=266-298; Score =23.0; E_value=0.001; Accession=PF00023.20; Description=Ankyrin repeat
  Pfam annotation: Domain name=Ank; Domain location=300-365; Score=4.9; E_value=6.2; Accession=PF00023.20; Description=Ankyrin repeat
  Pfam annotation: Domain name=Ank; Domain location=70-99; Score=11.2; E_value=0.76; Accession=PF00023.20; Description=Ankyrin repeat
  Pfam annotation: Domain name=Syntaxin-6_N; Domain location=371-459; Score=-0.6; E_value=0.037; Accession=PF09177.1; Description=Syntaxin 6, N-terminal
  Pfam module annotation: Pfam domain module=7tm_1::Ank::Ank::Ank::Ank:: Ank::Ank::Ank::Syntaxin-6_N; Domain location=452-622::129-158::164 -196::198-230::232-264::266-298::300-365::70-99::371-459
MASHSNQPGPGAEGLGEKDPPTSFQNPLSEISPSPSPSSAPAPALVLSNSGKRIDQAGKKKYVKQVTGRHNDTELHLAAQRGDVGAVRQILEDVDSQIMGTLSGDGDEDDLNAEIAEVRACLANEENELGETPLFTAAEKGHLDVVKELLNYSTAQTVSKKNRSGFDPLHIAASQGHHPIVQVLLDYDSGLSKTIGPSNSTPLITAATRGHTEVVNELLSKDCSLLEIARSNGKNALHLAARQGHVEIVKALLSKDPQLARRTDKKGQTALHMAVKGQSCDVVKLLLEADAAIVMLPDKFGNTALHVATRKKRVELNMPYLYRSSRITQVLVLYLGSREADFKHLKVIVNELLHLPDTNVNALTRDHKTALDIAEDLPLSEEASDIKDCLSRYGALRANELNQPRDELRKTVTQIKKDVHTQLEQTKRTNKNVHNISKELRKLHREGINNATNSVTVVAVLFATVAFAAIFTVPGGDHNDGSAVVAAYAAFKIFFVFNAIALFTSLAVVVVQITLVRGETKAEKRVVVVINKLMWLASVCTSVTFIAASYIVVGKKNEWAAILVTLVGGVIISGVIGTMTYYVVRSKRSRSMRKKEKQAARRSGSNSWHHSEFSNSEVDPIYAL

SEQ ID NO: 134896 - protein, 363 aa, Glycine max
  Coding DNA Sequence Number=SeqID_18118
MATTLFACDPAEDDYIDMEVNSYSNFFCHSQSHPQPREFEFQMSSILQEKDTTTLPADELFYKGKLLPLHLPPRLQMVEKLLQNSPSPYDKENDIFEEFYSTPLATTYTTPTAGTPFESCNISPSDSCQVSRELNPEEYYNFDCPTDTSGFAAENQKKSWTKKLKQSSLGSKLKASRAYLKSWFGKSGCSYETYATSTKVADEGSVSKARENLNKHVQVAKKHSYGQIHRDRYHQPSNSVMRSYKDKTGEDGSNQHRRSFSVGIKLLSGNKSSSSTSSVSGSTSFSFSFSNKSYGCQARQLLKRCSSANSEIENSIQGAIAHCKKSQQMFSSKKTASEVGIYSMSASRTSVCEDHERVELWRG

SEQ ID NO: 134897 - protein, 517 aa, Glycine max
  Coding DNA Sequence Number=SeqID_18119
  Gene Ontology: Mol. function=aspartyl esterase activity; Cellular component=cell wall; Biological process=cell wall modification
  Homolog annotation: Hit_ID=O04887; Match level="QueryCoverage=95%, HitCoverage=95%, E-value=0.0, Identity=69%"; Hit description =Pectinesterase-2 precursor
  Pfam annotation: Domain name=PMEI; Domain location=22-173; Score =107.8; E_value=3.1e-29; Accession=PF04043.6; Description=Plant invertasepectin methylesterase inhibitor
  Pfam annotation: Domain name=Pectinesterase; Domain location=209-503; Score=756.7; E_value=1.5e-224; Accession=PF01095.10; Description =Pectinesterase
  Pfam module annotation: Pfam domain module=PMEI::Pectinesterase; Domain location=22-173::209-503
MKAFRLFLTLLIPFLLSSFVSGYSWNDVKLWCNQTPNPQPCEYFLSNNPTYQYKALKQKSDFLKLSLQLAQERALKGHANTLSLGSKCRNPRERGAWADCVELYEQTIRKLNETLNPDPNTKYSQVDAQTWLSTALTNLETCKAGFYELGVQDYVLPLMSNNVTKLLSNTLSLNKVEYEEPSYKEGFPKWVKPDDRKLLQSSSPASRANVVVAKDGSGKYTTVSAAVNSAPKNSRGRYVIYVKGGIYNEQVEVKSKNIMLVGDGIGKTIITGSKSVGGGTTTFRSATVAVVGDGFIAQGITFRNTAGAKNHQAVALRSGSDLSVFYKCSFEGYQDTLYVHSERQFYRECNIYGTVDFIFGNAAVVLQNCNIFARNPPNKVNTITAQGRTDPNQNTGISIHNSRVTAASDLRPVQNSVRTYLGRPWKQYSRTVFMKTYLDGLINPSGWMEWSGNFALNTLYYREYMNTGPGSSTGRRVKWPGYRVMTRASEASKFSVANFIAGNAWLPATKVPYTPSL

SEQ ID NO: 134898 - protein, 214 aa, Glycine max
  Coding DNA Sequence Number=SeqID_18120
  Homolog annotation: Hit_ID=Q94F64; Match level="QueryCoverage=47%, HitCoverage=24%, E-value=2e-11, Identity=43%"; Hit description=CDPK adapter protein 1
MALSDISTPTSCPDEKESDCDSPIESNAFGDLSLTKEKTFDLQTVSPHSFGQGLPYAPEGWPNPGDVLGWKVLKRTSHAGDGASEPSFMFSNTLNQIFLTWELKHSLIYLAGRSRYWENSQKSQLTQKFSRLLHLRQCLAPNQDANIVIDFCDQNDKETRIDSTEISKGISDSEEGSAMQTTVKKDPNATTVLENLDEDLDTLENVTVEPHTET

SEQ ID NO: 134899 - protein, 307 aa, Glycine max
  Coding DNA Sequence Number=SeqID_18121
  Gene Ontology: Mol. function=RNA-directed DNA polymerase activity; Cellular component=chromatin; Biological process=chromatin assembly or disassembly
MNHPSSLPTILGRKKDCGSDELSWPQAFPILASQSLFSENGGGECDVGYCGVEVSEKDRKKWRNSGEEPKYRRGSKRLNWWAEVPSIAFKLILGSGTGSGETDREISDGKSISSSAMKRCGESLERELGGGTERGGQGFMEHGRRGGRHPRATPSVHQLILLESCQLRGLRKRKGLKCLNFALEFRNQTRDETTEQERRSEADDTIGQSFELRPPGDHRKKTERIKILKPKALRTMTGKIHFATSTDTKRALAHPFDFGSKERMDGIHFGVQGDVVLGEGRLALDEAIDSLLQAIRGDLASVVFGND

SEQ ID NO: 134900 - protein, 118 aa, Glycine max
  Coding DNA Sequence Number=SeqID_18122
  Gene Ontology: Mol. function=RNA-directed DNA polymerase activity; Cellular component=chromatin; Biological process=RNA-dependent DNA replication
MAELNASVSSVNGKEKSDVARIRALVIKVLRSSKAWVAVGVQINWSLRKRVGCHSLGRNDMAKVVKPVLCEDTFGLPEKKLACVKDRHDGIQMNRIRIQISVADEYIIEEHYHIFSQE

SEQ ID NO: 134901 - protein, 278 aa, Glycine max
  Coding DNA Sequence Number=SeqID_18123
  Gene Ontology: Mol. function=RNA-directed DNA polymerase activity; Cellular component=chromatin; Biological process=RNA-dependent DNA replication
MPFGLCNAPSTFQAAMNDVLQSFLRKYVVVFFDDILICNTDLDSYAVHLDTIMSIFHTRQFLLRQSKCVFAQNRLNYLGHVISAQGVAPDPDKVQAILAWPIPTSTTALHGFLGLTGFYRKFIKHYATVATPLTNLLRKDQFIWTPTATQAFDDLKTLMTKALILATSDFSLPFTLETDAFSSAIGALLAITSSVRKWRHYLLGNPFIILTDHKSLRDLMSQVIQTPEIPVPEAMCWTLSMPHFDFLDNLQQTLLRDPQYVDLLGQLRSRPEAYPDLS

SEQ ID NO: 134902 - protein, 131 aa, Glycine max
  Coding DNA Sequence Number=SeqID_18124
MKQFEAEREKIIKIHEEKRLALKKQWQEQVELEKELENERTQLMDKYTFNQTQEENFKDVPSYVSTHKISAVKVRNRVTEDYIAQHVEPIYRSKGSVRLATYFPSINMRKAGEKTDVDSVACLAMYGSLEL

SEQ ID NO: 134903 - protein, 117 aa, Glycine max
  Coding DNA Sequence Number=SeqID_18125
MKASSKITVVLGDYKEQYNDALENLHRAMKAILPHDLSTVTVMLSVVMVGVSAYDNGFEEHKVSITARFNKNPKDYANHSTIQWHCVSVYPQKLGDLVTEHVVPTLRFIYYHRRMLV

SEQ ID NO: 134904 - protein, 153 aa, Glycine max
  Coding DNA Sequence Number=SeqID_18126
  Gene Ontology: Mol. function=chromatin binding; Cellular component =chromatin; Biological process=chromatin assembly or disassembly
  Homolog annotation: Hit_ID=Q1SAV4; Match level="QueryCoverage=69%, HitCoverage=27%, E-value=2e-26, Identity=53%"; Hit description =Integrase, catalytic region
  Pfam annotation: Domain name=Chromo; Domain location=54-105; Score =24.3; E_value=0.00044; Accession=PF00385.14; Description='chromo' (CHRromatin Organisation MOdifier
VAERIRPVAYKLHLLTSSRIHPVFHVSLLKPHLGPVPETPARLPPSTVDDHPLLVPLSILDWKWDTSVSPSDKLVLVQWEGLAPEDNSWERWDDLRVSHNLEDKVVFGYEGVDSITPISDNTREATPDNIPEENNINRPRRTIKKPNYLKDYA

SEQ ID NO: 134905 - protein, 511 aa, Glycine max
  Coding DNA Sequence Number=SeqID_18127
  Gene Ontology: Mol. function=aspartyl esterase activity; Cellular component=cell wall; Biological process=cell wall modification
  Homolog annotation: Hit_ID=O04887; Match level="QueryCoverage=94%, HitCoverage=94%, E-value=0.0, Identity=69%"; Hit description =Pectinesterase-2 precursor
  Pfam annotation: Domain name=PMEI; Domain location=22-171; Score =112.6; E_value=1.1e-30; Accession=PF04043.6; Description=Plant invertasepectin methylesterase inhibitor
  Pfam annotation: Domain name=Pectinesterase; Domain location=207-497; Score=737.5; E_value=9.1e-219; Accession=PF01095.10; Description =Pectinesterase
  Pfam module annotation: Pfam domain module=PMEI::Pectinesterase; Domain location=22-171::207-497
MIAFRLFLTLSVPFFLSSFVSSYSWNDVKLWCSQTPNPEPCEYFLSNNPTHQYKPIKQKSDFFKLSLQLAQERALNGHANTLSLGSKCRNPRETAAWADCVELYEQTIRKLNKTLDPSTKFSQVDTQTWLSTALTNLETCKAGFYELGVQDYVLPLMSNNVTKLLSNTLALNKVEYEEPSYKDGFPTWVKPGDRRLLQASSPASKANVVVAKDGSGKYTTVSEAVNAAPKSNSGRYVIYVKGGIYDEQVEIKANNIMLVGDGIGKTIITSSKSVGGGTTTFRSATVAVVGDGFITQDITFRNTAGATNHQAVALRSGSDLSVFYRCSFEGYQDTLYVYSDRQFYRECDIYGTVDFIFGNAAVVFQNCNIYARNPPNKVNTITAQGRTDPNQNTGISIHNSKVTAASDLMGVRTYLGRPWQQYSRTVFMKTYLDSLINPEGWLEWSGNFALSTLYYGEYMNTGPGSSTANRVNWLGYHVITSASEASKFTVGNFIAGNSWLPATSVPFTSGL

SEQ ID NO: 134906 - protein, 73 aa, Glycine max
  Coding DNA Sequence Number=SeqID_18128
  Gene Ontology: Mol. function=pectinesterase activity; Cellular component=cell wall; Biological process=cell wall modification
  Homolog annotation: Hit_ID=O04887; Match level="QueryCoverage=65%, HitCoverage=9%, E-value=3e-17, Identity=79%"; Hit description =Pectinesterase-2 precursor
  Pfam annotation: Domain name=Pectinesterase; Domain location=1-64; Score=-215.4; E_value=2.6e-05; Accession=PF01095.10; Description =Pectinesterase
MKTYLDGFINPQGWMEWSGNFALNTLYYGEYMNNGPGSSTARRVKWPGKRSKGDGVVGVNMKGKCEGGIGKGG

SEQ ID NO: 134907 - protein, 54 aa, Glycine max
  Coding DNA Sequence Number=SeqID_18129
MSVEKAISLADLFKRSKHATGDFHQLLSHTRLGKNKMLSQLIARKFHYTFTCIQ

SEQ ID NO: 134908 - protein, 60 aa, Glycine max
  Coding DNA Sequence Number=SeqID_18130
MIPEALKILPDYGFWIIGCVITLRVTKGRKSKRYRKQKLRRKPSTSRKLPYHKKNIDKFI

SEQ ID NO: 134909 - protein, 247 aa, Glycine max
  Coding DNA Sequence Number=SeqID_18131
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1KSH9; Match level="QueryCoverage=85%, HitCoverage=93%, E-value=1e-101, Identity=89%"; Hit description=PP2c
  Pfam annotation: Domain name=PP2C; Domain location=2-237; Score =215.3; E_value=1.4e-61; Accession=PF00481.12; Description=Protein phosphatase 2C
MEDFFETKISEVDGQTVAFFGVFDGHGGSRTAEYLKNNLFKNLSSHPNFIKDTKTAIVEAFKQTDVDYLNEEKRHQRDAGSTASTAMLLGDRIVVANVGDSRVVASRAGSAIPLSIDHKPDRSDERRRIEQAGGFIIWAGTWRVGGVLAVSRAFGDKFLKPYVVADPEIQVAKIISLITHLEEEINGVDFIIIASDGLWNVISNKEAVSLVQNITDAEVASRELIKEAYARGSSDNITCVVVRFDLS

SEQ ID NO: 134910 - protein, 462 aa, Glycine max
  Coding DNA Sequence Number=SeqID_18132
  Gene Ontology: Mol. function=acyltransferase activity; Cellular component=integral to membrane
  Homolog annotation: Hit_ID=Q9LZ72; Match level="QueryCoverage=98%, HitCoverage=95%, E-value=1e-152, Identity=57%"; Hit description=3 -ketoacyl-CoA synthase 21
  Pfam annotation: Domain name=ACP_syn_III_C; Domain location=324-412; Score=11.4; E_value=9.4e-07; Accession=PF08541.1; Description=3 -Oxoacyl-[acyl-carrier-protein (ACP)
  Pfam annotation: Domain name=Chal_sti_synt_C; Domain location=266 -414; Score=-0.6; E_value=0.002; Accession=PF02797.6; Description =Chalcone and stilbene synthases, C-te
  Pfam annotation: Domain name=FAE1_CUT1_RppA; Domain location=1-290; Score=476.1; E_value=4.3e-140; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=324-412::266-414::1-290
LILERRGQPCYMLAYECFMPPEDTKLDTDSAAKIVLRNKKLRLEELRFLLKTIVSSGIGENTYCPRTVLEGREECPTLKDTYEEIDEIMFDTLDNLFKKTGISPSEIDFLVVNVSLFSPAPSLTARIINRYKMRENIKAFNLAGMGCSASVVAIDVVQQLFKTYKNSVGIVVSTEDLGAHWYCGRDKKMMLSNCLFRSGGCSMMFTNKASLKSRAILKLKHMERTQYGADDEAYNCCIQVEDELGYSGFRLTKSLVKSAAQALTVNLQTMAPKILPLWEMVRFFFASIRYSGMKKRELLPFLTGMVLGKGNKKKTKFNVLGGGLNFKAGIEHFCVHPGGRAVIDGVGKGLRLNEYDLEPARMALHRWGNTSAGGLWYVLGYMEAKKRLKKGDRILMISLGAGFKCNNCVWEVMRDLSDTNVWKDCIESYPPNTLNNPFKEKYDWINDEYLSFVRLDFSRMVL

SEQ ID NO: 134911 - protein, 77 aa, Glycine max
  Coding DNA Sequence Number=SeqID_18133
MISNSDPVEPVTATATAGADDATVSTTASSSNEDQPAPPAAPNIVMSSKDHDSLFSGGGIRLFFFVYPAFQSSAGFN

SEQ ID NO: 134912 - protein, 42 aa, Glycine max
  Coding DNA Sequence Number=SeqID_18134
MAGFTSSPMSTNVTDEIRKLIKMVYCDSAFLNVAGGQGSKKQ

SEQ ID NO: 134913 - protein, 420 aa, Glycine max
  Coding DNA Sequence Number=SeqID_18135
  Gene Ontology: Mol. function=cytochrome-b5 reductase activity; Cellular component=cellulose and pectin-containing cell wall; Biological process=electron transport
  Homolog annotation: Hit_ID=Q5PY86; Match level="QueryCoverage=59%, HitCoverage=88%, E-value=1e-108, Identity=71%"; Hit description =NADH:cytochrome b5 reductase
  Pfam annotation: Domain name=FAD_binding_6; Domain location=188-287; Score=160.3; E_value=5e-45; Accession=PF00970.14; Description =Oxidoreductase FAD-binding domain
  Pfam annotation: Domain name=NAD_binding_1; Domain location=296-405; Score=129.4; E_value=9.8e-36; Accession=PF00175.11; Description =Oxidoreductase NAD-binding domain
  Pfam module annotation: Pfam domain module=FAD_binding_6::NAD_binding_ 1; Domain location=188-287::296-405
MALRFPKLDFKSFPFTENLNPELLGHAGVAVGVVEAGDVGGGDEDGLVGWRDGGDEAGVNASGAVDEDEVDQRCERAFSTSTSQAAVTIQDLDHGVVDAILDVEEEVEVAEADVDVNGDHGEAKTSEGEADVGGGGGLAHATLAGGDASDAGDGAEELRLAIPLESSWSRGFHKRVEKRSLDPKNFKEFKLIKKTQLSHNVARFKFALPTPSSVLGLPVGKNILARGKDSQGEEVMRSYTPITLDSNIGYFELVVKMYPNGKMSHHFRQMKEGDFLAVRGPKGRFTYKPGQVRAFGMIAGGSGITPMFQLIRAILENPKDKTKVHLVYANVTVDDILLKEELDNFANKFAQRFEVYHVLNKPPEQWNGGIGFISKEIIKSHCPEPAQDIQILRCGPPPMNKAMATHLDALGYTSNMQFEF

SEQ ID NO: 134914 - protein, 68 aa, Glycine max
  Coding DNA Sequence Number=SeqID_18136
MLEDRRQVYGVVLALDVVKLQIPLLDVQCSGILHQMDRVVKINCGGAVHLGNQKAFCGAVFRDSKDSF

SEQ ID NO: 134915 - protein, 188 aa, Glycine max
  Coding DNA Sequence Number=SeqID_18137
  Gene Ontology: Mol. function=signal transducer activity; Cellular component=spindle; Biological process=cell division
  Homolog annotation: Hit_ID=Q9SZA4; Match level="QueryCoverage=80%, HitCoverage=32%, E-value=6e-41, Identity=57%"; Hit description=WD -repeat protein-like protein
MGGDNNVSNPPAKERKTPAYHYRYRHCKTTIVRGLRLDRFIPNRSAMDFDYAHYMLTEGNKKGKEEKKNPLVMSPSREAYQKQLADAFNMNRTRILAFKSKPRTRRVELIPNSIFSPPPPPISSKHRRHIPQSSERVLDAPDILDDFYLNLLDWGNNNVLSIALGNTVYIWDASYSSTAELVTVDEEE

SEQ ID NO: 134916 - protein, 55 aa, Glycine max
  Coding DNA Sequence Number=SeqID_18138
MVTGAENKTSSSNGFAVNKEAAALKITNIKSRILQQFHSNYNSMCYLSHSEGLTS

SEQ ID NO: 134917 - protein, 126 aa, Glycine max
  Coding DNA Sequence Number=SeqID_18139
  Gene Ontology: Mol. function=lyase activity
  Homolog annotation: Hit_ID=Q9M3D5; Match level="QueryCoverage=51%, HitCoverage=21%, E-value=1e-20, Identity=66%"; Hit description =Pectate lyase-like protein
MTYVKCGSLVDSQTHIEITYFITRCCFGQHDKTMLIGPDPTHIVTLVIDASGQRQPCVRFGKVHLYNNYTRNWGIYAVCASVESQVHQLMAYLVLKFNLRTILKCNSLGVTVFRVLQFRLEFHLNE

SEQ ID NO: 134918 - protein, 111 aa, Glycine max
  Coding DNA Sequence Number=SeqID_18140
  Homolog annotation: Hit_ID=Q9FF81; Match level="QueryCoverage=55%, HitCoverage=14%, E-value=1e-19, Identity=75%"; Hit description =Arabidopsis thaliana genomic DNA, chromosome 5, P1 clone:MUG13
MLVLKPDALRAGISASDAARTLGVAPAMAKEHLLSAESKGLLCRDISPDGFRFYINLFVEIDRDYMYFFDLLIFQQNCSPWSPLELKLALGWTIHSSSSIKPEKGVGNLLG

SEQ ID NO: 134919 - protein, 113 aa, Glycine max
  Coding DNA Sequence Number=SeqID_18141
  Homolog annotation: Hit_ID=Q5W7F2; Match level="QueryCoverage=28%, HitCoverage=3%, E-value=2e-08, Identity=81%"; Hit description=ARF-GAP
MYLLEKPSFNYCEKSSSHLTCPHSKRKVGGPKHYPNYGPKGFLHRGVLTVAFVLGLAQIAHLVAFSHLLLQVRSLTLDASLGTFCDKFVSVSWECFCQHGLGGTIGIKKFISG

SEQ ID NO: 134920 - protein, 1214 aa, Glycine max
  Coding DNA Sequence Number=SeqID_18142
  Gene Ontology: Mol. function=nucleic acid binding; Cellular component= nucleus; Biological process=protein complex assembly
  Homolog annotation: Hit_ID=Q9LD60; Match level="QueryCoverage=99%, HitCoverage=100%, E-value=0.0, Identity=86%"; Hit description =Spliceosomal-like protein
  Pfam annotation: Domain name=CPSF_A; Domain location=857-1157; Score =298.9; E_value=9.4e-87; Accession=PF03178.5; Description=CPSF A subunit region
MYLYSLTLQRPTGIICAINGNFSGGKSQEIVVARGKVLDLLRPDDNGRIQTILSVEIFGAIRSLAQFRLMGAQKDYIVVGSDSGRIIILEYNKEKNVFDKIHQETFGKSGCRRIVPGQYLAIDPKGRAVMIGACEKQKLVYVLNRDTAARLTISSPLEAHKSHTLVYSICGVDCGFENPIFAAIELDYSEADQDSTGQAASEAQKHLTFYELDLGLNHVSRKWSEQVDNGANLLVTVPGGGDGPSGVLVCAENFVIYKNQGHPEVRAVIPRRADLPAERGVLIVSAAMHKLKNMFFFLLQTEYGDIFKVTLEHNNDRVSELKIKYFDTIPVTASMCVLKSGFLFAASEFGNHALYQFKSIGDDDDVEASSATLMETEEGFQPVFFQPRRLKNLVRIDQVESLMPIMDMKVSNLFEEETPQIYTLCGRGPRSSLRILRTGLAVSEMAVSKLPGIPSAVWTVKKNVIDEFDAYIVVSFTNATLVLSIGETVEEVSDSGFLDTTPSLAVSLIGDDSLMQVHPNGIRHIREDGRINEWRTPGKRSISKVGSNTLQVVIALSGGELIYFEMDVTGQLMEVEKHEMSGDVACLDIAPVPEGRQRSRFLAVGSYDKTIRILSLDPDDCMQALSVQSVSSAPESLLFLEVQASVGGEDGADHPASLFLNAGLQNGVMFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLQPKRKLLVMIESDQGALTAEEREAARKECFEAAQAGENGTGSADQMENGGDDEDKDDPLSDEHYGYPKAESDKWASCIRVLDPRTSNTTCLLELQENEAAFSICTVNFHDKEYGTLLAVGTAKGLQFLPKRTVTAGFIHIYRFVEDGRSLELLHKTQVEGVPLALCQFQGRLLAGIGPVLRLYDLGKKRLLRKCENKLFPNTIISIHAYRDRIYVGDVQESFHYCKYRRDENQLYIFADDCVPRWLTASYHIDFDTMAGTDKFGNIYFVRLPQDVSDEIEEDPTGGRIKWEQGKLNGAPNKVEEIVQFHVGDVVTCLQKASLIPGGGECIVFGTVMGSVGALHAFTSRDDVDFFSHLEMHMRQDHPPLCGRDHMAYRSAYFPVKDVIDGDLCEQYPTLPMDLQRKIADELDRTPGEILKKLEEVRNKII

SEQ ID NO: 134921 - protein, 121 aa, Glycine max
  Coding DNA Sequence Number=SeqID_18143
  Homolog annotation: Hit_ID=Q2PXN5; Match level="QueryCoverage=52%, HitCoverage=100%, E-value=5e-24, Identity=79%"; Hit description=RW1 -like protein
MKVRVFNSNTSFRWGRVMLENIIIRVPPTSHLVNLGIPCKLRIVALKCPETIGSHRVAPHLLRLLTPVLHSINKLPEPPIPFLWVFHQLQYQVLCKFHDEAQLFLSYLLIIQTKNPKFHQL

SEQ ID NO: 134922 - protein, 53 aa, Glycine max
  Coding DNA Sequence Number=SeqID_18144
MEQDSALAKYTSCVLMAPHHICETHAMWLIRRLMEFVESQSNNYIMIMLMGEI

SEQ ID NO: 134923 - protein, 365 aa, Glycine max
  Coding DNA Sequence Number=SeqID_18145
  Gene Ontology: Mol. function=protein binding; Cellular component =integral to membrane; Biological process=response to DNA damage stimulus
  Homolog annotation: Hit_ID=Q8GTD6; Match level="QueryCoverage=86%, HitCoverage=99%, E-value=1e-118, Identity=65%"; Hit description =Polygalacturonase inhibitor-like protein
  Pfam annotation: Domain name=LRRNT_2; Domain location=26-66; Score =44.4; E_value=3.8e-10; Accession=PF08263.3; Description=Leucine rich repeat N-terminal domain
  Pfam annotation: Domain name=LRR_1; Domain location=133-155; Score =12.8; E_value=1.1; Accession=PF00560.23; Description=Leucine Rich Repeat
  Pfam annotation: Domain name=LRR_1; Domain location=157-179; Score =8.0; E_value=9.3; Accession=PF00560.23; Description=Leucine Rich Repeat
  Pfam annotation: Domain name=LRR_1; Domain location=181-203; Score =13.1; E_value=1; Accession=PF00560.23; Description=Leucine Rich Repeat
  Pfam annotation: Domain name=LRR_1; Domain location=205-227; Score =9.2; E_value=5.3; Accession=PF00560.23; Description=Leucine Rich Repeat
  Pfam annotation: Domain name=LRR_1; Domain location=229-251; Score =16.9; E_value=0.073; Accession=PF00560.23; Description=Leucine Rich Repeat
  Pfam annotation: Domain name=LRR_1; Domain location=253-275; Score =9.5; E_value=4.9; Accession=PF00560.23; Description=Leucine Rich Repeat
  Pfam annotation: Domain name=LRR_1; Domain location=276-298; Score =15.4; E_value=0.21; Accession=PF00560.23; Description=Leucine Rich Repeat
  Pfam annotation: Domain name=LRR_1; Domain location=300-322; Score =8.6; E_value=6.9; Accession=PF00560.23; Description=Leucine Rich Repeat
  Pfam annotation: Domain name=LRR_1; Domain location=324-346; Score =1.3; E_value=1.6e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=26 -66::133-155::157-179::181-203::205-227::229-251::253-275::276 -298::300-322::324-346
MGRVWFTAPLTALLLLAFSSAVSSCPQSDLAALLAFKSALRESNDGIFNTWTGTDCCHNWYGISCDRNTHRVAEISLRAGPVYTTFEKPFRPGYMSGSISPEICKLTHLSSIIITDWQGISGEIPRCITSLFFLRIIDLTGNRIAGTLPSNIGRLRHLTLLSAADNVIAGIIPPSLTNVTGLMHLDLRNNRIFGPIPRSLGRLQMLSRVLLSGNHISGPIPRSFCHIYRLVDLDLSNNRLSGSIPEALGRMKVLSTLKLDSNRLSGSIPASLLGSGISELNLSHNYLEGNIPDSFGGSSYFTLLDLSYNNLKGPIPKSMSSSSYVGFVDFSHNHLCGPIPSSYSDADASSFDYNDCLCGKPLKAC

SEQ ID NO: 134924 - protein, 255 aa, Glycine max
  Coding DNA Sequence Number=SeqID_18146
  Gene Ontology: Mol. function=protein binding; Cellular component =integral to membrane; Biological process=response to DNA damage stimulus
  Homolog annotation: Hit_ID=Q8GTD6; Match level="QueryCoverage=63%, HitCoverage=90%, E-value=1e-48, Identity=43%"; Hit description =Polygalacturonase inhibitor-like protein
MVSDILISISKQELASLVNLQANAFRACTQDKAIVVIKRRRIGITVAAGNWAAEVVVAKVHKPNVGRGRHGFGYWALEDAAQHLKPAQASWDGPEDPVVTEMAKSSDVGGESAGDAVSGEVDDAEEEEGGDAARDLAGDSLPIGDDDAGEVSELANLRRDGTGHVARTEGLLEGGVDGTGAEADLGDAVGVAVAGDAVPVVAAVGAGPRVEYAVVGLPESGFEGQQRRQYEGFEKREKENLEMRDLCMHMHEHES

SEQ ID NO: 134925 - protein, 476 aa, Glycine max
  Coding DNA Sequence Number=SeqID_18147
  Gene Ontology: Biological process=polysaccharide catabolic process
  Homolog annotation: Hit_ID=Q029P0; Match level="QueryCoverage=52%, HitCoverage=30%, E-value=1e-20, Identity=32%"; Hit description =Hypothetical protein precursor
  Pfam annotation: Domain name=DUF1680; Domain location=1-251; Score= -198.3; E_value=8.2e-06; Accession=PF07944.3; Description=Putative glycosyl hydrolase of unknown funct
MVSRHLFKWTKEVSYADYYERALTNGVLSIQRGTDPGVMIYMLPLGLGVSKAKTYHSWGTPFDSFWCCYGTGIESFSKLGDSIYFEEEGKDPTLYIIQYISSSFNWKSGKVLLNQTVDPVASWDPYLRVAFTFSPFEGKKVQTACKGTQTSICEPADWSTQPQTENTLTTNSTLNFRLPTWTHLDGAKGILNAETLSLPSPGNYLSITRQWSGSDKLTLQLPLTVRTEAIKDDRPEYASVQAILYGPYLLAGHTTGVDWDLKAGANNSDWITPIPASYNSQLVSFSQDFENSTFILANSNQSLAMQKLPLSGTDLALQATFRLVVLNESSSKFSTLADANGKSVMLEPFDFPGMNVVNQGADKPLLIIDSSHGGTSSVFLVVPGLDGRNETISLESQSYNGCYVYSGMSSIAGVKLSCKSGSDASFNQATSFVAQKGLSQYNPISFVAKGANRNFLLEPLFSFRDEHYTVYFNIQG

SEQ ID NO: 134926 - protein, 634 aa, Glycine max
  Coding DNA Sequence Number=SeqID_18148
  Gene Ontology: Mol. function=binding; Cellular component =intracellular; Biological process=metabolic process
  Homolog annotation: Hit_ID=Q6K2P5; Match level="QueryCoverage=92%, HitCoverage=83%, E-value=1e-106, Identity=29%"; Hit description =Putative pentatricopeptide (PPR) repeat-containing protein
  Pfam annotation: Domain name=PPR; Domain location=119-153; Score =27.9; E_value=3.6e-05; Accession=PF01535.11; Description=PPR repeat
  Pfam annotation: Domain name=PPR; Domain location=189-223; Score =24.6; E_value=0.00034; Accession=PF01535.11; Description=PPR repeat
  Pfam annotation: Domain name=PPR; Domain location=280-314; Score =34.5; E_value=3.6e-07; Accession=PF01535.11; Description=PPR repeat
  Pfam annotation: Domain name=PPR; Domain location=387-421; Score =40.7; E_value=4.9e-09; Accession=PF01535.11; Description=PPR repeat
  Pfam annotation: Domain name=PPR; Domain location=422-456; Score=3.6; E_value=2.8; Accession=PF01535.11; Description=PPR repeat
  Pfam annotation: Domain name=PPR; Domain location=524-558; Score=9.4; E_value=0.58; Accession=PF01535.11; Description=PPR repeat
  Pfam annotation: Domain name=PPR; Domain location=57-91; Score=9.6; E_ value=0.55; Accession=PF01535.11; Description=PPR repeat
  Pfam module annotation: Pfam domain module=PPR::PPR::PPR::PPR::PPR::PP R::PPR; Domain location=119-153::189-223::280-314::387-421::422 -456::524-558::57-91
YGMGRNGFVQKVVGDLCFLDSSPFAKLLDSCVRSKSEIDARRIHARISKTQFSYEIFIQNRLVDAYRKCGYFEDARKVFDRMPQRNTFSYNAILSVLTKLGKHDEAFNVFKSMPDPDQCSWNAMVSGFAQHDRFEEALKFFVDMHSIRLGVLLVLVQGMGSALVDMYSKCGVVACAQRAFDSMVVRNIVSWNSLITCYEQNGPAGKTLEVFVMMMDNVDEPDEITLASVVSACASLSAIREGLQIRACVMKWDKFRNDLVAASVKAARLMFSNMMEKNVVCWNVLIAGYTQNGENEEAVRLFLLLKRESIWPTHYTFGNLLNACANLTDLKLGRQAHTHILKHGFWFQSGEESDIFVGNSLIDMYMKCGMVEEGCLVFEHMVERDVVSWNAMIVGYAQNGYGTDALEIFRKILVSGEKPDHVTMIGVLSACSHAGLVEKGRHYFHSMRTKLGLAPMKDHFTCMADLLGRASCLDEANDLIQTMPMQPDTVVWGSLLAACKVHGNIELGKYVAEKLTEIDPLNSGLYVLLSNMYAELGRWKDVVRVRKQMRQRGVIKQPGCSWMKIQSHVHVFMVKDKRHPRKKDIHFVLKFLTEQMKWAGYVPEADDDEICEEESDSELVLHYEMETDVDTAVA

SEQ ID NO: 134927 - protein, 87 aa, Glycine max
  Coding DNA Sequence Number=SeqID_18149
MMFHPIRLNLWGGVGEKDTDEEIEWTKIINSVSIQVLLETGKASMGASSRDGSSGLSPIEIYFENFGGLLCIQVLSQQDGDPIKWEP

SEQ ID NO: 134928 - protein, 201 aa, Glycine max
  Coding DNA Sequence Number=SeqID_18150
MLVWWMLIHHWYQRAPLMTFRNILFQILEDGGNTRSLTLEEVTDTILFCSSIIHDLAHQATTTAMENEHSEPLEGSEPTVTILAKTNSDTKDSQQPNCWQGCMKPQKEARLRMMKILISLTPNVGLPNKDINLRHLEDCAPPVAPFLLFDFHLNEVIHQWKCEVELIHIRFKKKTQIMPYYYYISIWLLNVDIINENSYTE

SEQ ID NO: 134929 - protein, 380 aa, Glycine max
  Coding DNA Sequence Number=SeqID_18151
  Gene Ontology: Mol. function=sugar binding; Biological process =polysaccharide catabolic process
  Homolog annotation: Hit_ID=Q029P0; Match level="QueryCoverage=66%, HitCoverage=39%, E-value=5e-46, Identity=40%"; Hit description =Hypothetical protein precursor
  Pfam annotation: Domain name=DUF1680; Domain location=106-380; Score=- 35.7; E_value=1.1e-11; Accession=PF07944.3; Description=Putative glycosyl hydrolase of unknown funct
MEAFVFVFVVLVLCGCAAGKECTNIPTQSHTLRYQLLTSKNGRLEEKAMSHFHLTPTDESEWADLLPRKLLTEQHQHDWAVMYKNIKNMGVFKSPEGFLKEVPLQDVRLHEDSIHGIAQQTNLEYLLMLDVDSLIWSFRKTAGLSTPGTPYGGWEAPDVELRGHFVGHYLSASALMWAITQNDTLKQKMSYLVAGLSDCQKKIGTGYLSAFPSELFDRFEAIQEVWAPYYTIHKILAGLLDQHTFAGNPQALKMVTWMVDYFYNRVQTVITKYTLNRHYESLNEETGGMNDVLYKLYIITGDSKHLLLAHLFDKPCFLGLLAVQANDIADFHANTHIPVVVGSQMRYEITGDPLYQFMYVFNNISSQWHAESTYSLGNIT

SEQ ID NO: 134930 - protein, 409 aa, Glycine max
  Coding DNA Sequence Number=SeqID_18152
  Pfam annotation: Domain name=F-box; Domain location=3-46; Score=30.1; E_value=7.9e-06; Accession=PF00646.23; Description=F-box domain
MEDPFSNLPDEILSCIVSFLPLETSLISTRWRDLWNQALVRHGSTQDDVASVVAGFLSRFEELDPLKHPRKLHFHFSDQDTALFASIATNSKLLLDFPAGIKDLKKQYELKFILNKHHITHNTVPPTFLVKTLYLKSVSHLTSELISSIVSNLEHLEKLVIVECTGLQSLFIESESKLHELTILDCPQLKSLHLRTSKLKSFRLDGPLPTIWPESHFNLSHAMLNFRLGPSCADFKAQYFNQTLLTIKNCEALTLCEWTFQELIWPSISPSGNFIFYKIRELWWIHNHRGENSMDTLVSFLKLCPALEQLFVTNDSTSYSAPRSNSYCLTQETEYSTKLEHLKRIKFMGFTNRVDEISVAKKLIELVKGEPPKIETSDESCLNKGKLYEQVISHALSGWGWHSVIIQKR

SEQ ID NO: 134931 - protein, 1450 aa, Glycine max
  Coding DNA Sequence Number=SeqID_18153
  Gene Ontology: Mol. function=ATPase activity, coupled to transmembrane movement of substances; Cellular component=integral to membrane; Biological process=transport
  Homolog annotation: Hit_ID=Q9M3B9; Match level="QueryCoverage=99%, HitCoverage=99%, E-value=0.0, Identity=56%"; Hit description =Multidrug resistance protein 14
  Pfam annotation: Domain name=ABC_membrane; Domain location=128-395; Score=84.5; E_value=3.4e-22; Accession=PF00664.13; Description=ABC transporter transmembrane region
  Pfam annotation: Domain name=ABC_membrane; Domain location=865-1145; Score=126.3; E_value=8.8e-35; Accession=PF00664.13; Description=ABC transporter transmembrane region
  Pfam annotation: Domain name=ABC_tran; Domain location=1220-1405; Score=199.4; E_value=8.5e-57; Accession=PF00005.17; Description=ABC transporter
  Pfam annotation: Domain name=ABC_tran; Domain location=465-648; Score= 147.7; E_value=3e-41; Accession=PF00005.17; Description=ABC transporter
  Pfam annotation: Domain name=Viral_helicase1; Domain location=1223 -1403; Score=-56.8; E_value=0.041; Accession=PF01443.9; Description =Viral (Superfamily 1) RNA helicase
  Pfam module annotation: Pfam domain module=ABC_membrane::ABC _membrane::ABC_tran::ABC_tran::Viral_helicase1; Domain location=128 -395::865-1145::1220-1405::465-648::1223-1403
MMVSRGLFGWSPPHIQPLTPVSEVSEPPESPSPYLDLGAETSTSQPMEVEEEMEEADEIEPPPAAVPFSRLFACADRLDWFLMLVGSLAAALHGTALVVYLHYFAKVLRVPQQGSPEEQFHRFKEQLLVYGRLKGFGGNSNKGLIKVLMDEFCCYMPRKLALTIVYIAGGVFAAGWIEVSCWILTGERQTAVIRSNYVQVLLNQDMSFFDTYGNNGDIVSQVLSDVLLIQSALSEKVGNYIHNMATFFSGLVIAFINCWQIALITLATGPFIVAAGGISNIFLHRLAENIQDAYAEAASIAEQAVSYVRTLYAFTNETLAKYSYATSLQATLRYGILISLVQGLGLGFTYGLAICSCALQLWVGRLLIIHGKAHGGEIITALFAVILSGLGLNQAATNFYSFDQGRIAAYRLFEMISRSSSSFNHDGSAPASVQGNIEFRNVYFSYLSRPEIPILSGFYLTVPAKKTVALVGRNGSGKSSIIPLMERFYDPTLGEVLLDGENIKNMKLEWLRSQIGLVTQEPALLSLSIRDNIAYGRDTTMDQIEEAAKIAHAHTFISSLDKGYDTQVGRAGLALTEEQKIKLSIARAVLLNPSILLLDEVTGGLDFEAERSVQEALDLLMLGRSTIIIARRLSLIKKADYIAVMEDGQLVEMGTHDELLTLDGLYAELLRCEEATKLPKRKSLCSSSRMPVRNYKETATFQIEKDSSESNSFKEPSSPKMIKSPSLQRVSAIFRPSDGFFNSQESPKVRSPPSEKLIENGQSLDSSDKEPSIKRQDSFEMRLPELPKIDVQCVHRQTSNGSDPESPVSPLLMSDPKNERSHSQTFSRPDSHSDDLSVKMSETKDARHRKQPSVWRLAELSFAEWLYAVLGSIGAAIFGSFNPLLAYVIGLVVTDYYRIDEAQHLQGEINKWCLIIACMGIVTVVANFLQHFYFGIMGEKMTERVRRMMFSAMLRNETGWFDEEENSADNLSMRLANDATFVRAAFSNRLSIFIQDSAAVIVAFLIGVLLHWRLALVALATLPVLCVSALAQKLWLAGFSKGIQEMHRKASLVLEDAVRNIYTVVAFCAGNKVMELYQLQLNKIFKQSFFHGVAIGFAFGFSQFLLFACNALLLWYTAICVNKSYVDLPTALKEYIVFSFATFALVEPFGLAPYILKRRKSLMSVFEIIDRVPKIDPDDSSALKPPNVYGSIELKNIDFCYPSRPEVLVLSNFSLKVNGGQTIAVVGVSGSGKSTIISLIERFYDPVAGQVLLDGRDLKQYNLRWLRSHLGLVQQEPIIFSTTIRENIIYARHNASEAEMKEAARIANAHHFISSLPHGYDTHVGMRGVDLTPGQKQRIAIARVVLKNAPILLLDEASSSIESESSRVVQEALDTLIMGNKTTILIAHRAAMMRHVDNIVVLNGGRIVEEGTQDSLVAKNGLWRLACSKNGSIGSALDIGRHKKRVLWQG

SEQ ID NO: 134932 - protein, 271 aa, Glycine max
  Coding DNA Sequence Number=SeqID_18154
  Gene Ontology: Mol. function=beta-N-acetylhexosaminidase activity; Cellular component=lysosome; Biological process=carbohydrate metabolic process
  Homolog annotation: Hit_ID=Q9M3C5; Match level="QueryCoverage=99%, HitCoverage=48%, E-value=1e-124, Identity=74%"; Hit description=Beta- N-acetylhexosaminidase-like protein
  Pfam annotation: Domain name=Glyco_hydro_20; Domain location=1-221; Score=96.4; E_value=8.3e-26; Accession=PF00728.12; Description =Glycosyl hydrolase family 20, catalytic domain
MAEVDVPGHAASWGIGYPDLWPSPSCKEPLDVSKKFTFDVLSGILTDMRKIFPFELFHLGGDEVNTDCWTNTSTVNKWLRNHNMTAKDAYQYFVLKAQNIALTKNWSPVNWEETFNTFPTKLHPRTVVHNWLGPGVCPKAVAKGFRCIFSNQGVWYLDHLDVPWDDVYTAEPLEGIRKASEQKLVLGGEVCMWGETADTSDVQQTIWPRAAAAAERLWSRRDSTSGNVNIIALPRLHYFRCLLNRRGIPAAPVKNFIARTAPVGPGSCFEQ

SEQ ID NO: 134933 - protein, 151 aa, Glycine max
  Coding DNA Sequence Number=SeqID_18155
MSIFATSMPVLSIVHPRRMEAFVFVFVAILLCGCVAAKECTNIPTQSHTFRYELLMSKNATWKAEVMDHYHLTPTDETVWADLLPRKFLSEQNQHDWGVMYRKIKNMGVFKSGEGFLKEVPLQDVRLHKDSIHARAQQTNLEYLLMLDVDA

SEQ ID NO: 134934 - protein, 196 aa, Glycine max
  Coding DNA Sequence Number=SeqID_18156
  Homolog annotation: Hit_ID=Q945F5; Match level="QueryCoverage=99%, HitCoverage=51%, E-value=2e-23, Identity=34%"; Hit description=Auxin- regulated protein
  Pfam annotation: Domain name=DUF966; Domain location=1-196; Score= -69.9; E_value=9.5e-09; Accession=PF06136.4; Description=Domain of unknown function (DUF966)
MANMYSWSAKRSYKNGYVWQDLSENDFIYPSSGHEYVLKGTQMIEASLSFRSCETISTSSSKSSTEAINSSTGADSPATIKGRSQSLNSSDYKFYSAKTCEEFAGKATNASTQTEEKHRERIKREEQVEECEGNGDARELGENEGSLPFSRSSFGTLEGSLEGFESADIRSQRVENERPSGRIKASEVLMQFIRCG

SEQ ID NO: 134935 - protein, 70 aa, Glycine max
  Coding DNA Sequence Number=SeqID_18157
MGSIRGIKKRKKADNKDGQDASATSFDWWHHFSLRISGFQICFFKLTNLLTLLDFHTHVALIGHTSCPVT

SEQ ID NO: 134936 - protein, 315 aa, Glycine max
  Coding DNA Sequence Number=SeqID_18158
  Gene Ontology: Mol. function=transposase activity; Biological process= transposition, DNA-mediated
  Homolog annotation: Hit_ID=Q2QZ53; Match level="QueryCoverage=97%, HitCoverage=77%, E-value=6e-96, Identity=54%"; Hit description =Expressed protein
  Subcellular localization annotation: CTP_CleavageSite=58; ConfidenceScore=5.26e-01
MVARASNFVDLNGNRLSLNDQVAVALRRLSSGESLSTIGDSFRMNQSTVSQVTWKFVETMEERGLHHLSWPSTEMEMEEIKSKFENIRGLSNCCGAIDSTHIMMTLPSVDALNSVWIDREKNCSMVLQAVVDPDLRFHDIVTGWPGSMSDEQVLRSSSLFKLAEEGKRLNGGKKTLPDGSVLREYIIGDTGFPLLPWLLTPFEGKGLSDIQVEFNKRIVETQMVAKKALARLKDMWKIIQGVMWKPDKHKLPRIVLVCCILHNIVMDMEDEVHNDMLSCHQHDSRYQDQTSEFADNTANIMREKLSLYLSGKMPT

SEQ ID NO: 134937 - protein, 132 aa, Glycine max
  Coding DNA Sequence Number=SeqID_18159
MENHRFISKSDSAKARSNKKRIRQQKVHLDVQHSVHASFNPASSHTEDDYNQPKTPPHSVHATANRAPHDAKDHFNICDSSENETSGSAEESETISSVGYPNCESSHHDSSMDTGAIPIKKISQWLRLWSNI

SEQ ID NO: 134938 - protein, 179 aa, Glycine max
  Coding DNA Sequence Number=SeqID_18160
MAKFDPDIVLEFYANAWPTEESVHDMRSWVRGQWISFDADAIGQLLGYPLVLEEGQECEYGQRRNRSDGFDEEAIAQLLKTSMQTPESLSSFNECPRPSSLAQPSLTAYECVVESRNASLNLMAGTILASSPHYFSAVEDYHACLMKNWLALATLRSKQNLPQSHCLLRGKDSIFFLCQ

SEQ ID NO: 134939 - protein, 175 aa, Glycine max
  Coding DNA Sequence Number=SeqID_18161
MKWDVKPLVDIASVPGMRLGRTPRVGSRAPGHYYHGYYRPEPKEGKERTKARSSLAIHSEGGWGSTSFMTHGPIETRFSDMDFFEMVNHFFNREREVIQNPLAPVQNRWKFPTPIPQRRLSVHFPEIEEIYSSVAENIMSRDLEISAEISIETLRGWVEEIKENPNPLKSLIREH

SEQ ID NO: 134940 - protein, 97 aa, Glycine max
  Coding DNA Sequence Number=SeqID_18162
MVEASGNRLPACVIDYTEEWVTVVMRQMIVMVAQLIRDRVEMECLEGAWETLEGNTRCRFRGTTRFTATSLVHPDEPARTLQRTVEWTAPWISFVDF

SEQ ID NO: 134941 - protein, 35 aa, Glycine max
  Coding DNA Sequence Number=SeqID_18163
RIKWVGMIRAPYVNFSKSLGQKPVPNSPAGGPILV

SEQ ID NO: 134942 - protein, 79 aa, Glycine max
  Coding DNA Sequence Number=SeqID_18164
  Gene Ontology: Mol. function=RNA-directed DNA polymerase activity; Biological process=DNA integration
  Homolog annotation: Hit_ID=Q1SA33; Match level="QueryCoverage=92%, HitCoverage=7%, E-value=5e-18, Identity=56%"; Hit description =Integrase, catalytic region
MAFQEERFETENAKHMATPMSTACYLDKDEIGQSRDIRKYRGIIGPLLYLFASRPDIIFSICMCARYQENPKESHLSVV

SEQ ID NO: 134943 - protein, 95 aa, Glycine max
  Coding DNA Sequence Number=SeqID_18165
  Gene Ontology: Mol. function=DNA binding; Biological process =regulation of transcription, DNA-dependent
  Homolog annotation: Hit_ID=Q6KBS4; Match level="QueryCoverage=55%, HitCoverage=8%, E-value=9e-12, Identity=69%"; Hit description =Putative auxin response factor
MSASATSTSRTESTTPSSRSSMAIERERERNKDKKREKEWLKDAKAALYKELWHACVGPLVMVPREAKHVFYFLQGHAGLRSTTQDPLSGYQHQA

SEQ ID NO: 134944 - protein, 79 aa, Glycine max
  Coding DNA Sequence Number=SeqID_18166
FVWEPYPSTVISLFPPVCLVGSLAWRKTKMFVDPQNAKTATLAEVAETLQYMVSPQGRNTWTVDVLVPYVEKITILSKE

SEQ ID NO: 134945 - protein, 128 aa, Glycine max
  Coding DNA Sequence Number=SeqID_18167
MAAQLIRDRVEMECLEGAWETLEGNTRCRFRGTIRFTATSLVHPDEPARTLQRTVEWILPTPTPYRLVEPVQSDRGVMRIHFLRWILPRKSCRHLRQTLWWIAARGRWRSAEALHPSGQLFGLVLYTF

SEQ ID NO: 134946 - protein, 170 aa, Glycine max
  Coding DNA Sequence Number=SeqID_18168
  Subcellular localization annotation: CTP_CleavageSite=43; ConfidenceScore=5.45e-01
MNSWPSDVQGSSTRKYVGLAFDCRALFANSPFSSLIWSPMNLLSSAGRESSTLEFGAPQSYSVALFGNSPLSTFIGSPMNSLPSAVHASSTFESGAPRSDCLALFPNSPFSTFIRSPKNLLPSAVHASSTIESGAPRSDCVALFANSPFFTFIRSPKNLLPSAFHVSSTI

SEQ ID NO: 134947 - protein, 87 aa, Glycine max
  Coding DNA Sequence Number=SeqID_18169
GMLRKPADAPPPHQAGPAGSFDTEARVLLLFHAHTPDHFRAEVPWPGDWPKARAGEAPAEAPNEADEAREDEEMTNLLDFLGGSGAI

SEQ ID NO: 134948 - protein, 128 aa, Glycine max
  Coding DNA Sequence Number=SeqID_18170
  Pfam annotation: Domain name=zf-GRF; Domain location=34-83; Score =10.1; E_value=0.0018; Accession=PF06839.3; Description=GRF zinc finger
MVDMLATYIPFNIKQTRMNGEGGLSLLFSFHGMVKCKFEVPVVMFTSRSVNHPEKRFWRCPHWNESSSCRFFQWIGDTEADNNVSVEESELVRYVRENEELKLKVASLMEEAKTNVQEITNLRKKIVA

SEQ ID NO: 134949 - protein, 182 aa, Glycine max
  Coding DNA Sequence Number=SeqID_18171
ASEPIDTQRLTSSSAPLSSRDEEFDDMRGYFVGYLTVIRTFCQPEESEPVDKQGQTSSSAPFVNLGQASPDDESDDMWGYLMVIRIFCHPETTSPMTYGGASKPVHMQRLMPSSAPLSSRDDESNDIWGYLSVIGTSCQLEASESIDTQRLTTEDESDDMRLYLMVIRIFCHPETSSPMTYG

SEQ ID NO: 134950 - protein, 109 aa, Glycine max
  Coding DNA Sequence Number=SeqID_18172
STLEDPTPLYIKHEDLSEIAHGGECLSISLIQLWIPYIKNWMQNSKRDVYLGAYLNGAHWQMVVILLKENVVIWFCSLHNRSDNYLKGIINSALKGLNHIPQSKSKVVA

SEQ ID NO: 134951 - protein, 186 aa, Glycine max
  Coding DNA Sequence Number=SeqID_18173
MQSLEEKEHEIRIMTENVSRFVRLIVKECVNRNPGRVEIDAEEEAVGEGQGVMEQGDDAYVAKRSSRAKRNLWATRASIAKCSYNALSVMRESGRAQESKQRAKREISSLSDPNPFTRAKRDSGVKCDGTIFKAYLKPELSDFGHHQRESTFTIASYFCTKFEKSALEEAKRKQLSKEARFITLRD

SEQ ID NO: 134952 - protein, 97 aa, Glycine max
  Coding DNA Sequence Number=SeqID_18174
MASHQREIRHLSESPTEGQEARQERFARLKTVLDSVDSRLDQAREIDRVRDNERARLRAEMDHDCDRWRALERKNAQMRLKVNELNLKKRGPLIKFK

SEQ ID NO: 134953 - protein, 89 aa, Glycine max
  Coding DNA Sequence Number=SeqID_18175
MEAHKIFPNLECLVIDFDEAQKWLLSNTVKHPMHRLKELHLREVNDGERLCQILYRMPNLEKLFLWEAKHLLKESSESRLGTVLQLKEL

SEQ ID NO: 134954 - protein, 101 aa, Glycine max
  Coding DNA Sequence Number=SeqID_18176
MLESFKQQQEMSVLELYIEKDVAGGSLFHSANSLTSCGNYVSNDDTQPPTNMSNLNLDEDDDHDDDDYLVSNSYVEESLDEDDSVDGISDTDDAVIDIPQP

SEQ ID NO: 134955 - protein, 326 aa, Glycine max
  Coding DNA Sequence Number=SeqID_18177
  Gene Ontology: Mol. function=cation transporter activity; Cellular component=integral to membrane; Biological process=potassium ion transport
  Homolog annotation: Hit_ID=Q1GZJ9; Match level="QueryCoverage=98%, HitCoverage=57%, E-value=1e-101, Identity=52%"; Hit description=TrkA- N
  Pfam annotation: Domain name=TrkA_N; Domain location=55-165; Score =72.8; E_value=1.1e-18; Accession=PF02254.8; Description=TrkA-N domain
MASFGTNRIINPYHIFGEHLAMRLNALGTYLLHEWLTRAPGDAIATPAAIPQGQWIACGYGRFGKSVVSSLQNENMQVTIIEADPEGTQCDDCIIGSGVEAHVLQQAGVEHAVGIVAGTDNDINNLSIVMTALELNPDLFVIIRKNKRHNDPLFQHFNADITMQPSDVIAHTCLAYMVSPMLAEFLTIARHKGNQWANAVIAQLVSKLGEQVPDTWDITIADDMAIAVCAMMEQGLQPALKHLMMSPAGQQRREMPVVPLMLVRGDQEMLLPELSTPLQIGDRILCCGLDQAKSIQRFVMHDVKTMHYLVTGSEMPETWIGRWLKQ

SEQ ID NO: 134956 - protein, 195 aa, Glycine max
  Coding DNA Sequence Number=SeqID_18178
  Gene Ontology: Mol. function=nucleoside-triphosphatase activity; Cellular component=chloroplast
  Homolog annotation: Hit_ID=Q2PMM5; Match level="QueryCoverage=99%, HitCoverage=14%, E-value=3e-52, Identity=78%"; Hit description =Protein ycf2
MNIPDSEGKNLHQYLNFNSNMGLIHTPCSEKYLPSEKRKKRSPCLKKCLEKGQMYRTFNKIVFFNSLKMESIPNIYTMVPYLDREFFYSILFLLLVAGYLVRTHLLFVSRVYSELQTEFEKNLFLVALEQLGDSLEEIRSFAFGGNMLWGGGPTYGVKSIRSKKKYLNLIDLISIIPNPINRIAFSRNTRHLSHP

SEQ ID NO: 134957 - protein, 61 aa, Glycine max
  Coding DNA Sequence Number=SeqID_18179
MTFGTGRSQTGMCIIDIGDLSIEKIHRPETKRKKDSNNHLLPPPAIFFSTMSLSFDPIALR

SEQ ID NO: 134958 - protein, 418 aa, Glycine max
  Coding DNA Sequence Number=SeqID_18180
  Homolog annotation: Hit_ID=Q66BM7; Match level="QueryCoverage=36%, HitCoverage=90%, E-value=2e-65, Identity=77%"; Hit description =Putative tail tube protein FII
  Pfam annotation: Domain name=Phage_E; Domain location=162-231; Score =58.3; E_value=2.6e-14; Accession=PF06158.2; Description=Phage tail protein E
  Pfam annotation: Domain name=Phage_P2_GpE; Domain location=245-283; Score=80.8; E_value=4.3e-21; Accession=PF06528.3; Description=Phage P2 GpE
  Pfam annotation: Domain name=Phage_tube; Domain location=2-166; Score= 342.3; E_value=8e-100; Accession=PF04985.4; Description=Phage tail tube protein FII
  Pfam module annotation: Pfam domain module=Phage_E::Phage_P2 _GpE::Phage_tube; Domain location=162-231::245-283::2-166
MALPKKLKYLNLFNDGYSYMGVVSSLTLPKLTRKLEKYRGGGMNGAASIDMGLDDDALAVEWSMGGIDELVLKQWGAVDAVPLRFAGSFQRDDTGEVSAVEVVMRGRHKEIDFGEYKQGEDTETKVSTECTYFKLTVDGKELIEVDTVNMVEKNTMKDAKENTVTLDTPIQRGETTITEVQVIKPNAGALRGVGLAAIANADVDALLVVLPPAGFGGAGRESGRFFVAELGGVIPDARLGVDDLMADIAVIFHWPPSEMAGMTLTELLNWRHLALQRSGAVDQATRPLKSIQQASKQLAGDIKTTQQTLKALDAQSARIEGFRKAQGQLAVTGKALKKAKEEAAALAVQFKATEKPTAQQARLLEASRRAAAELQTKYNGLRQSVQRQRDALNADGIATRNLSAEQRRLKASAREATT

SEQ ID NO: 134959 - protein, 75 aa, Glycine max
  Coding DNA Sequence Number=SeqID_18181
MRMRRHSMFPFACMPLVLWGVVRLVVSSLANVRVLTIGSCVAYLPNGIRVASQTHSIQASLLGTLEDFKVPHVNH

SEQ ID NO: 134960 - protein, 784 aa, Glycine max
  Coding DNA Sequence Number=SeqID_18182
  Homolog annotation: Hit_ID=Q7N2R7; Match level="QueryCoverage=18%, HitCoverage=84%, E-value=3e-28, Identity=44%"; Hit description =Similar to phage tail fiber assembly protein
  Pfam annotation: Domain name=Caudo_TAP; Domain location=578-718; Score=123.0; E_value=8.1e-34; Accession=PF02413.7; Description =Caudovirales tail fibre assembly protein
NKPPIAGNIAAGVLSLPCDAAPSTGYVSVSGLGHGFIGRSNRPENGVVWSRIYTTDYKPTAADVGAWSKTEADGRFLMLSGGTVKKLAIKPGNAETDGDSLNIEGNQHTPLVMSRPSAQSNLSIGFQVAGKALMRLGLGMDNELHWGTEPNQGANPRIYTTAKPPTAQETGALTDAQAMQKYALRSIKVNGKPLSGDVNLLAGDVNAWNKTEADGRYVKRAGDTMTGALALPRVVFPSESLQATNADSDLTRPDGFTLEQLGDKSVGYPLTKGNLGNLMTFKLNKYRHVQFAIGSGNTEFWLRSPREDNPATAKAWAQVYTTHYKPTAADVGALTDAQAAQKYALRSIKVNGKPLSADVNLLAGDVNAWNKTEADGRYLAKTGGQLTGTLKTSAEIQSTHIDNYRMVGGGFGSFWRNDGNRLYLLLTNENDQYGTFNALRPFSVDVRTGAAAFESGIHIGGKWPAITTSSGTTWHPDGNVQGSCWGGYLSNWLNQNISAAQNNAQNWAYQNLVQGVRMAGRTVIADTGGRIDLPSGCVYTGMSGSNYNPSIWGAYSAVQVLINGTWATIGTDDNGIDWYAAQKLFSPDTVKLAYDESGIICVINSDVSMLWPIGLSVIELNPTKLPKRCLANGEWVFDGKKVSPRAYSAEEMMARAEARKNELLAIAGAAVAPLQDAVDLDMATEAEKALLADWKKYRVTLNRLDMSASEIDWPHPPRAARRAGRHHACTYSPWSKLMGDYHHGVRVVEINDGTRVISTVSTAIVGMVCTAEDADASVFPLDTP

SEQ ID NO: 134961 - protein, 163 aa, Glycine max
  Coding DNA Sequence Number=SeqID_18183
MWHWGIGFYRRPCLSRSEFIIYLEKFYDDVRKVNRVSQGGGGGGGEAGGEAMILYTITYNNIQNIEEAKEHHLDEDALIPHDVSSIGACRLRIFFINGFLCFLEDEWQRNEERKRERRHHFKEKMSLEEAHHHRRPWIRAWRKNEMNEGRGREEHEICALNEL

SEQ ID NO: 134962 - protein, 226 aa, Glycine max
  Coding DNA Sequence Number=SeqID_18184
  Gene Ontology: Mol. function=receptor activity; Cellular component =cell soma; Biological process=protein kinase C activation
  Homolog annotation: Hit_ID=Q9FSU2; Match level="QueryCoverage=62%, HitCoverage=50%, E-value=7e-38, Identity=51%"; Hit description=Gbf1 protein
  Pfam annotation: Domain name=WD40; Domain location=100-136; Score =9.0; E_value=3.3; Accession=PF00400.22; Description=WD domain, G -beta repeat
  Pfam annotation: Domain name=WD40; Domain location=58-96; Score=40.5; E_value=5.9e-09; Accession=PF00400.22; Description=WD domain, G-beta repeat
  Pfam annotation: Domain name=WD40; Domain location=8-48; Score=50.3; E_value=6.4e-12; Accession=PF00400.22; Description=WD domain, G-beta repeat
  Pfam module annotation: Pfam domain module=WD40::WD40::WD40; Domain location=100-136::58-96::8-48
NSYDHDYEFELGTGDGHTDWVSCVRFIPDAAPPRLVSASWDGSVRVWDVDVDVDKGALRKRFTLSGHEGYVNVVAVSPDASLVASGGKDGVVLLWDMAGGVKIYEFEVGSVVHGLWFSPNRYWMCIATDESVRVWDLESNSIIKDLNVNGNNDHYNYVNGGTEITANNKSRPAGMQAWHWPSFYNVVTGKTLALPNLIALQHIPLSPAGVIAKRPAPIALPNSCAA

SEQ ID NO: 134963 - protein, 69 aa, Glycine max
  Coding DNA Sequence Number=SeqID_18185
MAQPPPRERTLREMAAPDFTYESLCIQYLDEGVPYVLKTGLIHLLPKFHGLADHHTNLCPSLQQSGVNE

SEQ ID NO: 134964 - protein, 92 aa, Glycine max
  Coding DNA Sequence Number=SeqID_18186
SWHSCEAKDDESLGYEVEGSCYVHPALLLGHPANSEVAKLPFNNSSSGRSISVNFSEQAFPESFRKKTSSGKRIWEFRKYSQTSSGRTFFRN

SEQ ID NO: 134965 - protein, 229 aa, Glycine max
  Coding DNA Sequence Number=SeqID_18187
  Gene Ontology: Mol. function=catalytic activity
  Homolog annotation: Hit_ID=Q1YM06; Match level="QueryCoverage=54%, HitCoverage=91%, E-value=2e-38, Identity=63%"; Hit description=Acyl -CoA hydrolase
  Pfam annotation: Domain name=4HBT; Domain location=126-203; Score =75.8; E_value=1.3e-19; Accession=PF03061.12; Description =Thioesterase superfamily
MVVLPGVPIEAYQSRKCHFSELSRCCLAILMADGDNASDRQNYTIVTLLYRVVSTPVIGHLYAPALFWNRAPSWLTEAYGAPVIPCGFGRAAATNRLLAEGMDQQPPADMELTLRTLAMPADANPAGDIFGGWVMSQMDLAAFVRANDVAGGRTVTVAVNEIVFKKPVKIGDTLCVYTRIEKIGRTSVTLKIEAWTRRHYRDSREKVTEAVFIMVAVDENGEPRPVRKD

SEQ ID NO: 134966 - protein, 112 aa, Glycine max
  Coding DNA Sequence Number=SeqID_18188
MDDEDPAAQLTHQSVDESSESSTPEPLIRKRRVVVTPEVVATPKKSPEATPKPLAPMADTTSPQQATDPSTPEDQTTPVQSPNASLVSTFVLHLTDEEEVQTQDTQDQSQDF

SEQ ID NO: 134967 - protein, 74 aa, Glycine max
  Coding DNA Sequence Number=SeqID_18189
IKREISTLKLLKHPNVRNLDQLEDLLNKVKLKTIRTEPPSASIAGTSWCIFGVSVDSVVAALQFVAPSAKGFFL

SEQ ID NO: 134968 - protein, 49 aa, Glycine max
  Coding DNA Sequence Number=SeqID_18190
VKKRLSHEVPKVTVELSSSVSSARLNALLALSLNPLTRAKRNVTNSEPI

SEQ ID NO: 134969 - protein, 155 aa, Glycine max
  Coding DNA Sequence Number=SeqID_18191
MQSQLQSLIQSQGLALPPEPEVGPSAARVNTKGSCVDPSPTNPDTGDSDKCRLYIEENPSRLVALGRVYEGSTSVHNIPLLHGQVKVGVEEALNTFLPWSTHLVKHLSEQVVVSPTKPPDRPDPEVDDPLYLMTLTIPQLFLKPLQVMWDATVFG

SEQ ID NO: 134970 - protein, 92 aa, Glycine max
  Coding DNA Sequence Number=SeqID_18192
MANTLCGELGKRGTKRYRGKRGFFVYNETPKSVVESMSMIEELRKLLLLSDGALFLVEFELWNRDTKLSFPKRVSLVTRRRFTTMVENPQYL

SEQ ID NO: 134971 - protein, 45 aa, Glycine max
  Coding DNA Sequence Number=SeqID_18193
MNHAASDLSFSHSRYGESYKDGMAARAGVNTEVEMAPAELLSTRQ

SEQ ID NO: 134972 - protein, 152 aa, Glycine max
  Coding DNA Sequence Number=SeqID_18194
  Homolog annotation: Hit_ID=Q6ZGL7; Match level="QueryCoverage=47%, HitCoverage=7%, E-value=2e-09, Identity=43%"; Hit description =Putative glutamate receptor
MYDDVGTDVKAMMLNMGTSTSVVTYALMYNDVEYENFYIGGDIGTDMFQKGSPVARDVSKAILHLSKKAELKRLEEKWLITSPASCSNVTSDDTDSLKLRSLWILYVISGATSTICVLLSAIQSLVKSCHQCQAVAPEGNDTPSDHKVWENK

SEQ ID NO: 134973 - protein, 114 aa, Glycine max
  Coding DNA Sequence Number=SeqID_18195
MKDSTEEVVGNGNSGTSVTKSGKMQSMPRKRTRQWWKGWLCGWRLRWHGKRRRHGWRRWHVGLSGGGNGGGSSGVRGRVSIGVWVRNVCAEKEDGGGVGMGGGGGGGDCTKDDG

SEQ ID NO: 134974 - protein, 73 aa, Glycine max
  Coding DNA Sequence Number=SeqID_18196
MSQVYQSEEDCIEGRGLDPRRSLVIEVTKRIFNWAHRLVLRTRYVNSFFLVFRQSSGDETSFKGGEIVTSNFS

SEQ ID NO: 134975 - protein, 52 aa, Glycine max
  Coding DNA Sequence Number=SeqID_18197
MREKALCPDVLQHKVPLSTSPSHLLPRTQGSRSSQDPNTNSKPGVSYHIPNY

SEQ ID NO: 134976 - protein, 164 aa, Glycine max
  Coding DNA Sequence Number=SeqID_18198
MAAEWRRKRERRRYFKEKMSQEEAHHHRRPWIRAWRKKEMNEGRGREEHEILCSKRALKSEPMGPKSTLRLMRTLGSSLAFLAQSSWNLLSNALGGVGVFWEWLTLKAKACANHECGWPWGKFYSAPTMGAKCTYRNLELTNVRVVEIKMSSSISHVEFTSAHH

SEQ ID NO: 134977 - protein, 98 aa, Glycine max
  Coding DNA Sequence Number=SeqID_18199
MAREGVVQRMVWVAMVGAIMAATEAPFSEWCGWCIPYIEALAKVAATKTEGARMPKEINRKVENDNNAVFHDGKQHANNIFHMNQYPPDSSAPSNKFC

SEQ ID NO: 134978 - protein, 145 aa, Glycine max
  Coding DNA Sequence Number=SeqID_18200
MDSIADTNQFKVEGNWHMLYKLQIGSCLRLSPKLAIKIEQLELCEMEKASYWSTKMQYRCNIFCGRFRSQTNVVAYTLARNSKFYANDNIENLSSVSRIFPLDLMMKSVQFQVKKRLSHEVLKVTVELSSSVGLSAHPPLSAVSA

SEQ ID NO: 134979 - protein, 87 aa, Glycine max
  Coding DNA Sequence Number=SeqID_18201
MHNSQPVPRWQPPSRGFSNAMSMLHFSWIRKLWALDFVQGMIKAWFLMMPKYNQTRLLQQTFKVKQTEIASRLIQGQANKIKKKIRP

SEQ ID NO: 134980 - protein, 66 aa, Glycine max
  Coding DNA Sequence Number=SeqID_18202
  Subcellular localization annotation: CTP_CleavageSite=27; ConfidenceScore=5.67e-01
MAESSKKRKGSSASVSASRAHRSGATSASTVPIPPSLSSSTLFSSEEHQKRYSNLFSSCSIIDPKS

SEQ ID NO: 134981 - protein, 328 aa, Glycine max
  Coding DNA Sequence Number=SeqID_18203
  Pfam annotation: Domain name=Transposase_23; Domain location=243-298; Score=-5.6; E_value=0.0046; Accession=PF03017.5; Description =TNP1ENSPM transposase
EVPTAQKDLIWEDIQAEFEIPEASDNRTKKKILQIVGERWRQFKSDLTSKWALSADQDGVDDTVCEKYDISKEKWAKFCQRRRDPSWENKKLVVTKKKLEEAAQFGTADGVIDPPSPIRRHVKWKMVCIKKTGQMTSEAAKEIAEKIASQGSFVPHGRQDVLTAAIGRAEHPSHVCGVGARVTIKQYFGSAPQTSRNSSSLPLKDLQQLTQQIRDQQEESITQKGLALPPELMVGPSSPHVITKESYVDPSGNDPETVHKIPLLPGQVKVGVEEVKDAQAPVPIPTDEVTLVGQALNTFLAWPTHLMKHLSEQVAVSPAKPPQRPDLE

SEQ ID NO: 134982 - protein, 577 aa, Glycine max
  Coding DNA Sequence Number=SeqID_18204
  Gene Ontology: Mol. function=protein binding; Cellular component =membrane; Biological process=defense response
  Homolog annotation: Hit_ID=Q1SW19; Match level="QueryCoverage=97%, HitCoverage=61%, E-value=1e-128, Identity=45%"; Hit description =Disease resistance protein
  Pfam annotation: Domain name=LRR_1; Domain location=330-351; Score =6.6; E_value=17; Accession=PF00560.23; Description=Leucine Rich Repeat
  Pfam annotation: Domain name=LRR_1; Domain location=353-374; Score =10.0; E_value=3.9; Accession=PF00560.23; Description=Leucine Rich Repeat
  Pfam annotation: Domain name=LRR_1; Domain location=376-397; Score =13.6; E_value=0.74; Accession=PF00560.23; Description=Leucine Rich Repeat
  Pfam annotation: Domain name=LRR_1; Domain location=518-540; Score =6.7; E_value=16; Accession=PF00560.23; Description=Leucine Rich Repeat
  Pfam annotation: Domain name=NB-ARC; Domain location=1-216; Score =64.9; E_value=2.6e-16; Accession=PF00931.13; Description=NB-ARC domain
  Pfam module annotation: Pfam domain module=LRR_1::LRR_1::LRR_1::LRR _1::NB-ARC; Domain location=330-351::353-374::376-397::518-540::1-216
KEDHPKDVSTIESLTEEVRNRLRNKRYVVLFDDVWNGKFWDHIESAVIDKKNGSRILITTRDEKVAEYCRKSSFVEVHKLEKPLTEEESLKLFCKKAFQYSSDGDCPEELKDISLEIVRNCKGLPLAIVAIGGLLSQKDESAPEWGQFSRDLSLDLERNSELNSITKILGLSYDDLPINLRSCFLYFGMYPEDYEVQSDRLIRQWIAEGFVKHETGKTLEEVAHQYLSGLVRRSLVQVSSLRIDGKVRRCRVHDLIHDMILRKVKDTGFCQYIDGPDQSVSSKIVRRLTIATDDFSGSIGSSPIRSIFISTGEDEVSQHLVNKIPTNYMLVKVLDFEGSGLRDVPENLGNLCHLKYLSFRYTGIASLPKSIGKLQNLETLDIRDTHVSEMPEEISKLTKLRHLLSYFTGLIQWKDIGGMTSLQEIPPVTIDDDGVVIREVEKLKQLRKLWVEDFRGKHEKTLCSLINEMPLLEKLLINRADESEVIELYITPPMSTLRKLVLFGKLTRFPNWISQFPNLVQLRLGGSRLTNDALKSLKNMPRLLFLGLGYNAYEETKATVPRKFGSIEVHPYRQRST

SEQ ID NO: 134983 - protein, 167 aa, Glycine max
  Coding DNA Sequence Number=SeqID_18205
MDPEKIGSNFKDSDSYEPEAKPKRIVEAMNIPALIREQVASHLQWYVEALSLHEIQVPSLFSIQTQALAFCGSKQNIDIIESKGRAGAYGVTLKQNEKALQNYIESKGREGAYGRFDSIAFGDTSHVLYAALHPEGLTSNVTPREEDESFPSITKCSNNVKSEFLIL

SEQ ID NO: 134984 - protein, 86 aa, Glycine max
  Coding DNA Sequence Number=SeqID_18206
  Subcellular localization annotation: CTP_CleavageSite=32; ConfidenceScore=5.30e-01
MPAPHLPANSKVFSLCLKFFYPLLSASAFCVSASIQKYRHQLLNTSNGVTLKQNEKALQNNIESKGREGAYGRFDSIAFGDTSHVL

SEQ ID NO: 134985 - protein, 95 aa, Glycine max
  Coding DNA Sequence Number=SeqID_18207
  Gene Ontology: Mol. function=two-component response regulator activity; Cellular component=nucleus; Biological process=two -component signal transduction system (phosphorelay)
  Homolog annotation: Hit_ID=Q94LW1; Match level="QueryCoverage=87%, HitCoverage=13%, E-value=8e-15, Identity=44%"; Hit description =Response regulator 9
MGTYPTEKVFFQFPAGLRVLAVDHDTTILDVIKKMCFRCHYRAVTYSDASLALNYVREKKDCIDVILIEVHMPYGDSYEFLQHVTVETNIPVISI

SEQ ID NO: 134986 - protein, 336 aa, Glycine max
  Coding DNA Sequence Number=SeqID_18208
QRQCGSSGGSDAGDGGGNSNGGGNENSGRAAKARYDSNDGGGGMVEAIVVVVQTRTTGCGGGGMVTVEVAVRWRWQCGAVAEKEVQDTLTVSSIAKSVNKETIDLDMPVSTTNASNAGAAENLEEQEDTQSHSESSPLKQMSLPEPMLEENTVEVDSNLDHFMNYETKQHPPTAKEELPYINPVVAFVSIPIVKTNEPIIYQSIIPNYKCRKSLRRDSPIDVDPFAFIDVLSSNSMPSEASESSHNRPFTHFDKVVASQHTTDIAEIESSIELDRNKLIQAKEGFEKAKENLMLIEGLIEKTERYEAELVKKEDLLANLNPIQDEPHSTRFNLAEL

SEQ ID NO: 134987 - protein, 70 aa, Glycine max
  Coding DNA Sequence Number=SeqID_18209
MMIETTTWPSWLIELMPLKSLSVKVIVHAIVASVFVCLGLSLFFGLLPGSYVAPPDVLQVLLLLGGCMTS

SEQ ID NO: 134988 - protein, 421 aa, Glycine max
  Coding DNA Sequence Number=SeqID_18210
  Gene Ontology: Mol. function=RNA-directed DNA polymerase activity; Biological process=RNA-dependent DNA replication
  Homolog annotation: Hit_ID=Q8S5G1; Match level="QueryCoverage=62%, HitCoverage=36%, E-value=2e-19, Identity=29%"; Hit description =Putative retroelement
MEEELIKCLRHNKDAFAYKAQDMSGIHPNFIEHKLFTESGCKAGSLEKEFGDDKRKTIKNLQDSGTLKRVAWGLDVGTRLHGHILRIKPNLNGSQDEEKTAFTIEVGNFCYKVMPFWIEEFWGNISATNGYVEARYFDFLMMPKDQDRVFDGKLGKNIEVYVDNMEGKILGFMLTIRGIEANPDKCKAIMEMKSPKTVKDMQQLTGKIMPLSWFLSKLIKKELLVFIKDPQGMYPPLFSLNNLVDVPSTRTDPEEMYPLLFSVNNPSRCTLYLYHKGCTLQYVKTKFSGETSHLKKCEEKGDEGNWILSVDGSSNLVGNKTCIILEGPDGLMLEESLKFDFKADNKQAKYGTLLARIRLTLDRNSRVDLLAKLVITKKPGNNKSVIQENISHPSIDDSEPGEAKKIQNDVSRYSILDGRLF

SEQ ID NO: 134989 - protein, 81 aa, Glycine max
  Coding DNA Sequence Number=SeqID_18211
MTIRVRKVVPVIDFFIFSKLSLPKLGEVRILSLLQEVSENDQNKGSMLEGLYIVQDKYPDKVDRRALEDSSLSIYVIRLNA

SEQ ID NO: 134990 - protein, 152 aa, Glycine max
  Coding DNA Sequence Number=SeqID_18212
GGDDVVSYKAFLDRLRGLAMQWFLSLPPKSIFNFQELARKFESQFEASKSKRLEVVDLFEIKQQKGETLKKAGNMEEICARVKKHIEAEEEIWRSRSYGDRRRREQNPKHELPHRGTISTIVGPPKARNQMRDAEGIEPHDIDQVVITIVTK

SEQ ID NO: 134991 - protein, 201 aa, Glycine max
  Coding DNA Sequence Number=SeqID_18213
MVLVNQVPSSECIDPLLLAFSTNSTNASCELDVDSVDVVEEDSADNVSMEDVIKESDEDTLDSQDLSDNEVGNEDNDDVGAEDISIDVSTNTNYGGIDLVVVEACNEEEKQVIDDYLTALGDEEWMKKVGPGGACKAKKDVGLMKFELIKKEGMIIALNKKLEEALDEKTLETQVKDLTGFELQAKESSKEVESLIAMLRQ

SEQ ID NO: 134992 - protein, 61 aa, Glycine max
  Coding DNA Sequence Number=SeqID_18214
MAASQKHTTGELTTEQGVEVRQPIRPPKIAKDIRSTFLQGNFLNKTTTEVKKIIENLAASE

SEQ ID NO: 134993 - protein, 144 aa, Glycine max
  Coding DNA Sequence Number=SeqID_18215
  Gene Ontology: Mol. function=RNA-directed DNA polymerase activity; Biological process=RNA-dependent DNA replication
MSISDEGMVTLEARCSAIIEKTLLSKLGDPRSFTIPITIKNLSIGSAFLDLGASINLMTLSMMERIGNMEVKETRMTIQPTDHSIKIPHGVVENMLVDVGKFTLSTDFVIMDIEEDSNIPLILGKPFLNTINVVISVAKGKFTI

SEQ ID NO: 134994 - protein, 93 aa, Glycine max
  Coding DNA Sequence Number=SeqID_18216
MRPRRKAPKKGERRATSPKNVWRDSADLARFKPRRKKARGEKSSVDVQHPSSVNGRAGRSSRVNGEGILFSVESAVDEIKKDEIKKDEIGGKW

SEQ ID NO: 134995 - protein, 83 aa, Glycine max
  Coding DNA Sequence Number=SeqID_18217
MAIQVEMREMWADIADNNHAIGMVMDSLRVKLLLNPELEKKGNVILDFREEESKCLRIPRDSKLGVGNPCSPRENQVQVSQSG

SEQ ID NO: 134996 - protein, 121 aa, Glycine max
  Coding DNA Sequence Number=SeqID_18218
MSRSSKAISDEAMFGQYYKVARSSAQNVALERGGVRMIGCLSVIMKERECQCKGENEKKKVLKRERGVMNRGKGKRIQGVIEGMMEGEGKYDGSRSPNPTFVLAHLSINKGHLSEVGQGIP

SEQ ID NO: 134997 - protein, 169 aa, Glycine max
  Coding DNA Sequence Number=SeqID_18219
  Pfam annotation: Domain name=GRP; Domain location=79-165; Score= -28.8; E_value=0.068; Accession=PF07172.2; Description=Glycine rich protein family
  Subcellular localization annotation: CTP_CleavageSite=29; ConfidenceScore=5.07e-01
MMMVMVVMLATTKVEKPVVIAVTVTVEVVMAMVVAVVAMTMTILVVALAVLVVVMLATMVVMIMVAVASTTLVVAVTEMVLAVAVAMTTTMVVVVVVMPMTMLVSAASDGCDDIGTVVTKVVYIGIGGGGGGDSNGASGGNGGGDGGGGDNSIGSSNCGGDNKTCDCQI

SEQ ID NO: 134998 - protein, 152 aa, Glycine max
  Coding DNA Sequence Number=SeqID_18220
MATCPRLQKTARPCLQRTTCPRLQRGPVVSLYQSLGHPLISEEGQLCEHNQRQAIVQPLCILEQDFNRAATKRRVRIMRTNMTTLTQIWMTDRTTRHPVDPGEPNSGLGVSSSGYGPLSVLQGARPPQQVSCHCDIGIAPARHPVDPEKSKQ

SEQ ID NO: 134999 - protein, 79 aa, Glycine max
  Coding DNA Sequence Number=SeqID_18221
  Gene Ontology: Mol. function=receptor activity; Biological process =DNA integration
  Homolog annotation: Hit_ID=Q1SEE1; Match level="QueryCoverage=91%, HitCoverage=5%, E-value=8e-21, Identity=68%"; Hit description =Integrase, catalytic region; Zinc finger, CCHC-type; Peptidase aspartic, catalytic
MMLPMFSDSQSAISLAKNPVFHSRCKHIQLRYHFIRELINDGDLSLLKILGSENPADMLTKAVTTDKLRFCIASVGLQG

SEQ ID NO: 135000 - protein, 96 aa, Glycine max
  Coding DNA Sequence Number=SeqID_18222
MDYLRRHHDLQEIKERGRLFHKRSNYGSNTMRLITTTCKGQTRITQPQDMKPAKMHCVIDYTALVIDYQRPLQHSRPLPKPGNRLRPFVIDYQKPS

SEQ ID NO: 135001 - protein, 50 aa, Glycine max
  Coding DNA Sequence Number=SeqID_18223
MTNQSRYFNLKYKLQQISPIIIRIHGKFFCATPPELSQETHIPLTTRSGK

SEQ ID NO: 135002 - protein, 529 aa, Glycine max
  Coding DNA Sequence Number=SeqID_18224
  Gene Ontology: Mol. function=oxidoreductase activity; Cellular component=intracellular; Biological process=lignin catabolic process
  Homolog annotation: Hit_ID=Q2LD62; Match level="QueryCoverage=95%, HitCoverage=95%, E-value=0.0, Identity=58%"; Hit description =Putative copper ion-binding laccase
  Pfam annotation: Domain name=Cu-oxidase; Domain location=148-301; Score=150.0; E_value=6.1e-42; Accession=PF00394.12; Description =Multicopper oxidase
  Pfam annotation: Domain name=Cu-oxidase_2; Domain location=376-513; Score=173.5; E_value=5.2e-49; Accession=PF07731.4; Description =Multicopper oxidase
  Pfam annotation: Domain name=Cu-oxidase_3; Domain location=30-139; Score=175.3; E_value=1.6e-49; Accession=PF07732.5; Description =Multicopper oxidase
  Pfam module annotation: Pfam domain module=Cu-oxidase::Cu-oxidase _2::Cu-oxidase_3; Domain location=148-301::376-513::30-139
  Subcellular localization annotation: CTP_CleavageSite=41; ConfidenceScore=5.16e-01
MKLFSFSLACAFALLTSSLASATIQEHTFKVQNTTIKRFCKEQVIVTVNGTFPGPTINVREGDTVIVHVLNEGPHGVLQLFSPWADGPEYVTQCTIRPRSKYTYKFNVTQQEGTVWWHAHASYLRATVHGAFIIQPRSGQFPFPKPYKQIPLILGDLYNSNVEDITTEAQASGGGPNISCAFTINGFTSGLLINNCTENETFKMKVQQGKTYMLRMINAALNYDLFFKIANHNFTVVAVDASYTDHYVTDLIVIAPGQSADVLFTANQPIGSYYMVASPYVVGLDHFDVNVGRGTQGGGPHWVPVPRKVDEHMFITIGFNTEFCDSKNPNNASCKGPNGQRFSASMNNESFAVPAGVKFSLLEAFYENMSGVYTTDFPNKPPVMFDFTNLNNANNMNLLFAPKSTKAKKLRFNSTVEIVFQNTALLGGQNHPMHIHGYSFHVLAQGFGNFHKKDRAKFNLVNPQFRNTVGVPMGGWTVIRFQANNPGVWLVHCHMEDHVPWGLAMIFEVENGPTPSTSVPPPPADLPKC

SEQ ID NO: 135003 - protein, 83 aa, Glycine max
  Coding DNA Sequence Number=SeqID_18225
MEALVTSLTRLHLDDAWLASLCFDTGVGFKAGSLSFNEEEGASPPRIALDKKLEKDALMEEKKERRGEHEIEGIKEGEKWNFE

SEQ ID NO: 135004 - protein, 64 aa, Glycine max
  Coding DNA Sequence Number=SeqID_18226
MSDLEPHTSVKAQRCQPRVVKVEARERGDEGLHDEARMGTKRWECANHNVLQKHRGRLRSMTII

SEQ ID NO: 135005 - protein, 90 aa, Glycine max
  Coding DNA Sequence Number=SeqID_18227
MEVNRPRWEAEDLKFVVGNDKEESRATTQVVWRRLETNFIKVNFDASVKKPNGIGMGLVARDHNGMVLGAMTFLINTVFEPQIAKALCYR

SEQ ID NO: 135006 - protein, 76 aa, Glycine max
  Coding DNA Sequence Number=SeqID_18228
  Subcellular localization annotation: CTP_CleavageSite=35; ConfidenceScore=5.17e-01
MLMLASPLNKAKHSCYAKLLLLSAPCALSLRVILMASKKRKAPATPSQVRYDRSRFTSPKAWERYSDIIVPRKLLP

SEQ ID NO: 135007 - protein, 63 aa, Glycine max
  Coding DNA Sequence Number=SeqID_18229
  Gene Ontology: Mol. function=protein disulfide isomerase activity; Cellular component=endoplasmic reticulum; Biological process=cell redox homeostasis
  Homolog annotation: Hit_ID=Q43116; Match level="QueryCoverage=98%, HitCoverage=13%, E-value=6e-22, Identity=78%"; Hit description =Protein disulfide-isomerase precursor
MDATANDIPRETFEVQGYPTVYFRSASGKISQYDGSRTKEDIIDFIEKNRDKADQQESVKDEL

SEQ ID NO: 135008 - protein, 175 aa, Glycine max
  Coding DNA Sequence Number=SeqID_18230
MEMASWTRGGTWWTRQWSWRVAVHVAAWVSVISGGFIQQPLMDREFISIGGSSLEDTRHGASHNDSFFSERVSASCRTSGSASHLRGRARPFIFSREPVPINMILPLFASRGVRRGSGGGYVKASPRVRHSHGAGLPSSPPIVTSYEWVKDNVLKYKSSFTFAASVTTLQRGEFG

SEQ ID NO: 135009 - protein, 98 aa, Glycine max
  Coding DNA Sequence Number=SeqID_18231
MATKSKTYQDTVDTRRGAKSALVPMAARKAMSTDTTDTVDTKQENLPEHSEEGGFETRARPGWLCETLRGGSRTMTVQRVALQGRSGEMAVMRVIALQ

SEQ ID NO: 135010 - protein, 405 aa, Glycine max
  Coding DNA Sequence Number=SeqID_18232
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=91%, HitCoverage=92%, E-value=1e-158, Identity=62%"; Hit description =Protein disulfide-isomerase precursor
  Pfam annotation: Domain name=AhpC-TSA; Domain location=26-124; Score=- 18.2; E_value=0.027; Accession=PF00578.11; Description=AhpCTSA family
  Pfam annotation: Domain name=ERp29_N; Domain location=35-144; Score= -38.0; E_value=0.015; Accession=PF07912.3; Description=ERp29, N -terminal domain
  Pfam annotation: Domain name=Thioredoxin; Domain location=33-141; Score=168.7; E_value=1.5e-47; Accession=PF00085.10; Description =Thioredoxin
  Pfam module annotation: Pfam domain module=AhpC-TSA::ERp29 _N::Thioredoxin; Domain location=26-124::35-144::33-141
MAHHNNNRVSIWFLFVSSLLSLFAQISSAEKEFVLTLDRSNFSDIVTKHNFVVVEFYAPWCGHCMKLAPEYEKAASILSSNDPPVILAKVDANEEKNRELARQFQVQGFPTIKILRNGGKVVQDYKGPREADDIVDYLKKQSGPATAEIKSADDASALIGKNKVVIVGVFPKFSGEEYENFNALAEKLRSEYDFGHTLDAKYLPRGESSVTGPVVRLFKPFDELFVDSHDFHMEALEKFVAESSVPVVTVFNNDPSNHPFVVKFFDNPNVKAMMFVNFTADNADSLKLKFRESAEQYRQQGVSFLVGDLEASQGAFQYFGLKENQVPLMIIQHNDGKKFLKTNVEPDHIATWLKAYKDGSVEPFKKSEPIPEVNNEPVKVVVADNLQDIVFNSGKNGMTFCFYLV

SEQ ID NO: 135011 - protein, 141 aa, Glycine max
  Coding DNA Sequence Number=SeqID_18233
  Gene Ontology: Mol. function=structural constituent of ribosome; Cellular component=ribonucleoprotein complex; Biological process =translation
  Homolog annotation: Hit_ID=Q2QD65; Match level="QueryCoverage=67%, HitCoverage=74%, E-value=2e-36, Identity=83%"; Hit description =Ribosomal protein S12
  Pfam annotation: Domain name=Ribosomal_S12; Domain location=15-140; Score=146.2; E_value=8.7e-41; Accession=PF00164.15; Description =Ribosomal protein S12
MGQILQDQTLWELRNDGRKEIKKKWDKRIDREKDFLFLLEDRDWIHICLSGSKGDLSVNFSTITPKKPNSALRKVARVRLTSGFEITAYIPGIDHHLQEHSVVLVRGGRVKDLPGVRYHIVRGTLDAVGVKDRQQGRSSAL

SEQ ID NO: 135012 - protein, 78 aa, Glycine max
  Coding DNA Sequence Number=SeqID_18234
  Gene Ontology: Mol. function=aldehyde dehydrogenase [NAD(P)+] activity; Cellular component=chloroplast; Biological process =aldehyde metabolic process
  Homolog annotation: Hit_ID=Q2PQL8; Match level="QueryCoverage=89%, HitCoverage=12%, E-value=6e-14, Identity=53%"; Hit description =Putative aldehyde dehydrogenase
MASNTKSKALFDSEEALMMVKELRVTFDCGKTRSYEWRISQLKAIIKLTEENEQQIYQALHSDLSKCETEAFVQETSD

SEQ ID NO: 135013 - protein, 125 aa, Glycine max
  Coding DNA Sequence Number=SeqID_18235
MRSFNKLIYERILEEFEARLSQARTNVASSVGKSQLTPIDPVEEQRLRSWCSVADVRPKRKGCIYGTGDLPYTYKCGNDSFMQPTCSRPVCKLSTPKRKKITQEKCCVKTSRERVGLPNRFLMLK

SEQ ID NO: 135014 - protein, 284 aa, Glycine max
  Coding DNA Sequence Number=SeqID_18236
  Gene Ontology: Mol. function=helicase activity; Cellular component =membrane; Biological process=viral genome replication
  Homolog annotation: Hit_ID=Q9LTU4; Match level="QueryCoverage=98%, HitCoverage=19%, E-value=2e-77, Identity=53%"; Hit description =Helicase-like protein
  Pfam annotation: Domain name=DUF889; Domain location=2-200; Score =228.4; E_value=1.6e-65; Accession=PF05970.5; Description=Eukaryotic protein of unknown function (DUF889)
PNNEELKQFSDWLLDIGDGKIGQHNDGFLEITIPDEFRIKNYDDPIHAIVEATYPSLIDNYSDTNYLQKRAVLASKKEIVDKINDYVLSLIPNHEKEYCSADSIDKSDELLNPVFALLPPEFLYSLQTSGIPNHKLKLKVGTPIMLLRNLDQTDGLCNGTRLIITKLGSNVIEVEVITVPNSGNRTYIPRINMSPSESAWPFKLIRRQFSFIVSYAMTINKSQGQSFHHIGLYLPHPGFSHGQLYVALSRVKNKDGLHILIHDNDGNPKNITTNVVYNEVFANL

SEQ ID NO: 135015 - protein, 132 aa, Glycine max
  Coding DNA Sequence Number=SeqID_18237
MYGVEARLQEDFDDANSQAYPRPTQEDFEFKKDLSSWIIQIELTSSKLEMMFCSTKQYIQLLTIELTFPARVFSMFDCENPDVNPGIDDKYICLPLPLLVLENENQHPIKFNDEKEGYASVIGYCSDEVWVF

SEQ ID NO: 135016 - protein, 90 aa, Glycine max
  Coding DNA Sequence Number=SeqID_18238
  Subcellular localization annotation: CTP_CleavageSite=24; ConfidenceScore=5.57e-01
MLSKPLILTSSTPNKKTKRSRSLPSRTVAGCDNTQKGTASLGRDGANNTQRGGQGGATMYGSFCGGHGGERDIQANTRRQLIVEFSETGI

SEQ ID NO: 135017 - protein, 389 aa, Glycine max
  Coding DNA Sequence Number=SeqID_18239
  Homolog annotation: Hit_ID=Q1SKD7; Match level="QueryCoverage=51%, HitCoverage=53%, E-value=2e-07, Identity=24%"; Hit description =Ankyrin
MASRKRKKPSTPTQVRFDRSRFTSQEAWERYTYVIVPRKHLLERNVVVYYTEFDEFKEELKRRHWDEELADFEDDNIDVAIMKEFYANLYDPEDKSPKQVRVRGHLIKFDEDMLNTFLKTHIIMKEGESLCAYSKFALLRPVKLCIPGRGFELNVDGQPLKILRKNMTTLAQTWSVLSFSNLIHTSHTSNVTLDRARLIYGIIMKMDMNVGGPKKARGKRLEASSTASSETRGPSSTLPPSSSTEIPVIPPVPTQIPLPPPLSAGPANFIFTPHMLHSMLQSIHRGKSIIMQSLQGLGLPSIMSMEEFDAQVAWPGDRPSSSRGGGAFTAQEPVTEEPPAPAPSPATAEEETTPAQTLQPSPPSAPTFEEIQPSALDLNEDQPQEEQDV

SEQ ID NO: 135018 - protein, 76 aa, Glycine max
  Coding DNA Sequence Number=SeqID_18240
MIRKRLGLIFSSSFSFFSLILLNLSMFESLNPFLQPPSYLFIGIEGRRLISSSPKRAQLAQIKGTGNRLPSSVIDY

SEQ ID NO: 135019 - protein, 76 aa, Glycine max
  Coding DNA Sequence Number=SeqID_18241
MGQVASGNTQVVIRTKTTSVIMTCENTQVVIRTKTTSVDPDPRVRWQAKIPKKLPEEATYSPRRAGRQPPPIFSYK

SEQ ID NO: 135020 - protein, 165 aa, Glycine max
  Coding DNA Sequence Number=SeqID_18242
  Pfam annotation: Domain name=Transposase_21; Domain location=1-122; Score=10.1; E_value=1.8e-15; Accession=PF02992.5; Description =Transposase family tnp2
MNHFGNLSTNHSSWPILLMIYILPPWLCMKRKYIMLSMMIAGPRQPGNDIDMYLTPLIEDLRKLWVEGVDVYDQSVQQTFRFLTKHDGHMIIWDHAVDGGGNAARARLKPGDQVLYTTSFFGDELWPADKLGFTKTAIQAKPDSIYFVFNRFSNPCLFHSTFLIT

SEQ ID NO: 135021 - protein, 53 aa, Glycine max
  Coding DNA Sequence Number=SeqID_18243
MYEKEIHLCELRVKGAVCTSVGIKNLLEEILRVGNVVVPSGFVGNQCMEGKVR

SEQ ID NO: 135022 - protein, 119 aa, Glycine max
  Coding DNA Sequence Number=SeqID_18244
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q41000; Match level="QueryCoverage=62%, HitCoverage=38%, E-value=1e-14, Identity=59%"; Hit description=ATP synthase delta' chain, mitochondrial precursor
VGQDEVDGEFGGESRRSGWSGLHVRQRRLRRVDVGAHFLPRLREDGIRRRRRRHVGGEAAAGGAGDEGGGCAAEHRGVRIGSLGLARATSLKRGVGLRDFGLIETLGSNMPQYYRAGSC

SEQ ID NO: 135023 - protein, 124 aa, Glycine max
  Coding DNA Sequence Number=SeqID_18245
MESDVWMNCWKEVRVFPSARYTSAHNPMELDFQNQILKKGRKRKKTKRYKFEKVWLNDVEGCQAVTKGWWCKATKDEELDELLKLEDEVWLQRSTGIWLEGGDRNTNSSIEKLLKGIKQIRSKK

SEQ ID NO: 135024 - protein, 115 aa, Glycine max
  Coding DNA Sequence Number=SeqID_18246
MKMKANKTRNELKVSDLKTYQLKTEESTKNGRRTAKNSGKSSRNCSQKHLESVTEAPRLGFSSRKHVFSPKTDEMHSIGVRNNFTQPPSPIYRRKREEVAAQLAQASRWLPQEAS

SEQ ID NO: 135025 - protein, 95 aa, Glycine max
  Coding DNA Sequence Number=SeqID_18247
MRLHCHQASWRPSMTIDSPPLLMAHIDPGIGPNISIKKVFLTMNVIDRQTHQTQQHSKVPSGVANCRNLPFGGRAMRGSWVRGVATNVYSRKTSY

SEQ ID NO: 135026 - protein, 86 aa, Glycine max
  Coding DNA Sequence Number=SeqID_18248
  Gene Ontology: Mol. function=alkaline phosphatase activity; Cellular component=membrane; Biological process=metabolic process
  Homolog annotation: Hit_ID=Q4J0Z9; Match level="QueryCoverage=99%, HitCoverage=9%, E-value=7e-22, Identity=58%"; Hit description =Alkaline phosphatase
MPAAALAAGCRDIARQLVEMKYGDGLNVAMGGGRANFLPDSVSDPEYPGKKGARKDGRDLTQAWLQHYGERGQYVWNQAQFDKIEP

SEQ ID NO: 135027 - protein, 196 aa, Glycine max
  Coding DNA Sequence Number=SeqID_18249
  Gene Ontology: Mol. function=alkaline phosphatase activity; Cellular component=membrane; Biological process=metabolic process
  Homolog annotation: Hit_ID=Q0M3G5; Match level="QueryCoverage=77%, HitCoverage=30%, E-value=2e-36, Identity=51%"; Hit description =Alkaline phosphatase precursor
MGIGRARRGVGDGGGRHGAGGHAERCGHLPQRGDGLGLLILAIVEGGRMVEAHQIVDGFDAGGHRHRAGRGVGDLGVGGVGFGRSQIGEGLPGQHVGFAVHAALLPFKNAGGGHGGKPHAVADHQNDVFGAVGVWRLFQPLLQLSLRLKEVRIFALRQLRVVRRAGGGRPAGEQGYGKRQAGCQCESEHEFLLGET

SEQ ID NO: 135028 - protein, 74 aa, Glycine max
  Coding DNA Sequence Number=SeqID_18250
MKDRVTTDQSSSLPSAGQAENVVARLARLGEQPLHQIIKNEGGGRFLHQETPPPPLIQKRDLTKLAVIALPSHF

SEQ ID NO: 135029 - protein, 224 aa, Glycine max
  Coding DNA Sequence Number=SeqID_18251
  Gene Ontology: Mol. function=receptor activity
  Homolog annotation: Hit_ID=Q6H663; Match level="QueryCoverage=78%, HitCoverage=69%, E-value=1e-33, Identity=38%"; Hit description =Receptor-like protein kinase-like
  Pfam annotation: Domain name=DUF26; Domain location=103-152; Score =14.1; E_value=0.0001; Accession=PF01657.8; Description=Domain of unknown function DUF26
  Pfam annotation: Domain name=DUF26; Domain location=176-224; Score =26.7; E_value=2.7e-06; Accession=PF01657.8; Description=Domain of unknown function DUF26
  Pfam module annotation: Pfam domain module=DUF26::DUF26; Domain location=103-152::176-224
MRANKERKIFITIQSDSTQRIILALKLSYLLFLFSSIPNAQGYTTRAHTFIYAGCSQENYQPNTPFETKLNSFLSSVSASSSDTSYNSFAIGNGSSSPPEGFIYGLYQCRADLRPNNCSKCVKNCVDQIGLPDTNLWYKRCSKAVANNAEFFQRRDDVLADLQVANGFGVSTSGFVEGFALCLMDLSVADCPSCLQEAVEKLRSICGSAASADLFLAQCYAWYW

SEQ ID NO: 135030 - protein, 139 aa, Glycine max
  Coding DNA Sequence Number=SeqID_18252
  Homolog annotation: Hit_ID=Q39008; Match level="QueryCoverage=27%, HitCoverage=6%, E-value=2e-08, Identity=76%"; Hit description =Mitogen-activated protein kinase kinase kinase 1
MATKSKTYQDTIDIADTTRGAKSALVPMAARKATSADTVDTKQENLPDHSEEGGFATRAQPGWLCKTPRGGSRTMAVQRVALQGGSGAMAMTRLNYTWDIKCANILVDVSGQVKLAGFGLAKAMKFNDAKSSKGIPTKE

SEQ ID NO: 135031 - protein, 126 aa, Glycine max
  Coding DNA Sequence Number=SeqID_18253
  Subcellular localization annotation: CTP_CleavageSite=25; ConfidenceScore=5.04e-01
MSHPIRHCVSSSSSMGFSIAIHLTICSHKHKALCNKCTRTQSYMQCGIMSVKNLVERLGVYDNIDHTLVWVYGKKNKELGARDITLTTEIISKIPTIWMYGEKEMVLGKEKGKTKFRGRGSVEKLM

SEQ ID NO: 135032 - protein, 130 aa, Glycine max
  Coding DNA Sequence Number=SeqID_18254
  Homolog annotation: Hit_ID=Q6Z806; Match level="QueryCoverage=43%, HitCoverage=10%, E-value=4e-17, Identity=70%"; Hit description =Putative DegP2 protease
MHNSQRHVYLGTFLNGTLKRFNDKHGSKSKANVQWILVKIKLKITYTYKCLVLKFYALRSFFLNLLLGFPVLGIEWQKMENPNLQMEIGMKPDQKGVHNRRIDPTALESKVLNPSDVIPSFDGLILPMME

SEQ ID NO: 135033 - protein, 105 aa, Glycine max
  Coding DNA Sequence Number=SeqID_18255
MKAYHDRKLVKRNFQTEQQVLLSIPDLSCFWANSSPSGLAPSPSKMLKIYNGGNIERLPPSSTSKTHEDVSRQASDVKEALTRRQHRISDLTLGVVHNIRNFLHA

SEQ ID NO: 135034 - protein, 176 aa, Glycine max
  Coding DNA Sequence Number=SeqID_18256
  Subcellular localization annotation: CTP_CleavageSite=20; ConfidenceScore=5.35e-01
MSRFGLSVHSRAKPQSPFFVSMASKKRRAAPSQSQGAKPAWDSSHFVSEVAWHRYQDNIHLQNILSEWNVQLFPGQRQWHQRLSNLPEKGIDLALVKEFYTNIYDSKDGSLEQCRVRGKLIKFDEQTLNVFLETLVIIPEGESLTTFSQFMHTYPNAQTIVAKLCMSGGHFVLNVE

SEQ ID NO: 135035 - protein, 133 aa, Glycine max
  Coding DNA Sequence Number=SeqID_18257
  Gene Ontology: Mol. function=DNA binding; Biological process=DNA integration
MLHLEIVSNSHMWIINSVEVVAAQKNDAKTVIKSLKGNIFSRFRIPRVLISDGVHISSIHNCRRCWGTIISNIKVVSPYHPQTNGQTEVSNRELKKILEKTIASLRKDWAVKLDDAIWAYRTAFMTPIGLSPF

SEQ ID NO: 135036 - protein, 282 aa, Glycine max
  Coding DNA Sequence Number=SeqID_18258
MWLKGVKTPMVLFGNCDDALSVPAALSLFIATVKILDFQMNALSRPSRAKRAKRALCAKPECYSDEAELSAPCCTKLKLSSVSKIRSRFTSQEAWERYTDIVVPRKLLLERNVVVYYIKFDEFKEELERRHWDEELTDFNDSSIDIAIVKEFYANLYDPEDKSPKQVRVRGHLVKFDEDTLNTFLKTPVVLEEGEILCAYSRFALLKPDPQELAAKLYIPGRGFELNADGQPLKILRKNMTTHYKKNDLYLRTKTVTINKKSVDISSSTLRWHIMTANYLSL

SEQ ID NO: 135037 - protein, 74 aa, Glycine max
  Coding DNA Sequence Number=SeqID_18259
MTAQLIHDRVEMECLEGAWETLEGNARCRFRATIRFTATSLVYPDEPARTVQRTVEWILPTPTPYLLVEPVQVI

SEQ ID NO: 135038 - protein, 129 aa, Glycine max
  Coding DNA Sequence Number=SeqID_18260
  Gene Ontology: Mol. function=receptor activity; Cellular component =endoplasmic reticulum; Biological process=ER to Golgi vesicle -mediated transport
  Homolog annotation: Hit_ID=O22151; Match level="QueryCoverage=86%, HitCoverage=46%, E-value=9e-49, Identity=86%"; Hit description=Golgi SNARE 12 protein
MRDTNLELQESGWEELRKEARKIEGDLDVKLSSYAKLGARFTQGGSGYVDSGSPPIGSSRSWKSMEMEIQSLLEKLLDINDSMSRCAASAGPATSVTQKLARHRDILHEFTQINLSTFSQFKKNGSLAI

SEQ ID NO: 135039 - protein, 154 aa, Glycine max
  Coding DNA Sequence Number=SeqID_18261
  Gene Ontology: Cellular component=endoplasmic reticulum; Biological process=ER to Golgi vesicle-mediated transport
  Homolog annotation: Hit_ID=O22151; Match level="QueryCoverage=68%, HitCoverage=33%, E-value=8e-26, Identity=63%"; Hit description=Golgi SNARE 12 protein
  Pfam annotation: Domain name=V-SNARE; Domain location=2-121; Score= -3.1; E_value=0.0049; Accession=PF05008.5; Description=Vesicle transport v-SNARE protein
MREHAELLSSVRDDITDFKLFSLSCTRLTFFWQTSGSMSPRMQLLRERASIHGNISHESGFTFPAFFQIDDVISQAQATRAVLGSQRTLFTDVQGKVKVLGDKFPMIRSLLGSIRRRRSRDTLILSAVIAAWKRAETKELKKQKWPVVSRKVNS

SEQ ID NO: 135040 - protein, 109 aa, Glycine max
  Coding DNA Sequence Number=SeqID_18262
  Subcellular localization annotation: CTP_CleavageSite=32; ConfidenceScore=5.21e-01
MSSFTFQKTSMSSVIYSFKRLQRLHRTHCPCLCFGGRAEREVLRSRGEGSERKKRKEEGRREKEAKSLSNCDCNRSSFSSVSFNRSLMPKKKLNPCRIVIVIVLRSSSG

SEQ ID NO: 135041 - protein, 101 aa, Glycine max
  Coding DNA Sequence Number=SeqID_18263
  Gene Ontology: Mol. function=protein serine/threonine kinase activity; Cellular component=integral to membrane; Biological process=protein amino acid phosphorylation
  Homolog annotation: Hit_ID=Q1S7H1; Match level="QueryCoverage=85%, HitCoverage=10%, E-value=3e-22, Identity=51%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=15-83; Score =97.8; E_value=3.2e-26; Accession=PF08276.2; Description=PAN-like domain
MDWSHGFIRNKELRCENKNNDGFNKLTLLKTPDTTHSWLDQTIGLEECKVKCLDNCYCMAYTNLDISGQGSGCAMWFGDLIDIRQLQLEARMYMFKLMLQN

SEQ ID NO: 135042 - protein, 67 aa, Glycine max
  Coding DNA Sequence Number=SeqID_18264
MKTNREGINLDPFFVEGIGIRESVRIYNILKASQLASFWPSSHLSNPSFTGNPKRDRVEGKTCCVGH

SEQ ID NO: 135043 - protein, 89 aa, Glycine max
  Coding DNA Sequence Number=SeqID_18265
MGAAIEDGEKPAYVEVNPARHTHSRQFEWRDMLEAHAANTSGGTCQRGQSHPWLLRDNFTRSECPPSRGLNATALKMAVYRIAGLGFVV

SEQ ID NO: 135044 - protein, 115 aa, Glycine max
  Coding DNA Sequence Number=SeqID_18266
MAAQLIHDRVEMECLEGAWETLEGNVRCRFRGMIQFTATSLVHPDEPARTLQRTVEWILPTPTPYRLVELVQVIEGDEDPLLEVDSPEDAMSASEEDSTEESGPGEMATSGGSSS

SEQ ID NO: 135045 - protein, 82 aa, Glycine max
  Coding DNA Sequence Number=SeqID_18267
MDPTTNLVEFSSQNLEACTNNFSQNNLIGLTQFGRLYRGNLEGQHVVVKIWDGERMKQISSKYNDENLIIKASALTISFTHK

SEQ ID NO: 135046 - protein, 299 aa, Glycine max
  Coding DNA Sequence Number=SeqID_18268
  Gene Ontology: Mol. function=superoxide dismutase activity; Cellular component=membrane; Biological process=superoxide metabolic process
  Homolog annotation: Hit_ID=Q7XEY9; Match level="QueryCoverage=90%, HitCoverage=84%, E-value=6e-58, Identity=46%"; Hit description=SPX domain containing protein, expressed
  Pfam annotation: Domain name=SPX; Domain location=1-202; Score=138.6; E_value=1.7e-38; Accession=PF03105.10; Description=SPX domain
MKFGKRLKQQIQESLPEWRDKYLSYKELKKLVRLISAAPPTLLNGSLEFGKTEAEFVYLLNNEIDKFNGFFMEKEEDFIIRHMGIVALPHPQEDPTNMNMGQKGDNLAHDGFSRGTPSPLQEVQQRIQRVVDLWGPNGSQPSEEDYKEEMAKIRKAIVDFHGEMVLLVNYSNINYTGLAKILKKYDKRTGGLLRLPFIQKVLEQPFFTTDLISKLVKECESIIDAVFPAEEEAERAKEAKEAITVAGKGIFRNTVAALLTLQEIRKGSSTESPFSLPPLNLPDSDLIQSIQLNAAVPIV

SEQ ID NO: 135047 - protein, 118 aa, Glycine max
  Coding DNA Sequence Number=SeqID_18269
  Gene Ontology: Mol. function=oxidoreductase activity, acting on the aldehyde or oxo group of donors, disulfide as acceptor; Cellular component=intracellular; Biological process=metabolic process
  Homolog annotation: Hit_ID=Q6Z3X5; Match level="QueryCoverage=86%, HitCoverage=11%, E-value=8e-32, Identity=58%"; Hit description =Putative 2-oxoglutarate dehydrogenase, E1 subunit
MLRRVYYELDEQRTKEDAKDVAFVVFLLDAEVVWCQEEPMNMGGYTYILPRLITSMKAVGRGGYEDVKYAGRAPSAATATGFLKVHLNEQAELVQKAIQREPINFPLLRHSIYIVSPE

SEQ ID NO: 135048 - protein, 184 aa, Glycine max
  Coding DNA Sequence Number=SeqID_18270
  Gene Ontology: Mol. function=nucleotide binding; Cellular component =membrane; Biological process=small GTPase mediated signal transduction
  Homolog annotation: Hit_ID=P28186; Match level="QueryCoverage=96%, HitCoverage=77%, E-value=8e-80, Identity=84%"; Hit description=Ras -related protein ARA-3
  Pfam annotation: Domain name=Miro; Domain location=1-99; Score=9.9; E_ value=0.00059; Accession=PF08477.3; Description=Miro-like protein
  Pfam annotation: Domain name=Ras; Domain location=6-147; Score=214.3; E_value=2.8e-61; Accession=PF00071.12; Description=Ras family
  Pfam module annotation: Pfam domain module=Miro::Ras; Domain location= 1-99::6-147
MLYGSIDFKIRTIELDGKRIKLQIWDTAGQERFRTITTAYYRGAMGILLVYDVTDEASFNSNLLSLLGFCYPDIRNWIRNIEQHASDNVNKILVGNKADMDESKRAVPTSKGQALADEYGIKFFETSAKTNMNVEEVFFSIARDIKQRLADTDSRAEPQTIKINQPDQAASGGQPAQKSACCGS

SEQ ID NO: 135049 - protein, 66 aa, Glycine max
  Coding DNA Sequence Number=SeqID_18271
  Homolog annotation: Hit_ID=Q019D1; Match level="QueryCoverage=72%, HitCoverage=70%, E-value=5e-07, Identity=84%"; Hit description=[TU] KOG0078 GTP-binding protein SEC4
MVVIKLVVNEPSENLKSRQLFPTPRIINDQRKKELTAVADKKKLDEVIVIGTSSSGCCGHRRNEMP

SEQ ID NO: 135050 - protein, 219 aa, Glycine max
  Coding DNA Sequence Number=SeqID_18272
MDASSQEYIDEIKVVGAHDVSLSICRTKPRGVRVAKKVNQRKSKLMGCTCRLKYYNRTSLSTSSIEQEFIPSIPWHAIFVFLDPILIGVMQVEYQNKKESPFDTHPLQKNTFLTAICIYGALLGIKMQTKTRDGFFQEILNYGLLLSGAFSSVSLLSILLKQHHLLWIVLTIWGSIPIVLSRHMLKSSACWITKMLAKLTWGVCKDSSANGSNDICPRV

SEQ ID NO: 135051 - protein, 151 aa, Glycine max
  Coding DNA Sequence Number=SeqID_18273
  Homolog annotation: Hit_ID=Q1SZ11; Match level="QueryCoverage=40%, HitCoverage=26%, E-value=5e-13, Identity=65%"; Hit description=NADPH HC toxin reductase-related
MVTELTGNRLHHPGAKSLYVGEGSSMAVTTMKQLGFFSSVSVVQMHHFEQRNVLYKDNSFDFLFSKDLGEVSVPTLLVLETNSKTWVERDLLSYGSGENGGGLEVVSLACGLVGGDTLMSYTPLSVTLLSSQAQDNEAAYQSLKNGMEKSQ

SEQ ID NO: 135052 - protein, 56 aa, Glycine max
  Coding DNA Sequence Number=SeqID_18274
MELVQGLPEYLVVVVQHQQLGHLTTFPNETYNDQKGGVVKGGNDITVLGGVIDDHL

SEQ ID NO: 135053 - protein, 203 aa, Glycine max
  Coding DNA Sequence Number=SeqID_18275
  Gene Ontology: Mol. function=sequence-specific DNA binding; Cellular component=nucleus; Biological process=regulation of transcription, DNA-dependent
  Homolog annotation: Hit_ID=Q9ZRZ4; Match level="QueryCoverage=99%, HitCoverage=59%, E-value=1e-44, Identity=53%"; Hit description=HB2 homeodomain protein
  Pfam annotation: Domain name=Homeobox; Domain location=10-71; Score =76.8; E_value=6.8e-20; Accession=PF00046.19; Description=Homeobox domain
MTSGGHKITSRQRWTPTPVQLQILERIFDQGNGTPSKEKIKEITAELGQHGQISETNVYNWFQNRRARSKRKLQNVAAYSNTESEVETEVDSKDKKTKAEEEFQSQHNNNISTTSGGAEKLCFQNPQVHSDYLQYLNPADSNKPYSMFQTDDNLKSTRNLSHVSVFNEVLSNSRSEHIGGKMEVGGSVSYNLFHQTGHFNLAG

SEQ ID NO: 135054 - protein, 611 aa, Glycine max
  Coding DNA Sequence Number=SeqID_18276
  Homolog annotation: Hit_ID=Q9LHK2; Match level="QueryCoverage=99%, HitCoverage=48%, E-value=0.0, Identity=57%"; Hit description =Arabidopsis thaliana genomic DNA, chromosome 3, P1 clone: MMF12
MVIKALIETSRKNSWAELVHCKLISMLANMLYEVPDEVVELLPSTPKFLVNQLDLIGGVQFLLREDCTVKYALVNSREERKNLYSVLFDYVLHQVNENCIATGINEYSDDEIQPLASLLAQTNAAEAFHISVKLGVEGIGELLRRSIASALSRYPNSERLNMLLDFVTEKFDSLISSFTHLDEEFSHMIQITKTHKSLENVEIIALRNDIDLQAKHSWATLHSLLHSERIAYRQNGYIWLGDLLISEISGESNGTIWSNIEYFQQKFAQVGKQDSSDMSDIPLPISLMCGLLKSNHNYIRWGFLFVLERLLMRCKFLLDEYEMQQSRRSDLASGLKDWHLEKAHALIDIMSSALLFQINEKDCTNKYETDRTNILKMCDILLSQLCLRVPPAMALPNGDDMQHDRILNCFSSNKMFDSDNRALKQDTYLVDEHIEEEADGTSNYPKNYHLVRETAAMAALLLQGQAIASMQLIARIPLDLLFWPLMQLAGAATDDIALGVAVGSKGRGNLPGAASDIRATLLLLLIGKCTADPVAFEDVGEERFFMFINFVLCNDFPLLQRMMTESPEKYQHMLQNLLFKAQQTNNEKLLENPYLQMCGILQLANDLGFDL

SEQ ID NO: 135055 - protein, 1314 aa, Glycine max
  Coding DNA Sequence Number=SeqID_18277
  Gene Ontology: Mol. function=transition metal ion binding; Cellular component=nucleus; Biological process=regulation of transcription, DNA-dependent
  Homolog annotation: Hit_ID=Q9FNA4; Match level="QueryCoverage=99%, HitCoverage=99%, E-value=0.0, Identity=51%"; Hit description =Arabidopsis thaliana genomic DNA, chromosome 5, P1 clone:MSH12
  Pfam annotation: Domain name=IKI3; Domain location=1-948; Score =935.1; E_value=2.8e-278; Accession=PF04762.3; Description=IKI3 family
MKNLKVFGEVPLGLSLDSNEETIGFCSFDIERNRIFFLSSHNLIYTSHLSSFHENAVWSPNASLSSSDAVTVDLEPGDAVTSFDYLMEKEALLLGTSNGLLLLHNVDDASDATQVVGKLDGGVNAVSLSPDGELVAVTTGFGQLLVMTHDWDVLYETSLHDDDVPVSEGEFLPVSWRGDGKYFATMSDACGSGSLLKKIKVWDRDSGDLLASSELRSFAGAVLEWMPSGAKIAAVCDGKDGNESPSVVFFERNGLERSRFSVDSKVKLLKWNCSSDLLAGVVECENYDAVRIWCFSNNHWYLKHEIRYLKRDEVSFIWNPTKQLQLICWTVGGQVTVSNFIWITAVMENSVALVVDGSNIHVTPLSLSLMPPPMYLFSLKFSSHVRGMAVYCKHSKNQLAAFLSNGSLCVVELPSIETWEELEGKEFSVEDSHTEMAFGSILHLEWLDSHKLLAISHYGFSHSNDLFQTSLTEGGLRGFYLQEVELECSEDLVPGLLTCSGWHAAVSNRNTLEELVIGIASNPASKHSAYIQFSRGEIQEYVSKIGISRGSLEQEHQGFSAACPWMSVALVGSAGLSKSVLFGLDEIGRLHANAGILCNNCSSFSFYSNLADQVITHLILATKQDLLFIVDIADVFNGELDSKYSNFVRINSRKKEENESFINIWERGAKIVGVLHGDEAAIILQTTRGNLECICPRKLVLVSIINALVQKRFKDALLMVRRHRINFNVIVDYCGWQAFSQLASEFVRQVNNLGYITEFVCSIKNENIIEKLYKNHISVPCPKVADVMLVGGIQNSLAGNKVSSVLMAVRKALEDHITESPARELCILTTLAQSDPPLLEDALKRIKVIREKELSHADDQGRMSYPSAEEALKHLLWLADSDAVYEAALGLYDLNLAAIVALNAQKDPKEFLPFLQELERMPTLLMQYNIDLRLKRFEKALRHIASAGDSYYDDCMTLVKKNPLLFPLALQLFTGPTKQKPFLEAWGDYLSDEKCFEDAAAIYMSCFNLDKALKSYRAINNWSGVLTVAGFLNLGKDELLHLASELCEELQALGKPGEAAKIALEYCGDVNTGVNLLITARDWEEALRVVFMHRREDLIKTVKSASLECASTLTSEYEEGLEKVGKYLARYLAVRQRRLLLAAKLQSEERAASDLDDDAASETSSNFSGMSAYTTGTKKSSAASMSSTATSKARETRRLKKRGKIRPGSPDEEIALVEHLKGMSLTVEAKRELKSLLVSLMMFGEGETCKKLQQTGENFQLSQMAAVKLAEDTISNDTINEYAHTLEQYTQKVRNEIHNSEAFSWRLKVFLSYE

SEQ ID NO: 135056 - protein, 280 aa, Glycine max
  Coding DNA Sequence Number=SeqID_18278
  Homolog annotation: Hit_ID=Q9LHK2; Match level="QueryCoverage=91%, HitCoverage=20%, E-value=8e-61, Identity=50%"; Hit description =Arabidopsis thaliana genomic DNA, chromosome 3, P1 clone: MMF12
MLLRLKSSQLVNLYRYKPSEETLIQIDLFCSTIIAQCDINLNRPWSRSLNQQTGALATSTNTSPLPVSSFTSGAILKSLSYVRSLVAQHIPKRHFLPASLAGPPSASGQSLPTLSSLLSKSFNSQLCPASVTESVEKDSVTSSISKLSKIEKIDEKDELGFIAHDILQWRWLDKQQSSSMKADSDHAVNSQGMRAYNFLEVGAAALLEGDIGAKMKGQPWKYFGTDDMPYLDQLLQASPVTSFTNSASACPHLRAITASKRTKAGPRQVWHVLLSDNFLF

SEQ ID NO: 135057 - protein, 90 aa, Glycine max
  Coding DNA Sequence Number=SeqID_18279
  Homolog annotation: Hit_ID=Q9LHK2; Match level="QueryCoverage=67%, HitCoverage=4%, E-value=9e-12, Identity=62%"; Hit description =Arabidopsis thaliana genomic DNA, chromosome 3, P1 clone: MMF12
MVYHHDYRPLYLIFNAQGLTFTLILAGLSGRPCNHGLGLQCNFGTYYCREGAESCSSLKVCDTFQTLSSKEKEYSTSLNTTSFTNGHPKL

SEQ ID NO: 135058 - protein, 91 aa, Glycine max
  Coding DNA Sequence Number=SeqID_18280
MINDCRCDCANYECPFILVSRDCNKKIRNKNNSRFLHQDLAPTSVRLREIDADLQGRDALDQREVAEGGPAFDGSGAGRSKGAFGGGGRGE

SEQ ID NO: 135059 - protein, 855 aa, Glycine max
  Coding DNA Sequence Number=SeqID_18281
  Gene Ontology: Mol. function=protein serine/threonine kinase activity; Cellular component=integral to membrane; Biological process=protein amino acid phosphorylation
  Homolog annotation: Hit_ID=Q9ZQC2; Match level="QueryCoverage=96%, HitCoverage=84%, E-value=0.0, Identity=71%"; Hit description =Putative receptor-like protein kinase
  Pfam annotation: Domain name=LRR_1; Domain location=418-440; Score =3.6; E_value=60; Accession=PF00560.23; Description=Leucine Rich Repeat
  Pfam annotation: Domain name=LRR_1; Domain location=442-463; Score =12.3; E_value=1.4; Accession=PF00560.23; Description=Leucine Rich Repeat
  Pfam annotation: Domain name=LRR_1; Domain location=465-487; Score =14.3; E_value=0.44; Accession=PF00560.23; Description=Leucine Rich Repeat
  Pfam annotation: Domain name=LRR_1; Domain location=489-508; Score =13.6; E_value=0.73; Accession=PF00560.23; Description=Leucine Rich Repeat
  Pfam annotation: Domain name=Pkinase; Domain location=603-855; Score =94.9; E_value=2.4e-25; Accession=PF00069.15; Description=Protein kinase domain
  Pfam annotation: Domain name=Pkinase_Tyr; Domain location=604-834; Score=88.4; E_value=2.2e-23; Accession=PF07714.7; Description =Protein tyrosine kinase
  Pfam module annotation: Pfam domain module=LRR_1::LRR_1::LRR_1::LRR _1::Pkinase::Pkinase_Tyr; Domain location=418-440::442-463::465 -487::489-508::603-855::604-834
MESIFLSSFKFALSLSLLLHSPSFSSAQIMQGFVSLDCGGTEKFTDELGLHWTPDDKLTYGQISTISVANETRKQYTTLRHFPADSRKYCYTLEVVSRTRYLLRASFLYGNFDNNNVYPKFDISVGATHWSTIVISDANSIEMRELIFLASSPTVSVCLSNATTGQPFISTLELRQFNGSVYYTQFEQHFYLSVSARINFGAESDAPIRYPDDPFDRIWESDSVKKANYLVDVAAGTEKISTTVPIDVNRDEMPPVKVMQTAVVGTNGSLTYRLNLDGFPGTGWAFTYFAEIEDLDPDESRKFRLVLPGQPDISKAVVNIEENAQGKYRLYEPGFTNISLPFVLSFRFGKTYDSSRGPLLNAMEINMYLEKNDGSLDGATISNILSHYSAADWLQEGGDPCLPVPWSWVRCNSDPQPRIVSILLSNKNLTGNIPLDITKLVGLVELWLDGNMLTGPFPDFTGCMDLKIIHLENNQLTGVLPTSLTNLPSLRELYVQNNMLSGTIPSELLSKDLVLNYSGNINLHRESRIKGHMYVIIGSSVGASVLLLATIISCLYMHKGKRRYHEQGCIDSLPTQRLASWKSDDPAEAAHCFSYSEIENATNNFEKKIGSGGFGVVYYGKLKDGKEIAVKVLTSNSYQGKREFSNEVTLLSRIHHRNLVQLLGYCRDEENSMLVYEFMHNGTLKEHLYGPLVHGRSINWIKRLEIAEDAAKGIEYLHTGCVPVVIHRDLKSSNILLDKHMRAKVSDFGLSKLAVDGVSHVSSIVRGTVGYLDPEYYISQQLTDKSDVYSFGVILLELISGQEAISNESFGVNCRNIVQWAKLHIESGDIQGIIDPLLRNDYDLQSMWKIAEKAL

SEQ ID NO: 135060 - protein, 33 aa, Glycine max
  Coding DNA Sequence Number=SeqID_18282
MAVTKSYVTPNCEMLNLITSSCWHPYLLVKNHY

SEQ ID NO: 135061 - protein, 283 aa, Glycine max
  Coding DNA Sequence Number=SeqID_18283
  Homolog annotation: Hit_ID=Q2QNE3; Match level="QueryCoverage=17%, HitCoverage=27%, E-value=3e-14, Identity=70%"; Hit description =Expressed protein
  Pfam annotation: Domain name=DUF588; Domain location=32-134; Score =68.3; E_value=2.5e-17; Accession=PF04535.3; Description=Domain of unknown function (DUF588)
  Subcellular localization annotation: CTP_CleavageSite=27; ConfidenceScore=5.61e-01
MRSPQPLRNGGDNSCSPSHNPRFHSTVAEHKLRRFNLLILVFRLSSFSFSLASSVFMLTNTRGSYSPHWNHYDTFRFFLAANAIVAVYSVFEMGASVWEISRGVTLFPEVLQIWFDFGHDQGGGAGIRVPAVVGERGGDVDGEDAEGDGDVLHLAPNGLPRRLFHNQRFPFSSLSVAVDEDLGHREEEGSLSANELLIDRLFSLSFVYLSFLVDVSLAPVNQGFAPKATPDADEVEEGTVVADGRPVHQACFIQIRAQKAQTISLQYRSVSALMDCQLERIWQ

SEQ ID NO: 135062 - protein, 115 aa, Glycine max
  Coding DNA Sequence Number=SeqID_18284
MALPHSMLSIISPSISNPWCLPLKLAIRQHSSISLKQDGDSSRSIRILKSDGTTSGDNYIRPIKDIKTAEWEETVFKDISSLIILVHNRYKRPKENEKIRDELEIAFGSCYFNMR

SEQ ID NO: 135063 - protein, 793 aa, Glycine max
  Coding DNA Sequence Number=SeqID_18285
  Gene Ontology: Mol. function=cytochrome-c oxidase activity; Cellular component=membrane; Biological process=electron transport
  Homolog annotation: Hit_ID=Q33B99; Match level="QueryCoverage=65%, HitCoverage=70%, E-value=1e-109, Identity=43%"; Hit description =Expressed protein
  Pfam annotation: Domain name=DUF639; Domain location=128-753; Score =897.6; E_value=5.5e-267; Accession=PF04842.3; Description=Plant protein of unknown function (DUF639)
MNRFVVCKSRLWVVTIVFYTCILIPLMQLKKALASMVLFSCETKGMAKEMEFPEIPSLPVARFEDLKGHNCDEEKEEICSICLVEYEGEDAVSKLGSKSGEMEGMWENILGKHQQSLKSLFLRSKPSSPNADAADDYANSPKPIPQLSPLANSVVSRCSKILGMSTQELQHCFDSELPMGVKELLTYARHLLEFCSYKALHKLIQISDFLNDKDFHRLTFDMMLAWEAPSVHTLPDTPTSSSSKEETAGDEDEASLFYSSSTNMALQVDDKKTVGLEAFSRIAPVCIPIADVVTVHNIFHALTSTSAHRLHFLVYDKYLRFLDKVIKNSKNVMATSAGNLQLAEGEIILDVDGTIPTQPVLQHIGITAWPGRLTLTNYALYFESLGVGVYEKAVRYDLGTDMKQVIKPDLTGPLGARLFDKAVMYKSTSVAEPVYFEFPEFKANLRRDYWLDISLEILRAHKFIRKYYLKEVQKTEVLARAILGIFRYRAVREAFQFFSSHYKTLLSFNLAETLPRGDIILQTMSNSLTNLTVVSGKHDIPATVDTKRQPAVSPVAVMALFYLGYKSKKVTDICEEATFVSDIRVGEIHPLEVAVKKSLLDTGKAEAAQATVDQVKVEGIDTNVAVMKGRPLEAFIVTPPPNRNAVEQLLTLQEAITQFESLIQAANIILLKLRALLLAILPQATEKVALLLVFLAAVFAFVPPKYIFLVVFVEFYTREMPYRKESSDRWIRRIREWWDRIPAAPVQLVKPGYGILQDLSTIKPFLYGNNLIPMVGQVLHGQTDPPGTANFEN

SEQ ID NO: 135064 - protein, 155 aa, Glycine max
  Coding DNA Sequence Number=SeqID_18286
  Gene Ontology: Mol. function=nucleoside-triphosphatase activity; Cellular component=nucleus; Biological process=DNA replication initiation
  Homolog annotation: Hit_ID=Q1T2L5; Match level="QueryCoverage=75%, HitCoverage=20%, E-value=5e-53, Identity=88%"; Hit description=MCM
MKFQMRRVSTTERFLSIKFQMTMLFLIMNFSCLSGFLVTTIGVQDVVEIMKESLYDKYVDEHGVVDFGRSGGMSQQKEAKRFLNALNKQSELEQKDCFSVSEIYSLADRICLKVPDIDTFIENLNSVGYLLKKGPKTYQVLSSSYARSQPFRTRD

SEQ ID NO: 135065 - protein, 184 aa, Glycine max
  Coding DNA Sequence Number=SeqID_18287
  Gene Ontology: Mol. function=nucleoside-triphosphatase activity; Cellular component=nucleus; Biological process=DNA replication initiation
  Homolog annotation: Hit_ID=Q1T2L5; Match level="QueryCoverage=95%, HitCoverage=31%, E-value=3e-63, Identity=71%"; Hit description=MCM
  Pfam annotation: Domain name=MCM; Domain location=1-183; Score= -102.7; E_value=6.7e-11; Accession=PF00493.13; Description=MCM235 family
MSAALLSRFDLIFILLDKPDELQDKRLSEHIMALHGGNAQHSPVLKKRRGDPSDSIAGVSQNAEGFDLGVRSGSLISSLRLDPQRDCDFVPLPGQLLRKYIAYARSFVFPRMTKPAAEILQKFYLKLRDHNTSADGTPITARQLESLVRLAEARARLDLRVEITTQDATNLAEVFKIVAMSKPS

SEQ ID NO: 135066 - protein, 142 aa, Glycine max
  Coding DNA Sequence Number=SeqID_18288
  Gene Ontology: Mol. function=hydrolase activity; Cellular component =cytosol; Biological process=regulation of progression through mitotic cell cycle
  Homolog annotation: Hit_ID=Q0WWV2; Match level="QueryCoverage=68%, HitCoverage=32%, E-value=2e-50, Identity=97%"; Hit description =Phosphoprotein phosphatase
MDLDQWISKVKDGQHLLEDELQLLCEYVKEILIEESNVQPVNSPVTVCGDIHGQFHDLMKLFQTGGHVPETNYIFMGDFVDRGYNSLEVFTILLLLKASFFYGACPSHTNYKFIYSSLLVLNFSIGAMIVVQSRKKRRVTVD

SEQ ID NO: 135067 - protein, 484 aa, Glycine max
  Coding DNA Sequence Number=SeqID_18289
  Gene Ontology: Mol. function=nucleoside-triphosphatase activity; Cellular component=nucleus; Biological process=DNA replication initiation
  Homolog annotation: Hit_ID=Q9SF37; Match level="QueryCoverage=99%, HitCoverage=63%, E-value=0.0, Identity=69%"; Hit description =Putative minichromosome maintenance (MCM) protein
  Pfam annotation: Domain name=AAA_3; Domain location=365-484; Score= -11.0; E_value=0.0052; Accession=PF07726.2; Description=ATPase family associated with various
  Pfam annotation: Domain name=AAA_5; Domain location=365-483; Score= -14.7; E_value=0.023; Accession=PF07728.4; Description=ATPase family associated with various
  Pfam annotation: Domain name=MCM; Domain location=303-484; Score =178.0; E_value=2.4e-50; Accession=PF00493.13; Description=MCM235 family
  Pfam module annotation: Pfam domain module=AAA_3::AAA_5::MCM; Domain location=365-484::365-483::303-484
MDILGTYFPQQLFTVDDILLNLTSALLSFFSSPPGQNLVSQVKNDYGNYVLSLDFLQLQQICHVEEFYKMLTEKPKIALLCMSAAVHKNGDLEHGAKVDIRLHNCPETMIALKNLKAAYIDKLVSVRGTAVKVSTVRPLVVEMSFECSKCKQSITRIFPDGKYSPPSTCNLNGCKSKFFNPLRSTAQTIDFQKIRVQELLKPEDHEEGRVPRTVECELTQDLVDACIPGDVVTVTGIIRGINTYMDIGGGKSKNKNQGFYYLYLEAVSIKNSKSQSVPEDLPDSNPKARPTELFDLFSFSSKDLEFVAKFAQEHGSDLFRQILQSICPSIYGHELVKAGITLALFGGVRKHSMDQNKVPVRGDIHVIIVGDPGLGKSQLLQAAAAVSPRGIYVCGNATTRAGLTVAVVKDPMTSDYAFEAGAMVLADSGLCCIDEFDKMSTEHQALLEAMEQQCVSIAKAGLVASLSSRTSVLAAANPAGGHYK

SEQ ID NO: 135068 - protein, 384 aa, Glycine max
  Coding DNA Sequence Number=SeqID_18290
  Gene Ontology: Mol. function=phosphoprotein binding; Cellular component=membrane; Biological process=signal transduction
  Homolog annotation: Hit_ID=Q1T2L0; Match level="QueryCoverage=99%, HitCoverage=60%, E-value=1e-127, Identity=66%"; Hit description =Serine/threonine dehydratase, pyridoxal-phosphate-binding site; t- snare
MEVVGKMQMQLETANQTVETLRSDGMKAAEAYKSLALELEQSRTQAKSLEALVSKLQADLLSSANKSISGSTPTNENGPSQENGENEEINQLKAELISAKVEVGKLKSALDISEVRYQEEYIQSTLQIRCAFEQLELTKSESSQREVELYEELRRAKANTEELRASLMDKESQFFSVSEENKELNSKIKENQSTKRQSELVIELKKLVADVEELKEKLLDRETELQNIAVENSMLKMELKEFKTNKITNEALASAEAARAAEQEALTKLGHITEEADKSNKRVARVTEQLDAAQAANSELEAELRRLKVQSDQWRKAAEAAASMISAGNNGKFVDRNCSRENSFNSVTGKMNSPYLLDTDDESPKKKNTNMLKKIGVLWRRNHH

SEQ ID NO: 135069 - protein, 756 aa, Glycine max
  Coding DNA Sequence Number=SeqID_18291
MISEPASSLRKSNFQDRRLSIIDVSSADDSLLDGNPLSHQRSENQEQADVLYTPNSKKFEDAATKLQQWDHEPHSNDSSGIGKPKKNSKCNLRKSLAWDSAFFTSAGVLDPEELTIIIEGVEKDEKPELPSIQEDVYKSCESISTLASDSLTFESVEMEGDLFEDVRASIQKSSKKSSPAASNIKVPSSPSVPLFQTHDSSKKVGMVSCNKMKVPPASKNPSAGMQGFGKMTKKNNPIFPQIPQKHVATRRESSILMQSKVPGRSSLSSTIPSKRDSLGNPHVKSERDKAKRIVGDRVSSVAKASVVRGSRGSVPKPTLPSKSPSGPTVSTRTKSVTSTSSGNNLSDNIGKSSFSYLKRSYKPTSCCPVVKTPSRVASRNKAEPEISSLSRLMSATKLSSSISPASSISDWSSSESSSTTSMAKRVCNSSRPSIDCGSSRKVLLNTDADQGTHPQTPLSDSSLERQEARQSGIISQKERTVPGATVLPPVSKKPSGLRLPSPKIGYFDGVKPLVRTPRGSVVPGGLPKHGAESPREGQNKAELGKLQPSRSFVSIDNTKPNNQQPPHPNPFHESLDVAIKTSNSVQNGKSSSDISIGAVENTSHFHVVEKAHHDLPPLKGVNNQENAHHDDQIDCLSKQVGHMDINFEIGEKFNSDSLYLLQNDISFQDKSNGLDLSSHKELIDCPKKDELFNGLSTTYLYVSPTSFDVVASTRRPFAVKDSFCNMDGVVFTDSTVSEAKSTNLPVPESIIMKENE

SEQ ID NO: 135070 - protein, 1123 aa, Glycine max
  Coding DNA Sequence Number=SeqID_18292
  Gene Ontology: Mol. function=nucleic acid binding; Cellular component= nucleus; Biological process=RNA processing
  Homolog annotation: Hit_ID=Q94BR5; Match level="QueryCoverage=88%, HitCoverage=90%, E-value=0.0, Identity=55%"; Hit description =Putative DNA-binding protein
  Pfam annotation: Domain name=DEAD; Domain location=317-597; Score= -32.5; E_value=0.0031; Accession=PF00270.19; Description=DEADDEAH box helicase
  Pfam annotation: Domain name=Helicase_C; Domain location=966-1044; Score=81.7; E_value=2.2e-21; Accession=PF00271.21; Description =Helicase conserved C-terminal domain
  Pfam annotation: Domain name=SNF2_N; Domain location=319-723; Score =207.0; E_value=4.4e-59; Accession=PF00176.13; Description=SNF2 family N-terminal domain
  Pfam annotation: Domain name=zf-C3HC4; Domain location=801-836; Score= 6.9; E_value=0.031; Accession=PF00097.15; Description=Zinc finger, C3HC4 type (RING finger)
  Pfam module annotation: Pfam domain module=DEAD::Helicase_C::SNF2 _N::zf-C3HC4; Domain location=317-597::966-1044::319-723::801-836
MDGCIYISSSDDDLEEIDDQGRTLPQWATTTVKSLDNGGWSRRDSFSRGANSSNPSSSNVYNHSQVKPQTPPVSSTNTLNHRIARRDEPSYHAQNGNTSQHQTVNSRISNNHGADYEKMSSQQAFKRTLQSSLQPSATRALPSSFAPDSRLRNLKDSTNSSQLHDAYKNRPHGVGPNTSSDRGYIHENFGRGYDEDRFLYQNGGNRILPSPLMLGKAISPQFATSSESAYRAGAGDERAAESDERLIYEAALQKIFSLLSLSRNRLMKNYFLKVAETLGFSRSELGFIGLIKGRKQDISQPKTEYDLPAGVLSVSLLRHQKIALAWMLQKETKSLHCLGGILADDQGLGKTISMISLILAQRSLQSKSKIDDTCSHKTEALNLDDDDDNGSVDVEKHKNSEESDDIKPSREPSSSTQAPGRKRPAAGTLVVCPASVLRQWARELDEKVGDEKLSVLVYHGGSRTKDPVELAKFDVVLTTYSIVTNEVPKQPLVEDDDIDGKNGERFGLSSEFSVSKKRKKPFNGNKKSKKGGKGIDSSSIECGSGPLAKVGWFRVILDEAQTIKNHRTQVARACCSLRAKRRWCLSGTPIQNTIDDLYSYFRFLKYDPYAVYKSFYNTIKVPISKSTIQGYKKLQAVLRAIMLRRTKGTLLDGKPIINLPPKTIELSKVDFSIEERAFYTKLESDSRLQFKAYAAAGTVSQNYANILLMLLRLRQACDHPLLVKDFDSDPVGKDSVEMAKNLPRDMLINLFNCLEATFAICLVCNWPCFRSVVYLHSPWMFTKLTEVEHLTSFLQEKDVADPPEEPVITMCGHVFCYQCVSEYLTGDDNMCPSVNCKELIGDDLVFSKATLRSCISDDGGSLSSANSHLCDYSLVQQRDYTSSKIKAVLEVLQSNCKLKISSSDLLNSSGGCRDSPSSDNLYVEDCDSDVRVTKHTIKYSESTTEGPIKAIVFSQWTSMLDLVETSLRQFSIQYRRLDGRMTLGARDKAVKDFNTEPEIAVMLMSLKAGNLGLNMVAACHVILLDLWWNPTTEDQAIDRAHRIGQTRPVTVTRITIKDTVEDRILALQEDKRKMVASAFGEDHAGGTGTRLTVDDLKYLFMCLLTSVAQVGRRGQACLIQVVT

SEQ ID NO: 135071 - protein, 287 aa, Glycine max
  Coding DNA Sequence Number=SeqID_18293
  Homolog annotation: Hit_ID=Q1T2K4; Match level="QueryCoverage=99%, HitCoverage=70%, E-value=1e-102, Identity=62%"; Hit description=IQ calmodulin-binding region
MEGPVVKRQATSTLRSMQTLSRLQSQIRSRRIRMLEENQALQRQLLQKHARELESLRQNWKNSSRSVNPMFMDPTNPSWGWSWLERWMAARPWESRSHMDKELNDHSSIRSSSRSITGGEISKSFARFQLNSEKHSPTASQNPGSPSFQSTPSKPASSSAKKPKKVSPSPRGSWVMDEDSKSLVSVHSDRFRRHSIAGSSVRDDESLASSPAVPSYMVPTQSAKAKSRTQSPLASENAKAEKGSFGSAKKRLSFPASPARPRRHSGPPKVESSSLNAELAVDKGVDS

SEQ ID NO: 135072 - protein, 599 aa, Glycine max
  Coding DNA Sequence Number=SeqID_18294
  Gene Ontology: Mol. function=protein binding; Cellular component =integral to membrane; Biological process=protein amino acid phosphorylation
  Homolog annotation: Hit_ID=Q9FHL8; Match level="QueryCoverage=98%, HitCoverage=99%, E-value=0.0, Identity=57%"; Hit description=Disease resistance protein-like
  Pfam annotation: Domain name=LRRNT_2; Domain location=37-78; Score =43.9; E_value=5.5e-10; Accession=PF08263.3; Description=Leucine rich repeat N-terminal domain
  Pfam annotation: Domain name=LRR_1; Domain location=115-138; Score =9.1; E_value=5.6; Accession=PF00560.23; Description=Leucine Rich Repeat
  Pfam annotation: Domain name=LRR_1; Domain location=140-162; Score =12.0; E_value=1.6; Accession=PF00560.23; Description=Leucine Rich Repeat
  Pfam annotation: Domain name=LRR_1; Domain location=164-186; Score =13.6; E_value=0.73; Accession=PF00560.23; Description=Leucine Rich Repeat
  Pfam annotation: Domain name=LRR_1; Domain location=188-210; Score =14.4; E_value=0.43; Accession=PF00560.23; Description=Leucine Rich Repeat
  Pfam annotation: Domain name=LRR_1; Domain location=212-234; Score =12.9; E_value=1.1; Accession=PF00560.23; Description=Leucine Rich Repeat
  Pfam annotation: Domain name=LRR_1; Domain location=236-258; Score =19.9; E_value=0.0093; Accession=PF00560.23; Description=Leucine Rich Repeat
  Pfam annotation: Domain name=LRR_1; Domain location=260-282; Score =14.5; E_value=0.38; Accession=PF00560.23; Description=Leucine Rich Repeat
  Pfam annotation: Domain name=LRR_1; Domain location=284-306; Score =15.8; E_value=0.16; Accession=PF00560.23; Description=Leucine Rich Repeat
  Pfam annotation: Domain name=LRR_1; Domain location=308-334; Score =9.4; E_value=5; Accession=PF00560.23; Description=Leucine Rich Repeat
  Pfam annotation: Domain name=LRR_1; Domain location=357-378; Score =5.3; E_value=29; Accession=PF00560.23; Description=Leucine Rich Repeat
  Pfam annotation: Domain name=LRR_1; Domain location=380-402; Score =10.6; E_value=3; Accession=PF00560.23; Description=Leucine Rich Repeat
  Pfam annotation: Domain name=LRR_1; Domain location=404-425; Score =5.7; E_value=25; Accession=PF00560.23; Description=Leucine Rich Repeat
  Pfam annotation: Domain name=LRR_1; Domain location=427-448; Score =3.3; E_value=70; Accession=PF00560.23; Description=Leucine Rich Repeat
  Pfam annotation: Domain name=LRR_1; Domain location=453-475; Score =12.7; E_value=1.2; Accession=PF00560.23; Description=Leucine Rich Repeat
  Pfam annotation: Domain name=LRR_1; Domain location=476-498; Score =18.6; E_value=0.023; Accession=PF00560.23; Description=Leucine Rich Repeat
  Pfam annotation: Domain name=LRR_1; Domain location=500-522; Score =15.5; E_value=0.2; Accession=PF00560.23; Description=Leucine Rich Repeat
  Pfam annotation: Domain name=LRR_1; Domain location=524-546; Score =10.5; E_value=3.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=37-78::115-138::140 -162::164-186:...
  Pfam module annotation: Domain location=:188-210::212-234::236 -258::260-282::284-306::308-334::357-378::380-402::404-425::427 -448::453-475::476-498::500-522::524-546
  Subcellular localization annotation: CTP_CleavageSite=25; ConfidenceScore=5.05e-01
MQLGKWVVDLVLIFSLLSPQFSGSVAETTSSSTPICSEEDRASLLRFKASISQDTTETLSTWTSRDCCDGGWEGVQCNPSTGRVNVLQIQRPGRDDDDETYMKGTLSPSLGNLHFLEVMVISGMKHITGPIPNSFSNLTHLTQLILEDNSLGGCIPPSLGRLSLLQSLSLSGNHLKGQIPPTLGALRNLAQLNLAKNSLTGPIPLSFKTLINLQYFDLSYNLLSSTIPDFLGEFKNLTYLDLSSNLLTGKIPVSLFGLVNLLDLSLSYNKLTGNIPDQVGNLKSLTSLQLSGNLLTGNIPLSISRLQNLWYLNVSRNCLSDPLPVIPSKGIPALLSIDMSYNNLSLGIVPDWIRSKQLKDVHLAGCKLKGDLPHFTRPDSLSSIDLSDNYLVEGISNFFTNMSSLQKVKLSNNQLRFDISEIKLPTELSSIDLHANLLVGSLSTIINNRTSSSLEVIDVSNNFISGHIPEFVEGSSLKVLNLGSNNISGPIPVSISNLIDLERLDISRNHILGTIPSSLGQLLKLLWLDVSINGLTGQIPSSLSQITGLKHANFRANRLCGEIPQTRPFNIFRPVAYAHNLCLCGKPLEPCKKQGSMGQ

SEQ ID NO: 135073 - protein, 106 aa, Glycine max
  Coding DNA Sequence Number=SeqID_18295
  Homolog annotation: Hit_ID=Q1T2K5; Match level="QueryCoverage=39%, HitCoverage=10%, E-value=4e-09, Identity=57%"; Hit description =Alpha/beta hydrolase fold
MIQLNKEKVLPPFGQKNFSVDMMLVFDTLSYHSELETDTCETSSLFSSNAVSYCRSMGPCGVPKRVGKKSSYGTRHRKRNRTIPVICIPSFMVGPLYRPIPVFIYN

SEQ ID NO: 135074 - protein, 154 aa, Glycine max
  Coding DNA Sequence Number=SeqID_18296
  Gene Ontology: Mol. function=protein serine/threonine kinase activity; Cellular component=membrane; Biological process=protein amino acid phosphorylation
  Homolog annotation: Hit_ID=Q9FE20; Match level="QueryCoverage=96%, HitCoverage=32%, E-value=4e-46, Identity=65%"; Hit description =Serine/threonine-protein kinase PBS1
MGVARPLFNDRRKFPKLADPQLQGRYPMRGLYQALAVASMCIQEQAAARPLIGDVVTALSFLANQAYDHRGGAGDDKRNRVLKNGEGGGGGSGGRWDLEGSEKDDSPRETARMLNSNNRDLDRERAVAEAKMWGENWREKRRQSAQGSFDGSNA

SEQ ID NO: 135075 - protein, 80 aa, Glycine max
  Coding DNA Sequence Number=SeqID_18297
  Homolog annotation: Hit_ID=Q10AI2; Match level="QueryCoverage=35%, HitCoverage=15%, E-value=2e-07, Identity=82%"; Hit description=SnRK1- interacting protein 1, putative, expressed
MGSIGDPVSAAEEIAFCKTCARFGLSLYLYHEDEMTKVAVRYFYKALSSIVENLKPCLLFMRIRCLCVFRFLLLLRGAER

SEQ ID NO: 135076 - protein, 54 aa, Glycine max
  Coding DNA Sequence Number=SeqID_18298
MIAIVAMEKWWQRRQCSIVGGDDDNCNGDKSGGMMVVVKAVKARYDGGSSDDGV

SEQ ID NO: 135077 - protein, 111 aa, Glycine max
  Coding DNA Sequence Number=SeqID_18299
  Subcellular localization annotation: CTP_CleavageSite=28; ConfidenceScore=5.47e-01
MQNSTPMVVNIAQSSNSFNTSSKLASLCFHHDVSSIRACRPRIFFINGFFCFLEDEWQQNEERKRERRHHFKEKMSLEEAHHYRRPWIRAWRKKEMNEWRGREEHEILCSK

SEQ ID NO: 135078 - protein, 132 aa, Glycine max
  Coding DNA Sequence Number=SeqID_18300
  Gene Ontology: Mol. function=nucleic acid binding; Biological process= DNA integration
  Homolog annotation: Hit_ID=Q1S9I4; Match level="QueryCoverage=56%, HitCoverage=7%, E-value=1e-13, Identity=48%"; Hit description =Integrase, catalytic region; Zinc finger, CCHC-type
MEEAIHVGFNDTKPDIEILELDESFADIRLDEGIGPLTEHQIIGDPSTKVQTRRSHRQQGYIALISEVEPKHIDDAMEDENWVKAMQEELEQFQKNDIWKLVELPQGKKACPSHGFGDDNPKVAQIQGPMTR

SEQ ID NO: 135079 - protein, 102 aa, Glycine max
  Coding DNA Sequence Number=SeqID_18301
MSRSSSKVVKIDTPYDDECNDEGLEKEDQFAFMSRKNKKVLISTWEELNNTSSNEEIEEEEEANLCLMVDTTLKGSDEEENINNIETLPLAYHELFSNSPIL

SEQ ID NO: 135080 - protein, 111 aa, Glycine max
  Coding DNA Sequence Number=SeqID_18302
  Gene Ontology: Mol. function=RNA-directed DNA polymerase activity; Biological process=RNA-dependent DNA replication
  Homolog annotation: Hit_ID=Q8H6Q8; Match level="QueryCoverage=91%, HitCoverage=43%, E-value=9e-23, Identity=50%"; Hit description=CTV.20
MMKNFRWYRDTFLTRVYPREDSQQPFWKEKCLARLPRSLGDKVRDKICSQSVNGDIPYENLSYGQLISYVQKVALKICQDDKIQRQLAKEKAQTKRDLGSFCEQLGLPACP

SEQ ID NO: 135081 - protein, 69 aa, Glycine max
  Coding DNA Sequence Number=SeqID_18303
MDEEPLRTMENLHEIAHGNISEVLRKHLDLDFLRGNTLQEFYGSITEARDAIFYKMEVVAAQRLLEEDS

SEQ ID NO: 135082 - protein, 127 aa, Glycine max
  Coding DNA Sequence Number=SeqID_18304
  Gene Ontology: Mol. function=oxidoreductase activity; Cellular component=cytosol; Biological process=leukotriene metabolic process
  Homolog annotation: Hit_ID=Q8LA26; Match level="QueryCoverage=92%, HitCoverage=34%, E-value=2e-46, Identity=75%"; Hit description=Allyl alcohol dehydrogenase, putative
MKYFSQPIIGYGVCKVLDSKHPDFKKDDLVWRVTKWEEYSIIKTDSLFKIDHTDVPLSYYTGLLGMPGMTAYAGFYEVGVPKKGDYVFISSAFGAVGQLVGQLAKLMGCYVVGSAGSKDKVEILHAT

SEQ ID NO: 135083 - protein, 514 aa, Glycine max
  Coding DNA Sequence Number=SeqID_18305
  Gene Ontology: Mol. function=malate transporter activity; Biological process=response to aluminum ion
  Homolog annotation: Hit_ID=Q9LS22; Match level="QueryCoverage=93%, HitCoverage=91%, E-value=1e-134, Identity=52%"; Hit description =Arabidopsis thaliana genomic DNA, chromosome 5, BAC clone:F10E10
  Pfam annotation: Domain name=UPF0005; Domain location=23-479; Score =506.5; E_value=2.9e-149; Accession=PF01027.11; Description =Uncharacterised protein family UPF0005
MRYIYSYADKLKRFPGLARKAIWKVGKEDPRRVVHSMKVGVALVLVSLLFLLEPLFKGIGKNALWAVMTVVVVMEFTVGATLCKGLNRGIGTLSAGSLAFLIKYFADAPGRIFQAVYIGIAVFMIGALTTYVRFIPNIKKNYDYGVLIFLLTFNLITVSSYRVDYIWDFARDRIYTIAIGCGLCLVMTILVFPNWSGEDLHKNTISKLEGLANSIQVCVREYFYESAKEETEDDDSSEDPIYEGYKAVLDSKAKDETLASQASWEPRFSRYCHKFPWHQYTRVGAALRQFGYTVVALHGCLQSEIQTPKSISTLYKDSCMRLGEEVSNVLRELANSIRNNRQFSPQTLSNNLNEALQDLDNALKSQPQLVLGLRNGRTRTLKTAVQAIPLPHPDQKLEEDTKFSFTSLGNCSSTPRLRQSVEHSRELKRKVLRPQMSMTASAIISLEFSEALPFAAFTSLLVEMVAKLDHVMVEVYELGLVAHFKEFQGDEIVVTCEKPNMNRAQNDLPSHGAE

SEQ ID NO: 135084 - protein, 502 aa, Glycine max
  Coding DNA Sequence Number=SeqID_18306
  Gene Ontology: Mol. function=malate transporter activity; Biological process=response to aluminum ion
  Homolog annotation: Hit_ID=Q9LS22; Match level="QueryCoverage=89%, HitCoverage=91%, E-value=1e-138, Identity=54%"; Hit description =Arabidopsis thaliana genomic DNA, chromosome 5, BAC clone:F10E10
  Pfam annotation: Domain name=MCP_N; Domain location=302-388; Score= -14.7; E_value=0.058; Accession=PF05581.2; Description=Vibrio chemotaxis protein N terminus
  Pfam annotation: Domain name=UPF0005; Domain location=36-466; Score =526.1; E_value=3.8e-155; Accession=PF01027.11; Description =Uncharacterised protein family UPF0005
  Pfam module annotation: Pfam domain module=MCP_N::UPF0005; Domain location=302-388::36-466
MAETNTSNKSSSQLRYVYSFADKVKSFPGWARRATWKVGKEDPRRVVHALKVGMALTLVSLLYLMEPLFKGIGKNAMWAVMTVVVVMEFTVGATLSKGLNRGLGTLLAGSLAFLIEYVADAPGRIFRAVFIGVAVFMLGAMTTYVRFIPYIKKNYDYGVLIFLLTFNLITVSSYRIDNVWNIAKDRMSTIAIGCGLCLVMSILVFPNWSGEDLHNNTISKLEGLANSIQVCVREYFYDSATEATEDDDSSEDPIYEGYKAVLDSKANDETLALQASWEPRCSRYCHRIPWHQYARVGAALRQFSYTVVALHGCLRSEIQTPKSIRALYKDSCMRLGEEVSKVLRELANSIRNNSQFSTQTLSNNLNEALQDLDNALKSQPQLVLGSRNGRVQKLEAEDTAAARTSLSSVKNDFFSPRKKVLRPQLSKSAIISLEFSEALPFAAFTSLLLEMVAKLDHVMVEVEELGRMAHFREFKDDDEIVVTFEKSKMIIAQNGLPSYGAE

SEQ ID NO: 135085 - protein, 446 aa, Glycine max
  Coding DNA Sequence Number=SeqID_18307
  Gene Ontology: Mol. function=calcium ion binding; Cellular component =endoplasmic reticulum; Biological process=biological_process
  Homolog annotation: Hit_ID=Q9FNN0; Match level="QueryCoverage=77%, HitCoverage=96%, E-value=1e-140, Identity=64%"; Hit description =Arabidopsis thaliana genomic DNA, chromosome 5, P1 clone:MAH20
  Pfam annotation: Domain name=efhand; Domain location=153-175; Score =4.3; E_value=4.9; Accession=PF00036.22; Description=EF hand
  Pfam annotation: Domain name=efhand; Domain location=189-217; Score =10.0; E_value=1.1; Accession=PF00036.22; Description=EF hand
  Pfam annotation: Domain name=efhand; Domain location=228-256; Score =12.7; E_value=0.53; Accession=PF00036.22; Description=EF hand
  Pfam annotation: Domain name=efhand; Domain location=275-303; Score =17.4; E_value=0.051; Accession=PF00036.22; Description=EF hand
  Pfam annotation: Domain name=efhand; Domain location=314-342; Score =11.1; E_value=0.81; Accession=PF00036.22; Description=EF hand
  Pfam module annotation: Pfam domain module=efhand::efhand::efhand::efh and::efhand; Domain location=153-175::189-217::228-256::275-303::314 -342
MAKASIFIYILVAAALLLFLSHSPDKHSGHRHRRLKLRSNFTLAPSRHHAVAFDPLVAELERHREDKEWEKQIIHQAHPELESDPAPAHESQPEWEDFMDAEDYLNDEDKFNVTNRLILLFPKIDVDPTDWFVTEHELTQWNLQQAQREVLHRTQREMELHDKNHDGFVSFSEYDPPNNESFGYDMGWWKEEHFNASDADGDGVLNLTEFNDFLHPADSKNPKLLQWLCKEEVRERDTDRDEKVNFKEFFHGLFDLVRNYDEESHNDTDNSMDAPARGLFAQLDKDGDGYLSDVELLPIIGKLHPSEHYYAKQQADYIISQADEDKDGRLTLTEMIENPYVFYSAIFNDDEDDDDDYHDEFRSSSIAGYPEKFGTILVTRNQYLKIMTRQNFDVWALSWFLVSIMVGFLCDGNTYCFFPFILSASSYLLMGSTVACRRVTPGSVGG

SEQ ID NO: 135086 - protein, 188 aa, Glycine max
  Coding DNA Sequence Number=SeqID_18308
  Gene Ontology: Mol. function=calcium ion binding
  Homolog annotation: Hit_ID=Q9FNN0; Match level="QueryCoverage=68%, HitCoverage=35%, E-value=1e-39, Identity=57%"; Hit description =Arabidopsis thaliana genomic DNA, chromosome 5, P1 clone:MAH20
MQDLALGLLEVPLSQLVLRHEPIGGVHIDLREQEYQPVGNIKLVLVIEVILGVHEVLPLGLGLVGRGRVRLQFGMGLVDYLLLPLLVLAVALELSDERVEGDGVVARGGEVNRVHRVENQFHPFIDGIMEISLAPEPGWKMLVIDRYNRLSDPDEHVDTFLTQMNLFTNDDVIMCRVFLTILRGATLY

SEQ ID NO: 135087 - protein, 522 aa, Glycine max
  Coding DNA Sequence Number=SeqID_18309
  Gene Ontology: Mol. function=chromatin binding; Cellular component =chromatin; Biological process=chromatin assembly or disassembly
  Homolog annotation: Hit_ID=Q1SAV4; Match level="QueryCoverage=70%, HitCoverage=93%, E-value=1e-130, Identity=58%"; Hit description =Integrase, catalytic region
  Pfam annotation: Domain name=Chromo; Domain location=430-480; Score =19.1; E_value=0.0055; Accession=PF00385.14; Description='chromo' (CHRromatin Organisation MOdifier
  Pfam annotation: Domain name=rve; Domain location=127-283; Score =112.4; E_value=1.3e-30; Accession=PF00665.16; Description=Integrase core domain
  Pfam module annotation: Pfam domain module=Chromo::rve; Domain location=430-480::127-283
VGSSNAVADALSRTTPSGEFLLLSVPHLDFMRDLRNTLHSSNEFQELLSKVRDNPGDFPDYRIHQGLILFKNRIWLNNDNPSIPSLMFEFHATPIGGHQRFVKECTTCQQTKSSTQRPAGLLQPLPPPTGVWEDISMDFITQLPSSHGYTTIMVVVDRYSKGVHLGALPSNHSAFKVASLFIDIVCKHHGFPRSIVSDRDPIFLSSFWRELFRLSGTRLRMSTAYHPQSDGQTEVMNRVLEQYLRSFVHAQPNTWYRYLTMAEWCYNTSIHSSSGMTPFEVIYGKPPPTLPHYLQGASTNEAVDSMLHSRQEIHRKLQQRIRKAQDAMKKVADEKRRDVKYSIGQWVYVKLRPFRQRSVAGLIHPKLSKRYFGPFQISERVGQVSYKLKLPDEARIHPVFHCSLLREHHGTPPTQPDRWPLQFIAHKPVARPLCILDSKLDTSSSPPNQLVLVQWAGQPPEDTTWESWPEVRDLHHLEDKVVFTGEGIVSNHLNDITTGPETADTRPKRRTSRPSFLIDYET

SEQ ID NO: 135088 - protein, 515 aa, Glycine max
  Coding DNA Sequence Number=SeqID_18310
  Gene Ontology: Mol. function=malate transporter activity; Biological process=response to aluminum ion
  Homolog annotation: Hit_ID=Q9LS22; Match level="QueryCoverage=92%, HitCoverage=93%, E-value=1e-142, Identity=52%"; Hit description =Arabidopsis thaliana genomic DNA, chromosome 5, BAC clone:F10E10
  Pfam annotation: Domain name=DUF939; Domain location=53-394; Score= -168.3; E_value=0.036; Accession=PF06081.2; Description=Bacterial protein of unknown function (DUF939)
  Pfam annotation: Domain name=UPF0005; Domain location=39-481; Score =519.4; E_value=3.9e-153; Accession=PF01027.11; Description =Uncharacterised protein family UPF0005
  Pfam module annotation: Pfam domain module=DUF939::UPF0005; Domain location=53-394::39-481
MAESNYFASNSRRHWIWKNMNSVGEKVKRYSGLAWRTAVKVGKEDPRRVVHSLKVGLALTLVSLLYLIKPLFRGIGQNAMSAVLTVVVVMEFTVGATLGKGLNRGLGTLLAGSLAFLVEYIADIAGRVFQAVFIGAAVFVLGATTTYVRFIPHIKKNYDYGVMIFLLTFNLITVSSYRVDNVWEIAKDRIATIAIGGGLCLVMSLLVFPNWSGEDLHNSTISKLEGLANSIEACVVRYFHDSENQETQDDSTEDLIYKGYKAVLDSRAKDETLALQASWEPRWSRYWHRIPWRQYTKVGTTLRQFSYTVVALHGCLLSEIQTPGSIRALYKDSCIKLAEEVSKALRELANSIRDKRQFSPQVLSDNLNEALQNLNDDLKSQPQLFLGSKKFGGTTHPEEDTKVSFSSVRGDCSSMFEYKSKEHSGEMSMEGHTKVLKPLMSKIAMTSLEFSEALPFAAFTSMLVEMVAKLDHVIDAVEDLAKLSRFREFRDEDEIVVTCERPKVANNDLPSYALD

SEQ ID NO: 135089 - protein, 89 aa, Glycine max
  Coding DNA Sequence Number=SeqID_18311
MLAATTTRAKTKALVLLPITLCFWNFQVIKISISSMMSQSLENKIKAYIHLRWSHRNNITVSLLFPTSSQGNLEKSDIRKFKCQFIKPW

SEQ ID NO: 135090 - protein, 604 aa, Glycine max
  Coding DNA Sequence Number=SeqID_18312
  Gene Ontology: Mol. function=RNA-directed DNA polymerase activity; Cellular component=chromatin; Biological process=chromatin assembly or disassembly
  Pfam annotation: Domain name=RVP; Domain location=343-448; Score= -4.4; E_value=0.011; Accession=PF00077.10; Description=Retroviral aspartyl protease
  Pfam annotation: Domain name=RVP_2; Domain location=329-462; Score= -41.9; E_value=0.0018; Accession=PF08284.2; Description=Retroviral aspartyl protease
  Pfam module annotation: Pfam domain module=RVP::RVP_2::Retrotrans _gag; Domain location=343-448::329-462::110-200
MADHATRKTTTDRLEEAITRLSNSQSSLLDKHADLVDKYSELSGKVDTLLDHLHLRSPAREHHGTSSQFHQRNSVKIDVPRFDGRDPMGWIFKISQLFEYQNTPEEERITVASFYLDGAALSWYQWMFRNGFITSWSGFLQALESRFAPSFYDDPKGALFKLTQRGMVNEYLTEFERLANRVIGLPPPFLLSCFVSGLTQDIRREVLALQPISLPQAMALAKLQEDKIRDRRQAPSRGHNTPSPSYAPPSRKPQSTYVQRTPEEMALRREKGLCYNCEEKWSSTHRCKGRVLLFIADNPSLLPDEPNPEPPLLPEPIPACPLDLDTTSDFTSPHVSLHALSGLPSSETFRLVGIINHSSLTILIDSGSTHNFLQPRLAQFLHLKTENTNPLHVLVGNGSVLECNQVCRDTSLLLQGHQFTVTFHLLPISGADAVLGIEWLRQFGPVITDYTAFSMKFTHMGRPIELHADISTGPKPISAPQVKRLLQTRSASALFHLKMIPDQQPDPLLHLPHPIPAVEALLTQFHKLFRQPSSLPPPRSIVHHINLLPNTTPINVRPYRYPQVQKSEIEKQVLELLESGLIQPSMSPYSSPVLLVKKKDGTWR

SEQ ID NO: 135091 - protein, 94 aa, Glycine max
  Coding DNA Sequence Number=SeqID_18313
  Homolog annotation: Hit_ID=Q5MJW1; Match level="QueryCoverage=47%, HitCoverage=32%, E-value=7e-09, Identity=64%"; Hit description =Avr9/Cf-9 rapidly elicited protein 140
MQTSLLRELVVGTPVISATYDRPQKSVNRYLPGPATQCQYSTTTSKQIEEGERLLKVSQCYLSTTSGPGPLAGFLFISTDKVAFCSERSMKVFT

SEQ ID NO: 135092 - protein, 134 aa, Glycine max
  Coding DNA Sequence Number=SeqID_18314
  Gene Ontology: Mol. function=protein tyrosine/serine/threonine phosphatase activity; Biological process=protein amino acid dephosphorylation
  Homolog annotation: Hit_ID=Q2QYN1; Match level="QueryCoverage=93%, HitCoverage=46%, E-value=3e-46, Identity=67%"; Hit description=Dual specificity phosphatase, catalytic domain containing protein, expressed
  Pfam annotation: Domain name=DSPc; Domain location=2-134; Score= -29.2; E_value=0.031; Accession=PF00782.11; Description=Dual specificity phosphatase, catalytic domain
MNYTLITDNLIVGSQPQKPEDIDHLKKEEGVAYILNLQQDKDVEYWGVDLQSIIRRCRELEISHTRRPAKDFDPDSLRNGLPKAVSSLDWAFSEGKGRVYVHCTAGLGRAPAAAIAYLFWFCDMNVSPKPSPYL

SEQ ID NO: 135093 - protein, 285 aa, Glycine max
  Coding DNA Sequence Number=SeqID_18315
  Gene Ontology: Mol. function=transferase activity, transferring hexosyl groups; Cellular component=mitochondrion; Biological process= metabolic process
  Homolog annotation: Hit_ID=Q6YW98; Match level="QueryCoverage=94%, HitCoverage=79%, E-value=8e-51, Identity=32%"; Hit description=PPR protein-like protein
  Pfam annotation: Domain name=PPR; Domain location=166-200; Score =17.3; E_value=0.057; Accession=PF01535.11; Description=PPR repeat
  Pfam annotation: Domain name=PPR; Domain location=201-235; Score=8.3; E_value=0.79; Accession=PF01535.11; Description=PPR repeat
  Pfam annotation: Domain name=PPR; Domain location=27-61; Score=49.9; E_value=8.7e-12; Accession=PF01535.11; Description=PPR repeat
  Pfam annotation: Domain name=PPR; Domain location=62-96; Score=38.5; E_value=2.3e-08; Accession=PF01535.11; Description=PPR repeat
  Pfam annotation: Domain name=PPR; Domain location=97-131; Score=2.7; E_value=3.5; Accession=PF01535.11; Description=PPR repeat
  Pfam module annotation: Pfam domain module=PPR::PPR::PPR::PPR::PPR; Domain location=166-200::201-235::27-61::62-96::97-131
MCEAGQLVDAYKLLTQVACSGVMPDIVTYNVLINGFCKAANINGALKFFKDMQNKGFSPNSVTYGTLIDGLFRIGREEDAFKIREHMLKHGCEPSFEVYRALMTWLCRKRKVSQAFRLYLEYLKNLRGREDDSINALEQCFVRGKVEQAFQGLLELDFRLRDFALAPYTILLIGFCQAEKVDEASVIFSVLDKFNININPTSCVFLIRGLSEKGRLDDAVNIFLYTLDRCFKLKSSVCEQLLNHLNLSQDKKECAIDLVHRMKSAGYLLNSLFSQNTLCTEQDKQ

SEQ ID NO: 135094 - protein, 118 aa, Glycine max
  Coding DNA Sequence Number=SeqID_18316
  Gene Ontology: Mol. function=riboflavin kinase activity; Cellular component=integral to membrane; Biological process=riboflavin biosynthetic process
  Homolog annotation: Hit_ID=Q9FMW8; Match level="QueryCoverage=52%, HitCoverage=17%, E-value=3e-19, Identity=71%"; Hit description =Arabidopsis thaliana genomic DNA, chromosome 5, P1 clone:MKD15
QQEEDREILSDGTSAVAGGIVALGKFDALHIGHRELAIQASRAGPPFLLSFVGMAKVLGWEPRKGFLKGLKFCLDLKGKVGLYTSTLPRPIWWEPRVLDHPINDPCCNNKVMPLSRRS

SEQ ID NO: 135095 - protein, 1389 aa, Glycine max
  Coding DNA Sequence Number=SeqID_18317
  Gene Ontology: Mol. function=protein binding; Cellular component =cytoplasm; Biological process=ubiquitin cycle
  Homolog annotation: Hit_ID=Q09HM7; Match level="QueryCoverage=63%, HitCoverage=99%, E-value=1e-162, Identity=49%"; Hit description =Putative F-box and leucine-rich repeat protein
  Pfam annotation: Domain name=DUF829; Domain location=160-427; Score =323.3; E_value=4.3e-94; Accession=PF05705.5; Description=Eukaryotic protein of unknown function (DUF829)
  Pfam annotation: Domain name=LRR_1; Domain location=1136-1162; Score =3.4; E_value=67; Accession=PF00560.23; Description=Leucine Rich Repeat
  Pfam annotation: Domain name=LRR_1; Domain location=1176-1203; Score =3.1; E_value=77; Accession=PF00560.23; Description=Leucine Rich Repeat
  Pfam annotation: Domain name=LRR_1; Domain location=1229-1253; Score =4.3; E_value=45; Accession=PF00560.23; Description=Leucine Rich Repeat
  Pfam annotation: Domain name=LRR_1; Domain location=1255-1277; Score =4.1; E_value=49; Accession=PF00560.23; Description=Leucine Rich Repeat
  Pfam annotation: Domain name=LRR_1; Domain location=1283-1307; Score =8.1; E_value=8.6; Accession=PF00560.23; Description=Leucine Rich Repeat
  Pfam annotation: Domain name=LRR_1; Domain location=596-620; Score =4.5; E_value=40; Accession=PF00560.23; Description=Leucine Rich Repeat
  Pfam annotation: Domain name=LRR_1; Domain location=622-646; Score =4.7; E_value=38; Accession=PF00560.23; Description=Leucine Rich Repeat
  Pfam annotation: Domain name=LRR_1; Domain location=648-668; Score =2.6; E_value=94; Accession=PF00560.23; Description=Leucine Rich Repeat
  Pfam annotation: Domain name=LRR_1; Domain location=674-698; Score =5.5; E_value=26; Accession=PF00560.23; Description=Leucine Rich Repeat
  Pfam annotation: Domain name=LRR_1; Domain location=700-723; Score =6.6; E_value=17; Accession=PF00560.23; Description=Leucine Rich Repeat
  Pfam annotation: Domain name=LRR_1; Domain location=753-784; Score =3.3; E_value=68; Accession=PF00560.23; Description=Leucine Rich Repeat
  Pfam annotation: Domain name=LRR_1; Domain location=806-828; Score =5.5; E_value=26; Accession=PF00560.23; Description=Leucine Rich Repeat
  Pfam annotation: Domain name=LRR_1; Domain location=834-858; Score =5.9; E_value=23; Accession=PF00560.23; Description=Leucine Rich Repeat
  Pfam annotation: Domain name=LRR_1; Domain location=860-885; Score =9.7; E_value=4.4; Accession=PF00560.23; Description=Leucine Rich Repeat
  Pfam annotation: Domain name=LRR_1; Domain location=942-965; Score =7.1; E_value=13; Accession=PF00560.23; Description=Leucine Rich Repeat
  Pfam module annotation: Pfam domain module=DUF829::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=160-427::1136-1162::1176 -1203::1229-1253::...
  Pfam module annotation: Domain location=1255-1277::1283-1307::596 -620::622-646::648-668::674-698::700-723::753-784::806-828::834 -858::860-885::942-965
  Subcellular localization annotation: CTP_CleavageSite=14; ConfidenceScore=5.17e-01
MSSFSGAIQRPLVAAAAVAVASFSADLSDKLPSRDCSTSDLAHSTPCSNTQKSDSSWVSHISDSKLANLSFVTRIPVPVPHVQFRVPSLGHNCVSNLYHSSVASSPHLRNLYHSADLPRVSRPAAYSHGVSDSTTSEVMYKWHLPEPNALDDSSCSLTKSRTVVVLLGWLGARQRHLKKYAEWYTSKGFHVVTFTFPMGEILSYQPGGKAEQNVHLLVDHLADWLEGESDKNLVFHTFSNTGWLTYGVILEHLQKQDPTITGRIKGCIVDSAPVAYPDPWVWASGFSAAFLKKNSVATKGRVFSDESGIKVSIGSEDWRKPALTEAALLLILKKFFEIILDLPSVNRRLSDVMSMLSSRQPSCPQLYMYSSADRVIPADSVESFVEAQRRAGHDVRACNFVSSPHVDHFRNDPKLYTSQLSQFLEDHSINGWCDGAMVVRTISKVNHLMGITQLFPHSNTTLSSTSNSHLQLLAPNPGVTVSSASMASNSIDGDAVLGSGLCINDVLRDDELRSILGRVESEKDKETFGLVCKRWLRLQSTERKKLAARAGPHMLRKMADRFTRLVELDLAQSVSRSFYPGVTDSDLAVIATAFTCLKILNLHNCKGITDAGMKAIGEGLSLLQSLDVSYCRKLTDKGLSAVAKGCCDLRILHMAGCRFVNDGVLEALSKYCRNLEELGLQGCTSITDNGLINLASGCRQIRFLDINKCSNVSDVGVSSFSSACSSSLKTLKLLDCYKIGDETILSIAEFCGNLETLIIGGCRDVSADAIKSLATACGSSLKNLRMDWCLNTSDSSLSCVLSQCRNLEALDIGCCEELTDAAFQLMSNEEPGLSLKILKVSNCPKITVAGIGIIVGKCTSLQYLDVRSCPHITKAGLDEAGFHFPEFCKINFNGSSISEPVLDYSKFASLIGGCWHVAGDCLNLELTEAAFHLMSNEEAGLSLKILDVSYCDEITVAAGKALLLCYASNNSHLQSALNPGVRVSSASISMSLKRGSPLCINDVLTDDVLCLILGCVESTKDKEAFGLVCKRWLGLQSTETKKITARAGLHMLRRMSDRFTRLVELDYSQFASHRIYPDVTDSDLAVIARGFPCLRNYRFWNESHWRRSYPIAVVGRDTLYKADGHGIIALSKNCHDLEELRLELTSITDDGLISLASGCHHIKILNLYLCQRACSRLKTLKLMDCYEIGDGTILSLAKFCGNLETLNIVGSEDVSADAMKTLATACGSSLKILSMDGCPNVSDYLVSCILCQCRNLEALGVRCCEELTDVAFQLKSNVEPGLSLQMLDISYCEKISVGYMHSFLGHLLLFNGCRDSHATEALSKNCHNFEELSVRGFITELASGCPHNQTFEIGDGTILSLTKFCGNLETLLIGDCWLLLVELAAALKC

SEQ ID NO: 135096 - protein, 313 aa, Glycine max
  Coding DNA Sequence Number=SeqID_18318
  Gene Ontology: Mol. function=metal ion binding; Biological process =ubiquitin cycle
  Homolog annotation: Hit_ID=Q9SPL2; Match level="QueryCoverage=88%, HitCoverage=89%, E-value=3e-45, Identity=40%"; Hit description=E3 ubiquitin-protein ligase CIP8
MSEAPPSQPSPPTANASPPPYWCYHCEKRVSIETLANLPDVVCGECKNGFVESIHTPSRSRSPSASSDDPYFGSQFLQVLRLIAQSARDDDASPPPPPSRSPENDFLRIELGGWDNDEENDNDNNDDEEFEEHEEAEDRSGNEDPHGRDDEDLRRRRRELLRLRIRDLATRTRSMRNRILDWAEILMGLEDNSIEFRLQLPESDRYVGNPEDYVDAAEYEALLHTLAESDGGGRRGAPPASKAAVEALPTVKIASESEAVACAICKDLLGVGDLAKRLPCGHGYELPTDDKEYEEERVVNSASSSGGGGSAIV

SEQ ID NO: 135097 - protein, 636 aa, Glycine max
  Coding DNA Sequence Number=SeqID_18319
  Gene Ontology: Mol. function=motor activity; Cellular component =myosin complex; Biological process=actin filament-based movement
  Homolog annotation: Hit_ID=Q9SNF0; Match level="QueryCoverage=94%, HitCoverage=51%, E-value=0.0, Identity=85%"; Hit description=Myosin
  Pfam annotation: Domain name=Myosin_head; Domain location=54-636; Score=726.1; E_value=2.4e-215; Accession=PF00063.11; Description =Myosin head (motor domain)
KLQSWLQLPNGDWELVKIITTSGDESVISLPNGKVFKVKEESLVPANPDILDGVDDLMQLSYLNEPSVLFNLQYRYNHNMIYTKAGPVLVAVNPFKKVPLYGNDYIEAYKCKSIESPHVYAITDTAIREMIRDEVNQSIIISGESGAGKTETAKIAMQYLAALGGGSGIENEILKTNPILEAFGNGKTLRNDNSSRFGKLIEIHFSETGKISGANIQTFLLEKSRVVQCNEGERSYHIFYQLCAGAPSSLREKLNLLSAEDYKYLRQSNCYSITGVDDAEEFRIVKEALDVVHISKGDQENVFAMLAAVLWLGNISFTVVDNENHVQAVEDEGLLTVAKLIGCEIEDLKLTLSTRKMKVGNDIIVQKLTLSQAIDARDALAKSIYACLFDWLVEQINKSLAVGKRRTGRSISILDIYGFESFNRNSFEQFCINYANERLQQHFNRHLFKLEQEEYIQDGIDWAKVEFEDNQDCLNLFEKKPLGLLSLLDEESTFPNGTDLTFANKLKQHLNSNSCFKGEREKAFTVRHYAGEVTYDTSGFLEKNRDLLHLDSIQLLSSSICHLPKLFASHMLTQSEKPVVGPLHKSGGADSQKLSVATKFKLEKGQPHLNINDPNDKCDMACQRRCFRLVLLSMQV

SEQ ID NO: 135098 - protein, 88 aa, Glycine max
  Coding DNA Sequence Number=SeqID_18320
MMHAPDLNSQMQCGTYRIQYQGNSPKRVYMTPHLGNHAVFVEATQSCIVTPPLGDQLGATRSSLPGDTPPSTKYILPQFILFPVSYKV

SEQ ID NO: 135099 - protein, 355 aa, Glycine max
  Coding DNA Sequence Number=SeqID_18321
  Gene Ontology: Mol. function=anthranilate synthase activity; Cellular component=chloroplast; Biological process=tryptophan biosynthetic process
  Homolog annotation: Hit_ID=Q9AW95; Match level="QueryCoverage=99%, HitCoverage=67%, E-value=1e-148, Identity=69%"; Hit description =Anthranilate synthase alpha subunit
  Pfam annotation: Domain name=Anth_synt_I_N; Domain location=3-65; Score=15.5; E_value=0.00018; Accession=PF04715.3; Description =Anthranilate synthase component I, N terminal region
  Pfam annotation: Domain name=Chorismate_bind; Domain location=120 -345; Score=360.1; E_value=3.6e-105; Accession=PF00425.8; Description= chorismate binding enzyme
  Pfam module annotation: Pfam domain module=Anth_synt_I_N::Chorismate _bind; Domain location=3-65::120-345
MEKFLKPFVACGWVGYFSYDTMRYVEKKKLPFSNAPADDRNPPDVHLGLYDSVIVFDHVEKKAYVIHWVRVDRYSSAEEAFKDGKNRLESLVSLGPWLPAGSIKLYTRLFGPKLEMSNMTNEEYKRAVLQAKEHVLAGDIFQIVLSQRFERRTFADPFEIYRALRIVNPSPYMTYLQARGSILVASSPEILTRLKKRKITNRPLAGTVRREKTPKEDIMLEKELLNDEKPCAEHVMLVDLGRNDVGKVSKPASVQVEKLMNIEHCSHVMHISSTVTGELLDNLTSWDALRAALPVGTVSGASKDMKKRREWVAHLQAGAGIVADSDPADEQRECENKAAALARAIDLAESSFVDK

SEQ ID NO: 135100 - protein, 246 aa, Glycine max
  Coding DNA Sequence Number=SeqID_18322
MPSIVPIRLCASSAGVNRVNEAYGVAHSCLEVVVRGWPNNRRVQKKGSAKSSIEEAIRITERGVQFSGYFRKNNYKVSQFVLLPALLCCTSLFDFKWWCKSASVGHYKTNVGINKPVLLTISYKDVPQNSPPADTDNSVPKGAQGEANIESNGGKGAMVKNGIGIGKEIEIGTGTEQNPEIEIEEGILTKREREEAERDKLKDRGHSEKVKTPFLACIPSSFPTHFNFTDRDSHVSSYSSREKDRH

SEQ ID NO: 135101 - protein, 654 aa, Glycine max
  Coding DNA Sequence Number=SeqID_18323
  Gene Ontology: Mol. function=nucleotidyltransferase activity
  Homolog annotation: Hit_ID=Q2RBE2; Match level="QueryCoverage=45%, HitCoverage=37%, E-value=4e-81, Identity=51%"; Hit description =Nucleotidyltransferase family protein, putative, expressed
VFPFGSFPLKTYLPDGDIDLTVINHEDEEENLAKEICTILECANDLIYQVKDIEHIRAQVQVVKCTVKNIPIDITFNQMTGLCTLCFLEQVDQLAGKNHIFKRSIILIKAWCCYDSRLLGSQHGLLSTYATEVLVLYIINRFHASVRDPLEVLYIFFDYYGTFDWEHNYMSIWGPKALSSLPEIVDRPECDQDEFLLHKEFLINYRDIFSSKAKSSETTTNTFPVKHINILDPLRNDNNLGRSVNEASFHRIRFALSYGAKKFKQIFTLAGENMGEALEKFFFDTLQRNGKGERADVDVPVSPFGTGRYEKSVLDGDCDSYYGGSQYAQQYPNYAMPTTTIHSNSPSSPSQDDILALSTQQNWSEGDLLALSTQQNWSMYYQSVYNGYIPGQTLFHPTYNFEEGGRSRGTGTYIPDLNYNCYWDIRAKVNRPRRFPSAKHNALLKSCPKRKEAEEVHFETNMNDNSKPFELSNEDFPLILGIRKATSPTQAQESAPFANVHSETNKDGGNSRFYEPSNETHAKEPALLAKVLSKTDKPSNPWSFELVKEDFPLLPKVCSEPRMDDNSKSFDLSKKDFPPLQRSHKIVPSKSNQPTKYEKISSSSKESKLKNVEFGTHKLSQSLAEQSMSTKGEKEISGVSSSQETKLVVPKVAL

SEQ ID NO: 135102 - protein, 362 aa, Glycine max
  Coding DNA Sequence Number=SeqID_18324
  Gene Ontology: Mol. function=superoxide dismutase activity; Cellular component=mitochondrial matrix; Biological process=superoxide metabolic process
  Homolog annotation: Hit_ID=Q56VR0; Match level="QueryCoverage=57%, HitCoverage=84%, E-value=1e-107, Identity=88%"; Hit description=Mn -superoxide dismutase
  Pfam annotation: Domain name=Ribosomal_S26e; Domain location=235-353; Score=262.8; E_value=6.8e-76; Accession=PF01283.9; Description =Ribosomal protein S26e
  Pfam annotation: Domain name=Sod_Fe_C; Domain location=127-236; Score= 217.5; E_value=3.1e-62; Accession=PF02777.8; Description =Ironmanganese superoxide dismutases, C-term
  Pfam annotation: Domain name=Sod_Fe_N; Domain location=40-121; Score =170.6; E_value=4e-48; Accession=PF00081.12; Description =Ironmanganese superoxide dismutases,
  Pfam module annotation: Pfam domain module=Ribosomal_S26e::Sod_Fe _C::Sod_Fe_N; Domain location=235-353::127-236::40-121
MAARALLTRKTLATVLRNDAKPIIGVGITAAATHSRGLHVYTLPDLDYDYGALEPAISGDIMQLHHQKHHQTYITNYNKALEQLQDAIAKKDSSAVVKLQGAIKFNGGGHVNHSIFWKNLAPVREGGGEPPKGSLGWAIDTHFGSFEALIQKVNAEGAALQGSGWVWLGLDKELKRLVVETTANQDPLVTKGPNLVPLIGIDVWEHAYYLQYKNVRPDYLKNIWKVINWKYASETFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAPRPGQPGQAPRPAGVGAPART

SEQ ID NO: 135103 - protein, 145 aa, Glycine max
  Coding DNA Sequence Number=SeqID_18325
  Gene Ontology: Mol. function=unfolded protein binding; Cellular component=prefoldin complex; Biological process=protein folding
  Homolog annotation: Hit_ID=P57742; Match level="QueryCoverage=82%, HitCoverage=80%, E-value=1e-42, Identity=71%"; Hit description =Probable prefoldin subunit 5
  Pfam annotation: Domain name=Prefoldin; Domain location=26-145; Score= 65.4; E_value=1.9e-16; Accession=PF02996.8; Description=Prefoldin subunit
MATSAGSWKGLERMSVEQLKAVKEQGDLEVNLLQESLSNIRTATTRLEIASSALNDLSLRPQGNQILVPLTASLYVPATLHDSQHVLVDVGTGYFIQKTMPQGKHYCDRKINLLKSNFDQLLEVPTFLPFLLLAPSLLLLLRYHL

SEQ ID NO: 135104 - protein, 185 aa, Glycine max
  Coding DNA Sequence Number=SeqID_18326
MEKPAPKWYEISGLERLAPQEQVPKKKKGKSLYGLLGLFAGAIFSSSICGTPKNFKAGNDCSLMGKIGEFSSSLNNTVIIFLPALFHLTLHSSIIYKHAYNIFLSDCRNITKQDNTKNHVQWLPHSCIQVCALPNLEGIRQVIFTLYNDPAILGGIYPISFPYVRVIIKLRVQEISKTGWYLHSE

SEQ ID NO: 135105 - protein, 60 aa, Glycine max
  Coding DNA Sequence Number=SeqID_18327
MVHVNPATGKTDGPYRKKLRTYLGTVASNKGDVTIDNWKQVPAAQKDLMSKDIQDVQKKA

SEQ ID NO: 135106 - protein, 293 aa, Glycine max
  Coding DNA Sequence Number=SeqID_18328
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-28, Identity=31%"; Hit description= UPI00006A17C9 related cluster
  Subcellular localization annotation: CTP_CleavageSite=70; ConfidenceScore=5.59e-01
MATRPRLQRTTRPHLQRARRPRLQSTTRPRLQRTTRPPLQRSACPHLQKTTRPHFQRATRPHLQRTTRPRFQRATGPPLKKTTRLHAHAFRGLHVLTFRWLHALTFRGLHAHTSRGLHALIFRGPHVLAFKGLHVLTLRGRHALAFIGLHGLTFEDYSPSPLKDYTSSPSESCTPLPSEHYPSSLLEDYTSSPSEVCTPSPSEGYTLSPSEDYTSSPLEGYTSSPSEDYTFSPLEGCTPSPSEDYTSSSSEGYTPSPLEDYMSLPSEGYTPSHSEDYTSSFSEGYTPSPSESY

SEQ ID NO: 135107 - protein, 123 aa, Glycine max
  Coding DNA Sequence Number=SeqID_18329
  Pfam annotation: Domain name=Transposase_23; Domain location=51-120; Score=-8.3; E_value=0.0094; Accession=PF03017.5; Description =TNP1ENSPM transposase
  Subcellular localization annotation: CTP_CleavageSite=12; ConfidenceScore=5.01e-01
MASFSQMQSQFQSQMQSQGLALPPEPMVGPSGSHVITKESCVDPSGNDPEMGDSNKCELYIEANHPRLVALGRVYEGSIVYNISLLPGQMKVGVEEVKDAQAPVPVPTDEVTLVEQALNTLLA

SEQ ID NO: 135108 - protein, 135 aa, Glycine max
  Coding DNA Sequence Number=SeqID_18330
DVWKKAQAIQKQNIAPHVLSRGGYEYLEQKLMAEKTKKKLEEASQSRSTEGVINPPSPIRCHTKWKMACTKKTGQMTSEATKEITGKIEQASQGSFVLHGCQDVLTAAIGRVEHPARVRAAGVGVTIKQYFGSAP

SEQ ID NO: 135109 - protein, 166 aa, Glycine max
  Coding DNA Sequence Number=SeqID_18331
MVTQNNESGKFLLWDRECAELIGQTADGVNRVKIEDGDLDLNASPQALDKLLGHVLAFKVRIQSRLKNVVVLKYSKDLDLINVVLEMLPDSEACSKIDPSNVDCNDATHAECQFLSATADHDPVAGLPLTPKKRMSSDEADDELGSSQISPALLSSNKLTRHSHRS

SEQ ID NO: 135110 - protein, 315 aa, Glycine max
  Coding DNA Sequence Number=SeqID_18332
  Gene Ontology: Mol. function=transporter activity; Cellular component= integral to membrane; Biological process=transport
  Homolog annotation: Hit_ID=P21727; Match level="QueryCoverage=86%, HitCoverage=66%, E-value=1e-131, Identity=88%"; Hit description =Triose phosphate/phosphate translocator, chloroplast precursor
  Pfam annotation: Domain name=DUF6; Domain location=134-269; Score =14.2; E_value=0.01; Accession=PF00892.11; Description=Integral membrane protein DUF6
  Pfam annotation: Domain name=TPT; Domain location=125-269; Score =174.0; E_value=3.8e-49; Accession=PF03151.7; Description=Triose -phosphate Transporter family
  Pfam annotation: Domain name=UAA; Domain location=9-275; Score= -172.2; E_value=0.083; Accession=PF08449.2; Description=UAA transporter family
  Pfam module annotation: Pfam domain module=DUF6::TPT::UAA; Domain location=134-269::125-269::9-275
MLLCSFVSVIHLFVGVAYCLVSWAVGLPKRAPIDSNLLKLLIPVAVCHALGHVTSNVSFAAVAVSFTHTIKALEPFFNAAASQFILGQSIPITLWLSLAPVVIDYVKNAGVSMASLTELSFNWVGFISAMISNISFTYRSIYSKKAMTDMDSTNIYAYISIIALIVCIPPAVILEGPTLLKNGFNDAIAKVGLVKFVSDLFWVGMFYHLYNQVATNTLERVAPLTHAVGNVLKRVFVIGFSIIVFGNKISTQTGIGTAIAIAGVALYSFIKARMEEEKRVSIVLIYLYHNFLLNWLKLEKLLFILEYKPLWLDAL

SEQ ID NO: 135111 - protein, 111 aa, Glycine max
  Coding DNA Sequence Number=SeqID_18333
  Gene Ontology: Mol. function=protein transporter activity; Cellular component=integral to membrane; Biological process=protein transport
  Homolog annotation: Hit_ID=UPI00005F787D; Match level="QueryCoverage =62%, HitCoverage=100%, E-value=7e-12, Identity=56%"; Hit description= COG1826: Sec-independent protein secretion pathway components
  Pfam annotation: Domain name=MttA_Hcf106; Domain location=44-110; Score=38.8; E_value=1.9e-08; Accession=PF02416.7; Description =mttAHcf106 family
MGGAIYIRHLPDNRRKVAKYSQARSVFLAVHAALYDKKVSMEGISITKLLVIAVLVILLFGTSKLRTLGADLGAALKGFKKAVGDDSTPPAAGNNAAESQSAQQSVEKKDV

SEQ ID NO: 135112 - protein, 108 aa, Glycine max
  Coding DNA Sequence Number=SeqID_18334
MNSLWLEESIHIGIPCSHTCLSHMLFVVKTKLIMRDLRALCTTGWGSNVFQGYFDDAKESRFKQSFKQRFKIQISSFKIQRIKFQESRIIKIKIQDPRFKNQEKTQSR

SEQ ID NO: 135113 - protein, 98 aa, Glycine max
  Coding DNA Sequence Number=SeqID_18335
MYIKYGPKYIMKHSQQNKLSNETKTPHTYSQNNSKAPKFLKDMVISWKGKQGSKGLSKELIQGKSIWLEAYKNKIASIISKYACELGSINKNQAKAIV

SEQ ID NO: 135114 - protein, 386 aa, Glycine max
  Coding DNA Sequence Number=SeqID_18336
  Gene Ontology: Mol. function=[protein-PII] uridylyltransferase activity; Biological process=nitrogen compound metabolic process
  Homolog annotation: Hit_ID=Q2P497; Match level="QueryCoverage=75%, HitCoverage=33%, E-value=6e-96, Identity=63%"; Hit description =[Protein-PII] uridylyltransferase
  Pfam annotation: Domain name=GlnD_UR_UTase; Domain location=254-386; Score=115.5; E_value=1.5e-31; Accession=PF08335.2; Description=GlnD PII-uridylyltransferase
  Pfam annotation: Domain name=NTP_transf_2; Domain location=137-232; Score=29.4; E_value=1.3e-05; Accession=PF01909.13; Description =Nucleotidyltransferase domain
  Pfam module annotation: Pfam domain module=GlnD_UR_UTase::NTP_transf _2; Domain location=254-386::137-232
GALRPPGPGPGAAAGHDLHHRADDQRGHPLQQGAAGWLDRGDQGPQAVGTVGAHDRGHRDRRGRADPVAGRVAGLLRMLPASSLLDTPAASLNDPDWAAAARQALQQADARLYRRFDQGDNIERLLALRARAADHLIRLAWQRCLAADSGLSLFAVGGYGRGELFPRSDIDLLVFGDPPAQLAHESALARLFALLWDCGLAVSHAVRSAPQCREAAADQTVLTALIEARPILADDAARRALREAIDDRELWPARAFFLTKLEELRNRHQRFGDTADNLEPDLKDGPGGLRDLNTLGWMALRAFGVRDLEALVGLGHLGADEAAALKRERAVLARLRFGLHLVARRPEERLRFDYQKTLAARLGFEDDAENLGVEKMMQGFYRAALV

SEQ ID NO: 135115 - protein, 212 aa, Glycine max
  Coding DNA Sequence Number=SeqID_18337
  Homolog annotation: Hit_ID=Q6EVY3; Match level="QueryCoverage=31%, HitCoverage=80%, E-value=1e-15, Identity=64%"; Hit description =Hypothetical protein api63
MAGRIDYQIEKFQFIERNESPRITRQWAEVIAECQQEKANSETRLRTALLNVDYATSFELPFRLLLIRAPQLVDRLRHALALNQKNVVINGKKRGCVYSLKADLSAVPEEIRYRFVSRITRSGPDALSAAPYQQLAKEIKAPRERLRLALESGLQVNALDGLFWFGIQRIAADISALRSAGMAITTAEVEVADSLTRTTRMIAAYQVATCSR

SEQ ID NO: 135116 - protein, 155 aa, Glycine max
  Coding DNA Sequence Number=SeqID_18338
  Gene Ontology: Mol. function=beta-lactamase activity; Cellular component=outer membrane-bounded periplasmic space; Biological process=beta-lactam antibiotic catabolic process
  Homolog annotation: Hit_ID=Q84EZ8; Match level="QueryCoverage=57%, HitCoverage=23%, E-value=6e-32, Identity=77%"; Hit description=AmpC beta-lactamase
MLNWPVSPEVLINGSDNKVALAATPVTAVNPPAPPVKASWVHKTGSTGGFGSYVAFIPQQDLGIVMLANKSYPNPERVKAAYHILEALQERTGGGQSPPLQITALSPHPCRLPRTVGRIRRSRHPAYRRLPTCGHARRRCLRGPTDLVQWVGPVP

SEQ ID NO: 135117 - protein, 54 aa, Glycine max
  Coding DNA Sequence Number=SeqID_18339
  Subcellular localization annotation: CTP_CleavageSite=23; ConfidenceScore=5.02e-01
MGHATLPPFSCNLCLNMRPPSARDSIGNSNRPPNAIPRLGTQAFSFNARKHTYG

SEQ ID NO: 135118 - protein, 114 aa, Glycine max
  Coding DNA Sequence Number=SeqID_18340
MAKGAEDDVSLYASTGSFAPWLTKGAGAGDNVGLCATMGLFAPWLMKGAEIVCAKKLLVYLRMSPDFTGQYDKYCLCGELLVYLRTSPDFTGQYDRQHGRRRKSLRVNGLVGYN

SEQ ID NO: 135119 - protein, 149 aa, Glycine max
  Coding DNA Sequence Number=SeqID_18341
MERKQQDRMMQFLRGLNDQFNTVRSNVLMMDSFPNIAKVFSYVVQQERQINSNELTGSISLINAAGNNSSNSSLLVPIVGKKIKPIMVKLPNGHTITATLKIGTVKTVEGLYRLKMIPFKSKYKSDFGPCNVTSLKGYKYFLTIIYDYS

SEQ ID NO: 135120 - protein, 74 aa, Glycine max
  Coding DNA Sequence Number=SeqID_18342
MVGSTAPCLPSPLHNAQSILHWEKPLTYLAVHKGQVLQTSSSLWFLIFFSLHWLDAFSFSFKIVNPCEPYGLLK

SEQ ID NO: 135121 - protein, 113 aa, Glycine max
  Coding DNA Sequence Number=SeqID_18343
  Subcellular localization annotation: CTP_CleavageSite=37; ConfidenceScore=5.46e-01
MSFPVFLTFSSNKRWWRLCAYSFLGTRTRESRVALPSKEAKKSGRKRTAFSAFFLENVMNSLSEHATLSEFININCIYVFPKEHAKLTYCAKRVHLLRMNTHHPVEILVAKQG

SEQ ID NO: 135122 - protein, 68 aa, Glycine max
  Coding DNA Sequence Number=SeqID_18344
MTKARQKGVRKENGGDACYPARQGEQGDFLQKQPPSGGIFWRAQVGLRDKRLAVVGSLSANMAARNWA

SEQ ID NO: 135123 - protein, 419 aa, Glycine max
  Coding DNA Sequence Number=SeqID_18345
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-59, Identity=33%"; Hit description= UPI00006A17C9 related cluster
RAACPHLRGLHVLAIRGLHALAFRGLQVLTIGGLQAVTFRGLHVLACRGLHVLAIRGQHPLTFRGQHVLAIRVLHDLTFRGLHVLAIRGLHALTFRGLHVLAIRGLHTLAFRGLQVLTIGGQQALTFRGLHVLAIRGLHTLAIRGLHVLAIRGQHALTFRGLHVLAIRGLHALTFRGLHVLAIRGLYALTFRGLHVLAIRGLHALSFRGLHVLAIEGLHSLTFRGLHFLAIRGLHFLAVRGLHALTFRGLHVLAIRGLQALTFKGLHVLAIRGLHTLAFRGLHVLAIRGLHTLTFKGQYVLTIRGLHALSFRGLDVLAITGLHALTFRGLHVLAIRGLHFLACRGLHVLTIRGLHTLTFRGLHVLAIRGLHALNFGGLHVLAIKGLHALSFRGLHVLAIGRLHALTFRGLHVLVIRGLH

SEQ ID NO: 135124 - protein, 70 aa, Glycine max
  Coding DNA Sequence Number=SeqID_18346
MEKIIIMFVFKAEVTITKLNEERRRNTQEKDLLLRQEELDNLLFRISQISPLGVHSWLLEDAISNKYLLI

SEQ ID NO: 135125 - protein, 116 aa, Glycine max
  Coding DNA Sequence Number=SeqID_18347
MSKILRMGAIFLSSWELFPTKLSCLTVITARSVGFHDVSEGNGQEIQDRGKMVHFGTFLSSWAHLGPIDDLGGKKPARLGKQVASRVSHQLVWASWAASSSPYFAINSRGRLRRRV

SEQ ID NO: 135126 - protein, 225 aa, Glycine max
  Coding DNA Sequence Number=SeqID_18348
STLEDPTSHRLRLARLTLVPGLLLALGACAAGDSSVPTASAPAAAAPAAAPAAAPATAPAADGLAALIQASGVKCSNASTGSGCTAGDVDSGDFYDVELSPDCGDQGFFAGVADAKGVETLNAVPSTGSKASVTAKLSKGQLVCVQGIGRTGQNPLFYYVVAVPAATVGKCKGNTLCDTYGDRPITGLASTGGEACHAAAPGRYAGNCAQGWVSADVLDVFSNGM

SEQ ID NO: 135127 - protein, 420 aa, Glycine max
  Coding DNA Sequence Number=SeqID_18349
  Gene Ontology: Mol. function=protein binding; Cellular component =outer membrane-bounded periplasmic space; Biological process=cell wall organization and biogenesis
  Homolog annotation: Hit_ID=Q8ZJV4; Match level="QueryCoverage=53%, HitCoverage=95%, E-value=9e-50, Identity=48%"; Hit description =Putative fimbrial chaparone protein
  Pfam annotation: Domain name=DUF1120; Domain location=1-189; Score= -39.5; E_value=2.8e-05; Accession=PF06551.2; Description=Protein of unknown function (DUF1120)
  Pfam annotation: Domain name=Pili_assembly_C; Domain location=331 -415; Score=35.0; E_value=2.6e-07; Accession=PF02753.7; Description =Gram-negative pili assembly chaperone
  Pfam annotation: Domain name=Pili_assembly_N; Domain location=215 -328; Score=55.7; E_value=1.5e-13; Accession=PF00345.11; Description =Gram-negative pili assembly chaperone
  Pfam module annotation: Pfam domain module=DUF1120::Pili_assembly _C::Pili_assembly_N; Domain location=1-189::331-415::215-328
MRILVRLKQRSLNYNTVTSLPDTKIIPISITCETPTRVGVTFNDAHADSAPTEYLSTEFSDPEFLLTSQSTAGLGMFNGKKIGAYAMGIQRDKGTATDDTGATLYPVFSQDATATSGWHIKSGIHYLPVVTDKSETYSFTKDSGADTPAALKQINFNVGIVAQINPAGELNITDELTLDGLTNVELYYWTTIMLLLKRTLICACLLASFNTLAAGMVPETPLLIVKEDEQGASMDVKNTDADAQLLYTKLVDLPDDPKPGLIVTQPVVRVDAGKTQRVRFVLKNSAEPLKVEHIKRVIFTAIPQREKNKVKVAFSQNLPVIIRPAGLAVNLEPWKDLTWQMNDGNVTVENKTPYVVRMEQKAKLLPSGTTAQFAKTYILPGEKMTASAKTKITSADKQIEIYPVSRYGYQVQSYLTDLKE

SEQ ID NO: 135128 - protein, 141 aa, Glycine max
  Coding DNA Sequence Number=SeqID_18350
MWLHPEDSSTSRCRKHAWSLVEETKATNVCFISGSYTTWKPAPRWKSYFNGSWTGGSSMCLRGREEPQICTQSAERKAPPTPKALVICFTRNMTSPRSEYPQTVPKPTPFSNQSNKVVPWKYAPPAFGEGAATEVDSLSAK

SEQ ID NO: 135129 - protein, 86 aa, Glycine max
  Coding DNA Sequence Number=SeqID_18351
MKQKEPKSQVNGVLKERAMDVRLDYTMFNSKESNNVASKDKHGFKINTRLLQQTKPCFKINSRSTLALKQSAFKTFKALVIDYQAM

SEQ ID NO: 135130 - protein, 80 aa, Glycine max
  Coding DNA Sequence Number=SeqID_18352
MGSSQMPSLKNRFYQVKVRSLGITSLKELGQLMEPLQRQAFRKAYDKIWDLAMAEVSTEAIASLAQYDDQPLRCFTFGDF

SEQ ID NO: 135131 - protein, 194 aa, Glycine max
  Coding DNA Sequence Number=SeqID_18353
MKNYVGLSSSSQMEDRDGESDDMRRYLMVIHTFCQPEASEPVDTQRLTSSSAPLSSRDVKSDDMRRYPSGYLYKRFLLILAREVRWRYLMVIHKFCQSKASEPVDTQRLTSSSTPLSSRDGESDYMQRYLIVIRTFCQPEASEPVDTQRLTSSSPLSSRDVESDDMWRYPSGYLYKRFLLILAREVRWQAEILE

SEQ ID NO: 135132 - protein, 65 aa, Glycine max
  Coding DNA Sequence Number=SeqID_18354
  Subcellular localization annotation: CTP_CleavageSite=11; ConfidenceScore=5.01e-01
MWSSAPFPGMAASSGRDSFGLTTSVDPDPCVRWQVAGGYTQVIIRTKTTSAGPDPCVRWQVDIPK

SEQ ID NO: 135133 - protein, 99 aa, Glycine max
  Coding DNA Sequence Number=SeqID_18355
FRGALWGSNSELKLRRAERDQLRVEGMILEDKLKACQRSKRSLSDQLSKMEENMGAIIDQYKEKLSLAATHEQKLENEYAKVRLHLKWESRASKTASQS

SEQ ID NO: 135134 - protein, 354 aa, Glycine max
  Coding DNA Sequence Number=SeqID_18356
  Gene Ontology: Mol. function=iron ion transporter activity; Cellular component=integral to membrane; Biological process=high affinity iron ion transport
  Homolog annotation: Hit_ID=Q8UAI3; Match level="QueryCoverage=99%, HitCoverage=93%, E-value=0.0, Identity=94%"; Hit description=ABC transporter, substrate binding protein
  Pfam annotation: Domain name=Peripla_BP_2; Domain location=26-297; Score=23.2; E_value=4.5e-06; Accession=PF01497.9; Description =Periplasmic binding protein
IIDVTGRKIELDLPAKRVIVGEARQVHVIAALKGDQTFDTIVGWRDDLLKKDPDSYAAYVERFPEIEKLPRFGYVPQGDFSLESAITLSPDVITLNLEAEKSAKESGFEEKAEAAGIKVVYLDFRIDPEKNSEASVEILGKLFGAEERAKEFIAYRRAEIARVTDRLASVKDLKRPNVFIERSPGISGENNCCRTFGPANFGAMVDLAGGRNIADGIIKTTFGDLNPEQLVVADPEHVIVTGSNWAAESDINQFVPVGRGADMALSRERLANLMKRTPFPELTAVKQGNVHAVWHQFYGAPYEFFPIQQFAKWFHPDLFADLDPEKNFEEFHRKFLPVTYKPGYFASLEKGLNQ

SEQ ID NO: 135135 - protein, 137 aa, Glycine max
  Coding DNA Sequence Number=SeqID_18357
VFSSTLSSFISNFAIGIGDSDSGSLIQQPLVDQKVISINGSSKEEARHGASDSESPSLEWLTVSCRASGTSHPRGKAQPSATSPIEELVPITMILPSYIFGGARKSGGGGVRASPRARCSHSARSSSSLLPLLVLNR

SEQ ID NO: 135136 - protein, 116 aa, Glycine max
  Coding DNA Sequence Number=SeqID_18358
MLSELGAIVSTPHLKMKFPTLTGEIVTVKADQKQARQCYDESLKVAPHPSTRESGKPHPTSGGSSQVMNMDEESSIRTLVVYKATRRDQDDVFDVDLYGNTVNKGPIPIEELVKTI

SEQ ID NO: 135137 - protein, 178 aa, Glycine max
  Coding DNA Sequence Number=SeqID_18359
  Gene Ontology: Mol. function=protein serine/threonine kinase activity; Cellular component=integral to membrane; Biological process=protein amino acid phosphorylation
  Homolog annotation: Hit_ID=Q0ZA03; Match level="QueryCoverage=71%, HitCoverage=16%, E-value=7e-14, Identity=34%"; Hit description =Brassinosteroid-insensitive 1
  Pfam annotation: Domain name=LRR_1; Domain location=103-126; Score =9.7; E_value=4.3; Accession=PF00560.23; Description=Leucine Rich Repeat
  Pfam annotation: Domain name=LRR_1; Domain location=147-169; Score =6.3; E_value=19; Accession=PF00560.23; Description=Leucine Rich Repeat
  Pfam annotation: Domain name=LRR_1; Domain location=79-101; Score =5.4; E_value=28; Accession=PF00560.23; Description=Leucine Rich Repeat
  Pfam module annotation: Pfam domain module=LRR_1::LRR_1::LRR_1; Domain location=103-126::147-169::79-101
MDLYYSHDTSGFVLSPSDETCARPHHQKLEIIGFPFGFGGVAESAIPDWSSSTFADYCTWSGSKRLARKICESLAGLDQLRVLNHSHNFFTGSLPDNLFLLQHLEVMDFSNNHFEGPINTTICSSLPRLQDNKLSGSLSEGLGKISKLVDFDISSNEFYGILPNIFGSLRRLKFFSTE

SEQ ID NO: 135138 - protein, 122 aa, Glycine max
  Coding DNA Sequence Number=SeqID_18360
AHTKLEGRKHSKHKKLTLKKKEKGELNNLKEKCTSIYNTANPNPKHCKPTLPSSKLWHLQNCTVHGVKVSRQWERRDPLHVAPTWHVSPMVPATLSTSGVLPFIPTAPFQVSNKFAIGDGGT

SEQ ID NO: 135139 - protein, 261 aa, Glycine max
  Coding DNA Sequence Number=SeqID_18361
  Homolog annotation: Hit_ID=Q96294; Match level="QueryCoverage=25%, HitCoverage=12%, E-value=4e-17, Identity=63%"; Hit description =Calcium-dependent protein kinase
  Pfam annotation: Domain name=TPR_1; Domain location=48-81; Score =19.5; E_value=0.012; Accession=PF00515.18; Description =Tetratricopeptide repeat
  Pfam annotation: Domain name=TPR_2; Domain location=48-81; Score =19.1; E_value=0.016; Accession=PF07719.7; Description=Tetratricopepti de repeat
  Pfam module annotation: Pfam domain module=TPR_1::TPR_2; Domain location=48-81::48-81
MEKFLAELQTKFSEDLTVNEGWAAFLPRMKKKGIKDLTIGLSIDGSNIECLYLRASYYHVVGQLKEAVKDYDAALDKELDSMENCCCIFSSQEECTCFQGCCIYILNFLSYHDVQVNAWKKEVGEGGSPPSWLTELQKIVSVTLEVDKESLRWETYVEVHNSAYGGQDVEVALHRVLKDVVAHVLDVDGCVELPLGDALACEQLARVTVDAKVCHIKLVVPELTVHQVPILDALFRHTVRTVIDAFCFAMETLEKINFTSS

SEQ ID NO: 135140 - protein, 126 aa, Glycine max
  Coding DNA Sequence Number=SeqID_18362
MAWKYDLLIDVGNALACACCVCSWGALCTDLSGSLALAFGQVHTLDVVYDRGGHCALTFQGALIGPWSLAFTFGRDHSSYDTGNRVTVAKEHLWAPRLITYGRGAVTCTTGWSRQTQHSSLSESVV

SEQ ID NO: 135141 - protein, 259 aa, Glycine max
  Coding DNA Sequence Number=SeqID_18363
  Gene Ontology: Mol. function=protein binding
  Homolog annotation: Hit_ID=Q1T435; Match level="QueryCoverage=42%, HitCoverage=14%, E-value=8e-25, Identity=44%"; Hit description =Leucine-rich repeat; Leucine-rich repeat, cysteine-containing type
  Pfam annotation: Domain name=LRR_1; Domain location=35-57; Score =12.1; E_value=1.5; Accession=PF00560.23; Description=Leucine Rich Repeat
  Pfam annotation: Domain name=LRR_1; Domain location=72-93; Score =10.2; E_value=3.5; Accession=PF00560.23; Description=Leucine Rich Repeat
  Pfam module annotation: Pfam domain module=LRR_1::LRR_1; Domain location=35-57::72-93
MSEQFYCNEGNGSNPKKNCYETKGQEYLYLNPEFLLKSIDLSSNDLTGEIPKELSRNHFSCEVPSTLSKIDRLAMLDLSNNYLVGRIPWGRQLQTFSASTFEGNTDLCGEPLNKSCPVNGTATKPQGPAIHDDDDNSVFCEALYMSLGLGFFTGFWGLIGCPGQYFQRIQILTFMVGLHISDEHVEWEDIHEQRALNVFLAVGDCVLVGFQYVGLADASSIGACRPRIFFINGFLCFLEDKWQRNGEGRERGDATSRRR

SEQ ID NO: 135142 - protein, 1009 aa, Glycine max
  Coding DNA Sequence Number=SeqID_18364
  Gene Ontology: Mol. function=zinc ion binding
  Homolog annotation: Hit_ID=Q10PC5; Match level="QueryCoverage=67%, HitCoverage=90%, E-value=1e-153, Identity=43%"; Hit description =Tropomyosin, putative, expressed
  Pfam annotation: Domain name=DUF1423; Domain location=447-922; Score =705.5; E_value=3.7e-209; Accession=PF07227.2; Description=Protein of unknown function (DUF1423)
  Pfam annotation: Domain name=PHD; Domain location=600-662; Score=7.9; E_value=0.0093; Accession=PF00628.19; Description=PHD-finger
  Pfam module annotation: Pfam domain module=DUF1423::PHD; Domain location=447-922::600-662
MRVTFVRRRRMRGVASTREHSGSTVGTSRHDKLSHDERARELRGRGDESLVLIEESKPKLGTKEKRPRFSLAFRNYPSLFLVFIFLFPVPSAMIGGKDLVPNGVGSEGENSRSKVQQHQHHDFAHANKEHPQEKKPSFDEFQSTPSKVSISGLQELTLSYLCENPKLGFVEREVGDRSSVKGKEVVVYGNSDQDEKCLTGLGMPIWRDELRLKSSMVEVSTFSAQQYLEQDCLRRKISIGKQKQDQDEKWVERDFLSLSETREASSNRSIEEECEREKNDGSKKQKLETLSLSLALPDVSLSLTASNALQNGDQLVRPKPCKPSTRTTTTINSCSNDYTAASVSHSYSHPFSHNQSCSLTRNSTENFEYSHSKDDQIWHCGEGTNGSVHSRFKPIGDGVALANYSFMQGNSQYKATSSDNQSFFPSELPARVRFEGQSECSRGNNSGDLRGLEGVNGGKMQFSTSERVLRDIVSESIPAMALTFQEFTEEVITSIKEHLKGLIEMPEKKGELESLQNQLGRRSDLTRETLSNSHKQQLEILASIKMGLGSFLSGQFQFMEMVDVFLYMRCRNVNCKSLLPVDDCDCKICSGNKGFCSSCMCPVCMSFDCASNTCSWVGCDVCSHWCHAACAIQRNLIKPGPSLKGPSGTSEVQFHCIGCGHASEMYGFVKDVFVCCGKDWGLETLAKELDCVRRIFQGSEDRKGKELHIKTENMLLKLHAKLVSPLDACNHIIQFFNYTDGMSEFPPSVSSKDLSTSKANLTMDTTSSLPQSTSLMPIYTFDMSYTRSNDVQQKDLKSSLLSEQKKETDFHLEPLLGKGEGLESLESIVRIKEVEARMFQNKADEARREAEGFQKMIKTKAAQMEEEYAERIGKICLHEAEEKWKKKFDELNVLQNSHYDYFNMKNRMQDEIHGLLKRIEATKQQRVLVIFQRPRLEFARSETEEEKVTVVERQKSVEQVVGSCGVPKRIELQLKLTIFWQILQSKYGVGFWGGGIGVVGSQEREKKLE

SEQ ID NO: 135143 - protein, 181 aa, Glycine max
  Coding DNA Sequence Number=SeqID_18365
MDITIVIVVHCANQVLRNWESARQKTSCLPMQQVHHLPLQKLPSGLVKCNTDVAMFTNQVNALALPEAINWMADLGYNRAIIESDCKWIIEGIKGDENKHPTLCETRVNTLSHALYIQRTFTFTKCTKIETNWNITAYKESSSTSSGVESRRCSVLLPLSLSLLNKLSRSRKGQLVDNKNI

SEQ ID NO: 135144 - protein, 73 aa, Glycine max
  Coding DNA Sequence Number=SeqID_18366
KIVTEQAKRKELQEKAANSIQKLVDEKGREGLKAFSASQAVADEAKVMESADQVLTKEMASLKKLYGDLVKNL

SEQ ID NO: 135145 - protein, 126 aa, Glycine max
  Coding DNA Sequence Number=SeqID_18367
MGKLDHLEERLKAIEGGEDYSFANLEELFLVPNIITPPKFKVLDFDKYKGTICPKNHIKMYCRKMGAYTKDEELLIHFFQESLTGVAVTWFTNLEPSRVHSWKDLMVAFVRQCRYNSDMARDRMQL

SEQ ID NO: 135146 - protein, 120 aa, Glycine max
  Coding DNA Sequence Number=SeqID_18368
  Homolog annotation: Hit_ID=Q94FN0; Match level="QueryCoverage=37%, HitCoverage=9%, E-value=8e-11, Identity=76%"; Hit description =Phosphatidylinositol transfer-like protein IV
MEALEVGGGGCRQRGGGKEAVVVSAGEEVVVVVVDEEVAVWWRRTEPSCDGLTLRRRWLCRRRQWCNEADGLDRGRVFKEDEEATETLNSMFIINAGSGFRILWNTVKSVLDPKTTTKIN

SEQ ID NO: 135147 - protein, 114 aa, Glycine max
  Coding DNA Sequence Number=SeqID_18369
MGEMLATQLAQASKVTSSRSNRFLEESSGGPKWACCMPPRKGPRTKLGYDNQLRGKWETRDPKLIPYCRNLPFGGRATCDSRVRVPRKEYARSCHQRLFEENVGKTGKYVIYEL

SEQ ID NO: 135148 - protein, 120 aa, Glycine max
  Coding DNA Sequence Number=SeqID_18370
LVTGLCSPTGCPFPPARSRHHDIGIAPARHPVDPKKSNKVLELSSSNYGKGIRPPTNRAFIKKYCVSRQAQGETPQQPGDGQQRATDAPPSPLEFTSAHPQKAIMRPAQDVKEALLGGNL

SEQ ID NO: 135149 - protein, 89 aa, Glycine max
  Coding DNA Sequence Number=SeqID_18371
MERLTSSSAPFFVLTREVRDSESGGRWRYLMVIHAFRQPRGTNSTVFTLIVRKHSSPKTREILFCWPGTIECNGEGKCRGCPTLSFSRH

SEQ ID NO: 135150 - protein, 209 aa, Glycine max
  Coding DNA Sequence Number=SeqID_18372
MDRARLVYGLVMKMDMDLGSIISSQISQMAQSKSSRLEFPTLITALCIARGVVSDSLTFESLSPTINLAYIRKNCWNPDDPTITFPGSRKARAKAPSDTSTFALAPTLASTSAPAPLVPVPAPPALTAPSGPSAQSSEVLESQPVPEVTPEETLEDTPATTATNVDYVADMTAARGGNEPSSLSRAFGSAYVRLDSARLVYYKGQAQAF

SEQ ID NO: 135151 - protein, 76 aa, Glycine max
  Coding DNA Sequence Number=SeqID_18373
MARIGQNRLATRVFMAILHVDRKNKDLANLNKFYRFYLGVIWVCQNKNGCSCSSKEKKEINTTRKEKKTRKAIGIC

SEQ ID NO: 135152 - protein, 72 aa, Glycine max
  Coding DNA Sequence Number=SeqID_18374
MLNPTQFQAKEENVQVVDDLLSEWHPLSEAYNSLSGLGNPRRGSIRDVLAQCAASLPSKVFVSSRAYRAQSR

SEQ ID NO: 135153 - protein, 112 aa, Glycine max
  Coding DNA Sequence Number=SeqID_18375
MASDFPLLFDHVNLYPSMGRSWRPLSEIASRKTLNESKATTPSININSNARVKVSEIFYFFNSSRIHKGFTEKDGMQMLLNLHVHGKNSIDNKVHYIQAHINLLVGTSSLSS

SEQ ID NO: 135154 - protein, 204 aa, Glycine max
  Coding DNA Sequence Number=SeqID_18376
MSRSRASSSHWTSMNEELEHIVVHMPKLTIEEQGQCKELAYKMQHVTAPPEGFFQMIFGEVGKVYATKWKDVLGSIWHLVDKDGNYHNVMYNQDMDQPAIVAGPLACPEHSQDDTLYIIKYQDVPSSMYYFLKDKGWTHLHLGDVAECRLVFNHWRKSLKIGAGWKHFCETLSFTTGMEIVSEFIDPDVNHVLYWPCLLIGLGL

SEQ ID NO: 135155 - protein, 45 aa, Glycine max
  Coding DNA Sequence Number=SeqID_18377
MEWRHAPTINHASGILCLWGEGNLNVMNWKLEEGRKVLDKWPQIS

SEQ ID NO: 135156 - protein, 110 aa, Glycine max
  Coding DNA Sequence Number=SeqID_18378
MHMTQMQFTNTGARETVSFLDTTSRGSKVPQLRGSKTKPTHDAYAKGTTWGMYIVQQYSQTNISKRVHDTYAWQCDIWHAACLLRAPIWEVAKKAFSDNSHGGHISLDGL

SEQ ID NO: 135157 - protein, 74 aa, Glycine max
  Coding DNA Sequence Number=SeqID_18379
MGSSQKPSFKKRFYQVKIKSLEVTSLRELGQLMGQLQRQAFRKAYGIRPPKASRKWGGRDTEKMFGGKSKNLGR
